United States Patent 8,067,671 (METHODS FOR GENETIC CONTROL OF PLANT PEST INFESTATION AND COMPOSITIONS THEREOF) - sequence listing, part 51

SEQ ID NO: 131235 - protein, 2655 aa, Heterodera glycines
  Coding regions on vcDNA: vcDNA=SeqID_57658; Strand=+; Position=1-7968
  Homolog annotation: Hit_ID=NP_508324.1; Match level="QueryCoverage =89%, HitCoverage=90%, E-value=1e-136, Identity=28%"; Hit description= predicted CDS, peptidase family A16 and RNA-directed DNA polymerase and Integrase, catalytic domain and
MSAGIRSVLGPATARVRTNLNEGLALLHNQNVTAEALIRASEKIGRSVKLVQGYMRDWDRIMAGLDGDARTAEEAVYLGFRPGGEQLGELIVEANEAVTELDLRTDQLRIQVAPMQPQQHQQAVQVQPFVAHRPVVPLPTMGLLDFDGTPSRWSSFWANFRDNVDHRNDLSPAQKLCYLMGQLKGPAKDIVLGYSTTDADYPIVKEALVGRYGDETKRAHELRAELIRLPKANAATPSLRLFSESVERICRQLNSLEAGLDDSPYLITALMEKLPGEIRLKLLEQERDGGAKWTARQWRLGLSGLVQLREAVNMDRENMHRQPPNNGGVGERRQNSHQTFQTQPRRAFPVVKPVRPEIRNPTPPPRKFSPNCSLCESGDHKPTNCPRYFTAKKRQQRLTEQGRCHLCIRSGHSAANCATNFKCSKCGDRHHLIVCPKFRSEQSTTQNRDSRSVHFSGENRGGMRQGLLASAPVSATALSHPGKKRNPSYLMVRTTPVYNYREPANPTRAPVFWDPGSQTSFIATDLTNEIKPPRVSSEEMIVGGFIGNQKETYSRFHSPCYSVMLGREDGGWEQILLNQTDRITPPIECLVEPRNSNEFLSGDDQEGPIPYFLEPKIMIGVREFWRFILDRREIRPGIFEIQTVFGTIYGGEEMAVASNPGNSLTCTIIQSAHIQPESDVGRFWALESIGITDCPKLNDDEKALKKFNESVSADPEGRYEVALPWKEEGEYPAENFRLAFSRLSALIRRLKESPQLFSGCNDIIQEYLEKGIIEKAHRAKSPQHFLPHHTVMGKKLRIVFDASSHEKGAQSLNEMLFSGPNLYPDLAGKLIQFRATKYPIWADIEKAFLMVSLKESDREFSKFLWVKNIFAPLSGENLLVFRFRRITFGIVSCPFLLAATLQHHLEAFPSELAEEIREKSLLYVDNLLLLADSPEEARRKAAEAQKIFAAAQMRLCEFIAADPSSLDEIPENDRLRNEAPTVLGLKWTICEDNLSLTFPTVPSPDGLTRRTVLKTVASFFDPLGLCSPCLVGAKLFFQKLWDGSKGWDDPIPAEETKEWDEIKALWAAKTMHIARFTPRINTGGIQLHVFTDASPNAFACTVYLRAEMPQGILSSLAYARSRLRPKKMAVDQADGLTIPRLELLGILIGSRAVKFVHKHLNYEIEQINLWSDSRIALSWLASTDKMPMFIANRVREIRANRHIIFRYVRSADNPADLATRPVTPDELKLSELWWRGPNWLGKTPENWPDELTVSLPPEESAISEPIVCAPLTTPPAVFDFDRFSSWQKLIRTAMYALKFLSETGKKRKLLPEFREAENFSPDCNKFTHNWIIRIVQGTFSPPKETYLDNDGLIRLKSRLCGTGNPGFEHPIVIPSESWVCALLIRHSHLNLCHAGVDSTLTDFLQNYWCHKARRTVRSVIFSCNMCKRDRARKFGLPPMPPLPKNRTCPSAVFENVGMDFLGPTLYKIPNEQPAKAWVLLITSLACRAVHLELVSSMSAEHFLLAFRRFVARRGLPKSILSDHGSQFVLAKTLFEKNTEVSIKWTLIPAFSPWSGGVYERLNSLIKNCFRRVLGRRLLSWEEINTFLAEAEASINSRPITFVSDESDGPLPLRPIDFIAPRANLEFEGTDMEDESYRPSAAEKLATRWWATAKSIRNFWDRWSSEYLLLLRERNQTAHKGPHLNSNVQPELGHIVLVERDEYPRNTWPMGRIVGLNGPEGHPRSAEIKMPNGHIWTRPVSKLVPLEVNPDNKDLNQALSPRGDSREGNEESNEELTRNQRSEEPVEMGPELINESIRPKAKFRWAKNPPIQIQRASKTPRALTSSPAYLLSMVAIFILLGVPIADAFALSTANQQSNQSSWITCNMKGVKIEAPEGSKNIELCCDGICGTRNYIKPFVFPLLEESLLSGFSCRATYWSPPDNTIQQNIECAPIDVCTLLDCYLCESRILNAHCSPAISAILIGILALLAGFICCALCCLFRWSAWCYKSLRMIVKCIFRCQKHKNLKYTRLRRESYGDNSAEEGYSPRNYYRTTGKPLTKLGYALAISVMVSNVGWTHGDPVSITAKTEECETSPISTECRLNSVTLLNLLPAGQPVDLIVRTTDAAVLGKITFKLKGLVQECIPESVGFIRSYQVKTLASKRCPGMGSCSGKTCENLLPNGTVSELAEGNSFPGNSFCLDSSSFWFHGCGGTNSACLFFRNYATPTLTGEGSVYEMFRCPAWQFRIKTEIKVSFSGGITISEETELYSGRTFHIKGANLSVTPAVFGNPAAPIMSETFFGGSDSAVLVPNIEPALHCRNELDALLMKCALSLDACTKCRPDHSEGIVRCHCKEVDIERWRNDPSKRLPLSVGPLTLNYRKPRQVWAESEYVPVQMALKMEGLTLSIRKDMAKCIITPGGLAGCYGCRMGSRFNFTCKASLGNPLADIICDNGARWVTHCPENSIKMNVSLSLNEGEVKTVCHVSCPGGITNFTMEGLLHYLPIVRGEWKISGNKVERGSQLPDFSILEHFYRVLSWVLGGPQLFIVVCVFCAGIFGLYICLKCNPIFRAYRRLIRVVTLITILLITAPLVTCDEGTKDEETIINQSWSQFKFLLSKFKAELAWGTFLILASANVYAIYIIYKEWTIRHGEPQRNPIRKDRVQPRGDRIMPGFRL

SEQ ID NO: 131236 - protein, 238 aa, Heterodera glycines
  Coding regions on vcDNA: vcDNA=SeqID_57659; Strand=+; Position=1 -363,469-822
MSQQNQPQFTAPPPAPLYPYGYAPHYGYMPPHAPMGYQPVPTAPPPSFVPQQQESVPQAHPQGNATVQATAAQAIPQNSASVPPATAAPIHQVQQNNNGQGVVPQAGRQAQDMHQSGSRSQHGPAPYAFRRKGKFGVAKPVNFGPPPAPIPRVSEVLLQLVTEFTNFTTEYTRNFNAFATSFSCDFNNYATEFAQFSAWVRENAHQFGGKNASGQAANETEDKEEEEEEEEETEANDA

SEQ ID NO: 131237 - protein, 97 aa, Heterodera glycines
  Coding regions on vcDNA: vcDNA=SeqID_57660; Strand=+; Position=1 -228,545-610
MEKQRAEADKMNNRKAFLARKRGEVAANIGKTAAETNGTGGGTVAEEKDEDLVRIRLVFPSSARMEQNFRHSDSLEKIQGMKQIRWQASFWGCTRET

SEQ ID NO: 131238 - protein, 84 aa, Heterodera glycines
  Coding regions on vcDNA: vcDNA=SeqID_57661; Strand=-; Position=1 -85,143-312
MACSAGSTKKTNLSKNQHEKDGLRSLKLTNAAQSGLYILIFHQNDFIFCYLLSLFVLILFDTCIFLKNGVKVDTKNCDTEKRKN

SEQ ID NO: 131239 - protein, 139 aa, Heterodera glycines
  Coding regions on vcDNA: vcDNA=SeqID_57662; Strand=+; Position=1 -141,346-583,1164-1204
  Homolog annotation: Hit_ID=NP_503600.1; Match level="QueryCoverage =57%, HitCoverage=23%, E-value=1e-10, Identity=34%"; Hit description =predicted CDS, putative protein family member, with at least 5 transmembrane domains (5C684) [Caenorhabdi
MELFIFYHDEYERLYNCTGLNIDSVPLEQRQFVPESIAISILCTIYYIERVLYCLIQYVEILYLPCMYSIWKRLRDNSCYKLLFYIGITDMGILWILGFFRAWLNLHGYVFCSYPTLIYFVGVLVTALWMAESTADLVG

SEQ ID NO: 131240 - protein, 96 aa, Heterodera glycines
  Coding regions on vcDNA: vcDNA=SeqID_57663; Strand=+; Position=1 -163,207-334
  Homolog annotation: Hit_ID=NP_502882.1; Match level="QueryCoverage =80%, HitCoverage=15%, E-value=8e-11, Identity=42%"; Hit description =DNA polymerase like family member (4Q408) [Caenorhabditis elegans] emb|CAB60306.1| Hypothetical protein Y
AANYGIVLDSLPPLDDYYPGGHFPEELKKPEQWYEENRNTPFDLREVIADYCKADVQILAHGMAKMRQLFAAATSQELTDSITMASVRLHKGQRDH

SEQ ID NO: 131241 - protein, 81 aa, Heterodera glycines
  Coding regions on vcDNA: vcDNA=SeqID_57664; Strand=-; Position=1-245
MSGQQKAEGLFPVDECFGTNIGRPIAELVDENGFGRESREELVSFEEFVRGGDKKRGKKEKDEGEKGTMGVEAAKRQLIVE

SEQ ID NO: 131242 - protein, 63 aa, Heterodera glycines
  Coding regions on vcDNA: vcDNA=SeqID_57665; Strand=-; Position=1 -61,115-181,249-312
MMARCLPGANAEDTFVVDVENTSHSINLVNYSDTSSNETTFTCTTDRPKRKAAEKAMMLLIKP

SEQ ID NO: 131243 - protein, 100 aa, Heterodera glycines
  Coding regions on vcDNA: vcDNA=SeqID_57666; Strand=-; Position=1 -241,311-372
MGEASRQEPTKLWNRVIVDNLTARRLRREQSNRKEEEKATEERDERHKDEEEGEEEEKRREGEEKQGEEMEEAMGTSRKQKHKRSFSGILSKLMPRKKSY

SEQ ID NO: 131244 - protein, 58 aa, Heterodera glycines
  Coding regions on vcDNA: vcDNA=SeqID_57667; Strand=-; Position=1 -57,633-752
MSAVCWNPILFAWLGARGKKKILLTVSELRPFPQQITGEKQNCNKRKGQGRLFASFRQ

SEQ ID NO: 131245 - protein, 60 aa, Heterodera glycines
  Coding regions on vcDNA: vcDNA=SeqID_57668; Strand=-; Position=1-280
AGMCLGFAFRISPFALFAFFGVSHFAFRFLARKATFTPLRIGLNSHKIFQNFTYKLANFQ

SEQ ID NO: 131246 - protein, 185 aa, Heterodera glycines
  Coding regions on vcDNA: vcDNA=SeqID_57669; Strand=-; Position=1-558
MILWHLIFVIFFIAFKIDSGKIQTNFDEIFGEGWNKNEREDKVIKMEQNDPNEHNERSAAVDQMGGEMGNDPNDQQKREIIQKFDAIKEKLKERGKYHWENTTNIERKIARLLGANRHKIYKWKKELNLNKKKIFYEKKRKEFIERIDEFKSLYDKGKQKEFVKELGISNVTFRKWKKELMPNCQ

SEQ ID NO: 131247 - protein, 116 aa, Heterodera glycines
  Coding regions on vcDNA: vcDNA=SeqID_57670; Strand=+; Position=1-348
  Homolog annotation: Hit_ID=EAK90470.1; Match level="QueryCoverage =81%, HitCoverage=7%, E-value=5e-10, Identity=37%"; Hit description =hypothetical low complexity protein with coiled coil regions [Cryptosporidium parvum]
MSCELPVNHADAHLPLAAATAEERKKNAKRKWEETVRVKTETVDEPKQNEPEENAKRKREETVRVKTETVDEPKQNEPEENAKRKREETVRVKTETVDEPKQNEPEENAKRKREET

SEQ ID NO: 131248 - protein, 183 aa, Heterodera glycines
  Coding regions on vcDNA: vcDNA=SeqID_57671; Strand=+; Position=1 -187,560-921
MVIRDTEQSEKGAKSTERVCQTFRFAISLLNCLWKEMDEERRKMLAKWLKDGRWTEFVRIVNEKMNHRMRIYLYRKLIINRSWSAGSLATHARIILPLLLEELDTKIYNKNIAKCRIFEELEELLLIIKFEVFRAIESFSSVCWLMYLWQYVEGYDGRTMESTKEMPTRQMIDECTKLNAAMP

SEQ ID NO: 131249 - protein, 54 aa, Heterodera glycines
  Coding regions on vcDNA: vcDNA=SeqID_57672; Strand=-; Position=1-167
ILSYFVKKFVSPALDMIIADSHLIMANLDLIMANLDLIMANLDLIMANLDLIMA

SEQ ID NO: 131250 - protein, 212 aa, Heterodera glycines
  misc_feature (207)..(207): Xaa can be any naturally occurring amino acid
  Coding regions on vcDNA: vcDNA=SeqID_57673; Strand=-; Position=1 -174,396-463,514-698,1115-1168,1230-1254,1332-1370,1700-1725
  Homolog annotation: Hit_ID=NP_492511.2; Match level="QueryCoverage =88%, HitCoverage=34%, E-value=5e-52, Identity=54%"; Hit description =putative protein family member, with at least 3 transmembrane domains, of ancient origin (1K45) [Caenorha
SLLNWSKLVTLNLFPQFLQLLGAMLIDWLDDSVDFPNGIYFAFLCLTAIEYGKLIPTDALYLPLVIGYICFGLAISTIALDIGSTYVKKLYYLGQKIRNIGSTYVKKLYYLGQKIRNIASIKIWFGAKHLRVRDLLAALGHNIGLEPTVLCDLDLEQLITNAIQVKEGRLHRVPQTHMIMDGIWPPELVPLFLVPLFLKDGTFPVFXHHDTA

SEQ ID NO: 131251 - protein, 64 aa, Heterodera glycines
  Coding regions on vcDNA: vcDNA=SeqID_57674; Strand=-; Position=1-194
MSEEDTNTEKFPSSETVVPFLFEENEQIAASHFNYDDNQSGKWVLSFQIDDELDTKWKRARQLY

SEQ ID NO: 131252 - protein, 111 aa, Heterodera glycines
  Coding regions on vcDNA: vcDNA=SeqID_57675; Strand=-; Position=1 -84,161-412
MAKFASKVDTDGGAKAFYCQVKQLTQQKPLLVACPLASVPSNDFLSSSNLFDFFLIDESFELADTELIRPLLLADRFTLCTAHKTPARLALSSAFTFSKQLISHSLKGILC

SEQ ID NO: 131253 - protein, 81 aa, Heterodera glycines
  Coding regions on vcDNA: vcDNA=SeqID_57676; Strand=+; Position=1 -58,153-256,479-559
MSSNFIGSPNCFFRPTADQAAAEEVDKYEVFSWHGDLSDQLAAQFLVSDQQLLKECREKLASAELRETKLLCKNGELNAEN

SEQ ID NO: 131254 - protein, 98 aa, Heterodera glycines
  Coding regions on vcDNA: vcDNA=SeqID_57677; Strand=-; Position=1-297
MMKEVFEKAVEISKNTDCEIPDITMLFDVREGTDLRRYNIPKSNEVCAIIFRDANDDIPAANYFLLILRLFAPYHFKNAPLMRREKKRRTKGRKCENE

SEQ ID NO: 131255 - protein, 144 aa, Heterodera glycines
  Coding regions on vcDNA: vcDNA=SeqID_57678; Strand=-; Position=1-435
  Homolog annotation: Hit_ID=NP_494302.1; Match level="QueryCoverage =79%, HitCoverage=7%, E-value=3e-11, Identity=33%"; Hit description =predicted CDS, putative protein of ancient origin (2C878) [Caenorhabditis elegans] gb|AAB95006.1| Hypothet
EENNKIKGTQEFYDCCNYGKNSNLEEMIQEYPMDLRVLFQPEIDQNNYTQIGELHNDFKKKLRYLNSSFSCASLGCMRFKFPDKNVPIFKIQGSIYHSYNSVARPNEEELPTNGQLYFIDTDEAINYRLSAYKDQLTKLSFPVI

SEQ ID NO: 131256 - protein, 32 aa, Heterodera glycines
  Coding regions on vcDNA: vcDNA=SeqID_57679; Strand=+; Position=1 -29,121-190
MHESGAVQAQSYYKNFCVVVKKNVIFGDCFQT

SEQ ID NO: 131257 - protein, 52 aa, Heterodera glycines
  Coding regions on vcDNA: vcDNA=SeqID_57680; Strand=-; Position=1 -54,138-242
MKFGLFFLLICFFFEIFEPGILDQFCAGKWHWGRKWSNWANCQRDGRGRTND

SEQ ID NO: 131258 - protein, 68 aa, Heterodera glycines
  Coding regions on vcDNA: vcDNA=SeqID_57681; Strand=-; Position=1 -159,1100-1147
MAQQPTNKGTPNKLKRRNERKKRGIKRKREGKRKRKTYRIFFEDIAAAKGKEKKNMISICFDSAKEKL

SEQ ID NO: 131259 - protein, 328 aa, Heterodera glycines
  Coding regions on vcDNA: vcDNA=SeqID_57682; Strand=+; Position=1-987
MGIRFNGHLAQNRREWHQRSTNCQFAWEGTANSAKADAKENHRIQMHYNRVNWTFMKNWLTFLVFFFRYFHQNVVSFLHRFRSLFGSSGINLSIGFGSLTDRTAEYLMCKLWPLLRGKVCGMEFWPAEFRCLRQFAPYILRDCPSLRTVCLPYCSHFDESDGQAVSKWLLSPRPDGLPKVFRCEFDLAEMRWVSLIREFKAVIYLLIIILHNLLLLFILSMFQSFANASRHVNFIIVIRFSCADDSAVATFDLINNFTGERSTLKRLNKDNSDDNNNDRFLLIRCPISRDECKWSKWEKEAIGWEFDNQWNRIIFSIKDYGIDHWSAI

SEQ ID NO: 131260 - protein, 98 aa, Heterodera glycines
  Coding regions on vcDNA: vcDNA=SeqID_57683; Strand=-; Position=1-297
MAEIWTKKAKMAKYGFIPENPQNMDRRLPGGRRLRLPGWFSLNNVPLLRTPPLSPDLSPIENLWHFVKRKIAGRHFQSKPQLGIWRPGTQFRLTQLSI

SEQ ID NO: 131261 - protein, 24 aa, Heterodera glycines
  Coding regions on vcDNA: vcDNA=SeqID_57684; Strand=-; Position=1-80
RTLSTAVRQRSSKIYSMPQILWAG

SEQ ID NO: 131262 - protein, 24 aa, Heterodera glycines
  Coding regions on vcDNA: vcDNA=SeqID_57685; Strand=-; Position=1-80
RTLSTAVRQRSSKIYSMPQILWAG

SEQ ID NO: 131263 - protein, 181 aa, Heterodera glycines
  Coding regions on vcDNA: vcDNA=SeqID_57686; Strand=+; Position=1 -74,306-399,475-663,796-984
MALTLQEVETVLKRVEAEKAHASESQLQSAILERDNLRQLLDNLHDQNAQLVNGLKANLSQASGDRDKALAEVKSLQSNINALDNVYQRLKADHEKLREEMEQIQSTDTNVEACKKEIQKLRNTVAYQEKQIAEWEQKCEELNQTIERKDKQMEEICRLGADMESSIEVKLKKPITKRIYR

SEQ ID NO: 131264 - protein, 280 aa, Heterodera glycines
  Coding regions on vcDNA: vcDNA=SeqID_57687; Strand=+; Position=1-843
MRYDELRFSCRRQGGDGSSGTFCQQCRFVFPNADCFEAHRRRVDVAPAPPPGVAAAAAVPHCGEEATGGDGDDAVSLAAAVGAAVAPAFADRRRGRPHRSMCEERRLCEWCNVVVWARSGPHVCRRRPQQQQQQEDRAVLQQQQQQNHHNQQPAPPKCEKCGGPHDPERTPHFIQPKQYARQCQWRRGAARGAHDNADDGAVADAADAAAAVDDDDDDDVSEEEGAEAGAARGGVGDGARGHLRKPKPVRFIFWDVECAQERVGEQQEQLEDGNEFVFKR

SEQ ID NO: 131265 - protein, 140 aa, Heterodera glycines
  Coding regions on vcDNA: vcDNA=SeqID_57688; Strand=+; Position=1-420
MDAVQQQQQQLPELLKHVPVLVCAEVICERCIAYGVDIEREPLRRAPQCQCGVPWRGANRRRWCSRIGEELFDDDDTGGPATAQQQQQQQMPPDGLNPRRLRFFCDGEPGTGRGAMAQFVDFLLHTGPKGTRTVMLAHNG

SEQ ID NO: 131266 - protein, 59 aa, Heterodera glycines
  Coding regions on vcDNA: vcDNA=SeqID_57689; Strand=-; Position=1 -94,224-308
MRCQMGICGERTVRCHAAVLAKHRDQSGAATQFAIGQQKSGRSDSDPIGTAASGNSHEA

SEQ ID NO: 131267 - protein, 62 aa, Heterodera glycines
  Coding regions on vcDNA: vcDNA=SeqID_57690; Strand=-; Position=1 -13,95-270
MDIAGLTLQRDYMPNRSTADTLAAPFNAECTTDEPKALRTSLLRGRGCANIVILKYIWRFVI

SEQ ID NO: 131268 - protein, 28 aa, Heterodera glycines
  Coding regions on vcDNA: vcDNA=SeqID_57691; Strand=+; Position=1-84
VLSPPPPPASLSSPNTTATPIHSLLTFQ

SEQ ID NO: 131269 - protein, 77 aa, Heterodera glycines
  Coding regions on vcDNA: vcDNA=SeqID_57692; Strand=-; Position=1 -89,208-352
MVVTLMIGMKNGVEKLFKQRPLTIDQLDEQSFGTKLEAQCCVFGAISAHRFGPKFIPGGDPIGDMATDQRNPILCGF

SEQ ID NO: 131270 - protein, 301 aa, Heterodera glycines
  Coding regions on vcDNA: vcDNA=SeqID_57693; Strand=-; Position=1 -654,1108-1359
  Homolog annotation: Hit_ID=EAL49477.1; Match level="QueryCoverage =98%, HitCoverage=44%, E-value=3e-44, Identity=38%"; Hit description =hypothetical protein 42.t00003 [Entamoeba histolytica HM-1:IMSS]
MEQKEEEEKRKEGEKREEEEKQKKSREKEEKERKEQEEKMMEEAERKRIEQEKVRKEEETQKKEEEEKKRLEEESRKRMEKKRAEEEKKKQDEEKKKEEEKERKRKEEEEKKKHKEEKKEEEEERKRKATEDKKKEQAEEEKTKSNEEEKKKAMEEEKKTDGFDNALEDKEATEGQIRVELGAKLDKNAKEALMRAKWWELGQTITKLTNHFDINHLKKNEPRKATEVKGSKETEEEKPGTSKIQKREEKRKAPEFVKKPKQSIVKRGRSKVNKSMRLSGSDQWFSRLFGRFVRRQPNAIV

SEQ ID NO: 131271 - protein, 387 aa, Heterodera glycines
  Coding regions on vcDNA: vcDNA=SeqID_57694; Strand=-; Position=1 -1101,1155-1214
  Homolog annotation: Hit_ID=NP_504584.1; Match level="QueryCoverage =97%, HitCoverage=10%, E-value=4e-67, Identity=38%"; Hit description =immunoglobulin-like and fibronectin, type III and M protein repeat (5G632) [Caenorhabditis elegans]
MCTWQHLEVEILSGNSVSVRWTTAETVQQQIPQGAHAVIQYRSEGSSVWNEVLEQYSKSPAVIEDELKEGVPYRIRVLMKSADGEEIGKSAESRTVKLSGSNLPILTKTLRDALVPKNNEIRLEVCAVGEPAPTYLWFKNGEEIVPTPENDNVSISNEGYLSKLTIHRMADGDEGVYTCQVSNSHGTIESRAELLLGAIQAHFTKAFAERMDLVEGKDITLECEVSHPDANVRWSRNKRTINEATNRVALDSVGKVRHLTLYGAMKEDSGTYTCETEGGQDRVQTELAVRPPDARIMFSPQGRTVHDYGERVCLFAELSRTTERANWFRNGVGLMSKKCFAYVDELRANLEIYNFDENDVGDYHVTLDSGERSAPAKLKFEVAPKIQ

SEQ ID NO: 131272 - protein, 169 aa, Heterodera glycines
  Coding regions on vcDNA: vcDNA=SeqID_57695; Strand=-; Position=1 -54,358-433,755-1134
  Homolog annotation: Hit_ID=CAE64509.1; Match level="QueryCoverage =65%, HitCoverage=3%, E-value=4e-10, Identity=31%"; Hit description =Hypothetical protein CBG09244 [Caenorhabditis briggsae]
MYLQFSQIVPLDFIMKVQISWYHNGRELTELGTEHVISKEGCLFHGKPSLDQQKGERIVLDSNENLSLNIRLKSLPEPEVDLYLNGELLTPELRTSVTVLEEALLLTRKELTKEDRGTYRVVLFNEYGEDAVEYEVYVRDVPDPPSGLMVTDVGHDYCFLKVGPLRANF

SEQ ID NO: 131273 - protein, 188 aa, Heterodera glycines
  Coding regions on vcDNA: vcDNA=SeqID_57696; Strand=-; Position=1 -182,217-297,353-656
  Homolog annotation: Hit_ID=EAK96776.1; Match level="QueryCoverage =87%, HitCoverage=37%, E-value=4e-11, Identity=23%"; Hit description =hypothetical protein CaO19.2859 [Candida albicans SC5314]
MLTFILLVPLVIVIGAFIYLLFMKPKSAASDEEGDEEAKGTADGDVEKGEDDKSDLICLQLKETPPAGEGVTVPAEQVVDEQPKEDDGGDKAEEEKKEEGGSAAEEKQKEGAAETGGGEEKSATTEETTEETTETTDETATTETSESGSGSASSSASGSGSGSGGSTSADATSEDKTSDASSSSSEGS

SEQ ID NO: 131274 - protein, 71 aa, Heterodera glycines
  Coding regions on vcDNA: vcDNA=SeqID_57697; Strand=-; Position=1 -137,171-249
MMHYFAIFWSLNIIFLQQNGQNVASATNPLMGKHQMKIAKLENLLSRGPAQCCPWKSKNSLYFLGRFLKNF

SEQ ID NO: 131275 - protein, 149 aa, Heterodera glycines
  misc_feature (106)..(106): Xaa can be any naturally occurring amino acid
  Coding regions on vcDNA: vcDNA=SeqID_57698; Strand=+; Position=1-446
  Homolog annotation: Hit_ID=CAE71741.1; Match level="QueryCoverage =94%, HitCoverage=27%, E-value=4e-25, Identity=39%"; Hit description =Hypothetical protein CBG18725 [Caenorhabditis briggsae]
SPLPLEAQVFVVVFFLSYLVLKSLVEIDETLAVKRKYGVGRILVKGEVWLFGGVERDSNWERVFLVPVESRTANRLIPLIQQYILPGTTIVSDEWRSYRGIPNLPXNYTHWTVNHSQNFVNPANRQAHTQNVESLWKKLKKNFKQHFGI

SEQ ID NO: 131276 - protein, 67 aa, Heterodera glycines
  Coding regions on vcDNA: vcDNA=SeqID_57699; Strand=+; Position=1 -82,329-450
MKEAAAIVDDCCDSQLSTAADIHVLSEFEWFEQWKHLIGLNVVDQKWKDDEWKDDGVEKMFEVFEFI

SEQ ID NO: 131277 - protein, 150 aa, Heterodera glycines
  Coding regions on vcDNA: vcDNA=SeqID_57700; Strand=+; Position=1-450
MALNPTIDQLVKMLADQQKMVQDQSQQIAQLIAIGQNAPNAAAQPNQGANSVPILPDISPFEPTDDKSRISEWIERFKFALDCTAPTADDEVKVKCLMNKLSESAFSEYSRSVLPSSVTDFSFKVTTEKLEKLFAKAQSIFIDRYECLKA

SEQ ID NO: 131278 - protein, 872 aa, Heterodera glycines
  Coding regions on vcDNA: vcDNA=SeqID_57701; Strand=+; Position=1 -56,220-505,659-751,924-1335,1382-1751,1799-2003,2054-3250
  Homolog annotation: Hit_ID=NP_502882.1; Match level="QueryCoverage =13%, HitCoverage=22%, E-value=5e-10, Identity=35%"; Hit description =DNA polymerase like family member (4Q408) [Caenorhabditis elegans] emb|CAB60306.1| Hypothetical protein Y
MSNNLFNPCLSMRHISKCRPICLTVVAVDHRPHQQTPAGPLPVTNVVLRNGDGQRVEASGWQHQASVLASLDIGSAYWFTNCTARARYQQLDCWYRIGVDGKNAIVVPHTAAPQAPHVQTGGGRTFNEARAPPEASPIEEDANNNVTRSIEDCFVIERTTPMRNTLRNTRGELCEIRFLPLEDAERPDLVLETLIQHLLDRVLEGHPPPMLVGLQLHPPGFDRPYVIRLRPPEQNNAAALSAPIERLNEQSAAGIDLLAGTTVTKVLAVWPLEPIRANAQRGGGCDFDAEHHVSNTVRSLVRVVNPNDRHCLARSVLLGLCDRETRQPNGGGRDTFAAYAGRQDQHGAQAVDLLRNAGLPVDKQMYTLEDVEQLQRWIINEHGVGQIRLVVFEKEQEYRIVFKGEGVAAHFNLCLLLERGHFNYIGRIEQLFKIENYCFDCERRATTRYHLAGCKVVCRLCLRFGAGFPCQPEQLPNGGSSSRRCNECGFVFPNDGCYDYHLANMAPAPIDGRGQRQRQPICQWRRFCRACGRVAYFGVHQCAPLRRPAGPIDCRRCHGRHTLDEPCFIQPLLDRPAHQNNNNNNDDDDDDDDDADVLDDDEADDELPLRLCFFDAETSQERPLQLNNQIAQKHVPLLIVAEVICEPCLRAGINVNDGFGRRAPDCVCLCRMVRGQQLRQWSSPPFVNGAGDNTPPPEGAPAFNQRRFYFHSFDNEANDPIEQFLLFLMKHGSKKAHTVCIAHNGGKYDFHLVLEALHRRSIPPKRLCTTGLKIYSMKLRGLNQRRITFKDSINYFFCELDALVKSFDLPQHLATVKPFFPYLYIQRQHLLHRLNGLPAIEHYSPDTMKVEKRTKFSSMARLQQQQRQLSTA

SEQ ID NO: 131279 - protein, 71 aa, Heterodera glycines
  Coding regions on vcDNA: vcDNA=SeqID_57702; Strand=-; Position=1 -200,828-843
  Homolog annotation: Hit_ID=NP_500139.1; Match level="QueryCoverage =77%, HitCoverage=15%, E-value=1e-15, Identity=70%"; Hit description =CaM Kinase (39.1 kD) (cmk-1) [Caenorhabditis elegans] gb|AAF23187.1| Cam kinase protein 1 [Caenorhabditis
MISRLIPHKILFRYEFKDLLGTGAFSKVFLAECRFVPGTFVAIKCIDKKALKGKEESLENEIRVLKRTHQI

SEQ ID NO: 131280 - protein, 150 aa, Heterodera glycines
  Coding regions on vcDNA: vcDNA=SeqID_57703; Strand=-; Position=1-450
MPSGLIKNCIVAKRHPMNHHFNRHQRCLDGLCLHLPTSSIGSKVADVGTKFSPKLSIRKKSIHGDCLQPELDVLLNELRECILDGNAVVEELEQFKRKDGDNLHKEFPVNCEEKGKEEEAEEKRRTRTEKVQRFVKMVKRQFELGRRIEK

SEQ ID NO: 131281 - protein, 309 aa, Heterodera glycines
  Coding regions on vcDNA: vcDNA=SeqID_57704; Strand=-; Position=1-929
  Homolog annotation: Hit_ID=BAD01590.1; Match level="QueryCoverage =99%, HitCoverage=16%, E-value=6e-36, Identity=31%"; Hit description =hypothetical protein [Drosophila melanogaster]
WVKALRVMAWARRFANNARRKAEDMHGTMGGSDPSRRKAAIRGQIVALPTHDEETDAKWAIVRATQRNCQPRDGMRTELDENGVQRLISRIGWCEEAELSRPVILPKRSRAGALIIDDIHVRLHHMGTDGTLSEFLRSWWCPSARQQVRQVLGQCKRCRRLRGMPYPLPTMPQLPMDRVRRRLPFESVGLDYLGPTVTLDDKGQQRKTWVLLITCLTTRAIYVDATRDLSANSFISALRRFIARRGAPSRILSENAPTFTVVGKTLAEFGMPGDNPIDFADSRGIKWRFTPQHTPWAGGIFERAVQLVK

SEQ ID NO: 131282 - protein, 81 aa, Heterodera glycines
  Coding regions on vcDNA: vcDNA=SeqID_57705; Strand=-; Position=1 -183,233-293
VWRERQIYSAKNLDDLSKCLTADEPSTFSVSPNLNSETESPSKSSPVDGGQSPVASEEDTKKIKEEFHAFSTLSSNMIALL

SEQ ID NO: 131283 - protein, 81 aa, Heterodera glycines
  Coding regions on vcDNA: vcDNA=SeqID_57706; Strand=-; Position=1 -63,186-368
MRVAPPKSAIVAAKVEPIRSWVETGGMQYIHQQQAANDLLLMGDDELEQKGKGEGEKDEEGAAEHNEMASNEVKMGNLKQF

SEQ ID NO: 131284 - protein, 109 aa, Heterodera glycines
  Coding regions on vcDNA: vcDNA=SeqID_57707; Strand=-; Position=1 -145,385-569
MANQKEVDQSMAPFQCLQANMHCTDKQPQHIITGGGGGIKLERALSRITRLGHAVNGTNDKFNVYHQQQQQTRSNRRRRGTAAKCAVTEKRASLCSAAAESGTEQQVVK

SEQ ID NO: 131285 - protein, 174 aa, Heterodera glycines
  Coding regions on vcDNA: vcDNA=SeqID_57708; Strand=-; Position=1 -139,412-555,655-896
  Homolog annotation: Hit_ID=AAR30497.1; Match level="QueryCoverage =60%, HitCoverage=6%, E-value=6e-12, Identity=42%"; Hit description =RhoGEF [Caenorhabditis elegans]
MTERCVLVARSKCQNAPNQNVKFDKCFRQSDGFGLTVNGEYPVKVAVIAFITLYVPYPLASISFPKLREGDRILKVNGMPVTAQNFQEVIKMISGGYNLALTLLGPASVATNSWDDFDKLFPVQHHPSPATALCQKSPPPLTATKRTKTMITEEDKNGHNWEVATNYKRKNNLI

SEQ ID NO: 131286 - protein, 72 aa, Heterodera glycines
  Coding regions on vcDNA: vcDNA=SeqID_57709; Strand=-; Position=1 -85,322-455
MSSRWSVISEENSSNSSSTTTDYPPSIPELSPQCRRFSPPTSAAGTELTKKGGPQTTTADGTQRENTKISPG

SEQ ID NO: 131287 - protein, 158 aa, Heterodera glycines
  misc_feature (155)..(155): Xaa can be any naturally occurring amino acid
  Coding regions on vcDNA: vcDNA=SeqID_57710; Strand=-; Position=1 -96,268-313,377-469,544-747
  Homolog annotation: Hit_ID=NP_493343.1; Match level="QueryCoverage =83%, HitCoverage=17%, E-value=2e-43, Identity=68%"; Hit description =phosphodiesterase 1C calmodulin-dependent 70kDa (1N904) [Caenorhabditis elegans] emb|CAB03289.1| Hypothet
VTCEKGRKKNRSKASLFRSHASKPWELHYRWTEGVLEEFFRQGDLEASMGLPYSPLCDRASMGLPYSPLCDRHTVHVADSQIGFIDFIVEPTMVVCGEMLVKMVEPLVSLPTTDSLFPPGAHRGGPDDGSASATSLSPLPPDLYASSFPTIPGRXTLH

SEQ ID NO: 131288 - protein, 31 aa, Heterodera glycines
  Coding regions on vcDNA: vcDNA=SeqID_57711; Strand=+; Position=1-94
MAKEREGTRVGADREGTRTDREQRRPGAVKG

SEQ ID NO: 131289 - protein, 72 aa, Heterodera glycines
  Coding regions on vcDNA: vcDNA=SeqID_57712; Strand=-; Position=1-219
KFEVDTINILLLKLCPTWSICLDENRHDSSLSDRSRPPTFPRTATLRASPISSPSRPLHPAEFDANFLSPRH

SEQ ID NO: 131290 - protein, 343 aa, Heterodera glycines
  Coding regions on vcDNA: vcDNA=SeqID_57713; Strand=+; Position=1 -198,256-558,633-965,1229-1423
SLNPDHDEPAKIDEVLDNYSKHVLGQQPEKGKQSTDSRSMMNTFFMYFEMNVYAKLKEGKGKERKKKLRLHMLQFVVLNNVFEGIDEQTLLKFDIKGTFAPGSAVQHDQKQKWYTGETGWQKSLYREYDFIGISREGREISAFFPEGIQLHPEAYRQLADGVKNDTSYLTENGVNDYSLLLGVQFMDPYPDSPKDRKDFEGTKKGAKCVEAKCHNCKRWPDAEYEEKATLCLYMGIIDIVTPSNEKAEKHFFEMMYRRKDIADFIHYKRMSEFIPYHNEIVTPVPPQMYGKRFVGTVLGCLFSPESSTSVGGESERQFQLGMRQSICKTFGEKRGIKTNHGIE

SEQ ID NO: 131291 - protein, 24 aa, Heterodera glycines
  Coding regions on vcDNA: vcDNA=SeqID_57714; Strand=-; Position=1-74
MLLLYFRISSDYAFFERCTSRIAE

SEQ ID NO: 131292 - protein, 88 aa, Heterodera glycines
  Coding regions on vcDNA: vcDNA=SeqID_57715; Strand=-; Position=1 -22,293-537
MLLQKGQSKHCHPICAICIVSVSIPSHYLLCPRTTDMNKTNIYLKHKYNNKMVKAMGIAMGGINDRMNEGGRKDSAYMREGIVPKGNQ

SEQ ID NO: 131293 - protein, 404 aa, Heterodera glycines
  Coding regions on vcDNA: vcDNA=SeqID_57716; Strand=-; Position=1 -963,1633-1884
  Homolog annotation: Hit_ID=NP_495557.1; Match level="QueryCoverage =90%, HitCoverage=32%, E-value=7e-76, Identity=39%"; Hit description =zn-finger, CCHC type and RNA-directed DNA polymerase  and Integrase, catalytic domain containing protein
MDAFGLLDGIKAKINSPINLCSAREELRGKTHAPIKSNKVAGKRNKDAEKEINQLKQEYTNVFKTELGLCKKVKAHLELNADARPIYRKARPVPYNAKEAVDRELDRWEKMGVIGKVEHTEWAAPILVVKKADGSARLCIDYSTGLNNALKDHQHPLPLPEDIFATLNGGQYFSQIDLRDAYLQVELDEASKKLCVIATHRGNYEVKRLPFGIKTAPGIFQSIMDQMLADFDFATAYLDDIIIVSKDQKKHSEHLKKMFSRFQEWGIRVKREKCSFFQDEIKYLGQIIDKNGRRPDPSKITAINEMPEPTDVSSLRSYLGMSSKSDQNIKKVMKFIRNGWPQNIGNENVEIRIFHQRKEQLSITKDCLMYAERVVIPTQHRAKILQLLHKGHPGMKRMKQLARE

SEQ ID NO: 131294 - protein, 224 aa, Heterodera glycines
  Coding regions on vcDNA: vcDNA=SeqID_57717; Strand=+; Position=1 -114,162-307,348-760
MDMSNAVTTIFPGCQIRFCFFNFVRNLQKEVKQQGLWQRYCSDPVFALNVRMLTSVAFVPLCDVRNAVTALDMEFGNLAAFRPLIDWLLDNYVGRPRPNGTWSQPLFRPEQWNVYQRTLDGNARTNNNAEAEHHRLQGAFNCRHPSLWNFIDVLRREQKIADHKYNSAIAGLSPDKKRGKYLAADRRILNMVRNYIPLNAVNDHDYLPPIPQPNQFHTILEFLR

SEQ ID NO: 131295 - protein, 145 aa, Heterodera glycines
  Coding regions on vcDNA: vcDNA=SeqID_57718; Strand=-; Position=1-435
MAKFWAFLCHKSQIFWLSFLVDKNRIDDNDPCDVHYHGIDKFKYLDDFFAHWQADAQIHHIDLFMGKAYLNYFLWHNANETWTSDEKNVLKKFSIQLQKVAKKLNTRSQFAMTVLPELYEFCCPTDLANDDDLENCIGHEVANPT

SEQ ID NO: 131296 - protein, 367 aa, Heterodera glycines
  Coding regions on vcDNA: vcDNA=SeqID_57719; Strand=-; Position=1-1102
  Homolog annotation: Hit_ID=NP_508324.1; Match level="QueryCoverage =100%, HitCoverage=13%, E-value=3e-47, Identity=34%"; Hit description= predicted CDS, peptidase family A16 and RNA-directed DNA polymerase and Integrase, catalytic domain and
MILRFRLKNYVLIGDLEKAFLRVGLNELDRDTTRFLWVNKSYLNEIRQNYREIEMRDIELRRFTRIPFGVNASPFLLTAVVNLHLSKINEMFEKFKTIQVNKELCLNDKEEEFKNLCIELKQNAYVDNFVMMCDDEKEIKFKHYWSKEIFKLASMNLREFVSNHEQSNKEIQKLEGSEIPKVTKMLGIKWNVDSDELELQIKIPLMSKDTTKRQILTMIAKNFDPMGWISPVILKYKLFFQKLWRSNKDWDDKLDDQEIIEWNNISNTEMIAIPRSPFTSQYLKHSILHIFADASELAYATSAYLHTNDQINLLFAKTRLTPLKGLTIPKLELLGLLIAARAAKFIKRESKLNLENTYIWSDSKCVL

SEQ ID NO: 131297 - protein, 128 aa, Heterodera glycines
  Coding regions on vcDNA: vcDNA=SeqID_57720; Strand=+; Position=1 -63,413-736
MCARLCEALWAQFQQWRASTKVLTGGGGRKESAGSMAAPPPVVELVTGSSSIKQQPAPPLGSSARLRKVSGERRPPPSGESGGGGLVLAASSPLAGKTVGGGGGGGPIVGTIGATKSPMFGDMRPHYV

SEQ ID NO: 131298 - protein, 244 aa, Heterodera glycines
  Coding regions on vcDNA: vcDNA=SeqID_57721; Strand=+; Position=1 -364,403-744
  Homolog annotation: Hit_ID=NP_502797.1; Match level="QueryCoverage =93%, HitCoverage=64%, E-value=3e-33, Identity=37%"; Hit description =HASI (4P602) [Caenorhabditis elegans] emb|CAB16520.1| Hypothetical protein Y57G11C.19 [Caenorhabditis ele
SKKSEDMIEAFDRVFDKSKIIPMKIYSDSGLEFQAGKIKNILRKNFIKNVMYSPDLHAGVVERANRTIKERLYRYFTKTNTLRWVDVIDKIITNINNSVNRTLGVKTSSINLKMPVRSGKKKFKIGDIVRIKKFKIGDIVRITKEKGKFSKGYLPNFTEELFKIVVANPTTPDSYRIEDLEGNLIKGIFYNQELVKTWMIFTLYYLRTHRGRRTLRQNSQYTPRDSGIGHKLVSSSLINYLPLL

SEQ ID NO: 131299 - protein, 37 aa, Heterodera glycines
  Coding regions on vcDNA: vcDNA=SeqID_57722; Strand=-; Position=1 -63,119-169
MVIFELGILMADLKKMKRDIELQLRVSSWSSTSSGLI

SEQ ID NO: 131300 - protein, 184 aa, Heterodera glycines
  Coding regions on vcDNA: vcDNA=SeqID_57723; Strand=-; Position=1-554
MTAARSLVNAIIEGEPKEEIRLFVAKKADFVATGQYPTEEDQKKSLECFFKKCLVARRALEESKFEKIGMTAPAGLNHLAESEKKKWEEASKETPWALEQLRAKIVHKASKLMAHPRVIIGDQSAHQLAEILDQTAVIGPKNGTLAETVRTLKPVVLSSKVKAALIIAGRDSLLRGETVEMMME

SEQ ID NO: 131301 - protein, 133 aa, Heterodera glycines
  Coding regions on vcDNA: vcDNA=SeqID_57724; Strand=+; Position=1-398
GDQSAHQLAEILDQTAVIGPKNGTLAETVRTLKPVVLSSKVKAALIIAGRDSLLRGETVEMMMEQYEMIANLCRRFAHVKFFWICPPYVHDKHDEYEELVARLGPMRSLNPFIPVWVTEKGRSIHELFRFGNS

SEQ ID NO: 131302 - protein, 374 aa, Heterodera glycines
  Coding regions on vcDNA: vcDNA=SeqID_57725; Strand=+; Position=1 -714,1103-1247,1380-1601,1970-2014
  Homolog annotation: Hit_ID=CAE64431.1; Match level="QueryCoverage =59%, HitCoverage=23%, E-value=4e-47, Identity=44%"; Hit description =Hypothetical protein CBG09134 [Caenorhabditis briggsae]
YPNSRNLFLSLHHQLTNSRRKGQNAIGDFLQHAPHELTDGMLQLSGESSEMLMATTLLGLSEQIKEEEGDGTMLEEKILTDDKHTFGEQCKSIQHFEMLNYPLCHFPNYSCALATLGHKRRHHHGQQSSVGAACSSTQSSAPSSSQSEQADSTLHPEERKRILHLHAEKNRRFALKEGFESLVNAIPVVEQTGVKCTNAVVLNRAAQHIKQLKSEQDQQQMKLRVLREKITNMNERIALIQSNLPSSSTGGSRPCEAQTPSMRIQVEQFFEHYKKERSREDYRFWLMGEVLKPIVHSFAEQIHPDASDHDRVLHSLKKWLDTHWNAAVLRPIASDVLVRLATASAAFTDEAALSNYIMNERNICQSFTIFLING

SEQ ID NO: 131303 - protein, 400 aa, Heterodera glycines
  Coding regions on vcDNA: vcDNA=SeqID_57726; Strand=-; Position=1 -192,234-462,581-1360
MPSKCPSFGQAEKRLERTHCERPLADDLKTDADQRGHIRGGAGAHSEGARKGGGRAPERTAAHMQNDRTVGTAEGTRYGQRRHAMPFVPNRIRTVGGKKLRCDVLGLPKGANGKSRLNSIRPVQYVCQRNCGVETFDQKRHVEEVGCLVLPRGSAAPRLLTALLRHGRVHRNDGQRRAVLLSAAQPIRTVQPPLGQPNRTNATEALRIWGRERPLQRSRKHSNAFRWRGQSAKDGGQDGTAPAAEEEQQQGTSANPSGTSAKVEKAGGGRSEGTNGNGRLKTTPRPRIIPSWVHEGLQQSSVSVDDDSDGESASSSTSSSLEPAQFRKSLVAAKERALSVKQHAAAHPLGANAGGFASGLRTNKAKPKSKGNATEALGHQQGIQKMQRVALGRVGRMSDT

SEQ ID NO: 131304 - protein, 191 aa, Heterodera glycines
  Coding regions on vcDNA: vcDNA=SeqID_57727; Strand=-; Position=1 -63,258-563,641-731,836-951
  Homolog annotation: Hit_ID=CAE70872.1; Match level="QueryCoverage =94%, HitCoverage=54%, E-value=3e-14, Identity=33%"; Hit description =Hypothetical protein CBG17662 [Caenorhabditis briggsae]
MFEIKTGGKGGEAAAARLANMAIQRRQLEKRDTLGDYWSRRLHDMALRDDPVDERAEGIGGRLGGSGGGATSPQAPTTGGVAKTAATSNASKSGGTSSTRGGSSSSKENAPRAESAGASAKAKSKEKTARDVPQSAYARGARDEFVETPSTGCCTCQRGPPGRTGPPGRDGLRGIDGEPGRRDFKIEKSNV

SEQ ID NO: 131305 - protein, 138 aa, Heterodera glycines
  Coding regions on vcDNA: vcDNA=SeqID_57728; Strand=-; Position=1 -258,314-472
MLLTFPFCLLLIFAKSFNCQMQNFNCFAQNGPNRRLSPAQLADTAFWHEQFQKIELNSADFKLKEFICELSQKQRIFEAVFGTLPRALVPPSMDDEFEFIKSRREMLVHNDPALSEVLNGLFVTAMNAKQKLQLFPGE

SEQ ID NO: 131306 - protein, 217 aa, Heterodera glycines
  Coding regions on vcDNA: vcDNA=SeqID_57729; Strand=-; Position=1 -50,97-244,536-632,759-972,1020-1164
MFFTGIDRLIGIAFSEIHDFLKTRLYLAMTTVISLSYGFLFSVVSYQEAKQDGDLMVTGSYIDVLRIIPLFVTISNLFTIMTFAIYIFLGITIRIKASGLPSADSFNRRTFRALFCIITVNIGGYLISAITYFLLIPIASPVTLWFFALMAAIPMNIGAVSNGPILYFTSTEYRQAFQKEFPFVFKQTPNQNQVVPRQNGPPIRVISQSRIIDSSKP

SEQ ID NO: 131307 - protein, 16 aa, Heterodera glycines
  Coding regions on vcDNA: vcDNA=SeqID_57730; Strand=+; Position=1-48
MATLMKQFKKGTKCQK

SEQ ID NO: 131308 - protein, 356 aa, Heterodera glycines
  Coding regions on vcDNA: vcDNA=SeqID_57731; Strand=-; Position=1 -76,201-289,345-472,1185-1282,1421-1470,1567-1659,1962-2366,3016-3147
MLWLITTIVFASAVLVYIFYPRNGQGVSSTPPETESVDDAQNSLDSNKSKDNVFKSIYSSFVRGKSTSLADIPQMLQRRHSTVDDSHIPSQVANVAKRILGFPSNCDINQKDIQVFIIEPNEVIVKPGDPDDAIFVTLEGCLSVFITPPDANDKPIHVRRIEPGDFFFSSLSLIDIFMRLNPPTERSKEKHRGQSLRALNSLTKPKLKRMSTEVEQPKAEQKMALAVSYFSEALRLSESDANDLIRPFLKIIHLEENQSLFEEGSSENQPALAIIVSGVLKLTQQPRFSTFEDSGQEIWTAFIHPKELVGGLQYPQVGFRLVRLLGQYYAGRSHFPLISHPSSDPLTQRVFRLIDQ

SEQ ID NO: 131309 - protein, 93 aa, Heterodera glycines
  Coding regions on vcDNA: vcDNA=SeqID_57732; Strand=+; Position=1 -15,60-173,233-290,359-453
MTDPANLLDERQQQAQQTLAGLRRDYEELDHTFVVYEKEFETRINRTKTAWEDAVRSRSNENDKRQLLESIRDRLQNVFEGQQYLLKTKIQII

SEQ ID NO: 131310 - protein, 225 aa, Heterodera glycines
  Coding regions on vcDNA: vcDNA=SeqID_57733; Strand=-; Position=1 -35,88-109,150-204,253-283,338-503,545-658,1258-1314
  Homolog annotation: Hit_ID=CAE69518.1; Match level="QueryCoverage =98%, HitCoverage=76%, E-value=2e-27, Identity=36%"; Hit description =Hypothetical protein CBG15727 [Caenorhabditis briggsae]
DRKKQTHLRCERQRREAINQRREAINSGYNELKDLLPASGYNELKDLLPASASFIGCKTTNAAILFRKTTNAAILFRAADYVKALEAADYVKALETSMEQNAEELAKLQTQYSALEMILQQYENFSLNSQPCSALQLQIVTLQHFLDTCFDSFTSRVDLSNYQLQIVTLQHFLDTCFDSFTSRVDLSNYQALTRSLLSWVECLEYQPKQFWCDLSKFVTIIFGKR

SEQ ID NO: 131311 - protein, 250 aa, Heterodera glycines
  Coding regions on vcDNA: vcDNA=SeqID_57734; Strand=-; Position=1 -166,222-348,474-557,621-774,1013-1185
  Homolog annotation: Hit_ID=XP_322018.1; Match level="QueryCoverage =86%, HitCoverage=42%, E-value=4e-59, Identity=54%"; Hit description =ENSANGP00000012089 [Anopheles gambiae]
FPGLTQFLWEKCGKSGLSLVFQGPGDMYDVGMGHGANFSVNVPLREGMDDESYHSVFKPVIQAVVDNFNPSFKPVIQAVVDNFNPSVIVLQCGADSLGSDRLGCFNLSFDGHGECVRFVKSLGLPLLILGGGGYTLRNVARCWCWANETAILVERDSEISNEIPDNSEYLEYFAPEFTLRPELPKRIENANSKEYLAAIKAEVLENIKLVRGAPSVQLQPVPGDAFDLTSTRGEENGAKMARISVRFDHF

SEQ ID NO: 131312 - protein, 31 aa, Heterodera glycines
  Coding regions on vcDNA: vcDNA=SeqID_57735; Strand=+; Position=1-93
GQQTHKNTSCTSMFEKRCFKIKSRDMSLGDY

SEQ ID NO: 131313 - protein, 171 aa, Heterodera glycines
  Coding regions on vcDNA: vcDNA=SeqID_57736; Strand=-; Position=1 -269,400-646
MVISTTTTTMTTNCLTERRYQRNWHDNQRERQKQQRERQRTGKVPTAAALLDSANGRRTFAASAGAAGRIICMQRMHAAHAYAQAKRAKGENSAFRALAALPARRALTDPKDSQALPAWLAQKAISAIWAQKDHVETEDYQGHQAERAFPAWTDCRVCPAIWARPDAMERT

SEQ ID NO: 131314 - protein, 337 aa, Heterodera glycines
  Coding regions on vcDNA: vcDNA=SeqID_57737; Strand=+; Position=1 -12,133-427,730-1043,1115-1280,1525-1751
MQKKANADQIQGKNIMDFVKSYLNNYLTKSIEKDETGENPMNSNSDLIKMKLNALVDKAGEQCQKVRKNQSKNFLGKFSAKIGKTFQKRELKNSKTIKNEFDEENLSANSPFEMISKLSDKTGKYPKNITSKEITKERNKITKFVKKSIANLNFGEIKKILTLKWFAKIFANFKKANFIIFTDLTKLKDILLIALRNDKSPEESQKKIINLADNILLAISSNHKCQKRINQALNERKYGKNDDKMIKNEPFIYMNKMIEIRKSYRQIGPRVKRQIGTDIVALIGYCNFYFGLAVLFIGAPIVAAVFLSPALLALFFITGWVGVPAAKVFFENCILNI

SEQ ID NO: 131315 - protein, 54 aa, Heterodera glycines
  Coding regions on vcDNA: vcDNA=SeqID_57738; Strand=-; Position=1 -77,248-335
MSYPIFVWREEMVDEARRGASLQQQKFFCQHADYQGLKSVDLRIHFWVILKSIN

SEQ ID NO: 131316 - protein, 146 aa, Heterodera glycines
  Coding regions on vcDNA: vcDNA=SeqID_57739; Strand=-; Position=1 -117,280-354,414-514,808-954
  Homolog annotation: Hit_ID=CAF93008.1; Match level="QueryCoverage =58%, HitCoverage=15%, E-value=3e-10, Identity=40%"; Hit description =unnamed protein product [Tetraodon nigroviridis]
MPNECSSGSPQGYLSDDFDQQMSPCSDVCGQSSPLFVQQHQFIFNSNRQSTSNDVLNKSSDPQSMIYEAARFDSIMKDLADCGVQRRQQQQQQQNVPNTPPSLSLPNGISVIQYEEPMFWCKVTYYELNQRVGEVFHASKPSLIID

SEQ ID NO: 131317 - protein, 64 aa, Heterodera glycines
  Coding regions on vcDNA: vcDNA=SeqID_57740; Strand=-; Position=1 -60,215-349
MGNHHAANGSPTSGSPSSSTIGTIEGTATAKISGNCNGKGEKKQIIKKKFKLGNKISNERIFGV

SEQ ID NO: 131318 - protein, 86 aa, Heterodera glycines
  Coding regions on vcDNA: vcDNA=SeqID_57741; Strand=+; Position=1 -57,297-452,682-729
MKPIRANLMDYIPDKKWLIHVNGNEKLQRNADEKCMPKGRGPKKEGAVPAKKWSSALRVVAAMTRFKNIPRQMVGFPYFLVSFPIY

SEQ ID NO: 131319 - protein, 88 aa, Heterodera glycines
  Coding regions on vcDNA: vcDNA=SeqID_57742; Strand=+; Position=1-267
MFLKLSPLSLLLFLSLLLLISFAIGYSPVGNAKSHPLKLRKRISYSDGGVMALNSAARKTRMPTRKMVEKPRMRFKGGERIWGKPEMP

SEQ ID NO: 131320 - protein, 85 aa, Heterodera glycines
  Coding regions on vcDNA: vcDNA=SeqID_57743; Strand=+; Position=1-391
LHFFSFQHLIKLGLPYKIKVVARLHKCAIIRYLKKPAQIWYSKWKKDFKMLCMTNTELQHPLISALSLSQMIFPAKRNFKKLPKF

SEQ ID NO: 131321 - protein, 82 aa, Heterodera glycines
  Coding regions on vcDNA: vcDNA=SeqID_57744; Strand=+; Position=1 -153,199-294
MMPKIGHIFTGLLALSSVAPGTVNASQTGGAVQSVQQQWTSPPQMPGQNLMETPISMKNRELSLGGKESFETAVYGQSKVES

SEQ ID NO: 131322 - protein, 235 aa, Heterodera glycines
  Coding regions on vcDNA: vcDNA=SeqID_57745; Strand=+; Position=1 -579,765-893
  Homolog annotation: Hit_ID=EAL51907.1; Match level="QueryCoverage =65%, HitCoverage=11%, E-value=7e-11, Identity=28%"; Hit description =Viral A-type inclusion protein repeat, putative [Entamoeba histolytica HM-1:IMSS]
MGINIINSGRNEEMGEMENNDKQVLDEVENMNKKGRLNESSKLNGVTYESHSFFKTIDHTEMELLTKDEEHVLKSLEKSLQSQMLAVRKSFAESEGSKMPVEDEDQVAPLMDEWGEKEEKKEKKEEKGMKENKKEEKKEKEERKEKREVPRKKAEEEKRSASAVTVGEEVVSIVDSTEEREQEREQELFLNPQRKNASMRRDRPKHEESTCGDGYTPRNSRECARTERPGAKGFP

SEQ ID NO: 131323 - protein, 30 aa, Heterodera glycines; identical to SEQ ID NO: 126607
  Coding regions on vcDNA: vcDNA=SeqID_57746; Strand=+; Position=1-91

SEQ ID NO: 131324 - protein, 15 aa, Heterodera glycines
  Coding regions on vcDNA: vcDNA=SeqID_57747; Strand=+; Position=1 -18,539-568
MLALLFIMKNYQMQN

SEQ ID NO: 131325 - protein, 59 aa, Heterodera glycines
  Coding regions on vcDNA: vcDNA=SeqID_57748; Strand=+; Position=1 -105,1504-1578
MTKISNFFPGGAYGHRRAPQNSYFFLENGPKSQNLANSASGGLSNHTKNVGFGWQRKKL

SEQ ID NO: 131326 - protein, 35 aa, Heterodera glycines
  Coding regions on vcDNA: vcDNA=SeqID_57749; Strand=+; Position=1 -4,629-732
MVIFPKNVGDFGPIDGETDQKSFDQDTKNDRIRNH

SEQ ID NO: 131327 - protein, 32 aa, Heterodera glycines
  Coding regions on vcDNA: vcDNA=SeqID_57750; Strand=-; Position=1 -95,262-265
MVLKGKKSQFYKFLCVLGFHKFSPLCTWKVTC

SEQ ID NO: 131328 - protein, 90 aa, Heterodera glycines
  Coding regions on vcDNA: vcDNA=SeqID_57751; Strand=-; Position=1-272
MSVETGADEDDDGDGELLAIPSPSAIAAPLAGAQQKQSVGQFAKFMPIDSEDGGDEANEREGKSEEGQMANGGGQMVEGASLRSQMLKLS

SEQ ID NO: 131329 - protein, 284 aa, Heterodera glycines
  Coding regions on vcDNA: vcDNA=SeqID_57752; Strand=-; Position=1 -275,540-689,1014-1160,2104-2388
LCVFLSPLSSARFHHASVPACALWLFLNFLLLLLIPSDASHSLIPSLITIFVLFAFFPFRPLVIFGTSFAISLAHLGAFGFSDEAKPSTEKLIAALLAHLWTHLVGFYSMANGRKISRAVFLSARNSVESETEWKRERERMCHLCPIPRLGLSVGTTASARLGTSAQRVGLAHWAVGQTARPFAGPIRRRAINRLLNQSVRPPTAVAATTDGIPLPTPFTKRKQFQPAQKVSLFRRRVRLPSDQCHSSLPSPLLGHSPLMTLSLRFADHQIEQLFHAQIDRWYV

SEQ ID NO: 131330 - protein, 193 aa, Heterodera glycines
  misc_feature (9)..(9): Xaa can be any naturally occurring amino acid
  Coding regions on vcDNA: vcDNA=SeqID_57753; Strand=+; Position=1 -156,200-381,427-546
  Homolog annotation: Hit_ID=CAH89652.1; Match level="QueryCoverage =93%, HitCoverage=31%, E-value=2e-49, Identity=57%"; Hit description =hypothetical protein [Pongo pygmaeus]
LMGLIILFXDPSIFTVLTVPGLRKGVALADFVIFPPRWSVAEGTFRPPYFHRNCMSEFMGLIVGRYEANCMSEFMGLIVGRYEAKEGGFSAGGASLHSMMTPHGPDAACFEKASTDKLNAGRIGDGTMAFMFESSLSLVVTDWANEESVDGTMAFMFESSLSLVVTDWANEESVDERYHEDWQPLKSHFERSK

SEQ ID NO: 131331 - protein, 79 aa, Heterodera glycines
  Coding regions on vcDNA: vcDNA=SeqID_57754; Strand=+; Position=1-237
MKSFEALRKSFCLPELGEKGEGSENRTENGEENEEEEKETEEEKQIIQKYCEQLKNGDETAENAHILFKINIIPLQRDG

SEQ ID NO: 131332 - protein, 111 aa, Heterodera glycines
  Coding regions on vcDNA: vcDNA=SeqID_57755; Strand=+; Position=1 -232,1189-1290
LNYGAHLDNNHHKEKFQGIFVEMALQNANYAFRHNFDTFLAEMLKRAEEGSLYFPILITDNDGSLMIEQMAFESYFLGPDPGAFLKNYLGQDQGSQENPDKILTCQLPVHP

SEQ ID NO: 131333 - protein, 38 aa, Heterodera glycines
  Coding regions on vcDNA: vcDNA=SeqID_57756; Strand=+; Position=1-114
MSSHNTSVIDENRRWSDLRCLTDRASTFANSGFVPGIK

SEQ ID NO: 131334 - protein, 207 aa, Heterodera glycines
  Coding regions on vcDNA: vcDNA=SeqID_57757; Strand=+; Position=1-621
  Homolog annotation: Hit_ID=NP_491240.1; Match level="QueryCoverage =84%, HitCoverage=11%, E-value=7e-17, Identity=33%"; Hit description =zn-finger, CCHC type and RNA-directed DNA polymerase  and Integrase, catalytic domain containing protein
MFDGTQVKFIGKGVANFKFRDICIKSEYYVAKRGSLNLLSVQMMDAFGLLNELKAKINAPVNLCRVGDETRGFTKAPKPSQNLTVKAHIDHLKATFPDIFKNELGRCMKFKAHLTLKADAAPVYRKARPVPYNAQEAIDGELERWEKMGVIGKVEYTEWAAPILAVKKADGSARFRKSTSGMHISKSNWMMNRENYARFQPIMAITK

SEQ ID NO: 131335 - protein, 72 aa, Heterodera glycines
  Coding regions on vcDNA: vcDNA=SeqID_57758; Strand=+; Position=1 -156,302-364
MAIKYGPKIAKYGHKWKKCQNMDINFSKLNVKFLQIYWLKLHMRYISKFFDSRKINNKSEIFAFLLIFDIIY

SEQ ID NO: 131336 - protein, 51 aa, Heterodera glycines; identical to SEQ ID NO: 124998
  Coding regions on vcDNA: vcDNA=SeqID_57759; Strand=-; Position=1-155

SEQ ID NO: 131337 - protein, 68 aa, Heterodera glycines
  Coding regions on vcDNA: vcDNA=SeqID_57760; Strand=-; Position=1 -110,1171-1267
MNATLKNRSEDNALIQKNKSDDHGLIALLSSRISSAGSKQIEMKIFGEPLWNYARVIEIDTNDAKGQT

SEQ ID NO: 131338 - protein, 53 aa, Heterodera glycines
  Coding regions on vcDNA: vcDNA=SeqID_57761; Strand=+; Position=1 -121,309-349
MDKGYVRGKRFEKLRLLNNDGIIDCHAAQSVKKNSTVWKGLQLIWTQCCWRNA

SEQ ID NO: 131339 - protein, 80 aa, Heterodera glycines
  Coding regions on vcDNA: vcDNA=SeqID_57762; Strand=-; Position=1 -71,753-924
MQTLFEKARKYCGEQMYPLGEEKNDVQMVVSARKLLDFDTCNLYFADFYLHAASVDEPTQSSVLHYVTVVVCKHNSDTDK

SEQ ID NO: 131340 - protein, 52 aa, Heterodera glycines
  Coding regions on vcDNA: vcDNA=SeqID_57763; Strand=-; Position=1-157
MGQFDLGGLLGNVNQFTSQAGVNLGGIFGQMGQQQPNTAQSNDQPPRHFHRG

SEQ ID NO: 131341 - protein, 82 aa, Heterodera glycines
  Coding regions on vcDNA: vcDNA=SeqID_57764; Strand=-; Position=1 -87,152-313
MRGGKGQVAGTRPSDGTRKAIGGGKGGTEASNVVEGSETIGSGKGANGRRNERGAAESGATAGTASRGTAGDGQGHRRKHDS

SEQ ID NO: 131342 - protein, 252 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (217)..(217): Xaa can be any naturally occurring amino acid
  Coding regions on vcDNA: vcDNA=SeqID_57765; Strand=-; Position=1-771
  Homolog annotation: Hit_ID=BAB33421.1; Match level="QueryCoverage =96%, HitCoverage=86%, E-value=1e-79, Identity=67%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNR

SEQ ID NO: 131343 - protein, 44 aa, Heterodera glycines
  Coding regions on vcDNA: vcDNA=SeqID_57766; Strand=+; Position=1-133
FLIFLGKFGRFAASGRALRARLLIILGTFGRFAASGRALCARFL

SEQ ID NO: 131344 - protein, 32 aa, Heterodera glycines
  Coding regions on vcDNA: vcDNA=SeqID_57767; Strand=+; Position=1 -4,646-740
MRKYLGLSRNKKSRITQGLIDRPELFNNYNSL

SEQ ID NO: 131345 - protein, 206 aa, Heterodera glycines
  misc_feature (192)..(192): Xaa can be any naturally occurring amino acid
  misc_feature (203)..(203): Xaa can be any naturally occurring amino acid
  Coding regions on vcDNA: vcDNA=SeqID_57768; Strand=-; Position=1 -161,571-761,1330-1492,1677-1786
  Homolog annotation: Hit_ID=NP_493694.2; Match level="QueryCoverage =83%, HitCoverage=56%, E-value=8e-71, Identity=75%"; Hit description =carrier (33.3 kD) (2A577) [Caenorhabditis elegans] gb|AAB37890.2| Hypothetical protein B0432.4 [Caenorhab
LIFVFLGNRWDLALVRMTADGRLPPAQRRNYSSVLNALVRVTREEGVLTLWRGCTPTVIRAMVVNAAQLATYSQAKQQLLASGHFRDGIPLHFCASMISGLATTIASMPVDIVKTRIQNMSVVDGRPEFSGVVDVVRRVLANEGIFALWKGFLPYYMRLGPHTVLTFILLEQMNALYKREIRRLKMHEGEEXTHFSDFNFTFXFCC

SEQ ID NO: 131346 - protein, 151 aa, Heterodera glycines
  Coding regions on vcDNA: vcDNA=SeqID_57769; Strand=-; Position=1 -115,170-362,602-751
  Homolog annotation: Hit_ID=XP_320088.1; Match level="QueryCoverage =93%, HitCoverage=8%, E-value=3e-12, Identity=31%"; Hit description =ENSANGP00000010656 [Anopheles gambiae]
HLPSNRAQILELKRNSQACFLLLHLKLYLLRLYGLKEEKIADYSPSEAKEVYEKPCCRRNIRCFSPDFATTVGESGAAGAAPQRTVTDEWAERRSIAEEFHKFHEMLLSLDERRDDDEERAVGAAANTSNSSATTAPAGGDHSAADDHQNE

SEQ ID NO: 131347 - protein, 18 aa, Heterodera glycines
  Coding regions on vcDNA: vcDNA=SeqID_57770; Strand=-; Position=1 -34,284-306
MPSGWRNCRFHRKIYYKF

SEQ ID NO: 131348 - protein, 118 aa, Heterodera glycines
  Coding regions on vcDNA: vcDNA=SeqID_57771; Strand=+; Position=1 -175,246-420
  Homolog annotation: Hit_ID=NP_699259.1; Match level="QueryCoverage =100%, HitCoverage=33%, E-value=4e-39, Identity=64%"; Hit description= threonine aldolase, low-specificity, putative [Brucella suis 1330] gb|AAN33264.1| threonine aldolase, lo
INLTSDNWSGAHPKISEALLRHCDGGATAYGASVLDRKIERTFNEVFERDVAVFFVGTGTTAANALSMAYVNRAGGIIFAHRHAHLIEDECGAPEYFTGGARLVGVSGAEGRIEPEVI

SEQ ID NO: 131349 - protein, 87 aa, Heterodera glycines; identical to SEQ ID NO: 129152
  Coding regions on vcDNA: vcDNA=SeqID_57772; Strand=-; Position=1-672

SEQ ID NO: 131350 - protein, 142 aa, Heterodera glycines
  Coding regions on vcDNA: vcDNA=SeqID_57773; Strand=-; Position=1-427
MTPPFRTSVIAVTKRITFPSKPNMVTIHIPTAMWIVTIHIAVGMWMVTILGLLGNVIRFVKTMTGVLKGGVITAADVQDLKRGWTQLELDAKVGALKAKNDRMYQSICARLQGQAATIQRLRATKGLKRSRGDKRKTSVRGN

SEQ ID NO: 131351 - protein, 75 aa, Heterodera glycines
  Coding regions on vcDNA: vcDNA=SeqID_57774; Strand=+; Position=1 -130,236-333
MSACLTPLVAALQAQLSTLQRLREPQGLLRCRRHTTKPSARRNGKKKGLRKDQKTAGRRRVVIDDSSNGGGSRGL

SEQ ID NO: 131352 - protein, 76 aa, Heterodera glycines
  Coding regions on vcDNA: vcDNA=SeqID_57775; Strand=-; Position=1 -117,555-665
MALSAAKPALLQFTRPIDFYASNQKFMCPIKSLCVLISEGFPILWHHANEPEEREMDGHSYSNRAEQDIILDYVKR

SEQ ID NO: 131353 - protein, 21 aa, Heterodera glycines
  Coding regions on vcDNA: vcDNA=SeqID_57776; Strand=-; Position=1 -21,494-538
MNVIIAKARKEHLDLSNDIKD

SEQ ID NO: 131354 - protein, 106 aa, Heterodera glycines
  Coding regions on vcDNA: vcDNA=SeqID_57777; Strand=+; Position=1 -45,344-619
MCSYKNSLARPIGAAKSEQFSSLPQNQNILINKNKWKPWFKGPLGLIHTGANEIGYPTFGDLQLGDPTLGNPTFRDPTFGDFNKTKKILKKPLTDFCSRWPLGKAL

SEQ ID NO: 131355 - protein, 100 aa, Heterodera glycines
  Coding regions on vcDNA: vcDNA=SeqID_57778; Strand=+; Position=1 -66,599-833
MTNAQRQSQGFASPQVKTTANEQIKWLARVHELESTIESAKLVIRIALPPNLIEKWVNNENWAVLKENLKNIDMEDFMAYQDERRWFGCNFSTTVCDNWG

SEQ ID NO: 131356 - protein, 43 aa, Heterodera glycines
  Coding regions on vcDNA: vcDNA=SeqID_57779; Strand=+; Position=1-459
VKHPISALLCREPAGNGWLSICKKLDWQYVVVKNFWVWNYFLK

SEQ ID NO: 131357 - protein, 95 aa, Heterodera glycines; identical to SEQ ID NO: 124528
  Coding regions on vcDNA: vcDNA=SeqID_57780; Strand=-; Position=1-658

SEQ ID NO: 131358 - protein, 127 aa, Heterodera glycines
  Coding regions on vcDNA: vcDNA=SeqID_57781; Strand=+; Position=1 -111,443-512,693-895
  Homolog annotation: Hit_ID=XP_392952.1; Match level="QueryCoverage =99%, HitCoverage=43%, E-value=1e-30, Identity=44%"; Hit description =similar to CG10882-PA [Apis mellifera]
MQNTTDVEIAALDADKAVQIEIKYDDKLDEKEAAYFQLAVLFTSCGGQRRLRVHNVKMEISEQTLREKAPKEIRDELTLRCAQMLAAYREKCSEQAPLGQLILPECAKLLPLHVNCIERHDALNGGQ

SEQ ID NO: 131359 - protein, 15 aa, Heterodera glycines
  Coding regions on vcDNA: vcDNA=SeqID_57782; Strand=-; Position=1 -35,568-580
MHFSWFTCATFINFA

SEQ ID NO: 131360 - protein, 61 aa, Heterodera glycines
  Coding regions on vcDNA: vcDNA=SeqID_57783; Strand=+; Position=1-183
LIVSLVDLFGTADDLWPKSASTLTILLTIISLILAIAAAMLLVSGVQFRSPYLLVPHILMQ

SEQ ID NO: 131361 - protein, 109 aa, Heterodera glycines
  Coding regions on vcDNA: vcDNA=SeqID_57784; Strand=-; Position=1 -111,1132-1350
MPKYGNMDINREIWKNMENIDMESHPRSFKPSKHMLFAFLCGRLCERYTLIGKDSKNGEFGDVIDRHNPFILYEHHQWTTNQRTETPILSLLGREIASRWTPLHSDNGP

SEQ ID NO: 131362 - protein, 129 aa, Heterodera glycines
  Coding regions on vcDNA: vcDNA=SeqID_57785; Strand=+; Position=1 -122,256-378,440-584
MISNFGCFFLQFLPNFGLFSSVWIVFFVGVDRLISVLLPLRYGLFEQHLFIYILPMLTVTFGYSIYVLVEAAKWPLFVYPDWPVLCTNSDMFSFGMTTMLLRNGLVINGVSIICYLFVGLSLFWSWQKS

SEQ ID NO: 131363 - protein, 104 aa, Heterodera glycines
  Coding regions on vcDNA: vcDNA=SeqID_57786; Strand=+; Position=1 -84,357-587
FTCAALELPDFSDFARLRPLIDALIAELDLNDFLGCTAALEMLAETAATAPKCVPFFGQIGLLDKVYALFIRTKEEPDMGIIHIGINSQPNLDTLLRDFGPSQN

SEQ ID NO: 131364 - protein, 121 aa, Heterodera glycines
  Coding regions on vcDNA: vcDNA=SeqID_57787; Strand=-; Position=1 -52,142-210,354-451,546-690
MNRKRFIYPREGLKMVPCSLLQQVGCYGKSILCHWLFAKSDAKCDVFISQFTAPNNTKLSKEQIDVFCAKVEEDKVVWTEGSAYLAHIATALYACVEKGLLLCVHRKRIFAVGPRMNHLTK

SEQ ID NO: 131365 - protein, 209 aa, Heterodera glycines
  Coding regions on vcDNA: vcDNA=SeqID_57788; Strand=-; Position=1 -231,785-1183
MLLYHWQLQQVEAVRRLLLSAGWCLRSSSVAVGGGQCVRPFATRDGGQKRVSDDEWKTEREQYQKYEQHNQQQQQPRGAATENFCIFQPFFAPKKYIKIENCSQKRYNGIGGCGGFVYARPSAKLSFDRFCGGFTSDRAANAAWKKDDDDEEDEDGQVNEEEQRRRARTVAAEDGENARQTKLAGRHGRDRVSAETGTIIALRHFLAEN

SEQ ID NO: 131366 - protein, 236 aa, Heterodera glycines
  misc_feature (1)..(1): Xaa can be any naturally occurring amino acid
  misc_feature (38)..(38): Xaa can be any naturally occurring amino acid
  misc_feature (234)..(234): Xaa can be any naturally occurring amino acid
  Coding regions on vcDNA: vcDNA=SeqID_57789; Strand=+; Position=1 -99,271-436,490-640,684-904
  Homolog annotation: Hit_ID=XP_421759.1; Match level="QueryCoverage =91%, HitCoverage=37%, E-value=3e-32, Identity=35%"; Hit description =PREDICTED: similar to zinc finger, DHHC domain containing 6 [Gallus gallus]
XQIALKFPKFFPAAPIGTAGLRFPTIFTWFLPYLCVFXLYKFTGAGYSKIGWHPQDEEEWEYFRYCYRCLAFKAPRVHHCSKCNRCVLLMDHHLMDHHCPWINNCVGQRNQIYFIKFLVVSIVGSVHAAVVLTSCLYQVIFFVVQFMLQNPDSVQQNPLQSPSQFMLQNPDSVQQNPLQSPSDLSISSFYLFIASIFAVGLSYGVIIAVGILLIVQLRSIYLDRTGIESLKDKXLK

SEQ ID NO: 131367 - protein, 55 aa, Heterodera glycines
  Coding regions on vcDNA: vcDNA=SeqID_57790; Strand=+; Position=1 -97,169-239
MALNHPLVHWESWFLIKNIRSTGRESNPRLGMDGGAKVCQWHSVGEQRLAQGDGE

SEQ ID NO: 131368 - protein, 94 aa, Heterodera glycines
  Coding regions on vcDNA: vcDNA=SeqID_57791; Strand=+; Position=1 -241,566-609
MAVTNVKTEKMREKLAPQKLGAISNGKYSMTTDDKGGGNYNTPPYSSTLKNNSNNSDSNNCRKDNGGGASGLKNQQNPGIAARVADGNEGEQSV

SEQ ID NO: 131369 - protein, 84 aa, Heterodera glycines
  Coding regions on vcDNA: vcDNA=SeqID_57792; Strand=+; Position=1 -156,573-668
MAPKKFMPMELIVEIVTFLQFRRRWANVRVSRAFDHFLLEQIGLFLTKTNSSAKQCLTEFGEMIKNLPSKHKRNVFNESARNEG

SEQ ID NO: 131370 - protein, 63 aa, Heterodera glycines
  Coding regions on vcDNA: vcDNA=SeqID_57793; Strand=+; Position=1-189
MHVNVKNEKDNVMEMPKQQVLISTMDSFIFAPESVTKPLMKDLKLVQDNQVFKAGRSLGKTGL

SEQ ID NO: 131371 - protein, 37 aa, Heterodera glycines
  Coding regions on vcDNA: vcDNA=SeqID_57794; Strand=-; Position=1 -73,133-171
MIHQIPAKAPTRPELQQSGQCGCCRFVPQRSGTIQGG

SEQ ID NO: 131372 - protein, 97 aa, Heterodera glycines
  Coding regions on vcDNA: vcDNA=SeqID_57795; Strand=+; Position=1 -89,138-210,257-387
AMYFVKCHTIPKDNSVIKLNSRSARIHITRYALVIVQEVPPKQRLYLNLEDLSADVECVQNRFAFRALTYPWSTPQSFVFTSDQIPELTAKLQCLLK

SEQ ID NO: 131373 - protein, 36 aa, Heterodera glycines
  Coding regions on vcDNA: vcDNA=SeqID_57796; Strand=-; Position=1-108
CKAGTGNGLYPSPPHFISPIGLLPSRGALKRQRITS

SEQ ID NO: 131374 - protein, 281 aa, Heterodera glycines
  Coding regions on vcDNA: vcDNA=SeqID_57797; Strand=-; Position=1 -522,1569-1679,1738-1878,2004-2061,2245-2258
MKEKRERIFDLEYFYKSKKFEGAKTIKNGQNIELEIDQQHNAKEEGIEKVDLQFYIFIKPFGRDEVPLIGHARVKMAPEGWLLRRYLTMAVIWPNPSKRYVINLGRIDPPGLYWNRKLMVDQKNDHGTYHALLYANTIKIGRTENSEEKMLLGYAKLEKVYDQNEPAIDLKLNEFNEYQLSFPIKHSLFYKSIMEETELIENVELKIYQFENIFANKTNKREIKKKREEEICSICLEAMEYKNEQITEIHNDGKGKITVCTKQDLLSSLYDGSKFSAVINF

SEQ ID NO: 131375 - protein, 95 aa, Heterodera glycines
  Coding regions on vcDNA: vcDNA=SeqID_57798; Strand=+; Position=1-288
VNLLFASPLFIFIVIAYPPLIGTWGALFFMPMALISAVLLFLLYRWMPETKGLSVNTIFLRMAKLGLLNSSSEGSTTSINGDDEDEETEALILKN

SEQ ID NO: 131376 - protein, 95 aa, Heterodera glycines
  Coding regions on vcDNA: vcDNA=SeqID_57799; Strand=+; Position=1 -56,483-714
MLLYLFLYLCLHYSVFGDGPPPHIFPAPSKCESGTLFAPSFCSSHFFYLCSNGQPIRMKCPADLVFDQLISVCNYKNACGKRQQPYASCGRITIF

SEQ ID NO: 131377 - protein, 76 aa, Heterodera glycines
  Coding regions on vcDNA: vcDNA=SeqID_57800; Strand=+; Position=1 -123,412-497,542-562
VNGKRPLNGQLGHYQNDEAAIHSNGMGEGIFKISAISRIPIGLVGWWMVKSGLDPSNNSNSDVPRVSHYRVASPTS

SEQ ID NO: 131378 - protein, 57 aa, Heterodera glycines
  Coding regions on vcDNA: vcDNA=SeqID_57801; Strand=-; Position=1 -82,509-600
  Homolog annotation: Hit_ID=CAE62837.1; Match level="QueryCoverage =98%, HitCoverage=29%, E-value=1e-09, Identity=51%"; Hit description =Hypothetical protein CBG07016 [Caenorhabditis briggsae]
DKIAGDGYSYTDDNVCVFNNVVTSRGPGTAFEFALKLVEMLVSEEKAKEISNSLLVH

SEQ ID NO: 131379 - protein, 24 aa, Heterodera glycines
  Coding regions on vcDNA: vcDNA=SeqID_57802; Strand=+; Position=1-72
MTPNCVFPKFCRRNSSLWSTQIRK

SEQ ID NO: 131380 - protein, 34 aa, Heterodera glycines
  Coding regions on vcDNA: vcDNA=SeqID_57803; Strand=+; Position=1 -10,96-190
MNCNQINIRVQRDREIWARPGPGLFWLKTRDFFG

SEQ ID NO: 131381 - protein, 123 aa, Heterodera glycines
  Coding regions on vcDNA: vcDNA=SeqID_57804; Strand=-; Position=1 -88,512-795
MTPIFLPIALCILLHTVSFPHNAHAAGDYASDDEQNFPLLDSEDSSSTASFTDTENYESHTDSSGHSNQTPKKRWQKAGKQIIKNYDWKKVEYYLNKEVLPNIRKEVQYPNANGFCVSANKKK

SEQ ID NO: 131382 - protein, 76 aa, Heterodera glycines
  Coding regions on vcDNA: vcDNA=SeqID_57805; Strand=+; Position=1 -33,569-766
  Homolog annotation: Hit_ID=NP_571369.1; Match level="QueryCoverage =97%, HitCoverage=62%, E-value=2e-18, Identity=46%"; Hit description =superoxide dismutase 1, soluble [Danio rerio] emb|CAA72925.1| Cu/Zn -superoxide dismutase [Danio rerio] gb
MAAGAHFNPYNAEGVAVVNIQDRLLKLNGLHSVVGRALVVHEKRDDLGLGGNAESLKTGNSGKRVGCGVVGITKEL

SEQ ID NO: 131383 - protein, 46 aa, Heterodera glycines
  Coding regions on vcDNA: vcDNA=SeqID_57806; Strand=-; Position=1-439
CKSFIVNFQFPHLQNNLISLIKIPELNSLIKKRILSNIFVPFVPFM

SEQ ID NO: 131384 - protein, 176 aa, Heterodera glycines
  Coding regions on vcDNA: vcDNA=SeqID_57807; Strand=+; Position=1 -111,216-414,473-690
  Homolog annotation: Hit_ID=CAE72125.1; Match level="QueryCoverage =94%, HitCoverage=17%, E-value=9e-32, Identity=41%"; Hit description =Hypothetical protein CBG19221 [Caenorhabditis briggsae]
MTAAWHRTDPKLKAERRMAETLAEAAVAISITSFTDMLSFGIGCFTTLPVVRLFCLYTFFGIFFTYLYQITYFAAVMAFAGQMEQSGDHSLLFGLRALRPEEADSTFKRWMLAGSSAEAAADEGEEKGGEMKPNGAKDGKRRERDKCQRVEGTEEDNWQTEGQKDQKRDGQKDQEE

SEQ ID NO: 131385 - protein, 139 aa, Heterodera glycines
  Coding regions on vcDNA: vcDNA=SeqID_57808; Strand=+; Position=1 -154,251-516
MRWNSTFQQLPPNQQKEMYNLVKNGPNSASSSRSPQPFQSSNQFPSNQFGSGTVPLGKAYLGQQPLVASGSSSRPLQSSGTFLRPNHSRNPRFNSSGNFQVPQNSSANASASSSSFHSLFGLEDPQKNTFESMFGSKKG

SEQ ID NO: 131386 - protein, 257 aa, Heterodera glycines
  Coding regions on vcDNA: vcDNA=SeqID_57809; Strand=+; Position=1 -106,489-665,1192-1334,2106-2317,2864-2999
MESDLDKNNVCQFQTTFPLHDYLNKINRDLEVEQKFKSERQLKRFINFAKTRSSPPINSDVHPISKISISMKNFPIGPYELFDFQNKSESVMIEAVKQDANETDQSSGIANMIEIIDPLKCSELCGVADELFIEKDEHQSFRTVGGEVITDNYYPWVVFVRVHVHCAYSAPIYIHCTGVLISFKHVMTAAHCMHLNTTMLNECIGWMKFFPAGRSLGVYFSLFCIFLVKNCQKWPKYGPKMLFLSPFLHSICAEKIC

SEQ ID NO: 131387 - protein, 179 aa, Heterodera glycines
  Coding regions on vcDNA: vcDNA=SeqID_57810; Strand=+; Position=1 -212,920-1076,1121-1172,1446-1508,1638-1693
TVGGEVITDNYYPWVVFVRVHVHCAYSAPIYIHCTGVLISFKHVMTAAHCMHLNTTMLNECIGWMKFVPAGWKKTELHDVYIHFSSSTMSETKIEKVRRISIVKDFDMSHDNLLRPDDLAILEAFLILYSDTLIVMWGRREHVGSVFVAQFIIIPTTKHFIAKPNIRPKSGQCCSDLLV

SEQ ID NO: 131388 - protein, 161 aa, Heterodera glycines
  Coding regions on vcDNA: vcDNA=SeqID_57811; Strand=+; Position=1 -152,475-586,1276-1499
SNYLNKSQTATLVPIRSAIYCNKIYNNILPWKYNPSKFVCASSRNKGITSGDCGGPLMIERNGLYYLIGIVIAAYHPKAGFYRKYVPDVYTRVNSFDSCGFVELVTNNEATCFQEFLKSDRLETVCATQHAQILEKTLRKSCEYVSVDQMCYIGMMLFSHP

SEQ ID NO: 131389 - protein, 318 aa, Heterodera glycines
  Coding regions on vcDNA: vcDNA=SeqID_57812; Strand=-; Position=1-956
  Homolog annotation: Hit_ID=EAL44122.1; Match level="QueryCoverage =89%, HitCoverage=54%, E-value=3e-13, Identity=25%"; Hit description =conserved hypothetical protein [Entamoeba histolytica HM-1:IMSS]
MSSSIDHLFEEMLGTDEPKKGEKEEANSESQKKFEKEVEKLKKEMKEEEAKRTQKRLEEEVTKLKKSLAKMKKEKKAEKRKTDEMEEEKAMVMNKIKKVQNLEEKEGIGESNEEIEERKEKQRIRQVLVDDEIYLNLEEEEQMLYEPLKGQETEKFGFFESCLNRAKSKTKMENGSEMIKPKKATNPFRLLKAEINSAEMDIVGRRGEEIPPEGKKLGNGWKSEGNGNEGVIKKLGEIRQMALSINEEVQNVLGLIERKGEIQHWQENGAWNRRGRGRGGNFYQHGSGRGNWQQRGRGHIHRADWTTPCTSRSMMNEW

SEQ ID NO: 131390 - protein, 127 aa, Heterodera glycines
  Coding regions on vcDNA: vcDNA=SeqID_57813; Strand=-; Position=1 -220,542-705
MKRKLRQSQKLIEEKEEINEDTKRELVRKFEEMRKEKIYGFKLENKNIAKIEREIAKDLGISRTKIYKWKKEFAKQKKYTKTEKLESVEKFDRMKKKNPNLSGAQIAKKLEIRMRNVRRWRKQFGTD

SEQ ID NO: 131391 - protein, 158 aa, Heterodera glycines
  Coding regions on vcDNA: vcDNA=SeqID_57814; Strand=+; Position=1 -168,592-753,796-940
MDLRIVTHRQPFQHHRPISYATEGIVEYPAQEYGEIHGQIMNTPSGNHKILVQDEERGNGTSCSAALLDAGLDDVFRRSEEIWSRKQSLRPTAVGMGASLKTYQDLVGGTSQLSSTRLPMSKVAEKPPSADASDRYEDINTDVLNERFTDAETNKFVQ

SEQ ID NO: 131392 - protein, 75 aa, Heterodera glycines
  Coding regions on vcDNA: vcDNA=SeqID_57815; Strand=-; Position=1 -22,212-261,307-399,752-814
MPVVAAVGLAPAVANAVAVAVAGHAVAAAVAAAVADVRSAQLSSARPLKRPKPENLLHQPPKCQCHHSHAHQQKI

SEQ ID NO: 131393 - protein, 236 aa, Heterodera glycines
  misc_feature (211)..(211): Xaa can be any naturally occurring amino acid
  Coding regions on vcDNA: vcDNA=SeqID_57816; Strand=-; Position=1 -101,502-567,735-854,1171-1281,1333-1398,1653-1851
  Homolog annotation: Hit_ID=NP_741242.1; Match level="QueryCoverage =100%, HitCoverage=42%, E-value=2e-71, Identity=57%"; Hit description= dipeptidyl anminopeptidase (3J129) [Caenorhabditis elegans] gb|AAM48526.1| Dipeptidyl peptidase four (iv
NSEWGRKMHQDLLDGVDFLVSNNIADRRQVAIMGGSYGGYATLVGMTFTPDIFACGVDIVGPSNLITLLDTIPPYWLGFYNDMITMLGADKNTEEGRRFLKSRSPLYFANRVKNPLLIVHGANDPRVKQAESDQFVAALKRNHIPVTYQFVAALKRNHIPVTYILFPDEGHGPRKPHNTLAMAGFIEEFLHQCLHGDIEPFNLGKTIFGSXKLFKKFLISGQYNSTAMVAFVHNYF

SEQ ID NO: 131394 - protein, 88 aa, Heterodera glycines
  Coding regions on vcDNA: vcDNA=SeqID_57817; Strand=-; Position=1 -152,1107-1221
MKVMADAKTSITGLRSQAKNFNAEERQFHDLKFSHSLHMNPPDASAGVDKKTSPIADREAEGNMRFREIMQQRASKLPLGGEEPFAAL

SEQ ID NO: 131395 - protein, 56 aa, Heterodera glycines
  Coding regions on vcDNA: vcDNA=SeqID_57818; Strand=+; Position=1 -21,155-304
MILFNHNRNHWLFRENKCSVIPGDKKKALPRMRQKDGSRKLIQHSFLSLFIMTVLI

SEQ ID NO: 131396 - protein, 139 aa, Heterodera glycines
  Coding regions on vcDNA: vcDNA=SeqID_57819; Strand=-; Position=1 -37,155-208,418-566,1254-1435
  Homolog annotation: Hit_ID=NP_741242.1; Match level="QueryCoverage =100%, HitCoverage=27%, E-value=2e-38, Identity=56%"; Hit description= dipeptidyl anminopeptidase (3J129) [Caenorhabditis elegans] gb|AAM48526.1| Dipeptidyl peptidase four (iv
RPSGTPVIESMSMDFETWLVSFISDDQPFDIFIYYFFVKIAATTRPELAGRPLSKMIGFDYSARDGLRIQAYLSLPPQTPLLSPAQVRGDKLELARQGMLPRRPQKLIVLVHGGPKSRDFFGFAAINAWLTSRGYAVLQ

SEQ ID NO: 131397 - protein, 288 aa, Heterodera glycines
  misc_feature (36)..(36): Xaa can be any naturally occurring amino acid
  misc_feature (234)..(235): Xaa can be any naturally occurring amino acid
  Coding regions on vcDNA: vcDNA=SeqID_57820; Strand=-; Position=1 -158,224-360,407-547,674-807,890-989,1088-1177,1226-1252
  Homolog annotation: Hit_ID=CAE62478.1; Match level="QueryCoverage =82%, HitCoverage=67%, E-value=2e-46, Identity=41%"; Hit description =Hypothetical protein CBG06575 [Caenorhabditis briggsae]
GTEVSDNLLGYFVRGKNGSEWKREENDQIRAITKHXSHITEMFAAKLEVCESFSHRMFSKSFSHRMFSKDYVVLRAANKAKLGHFCALVDRGMIKDHFKFLVMDMLGDNLFKLLGDNLFKLRLQFQQHRFSAPTSLRLALEMLESLEQLHSFGFVHRDVKPTNFALSENGQSGGRVILLDFGLCRHFQTATGGIKPPREKTQFRGSVGSVRYASLAAHRAMELSPKDDLESWFXXVQQLISGDLPWSHFSAAERDSVKRAKENARTMDGMVHLLKYCPRVHLLKYCPR

SEQ ID NO: 131398 - protein, 46 aa, Heterodera glycines
  Coding regions on vcDNA: vcDNA=SeqID_57821; Strand=-; Position=1 -72,120-185
GQFNGRIFNNKLNNLGFPTFITFAQLMDPSRGFYDKDGDKVTLAVD

SEQ ID NO: 131399 - protein, 351 aa, Heterodera glycines
  Coding regions on vcDNA: vcDNA=SeqID_57822; Strand=+; Position=1 -213,293-448,1024-1173,1230-1466,1507-1806
  Homolog annotation: Hit_ID=NP_386245.1; Match level="QueryCoverage =30%, HitCoverage=73%, E-value=4e-16, Identity=40%"; Hit description =HYPOTHETICAL TRANSMEMBRANE PROTEIN [Sinorhizobium meliloti 1021] emb|CAC46718.1| HYPOTHETICAL TRANSMEMBRA
MSKYSSSFYTPATEPNCHCASIRKLGICASAAFTGAALYINLVEQPSRLQLETAAALKQFKESYTRAIPMQAGLAILSGIVGIGGTIKTGEKAWAFGAALMLANIPYTFLCVFPVNKRLLATNRGTAGVQGWLAYLPKPTLAPLNSRLIAGRRHLNRMLMSDTFFCVALEAQLYFPGIHNDRQWTNTIRTAFATTFNSNHSIVRRMQLIPRWEQDIVCPPRFPISFWNVYTRAQMAIERTNNGMEAAHGQFARDLNHHPSLSDFIAAFMKDINKQLDIGRAEQLQKSTKRRQRYVIKEQNVVRILDEADFESEEGLTNALHLLGIVMQGFAEGLHVRGNSENGEETEADEN

SEQ ID NO: 131400 - protein, 32 aa, Heterodera glycines
  Coding regions on vcDNA: vcDNA=SeqID_57823; Strand=-; Position=1-256
KYADPQNVQPTKCPSLEFEFFIIQMGLRLGKG

SEQ ID NO: 131401 - protein, 229 aa, Heterodera glycines
  Coding regions on vcDNA: vcDNA=SeqID_57824; Strand=+; Position=1 -216,267-741
  Homolog annotation: Hit_ID=AAL78214.1; Match level="QueryCoverage =56%, HitCoverage=75%, E-value=7e-11, Identity=29%"; Hit description =putative esophageal gland cell protein Hgg-20 [Heterodera glycines]
WICNDVWMDIFPSFDRPQLGLKMALLSPRFNSLVDKHFDGKSELTIWRPIEIFPLRDRPLPSKIRFKDLRIEYIDHSVIAFLRSNHQIFDKRGTNLDLWIYYSNTTDGQRIWDVFVREIWPIFSENIRHLGFYDAVNLDNLLRRTSSTILTDLNQLNSINLFGLSPAAFGDDFDVPNSTISAGQALSKWLHSPRKDGQPKRLRCDNYNAQGNTDWINNFKEVTIITTNY

SEQ ID NO: 131402 - protein, 371 aa, Heterodera glycines
  Coding regions on vcDNA: vcDNA=SeqID_57825; Strand=+; Position=1 -279,332-773,823-1097,1158-1278
  Homolog annotation: Hit_ID=AAL78214.1; Match level="QueryCoverage =50%, HitCoverage=95%, E-value=2e-15, Identity=30%"; Hit description =putative esophageal gland cell protein Hgg-20 [Heterodera glycines]
WICNDVWMDIFPSFDRTQLGLKLALLSPRFNALVDKHFDGKSELTIWRPIEIRRKDKGPEPKLSVRIDYKFVEFPLPDRPLPSKIRFKNLRIYYIYHSVIAFLRSNHQIFDKRGTNLELWLPYSHTTNGQRIWDVFVREIWPIFSANIRHLCFSHRDHLDNLLRQISPTILIDLNQLTSIKSFGLLPAAFGDDFDGPNSTISAGQALSKWLHSPRKDGQPKRLHCADKQTNFDWINNFKEQFLRANAISSVSYEIHFYVRTPSMPMVPFELVNEWTKEKLTLAKAKGWDNRWIMKRCKIIGETAVVNWEDGNWDNNCNSVFVWLFRTTNCIGPLSPPPAEEAGQNITKGPSSELTMSDGQTKKNSDQPQKE

SEQ ID NO: 131403 - protein, 108 aa, Heterodera glycines
  Coding regions on vcDNA: vcDNA=SeqID_57826; Strand=+; Position=1 -206,267-387
MPMVPFELVNEWTKEKLTLAKAKGWDNRWIMKRCKIIGETAAVNWEDGNWDNNCNSVCVWLFSTTNCIGPLSPPPAEEAGQNITKGPSSELTMSDGQTKKNSDQPQKE

SEQ ID NO: 131404 - protein, 243 aa, Heterodera glycines
  Coding regions on vcDNA: vcDNA=SeqID_57827; Strand=-; Position=1 -74,295-408,484-1027
MSSTVLQNALRLLFITLIIFNCCHGASTRVKHKKPTDETTSTNEFAGLSVKLWIIIGVSVLLVLVVVCAIVVICCLCRERRFGHDNDELSTAVSSSYYKSRQGPTDSRDWPPTSASGHGHGRGGRSGGGAITAVPSGMMSKMPTMKTKQPFSFRMLMPKSLRSIGPSRPAPSTATMERGGAQTKLKTTTMLGGGDQTKVKTTTMLGGGDQTKVKTTTMLGGGDQTKLKTSSTVPSGGEHYTTW

SEQ ID NO: 131405 - protein, 51 aa, Heterodera glycines
  Coding regions on vcDNA: vcDNA=SeqID_57828; Strand=-; Position=1-155
LQIYWLKLHMRYISKFFDSVRRFDKDGFRFAISRSTFGNWSRIFSAITGNH

SEQ ID NO: 131406 - protein, 311 aa, Heterodera glycines
  Coding regions on vcDNA: vcDNA=SeqID_57829; Strand=+; Position=1 -308,561-879,1253-1467,1542-1635
MAILTPIKGQPTEQSHQHHHHQQQQQQQPTQHVPIQREDIATQTDQQADEEAATAPALVAAAVTQAQHQPKQQQPPPQVTTTNANSTTPPTPQVETSNNNNKRDPNVMVDDQQQQQPKQQQMVPPPSPLQNIGQTMRKVKSATTPYEALRCELIDALVVQPKLRQQQNNNGNNDGTGNNDGTGNGHRGGLRRQKFKSICHPPPFSPLFQLFRFAFILLCFYFGMGFMERLAVAMIAACVRWAWPPVHFMLGSSRGTLFYLTDWFAWMEDFLSSWVCDMANRYCHQYGVMCDSQCSFVSRTQRAASFTGRRF

SEQ ID NO: 131407 - protein, 1375 aa, Heterodera glycines
  Coding regions on vcDNA: vcDNA=SeqID_57830; Strand=-; Position=1 -2238,2953-4842
  Homolog annotation: Hit_ID=NP_505184.1; Match level="QueryCoverage =62%, HitCoverage=50%, E-value=1e-102, Identity=30%"; Hit description= reverse transcriptase RNase H-like protein family member (5I956) [Caenorhabditis elegans] gb|AAB69941.1|
MLVQTGLNSEGNSRPPEARTKTKRKPKRRTNDPAIQSEKRGERSLGTDQRAFTAMGESLPAYLMVCPVVAANDDITRQRPTALLLDPGSQVDWVQTILTEQLELPTAGSAPLVVQVFGGSKKRVPSSRHRLKLKRLDGGWEPLEVSSVPNVCTPIQTKLVGPGTPGLLEPVGATLQPQIVIGIRKFWDFVIGFKKSAEGAFLIDTVFGTVLCGEHFGAHLGQPAPHNHILMAITDEDSGWSRMPAPSAVEQFWSLETIGIRDDPTGDADTEAIIQFEKSVRQNEDGRYSIRLPWRDPIPALPSNFAVAYRRLTSLIGRLQRMPDVLERYRAVIEEQFSTGIIEKAAIGANQREHFIPHQAVITPKKLRIVYDASAHAKGAPSLNDCLLRGPVWLPDLAGMLLRFRACQVPVIADVEKAFLMVEIEETDREVCKFLWVRDPTRPVTTDNLLPLRFRRLAFGLTPSPFCLAAVVRHHLRKFGSDFAEQLIRDTYVDNVLIPADTREEAAEKASLAKRMFTDARMNLREFLSNDQNLNREFPTDDYLGKTTTKMLGLEWDSERDEIRMNYPGIPPDCATTNSRRSVLKMIASLFDPLGTLAPATLAAKRFFQRLWDATHDWDSPLSPADQREWERITASWDGEVTLIPRKVISGTGLSLSLHIFTDASEFAYAAAVYIRSEGPDGIFSRLLMAKSRLKPKKAADTFTIPRMELMGILLGVRLAAFVRAQLHRPVAEQHLWSDSMIALHWGYWTPGARQQARKVIKSCRKCRRMEAAPYALPPMPPLPADRVRRRLPFESVGLDFLGPTAALDESGQRRKAWVLLITCLTTRAIYVDATRDLSADSLITLLRRFIARRGAPSRILSDNAPSFTLVGRTLSSFGVTGNDPVAFTDSRGIKWRFTPSHTPWAGGVFERALQKTLGSWVISYDELITLLAEVEAAVNLRPLTYVSDGAGDPLPIRPIDFIQENGRLGIGPLNPASELPPDRKDPPHVQLEKRWKAAQQRTEHFWRRWHSEYLLQLREKAGWQHRNRRVVAGGTPKVGDVVLVEDKMQPRNVWQMGRIIELRGPPDQIRSVLIRMPNGRIWGRPVNKICPLEESPESERDGTAETCESGDIRGDLIPPGPIMQQTEPQDEDNAEPTQQEAGTIGESVPASAEETTEVVGQSGQDKEGAQIERENNPVALRRSQRDRKIREIRDPEWSMPRKPQKRKFGQSRIGLTLFAVLMWTGTVVGCQPAPRNSRLTALRDSNDLKNPCEMSCAARGVTVYSDESVDKLEICCADGCWATSPKNPETHYELPVEPPAADIFGKTGGLDDILVVFQAGSGRQAHPGLRKAASSPSLLKGRIPSQEGCRGLHPVGRELSRGHSTAEGTIWGHG

SEQ ID NO: 131408 - protein, 19 aa, Heterodera glycines
  Coding regions on vcDNA: vcDNA=SeqID_57831; Strand=-; Position=1-60
EPVNSCIGCKCRRCCTPNS

SEQ ID NO: 131409 - protein, 344 aa, Heterodera glycines
  Coding regions on vcDNA: vcDNA=SeqID_57832; Strand=+; Position=1-1035
  Homolog annotation: Hit_ID=EAL50110.1; Match level="QueryCoverage =79%, HitCoverage=41%, E-value=2e-09, Identity=23%"; Hit description =hypothetical protein 28.t00024 [Entamoeba histolytica HM-1:IMSS]
MNNQKKSGPMGKGSEPKNGSDFEAEFFTAEENKLFRQLLGRLRTFEAAVCSQFRQMENEISKRTNETSTHLGTMERSINETNASGEIENFEREEKIAKLEGEIDNLGDKWAEYKENAQRELSELSIKMEKNFNETKSSIDGVKLKLESVENELKKSIDVVETRVEFLEMENASDEDMWIDNGHEDANFTDGNVQKNEGEDEEMDESEDKNNGEMEDESGENEGNKDKSCELMMADPFFMNVAPPGVYDGNPAMPFSRWYEKFKDLLLLCPQLNEEQKLSRLRVCLAGQARGELDSMSPAPETLQAAIDHLKRKFENENTKSIARQAMSICKQAPGEKVMNSRTD

SEQ ID NO: 131410 - protein, 65 aa, Heterodera glycines
  Coding regions on vcDNA: vcDNA=SeqID_57833; Strand=-; Position=1 -58,114-251
MNFIFLLNFLFVAIVFCGARKLYYPECENKKMFKGQWNYTYSSYGNDLCHTQAEHFQCIEFKCSI

SEQ ID NO: 131411 - protein, 32 aa, Heterodera glycines
  Coding regions on vcDNA: vcDNA=SeqID_57834; Strand=-; Position=1-3,55- 150
MDRTGLGILRNLGTVNPVLGHKPTKKGKKSGT

SEQ ID NO: 131412 - protein, 654 aa, Heterodera glycines
  Coding regions on vcDNA: vcDNA=SeqID_57835; Strand=-; Position=1-1965
MVFHGPPVSESEPEPEIIVTEEVSSSELQEENERRVQRAGHTPPSAPHIPEPEELRIECYQQSWPKGEQYVGYNILTECSGERHESCAKCTYRQIASTRKKQLNGFEDCKANSLMNAMLFDLVQRLLNLRSETVVLHEEYVMPSILTPKQLAEKFWKEQFVTKNRQLVKQASLMDLLKQWSTSCDHFGALMQLNQFEPIKLRPISIEGKETSEFENWLENLNKFTANVASRTKAAIANQHYSNHEIICVGDLAAEELANASRTQWFTHYASDRLHLSPGPDVQHIIFCYLANESDLTKGITPYIRELAKTDIQLTIVLAKTDDKSWLKNKNECYQLAKAAKAGFFVYHRRTGEARQLTDMILAREEDEIMEVDPTPSTSAASSSGLMSRNSINTLMVISMFALMFLQPTAAAPLRIHRASLSQNAQRFLQMVSAHYSTLTTAPPSELTITLSTALRPVTSSWYSTITRTEMMTTTKTNPWTTTTWASMTTTKQRWTPMMSNSASTWTTRRTRILYVTKARSQQTDATTPSGTIKSAKRDLGTNRDGADVFWCSDRGSTIWELKGPESSPFCRPPPTLTAQWHNLAIELFAKVIKPEQIAFAWHCSIKRTSERYYTNLLADKFVTIEKEFPPVSKRICNAGIFTIVTEFPENAHL

SEQ ID NO: 131413 - protein, 69 aa, Heterodera glycines
  Coding regions on vcDNA: vcDNA=SeqID_57836; Strand=-; Position=1-210
MSIIPGTSPEGVRYAGVTVFSKHRTYTQAQKMAMITMKICPRLYEIQLFGNALGVDHDTASARALAREV

SEQ ID NO: 131414 - protein, 25 aa, Heterodera glycines
  Coding regions on vcDNA: vcDNA=SeqID_57837; Strand=-; Position=1 -46,415-446
MSIIPGTSPEGVRYADGSSPAGQKN

SEQ ID NO: 131415 - protein, 49 aa, Heterodera glycines
  Coding regions on vcDNA: vcDNA=SeqID_57838; Strand=-; Position=1 -135,1187-1201
MPKYGHKICIKMPKYGNMDINPEIWKIWIWKPILEASNQAKNMFFRPNN

SEQ ID NO: 131416 - protein, 112 aa, Heterodera glycines
  Coding regions on vcDNA: vcDNA=SeqID_57839; Strand=+; Position=1 -135,272-368,914-1020
  Homolog annotation: Hit_ID=NP_491486.1; Match level="QueryCoverage =68%, HitCoverage=6%, E-value=4e-28, Identity=80%"; Hit description =SMC protein, N-terminal and structural maintenance of chromosome protein SMC, C-terminal (1F522) [Caenorha
MDNLSGGEKTVAALALLFAIHSSNPSPFFVLDEIDAALDNTNIGKVVHYIGERSRTDIQLIVISLKEEMYNKADSLIVDSLSQKGLLEANRQPPISHSTLSFLMERKKDPMS

SEQ ID NO: 131417 - protein, 336 aa, Heterodera glycines
  Coding regions on vcDNA: vcDNA=SeqID_57840; Strand=-; Position=1 -47,110-385,437-860,913-1083,1139-1231
  Homolog annotation: Hit_ID=AAL78214.1; Match level="QueryCoverage =43%, HitCoverage=76%, E-value=6e-13, Identity=30%"; Hit description =putative esophageal gland cell protein Hgg-20 [Heterodera glycines]
MSDNRKEAEAKMEKAIFISADCWLCAFDLLSPRKLGLGIALISHGFDFYVDEHFKTRKWTFGIIRIGSKIGKNGTKEMDVVNCYQRPMPIPQNPLPKKVVGFKAISLDYIDRNVIAFLHRFRQLFAVCPINLSIQTARDDYRISEFILRNIWPMLGKNIHAIEMSVRIFNHLRQFVPSILNECPPLRVVSFSVDLFIAFPTDDNAAASDGQAVAKWLFTPLQSNVPKVLRSPLDMNDGFLVSDIEDFKAAFASASSPVNFIVVIQFPPSFANSVVPFVMTNELTREHLALKRTKWNTSFLLIRCPIFHLRRLLALCLRIASPASAWLWHCDDQPPF

SEQ ID NO: 131418 - protein, 265 aa, Heterodera glycines
  Coding regions on vcDNA: vcDNA=SeqID_57841; Strand=+; Position=1 -41,282-1050
  Homolog annotation: Hit_ID=NP_508646.1; Match level="QueryCoverage =95%, HitCoverage=13%, E-value=1e-42, Identity=40%"; Hit description =predicted CDS, RNA-directed DNA polymerase  and Integrase, catalytic domain containing protein family mem
IVPPVELEIHWLVKQLWSLESIGIRDPLDPNDESLALALFSDSVKFKEGRYEVGWPFRGGKDRLSTNFSLAYSRLSALSHKLRDNSEFREKYQATITEQIERGIIEPAVRKGAQEHFITHHAVVSKKLRVVYDASAREKGKASLNDLLLPGPNLVPELAGILLRFRASTCPVLGDIEKAFLAVGLREEDREVAKFLWFRDPSQPLSHQNFVVYRFKRIAFGVNASPFLLALVLRHHLSTRGDPLEMAKNFYLDNLLICSESPEKR

SEQ ID NO: 131419 - protein, 20 aa, Heterodera glycines
  Coding regions on vcDNA: vcDNA=SeqID_57842; Strand=-; Position=1-62
MAATAQRMAHKSSLCGKSGR

SEQ ID NO: 131420 - protein, 37 aa, Heterodera glycines; identical to SEQ ID NO: 127515
  Coding regions on vcDNA: vcDNA=SeqID_57843; Strand=+; Position=1-117

SEQ ID NO: 131421 - protein, 82 aa, Heterodera glycines
  Coding regions on vcDNA: vcDNA=SeqID_57844; Strand=+; Position=1-249
MSLRKCPSANVRPQMSVRKCPSANVRPQMSVRKCPSAKVRPQMSVRKCPSANVRPQMSVRKSPSANVRPQMSVRKCPSANVW

SEQ ID NO: 131422 - protein, 93 aa, Heterodera glycines
  Coding regions on vcDNA: vcDNA=SeqID_57845; Strand=-; Position=1 -206,267-342
MVPFELVNEWTKEKLTLAKANENEWDDIWIMKRCKIIGETAAVNWKDGNWGNNCNNVFIWLDSDTNCIGPLSPPPAEETGQSITKVASSADDE

SEQ ID NO: 131423 - protein, 31 aa, Heterodera glycines
  Coding regions on vcDNA: vcDNA=SeqID_57846; Strand=+; Position=1-100
LFNFLFLTASIFYNNLSVWSDVRQTEKIIKI

SEQ ID NO: 131424 - protein, 166 aa, Heterodera glycines
  Coding regions on vcDNA: vcDNA=SeqID_57847; Strand=-; Position=1 -11,79-174,412-803
MNRRWICNDVWMDIFPSFDHAQLGLKLALLSPRFNAYIDHFVIAFLRSNHQIFDKRGIDLHLWIPYSNATNGQPIWDIFVREIWPIFAPNIGHLTISNAEHLDNLLRRTSPTILIDLNQLNSIKSFDLLPAAIGDGFDGPNSTTSAGQALSKWLHSPRKDGQPKRL

SEQ ID NO: 131425 - protein, 61 aa, Heterodera glycines
  Coding regions on vcDNA: vcDNA=SeqID_57848; Strand=+; Position=1 -59,113-239
MSSAGVTETLISPSSYIEKHTLSGLLTEDVLHFAIGKNITINVEEKAVPRVRDSARAKWKK

SEQ ID NO: 131426 - protein, 308 aa, Heterodera glycines
  Coding regions on vcDNA: vcDNA=SeqID_57849; Strand=+; Position=1 -648,694-789,962-1014,1133-1182,1221-1300
MCVIFEQTDRTREIVVNLQAFSAVGYSEATQKNMQNGKYYKIFVPDFILLDVVECKFGIFIKPKEQNENGNEKKGKKKAIIVENQMDKDEQKMWTMHRSVKLNLSDIHTLMKKPIVVNLGKIGGPELFLKRRIFVETNNDLGNYHAFLYAIIEGNEQNANEMNEKKRIFIGHAPFVKFDEEASSSSQANHKKKSLLKNFLSGKSKQMEKALPEGQQLIEYHLSIPIEEKRMFGHKICDLILAIFHDQKGDKIEEVLNVTNFEETENIYFTNHASLIGNLEIISLKHNQKYAAQFAIGNQHLSWSVFDE

SEQ ID NO: 131427 - protein, 18 aa, Heterodera glycines
  Coding regions on vcDNA: vcDNA=SeqID_57850; Strand=+; Position=1-56
YREAIPEGFGLPINLGAS

SEQ ID NO: 131428 - protein, 40 aa, Heterodera glycines
  Coding regions on vcDNA: vcDNA=SeqID_57851; Strand=+; Position=1-123
KKSIFLFSGQSPPNRCAQIYGETESFGNSFPIACTLFCVG

SEQ ID NO: 131429 - protein, 53 aa, Heterodera glycines
  Coding regions on vcDNA: vcDNA=SeqID_57852; Strand=-; Position=1 -101,151-211
MPDMVRIMGLLAPLSIPSTPIPDNLVRVISVRFECLNNNVLTVMHHFHRLFFT

SEQ ID NO: 131430 - protein, 280 aa, Heterodera glycines
  Coding regions on vcDNA: vcDNA=SeqID_57853; Strand=-; Position=1 -12,718-858,1095-1173,1218-1306,1401-1554,1602-1726,2064-2201,2254 -2358
  Homolog annotation: Hit_ID=AAV73809.1; Match level="QueryCoverage =46%, HitCoverage=79%, E-value=7e-25, Identity=47%"; Hit description =superoxide dismutase [Gryllotalpa orientalis]
MDDSAFFKLKENYQDAIAAGQDWNIVRQTARDDIACNNVMVALDRLMDVPQKDGEYVHVTVVISGLGPDQQHALTINQFGDLSVSSGNFHSVGKHFSHPGQKHGPPEAVSRHVGDLGNITADPKGVAKSNWSDKVISLYGQNNIIGRSVAVHARKDDFGEGTQDVIRSRESGNAGPILSCGVIGLAFDTNMSTRSEDFQREFLQLTQAYRAAETTKRWNMVVGCASGDDKCGALIKSLQQLMELPVHPQQCDSGPRKAVCWLACPKMKDTKGAITFKQVC

SEQ ID NO: 131431 - protein, 69 aa, Heterodera glycines
  Coding regions on vcDNA: vcDNA=SeqID_57854; Strand=-; Position=1-210
MKKIKLNPILDIGANELVTVTKHSLSKAMKRVASHLDGRCHAGQRSHERIGAGKDEKCCQTEQKSAQKR

SEQ ID NO: 131432 - protein, 182 aa, Heterodera glycines
  Coding regions on vcDNA: vcDNA=SeqID_57855; Strand=+; Position=1 -78,120-220,637-703,775-1034
  Homolog annotation: Hit_ID=CAE71145.1; Match level="QueryCoverage =98%, HitCoverage=12%, E-value=1e-47, Identity=58%"; Hit description =Hypothetical protein CBG18000 [Caenorhabditis briggsae]
FLSLLCSLMLWFTASVHYQRFYLVLAFLCTFLLCFLCTFLLCLTTLLIFSSTDFMGPLASMATSIQVVLLVYTVIPLPLYLCILICAIYSLLLELLSLLLELLSSPQSPSSSFTALLRPGTKATLHFCVHLLGIHLYILTQVRQRKTFLKVGQSLLARKDLELQTQFKDHMIQSVMPKKVRF

SEQ ID NO: 131433 - protein, 61 aa, Heterodera glycines
  Coding regions on vcDNA: vcDNA=SeqID_57856; Strand=+; Position=1 -74,156-269
SHCRQSQLPPSQPLPLYVPPVITGVNRQEQMEVPAISVAVVTEVPKVEQQGGEDEQELDLR

SEQ ID NO: 131434 - protein, 46 aa, Heterodera glycines
  Coding regions on vcDNA: vcDNA=SeqID_57857; Strand=-; Position=1 -34,112-218
MRPKSAPKMKMEHSPKKVHVELPAVDEYGDDPFEGVSEWPLQEEGQ

SEQ ID NO: 131435 - protein, 127 aa, Heterodera glycines
  Coding regions on vcDNA: vcDNA=SeqID_57858; Strand=-; Position=1 -292,490-581
MLVPLISNELLSRQFRMGIIVKCFLTEMTINCRRFSAVVPRLMAINQSSSRRVWGLFGPKKGDGKAMAMGEIYPSPRGTGKENVILRPKHPKKRSIKNFFAREFPLLYDSYYLPTVCSDKSRTKIDK

SEQ ID NO: 131436 - protein, 87 aa, Heterodera glycines
  Coding regions on vcDNA: vcDNA=SeqID_57859; Strand=+; Position=1 -132,762-893
MWHVTSAVEERTYQQQPLLLFHEISAIKINDYENADNEKRQRPRKKSLNKCRSPQCVKAVGGVGWLMHQTIAHIRSFDNWARMISAN

SEQ ID NO: 131437 - protein, 71 aa, Heterodera glycines
  Coding regions on vcDNA: vcDNA=SeqID_57860; Strand=+; Position=1 -91,478-601
  Homolog annotation: Hit_ID=NP_872018.1; Match level="QueryCoverage =100%, HitCoverage=8%, E-value=3e-34, Identity=97%"; Hit description =HCO3- transporter (2G447) [Caenorhabditis elegans] gb|AAM98009.1| Hypothetical protein F57F10.1b [Caenorh
HILSRTVQSICTTGTVGGTFDYDQTWICALCMLNTVQHRHVAIARLSHPTNLGRTMQDLRFIIIVIAPSRA

SEQ ID NO: 131438 - protein, 184 aa, Heterodera glycines
  Coding regions on vcDNA: vcDNA=SeqID_57861; Strand=+; Position=1 -286,390-658
  Homolog annotation: Hit_ID=NP_499293.2; Match level="QueryCoverage =52%, HitCoverage=24%, E-value=3e-23, Identity=47%"; Hit description =core1 UDP-galactose:N-acetylgalactosamine-alpha-R beta1,3 -galactosyltransferase (44.1 kD) (3L473) [Caenor
MLGLKIQRHSLGNWLTKVCRPLAKCRSSTHPFYCGLFLGLLFDLAIVWLFLPSLSHAPTKERQSSISEMAKTVKLPKQLMGYEAYFNKNFTYPFDSRGTVAQEIARKVRVFCWIFTYENFHESRARHVKATWAQHCTKFMFFSSKEDSTLPAIDLQIPLGRQFIWRRTKKIAKYIYKEYLVMGK

SEQ ID NO: 131439 - protein, 216 aa, Heterodera glycines
  Coding regions on vcDNA: vcDNA=SeqID_57862; Strand=+; Position=1 -62,779-1073,1430-1615,1824-1881,2064-2113
  Homolog annotation: Hit_ID=XP_311604.1; Match level="QueryCoverage =31%, HitCoverage=48%, E-value=5e-11, Identity=54%"; Hit description =ENSANGP00000025257 [Anopheles gambiae]
MCQVCRGFPKMSLNVLGVLLINLSDIRQDFDLTTKLANPVFDQTMVEKPKDAANQVLEGPKDSANPVFDGPKDSANPVLEGPKNSTNPALDGPKNSTNPALDGPKDLDGPMDAEHSEFLHTYLERHGPLDETICRAWMRQLTNGVSYLHENRIAHRDLKPENILLFERSVLKITDYGFAKQVTWRHLLCYADQHNAVQQRQCLRCVKFAVVFRRCL

SEQ ID NO: 131440 - protein, 76 aa, Heterodera glycines
  Coding regions on vcDNA: vcDNA=SeqID_57863; Strand=+; Position=1 -157,606-676
MPNDLPGVDAATDQRSVLFARKSNRASGLEAGEHFALRTWRSQNHRLRLRETEGLRCVKFAVFSEDVSERSGKSSD

SEQ ID NO: 131441 - protein, 660 aa, Heterodera glycines
  Coding regions on vcDNA: vcDNA=SeqID_57864; Strand=+; Position=1 -1306,1350-1684,1730-2071
  Homolog annotation: Hit_ID=NP_001004509.1; Match level="QueryCoverage= 81%, HitCoverage=36%, E-value=2e-53, Identity=29%"; Hit description =si:busm1-180o5.3 [Danio rerio] emb|CAD60788.1| novel protein similar to DNA polymerases [Danio rerio]
MSLATSSPIDDGSVRQRASIAVDNDDSDDDDDDEELPLRLCFFDAETSQDTPLQLNNRTVQKHVPLLIVAEVICERCLQAGISVSDGLGRRAPGCVCMTGMVRGQLFRQWSSPPFANAPGDNSASPVGAPAFNQRRFFFHSFDNDGNDPVDQFLDFLLQHGPKKAHTVCIAHNGGKYDFHLVLEALHRRNRPPKHLCTTGLKIYSMRLSGRNQRRITFKDSINYFFCALDALVKSFQVPDHLATVKPFFPYLYIRRQHLSQRLNGLPAQEFYAPDTMKAEKRAQFLRWHADNNGNGFQLREQLIMYCVNDVAILRESVIRFRQLIADNTQGLDPFLHASTAAGLALATFRRCFLPANRLVHSPEGGYLRGRRASAESQRYIRFFELEHPEAQVQCASWSVGEAHIEDSGYRVDGLWRREAPLRPLAIEWLGCYYHGCRVCFPDRQQQLAAGRTAEDLYERTERRLFELEHDHGCDLHVVWACQWAERLRHDPDLKRRYDAVFVPCPLDPRNDALRGGRTEPFKLHHVCSDDEEIMCIDIVSLYPYVMKANRFPVGNPRVLTREVLLRPPTVPLPWNAPENNIFRGLLLARVLAPRNIRVPLLGYRTKDGRFTFPLCAWCADRRQQRPCRHDDDKRSWVTAYTHVELNKALQLGYVVTDPI

SEQ ID NO: 131442 - protein, 148 aa, Heterodera glycines
  Coding regions on vcDNA: vcDNA=SeqID_57865; Strand=+; Position=1 -117,170-354,550-694
  Homolog annotation: Hit_ID=AAC46611.1; Match level="QueryCoverage =100%, HitCoverage=85%, E-value=1e-52, Identity=47%"; Hit description= a2 (IV) basement membrane collagen
EAGFPGIPGAKGEAGFPGLHGAKGELGFDGLPGQPGLQGPPGLPGFPGEKGEAGTPGYGVPGLPGEKGIPGIPGKSGRSGPPGERGMDGPHGFTGIKGEPGFPGQDGLPGQDGLPGLPGPKGDAGLPGFPGIPGQEGQPGLVRPPGLP

SEQ ID NO: 131443 - protein, 250 aa, Heterodera glycines
  Coding regions on vcDNA: vcDNA=SeqID_57866; Strand=+; Position=1-753
  Homolog annotation: Hit_ID=AAV44035.1; Match level="QueryCoverage =76%, HitCoverage=11%, E-value=6e-15, Identity=34%"; Hit description =putative helicase [Oryza sativa (japonica cultivar-group)]
MYEDCNTVFARSLDAKKARLFITFTNNREWPEFKENLHKNGQVFTDRFDMWMRVWSSKIAEFQEELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPGPGKIQVAEKWPGPGPGSRKNPGLDPGPGRALITSFSVT

SEQ ID NO: 131444 - protein, 19 aa, Heterodera glycines
  Coding regions on vcDNA: vcDNA=SeqID_57867; Strand=+; Position=1-60
EPVNSCIGCKCRRCCTPNS

SEQ ID NO: 131445 - protein, 20 aa, Heterodera glycines
  Coding regions on vcDNA: vcDNA=SeqID_57868; Strand=+; Position=1 -17,600-645
MNRKIIKILIEAKYSIFYKL

SEQ ID NO: 131446 - protein, 33 aa, Heterodera glycines
  Coding regions on vcDNA: vcDNA=SeqID_57869; Strand=+; Position=1-148
MGGKHHRSSSKMRADLSNPNKSYPHSFHKSIFS

SEQ ID NO: 131447 - protein, 31 aa, Heterodera glycines
  Coding regions on vcDNA: vcDNA=SeqID_57870; Strand=-; Position=1 -20,68-143
MFTKLEWSDKHSFEDQEEAAAGLANGLADGN

SEQ ID NO: 131448 - protein, 218 aa, Heterodera glycines
  Coding regions on vcDNA: vcDNA=SeqID_57871; Strand=+; Position=1 -50,224-320,378-492,580-672,728-770,817-930,1033-1071
  Homolog annotation: Hit_ID=CAE71402.1; Match level="QueryCoverage =91%, HitCoverage=17%, E-value=3e-36, Identity=44%"; Hit description =Hypothetical protein CBG18310 [Caenorhabditis briggsae]
QCSQLINGKNAVSQEKNLALSLFFRSHYAPFLLNKFVQSLVLFLFGFYLLISAYLISAYGCLNIEIGLEPLDLLPDNSNGKKALLEAEQYFPDHGGHLHVWMHNLSRVNLGHRRLWLVLEKEIELYEHTEFLYEHTEFTGAADSWLHVFLQFYHAKGQFTSNELHVFLQFYHAKGQFTSNENFVPRLKNFLKMKMHRKYRRAVILRAVILRDHPSDAF

SEQ ID NO: 131449 - protein, 127 aa, Heterodera glycines
  Coding regions on vcDNA: vcDNA=SeqID_57872; Strand=+; Position=1 -30,206-443,509-624
MHPNISVLRGIIASSPSDGRQFECCAGQYVPMECVASSAESIREINWRMKEDQRQIQLQLAFSDPDTERTVNIARTEKQCVHLPREADSGKKWTFVVETVKEDARHVVTLKSLVTVGKQSKYKTNHL

SEQ ID NO: 131450 - protein, 198 aa, Heterodera glycines
  Coding regions on vcDNA: vcDNA=SeqID_57873; Strand=+; Position=1 -177,233-393,441-478,579-678,739-781,1071-1145
  Homolog annotation: Hit_ID=NP_497650.2; Match level="QueryCoverage =98%, HitCoverage=10%, E-value=1e-69, Identity=60%"; Hit description =insulin receptor homolog, regulator of lifespan and dauer formation, abnormal DAuer Formation DAF-2 (207.
GNLRDFLRSHRPGAEENKQNRSLPTAEQYFNWAAQIADGMAYLESLRFCHRDLAARNCMVHADESVKIGDFGMARDIYYHEYYKPAGKRLMPVRWMAPEALKDGKFTLKSDVWSYGIVLYEMLTLGQQPYAGLGNDQVFNYTGVQRHVLHRPTDCPDFWYALMLSCWRYDPRERPSFRQIVRHLTTSCSDFIDEEFKV

SEQ ID NO: 131451 - protein, 124 aa, Heterodera glycines
  Coding regions on vcDNA: vcDNA=SeqID_57874; Strand=+; Position=1 -87,390-677
MVDLYQIVMERLLKVLDGCDLLQIDSSQLFTVNFIHGIFSRLDECEQSETAVKLHAVISYILLVPLKEHGMDEQIWKKLASNVVEALNASRQNPFQVDQSFKIDDLFNKNIPMGGQEQQHLYAL

SEQ ID NO: 131452 - protein, 500 aa, Heterodera glycines
  Coding regions on vcDNA: vcDNA=SeqID_57875; Strand=+; Position=1 -48,167-328,487-705,1117-1278,1445-1983,2173-2269,2980-3255
MIIQALVEQNDAILDKFEQEALAVFCAVVGGQICWANDAMVAICAIVDAMERFFVGRTAAAIVGTRPKDKDVLSERFDALISKILAQPNPDSLTVVPLSVLAAQKCNYHFRSLRWLEQFAASPKNGTDGDNGNFRHDFYFLLERLYSHLGNSDGVLGTFQMIRNRTMPEPFEQILALKVQGNYVDALPLCQQLVGQENEIVKCLLRSNQPLLAQTFIERTLRHIEQQQHPNHENGEAIGATDGENGAVNAGDDAKMAAGDCSKSRRLREYQMEAVCKLGDWDQLAMLHHNLVEEGRNRNNNNNGGPSQNVESDAQNGGSIEKWGAKMAAIFCNLRQFDLKSFGDGIERARASLVDALERTTLEDSSTIAQAHRNIIKLRSLYEVESVRAVLYSGGDKSALLRKTIADWEGEQFQSINLLEKTIHTNFAELCTELNALKVDIGGGISDGSATAKRLRKCVVLQQNGEQDGGGADIVEVAQPQQQQRRENFVEVTVVNLMFF

SEQ ID NO: 131453 - protein, 52 aa, Heterodera glycines
  Coding regions on vcDNA: vcDNA=SeqID_57876; Strand=+; Position=1-156
MLLAEFNERASAKQMDDLLNTYKRLEKFGQLTESFYYRYATFYDVKGESAKE

SEQ ID NO: 131454 - protein, 21 aa, Heterodera glycines
  Coding regions on vcDNA: vcDNA=SeqID_57877; Strand=-; Position=1 -17,1329-1377
MKLNQKKFFGPWKFGLKFENS

SEQ ID NO: 131455 - protein, 93 aa, Heterodera glycines
  Coding regions on vcDNA: vcDNA=SeqID_57878; Strand=+; Position=1 -113,163-215,1066-1181
  Homolog annotation: Hit_ID=CAE67125.1; Match level="QueryCoverage =60%, HitCoverage=6%, E-value=6e-11, Identity=50%"; Hit description =Hypothetical protein CBG12545 [Caenorhabditis briggsae]
PAYHSALADGVKGYPGIKARMNPRTFQYLSDIALGVLNYQIKRARLPNINQCLPQICQRLPSMLDEQANPKLCSKIPQFIPVRKMLEVAISAT

SEQ ID NO: 131456 - protein, 86 aa, Heterodera glycines
  Coding regions on vcDNA: vcDNA=SeqID_57879; Strand=-; Position=1-259
MNEVGPPEFSALIGCLSFICFSLSGALPRFALRPHFARPSSLSSDPSPFVAERFGLPNCDSLVTGNERAQNGGCPGKCGRDTWPKN

SEQ ID NO: 131457 - protein, 36 aa, Heterodera glycines
  misc_feature (33)..(33): Xaa can be any naturally occurring amino acid
  Coding regions on vcDNA: vcDNA=SeqID_57880; Strand=-; Position=1 -40,90-158
RDVQLPKVAQRPSGGVESAETKNLFLRFHKCKXVTC

SEQ ID NO: 131458 - protein, 68 aa, Heterodera glycines
  Coding regions on vcDNA: vcDNA=SeqID_57881; Strand=+; Position=1 -50,140-296
MTNSFYYTTEELFINFWWTPERGQLSWSPDPRTTETPLHDLRGRIWTDRKLELEPEKWSNIFANWQLN

SEQ ID NO: 131459 - protein, 96 aa, Heterodera glycines
  Coding regions on vcDNA: vcDNA=SeqID_57882; Strand=+; Position=1 -131,359-518
MKFPLPEEQSIAVVDLNLETLIDDAIHWAHINGMVTRTKENRLNFVLTSENFKKPKRACGKPFLAHAAILEALTKNFTKILSHLMMLHQFNFAFLE

SEQ ID NO: 131460 - protein, 30 aa, Heterodera glycines
  Coding regions on vcDNA: vcDNA=SeqID_57883; Strand=-; Position=1 -15,60-137
MIHRKFLPYELAALVQKLRVEKALGTVKMA

SEQ ID NO: 131461 - protein, 18 aa, Heterodera glycines
  Coding regions on vcDNA: vcDNA=SeqID_57884; Strand=+; Position=1-54
MRAQLRELAEKMTDKDPK

SEQ ID NO: 131462 - protein, 28 aa, Heterodera glycines
  Coding regions on vcDNA: vcDNA=SeqID_57885; Strand=+; Position=1 -22,76-140
MSPPVDQRSKSLFIISLFSQQINVHKCR

SEQ ID NO: 131463 - protein, 26 aa, Heterodera glycines
  misc_feature (8)..(8): Xaa can be any naturally occurring amino acid
  Coding regions on vcDNA: vcDNA=SeqID_57886; Strand=-; Position=1-163
SDRRTNHXGQQTITRIKPLIINNPTN

SEQ ID NO: 131464 - protein, 92 aa, Heterodera glycines
  Coding regions on vcDNA: vcDNA=SeqID_57887; Strand=+; Position=1 -204,639-710
  Homolog annotation: Hit_ID=NP_490866.2; Match level="QueryCoverage =100%, HitCoverage=15%, E-value=8e-24, Identity=61%"; Hit description= SRC oncogene related (60.7 kD) (src-1) [Caenorhabditis elegans] gb|AAN31394.1| protein tyrosine kinase [
MKQCSHNNLVRLFAVCTNEEPFLIITEFMPNGSLQSYLRAQETDEKGVNIGRPKNLLSMQAMIDICAQVANGMKYLEERKLVHRDLAARNVL

SEQ ID NO: 131465 - protein, 27 aa, Heterodera glycines
  Coding regions on vcDNA: vcDNA=SeqID_57888; Strand=+; Position=1-81
HILSHEFGKGSLCNRCDCPGFGHALLA

SEQ ID NO: 131466 - protein, 105 aa, Heterodera glycines
  Coding regions on vcDNA: vcDNA=SeqID_57889; Strand=-; Position=1 -45,100-234,579-713
VTWHGNDLIFPIAENPKPIAERSAKYDTEIVYHGSFLCQLDGQVAYQPTPGTNWTHYFILVESPVAETHAVRFSPGQTAVVDAFVKHSMPIPLEGQFEFDAWHRN

SEQ ID NO: 131467 - protein, 115 aa, Heterodera glycines
  Coding regions on vcDNA: vcDNA=SeqID_57890; Strand=-; Position=1 -78,224-308,442-626
MPKRKMPTELNVEIVAALPFDIRWANRQRLGQAKRRIKLMSFRLFENRLRNMRDHIASHFRLDNSFGLTEVQFRGELTPEIFGIQFDAIFATIDRNNLQDISWAQQCKKMPINER

SEQ ID NO: 131468 - protein, 64 aa, Heterodera glycines
  Coding regions on vcDNA: vcDNA=SeqID_57891; Strand=-; Position=1 -10,144-328
MRDHIASHFRLDNSFGLTEVQFRGELTPEIFGIQVDAIFATIDRNNLQDISWAQQCKKMPINER

SEQ ID NO: 131469 - protein, 394 aa, Heterodera glycines
  Coding regions on vcDNA: vcDNA=SeqID_57892; Strand=+; Position=1 -462,642-1364
MTIIWCRSVVFFYEESAISAVVGGAGDADDGSSSSVGTGGGDGQNCVLNSESGDSAPQFFVDETEALVDYASFDDCYQLGDAADADADDASGVQGTVAAAAATATAGEKRSMAASGTDKMGMDSDAGGRAASNSRADVAESRSRPQKAIALDRKKSASKIAQIASIPEERQQQQLHQQRLLLGHDHDEAVGLKNIGLKWPRRMGGQKIVFPSDKNVQQQQQQRKPIGAGDGQFGTNTANGRGQAPLAAATVASISGKQPPPRAAAIQLTAPVAESATAAAKHQMGKAMAVQHQRGKGGEGGQQQQIVAELSAVYSVEEEEGARKINNDNDNNDGVSGRVAAVTKGGEGGERQRHQQRQQQTMRVEGQTKMAQRQRHRSEKEMPAAGILGEHIYP

SEQ ID NO: 131470 - protein, 66 aa, Heterodera glycines
  Coding regions on vcDNA: vcDNA=SeqID_57893; Strand=+; Position=1-201
QIVLPVSARLKISAPSADNFNGTFIKSSKGEEMEAPKSKEEEGQQMEVIRQGIAVEMPINSNSGRG

SEQ ID NO: 131471 - protein, 146 aa, Heterodera glycines
  Coding regions on vcDNA: vcDNA=SeqID_57894; Strand=-; Position=1-441
  Homolog annotation: Hit_ID=AAP30764.1; Match level="QueryCoverage =78%, HitCoverage=26%, E-value=4e-58, Identity=93%"; Hit description =putative gland protein G28B03 [Heterodera glycines]
AADFYNINRLINDDYIDNVYEIVKVKWINGKTPQEIRKAFGVKEPYPPGHPEWARVEKENQWEESDEEREARHAKEREEEEERERKEEQKRKEKEAERLRQEQLQQQNQEHQPQQGEQHGEGQGHDEDMNDEWEEEDDEESEEDDE

SEQ ID NO: 131472 - protein, 189 aa, Heterodera glycines
  Coding regions on vcDNA: vcDNA=SeqID_57895; Strand=+; Position=1 -235,293-438,505-693
  Homolog annotation: Hit_ID=XP_316911.1; Match level="QueryCoverage =66%, HitCoverage=12%, E-value=3e-11, Identity=29%"; Hit description =ENSANGP00000006552 [Anopheles gambiae]
MQFPSYARISDWKKGTLLMDIEKVSEFAREEVESSRHSQKVYINGMPWKILAQIKTKTGYTDNEKSLGIYLSCAVPKEAENWSCKCSATIRIVSQKCGVADLRRKFDGTFISNQNIDCGFYYLISFAELLDPSEGFYSRSKDKVKLAINFIMQEAKREEKTSKGFYDKSEDKVTLAVDVIVEEAKTEDK

SEQ ID NO: 131473 - protein, 31 aa, Heterodera glycines
  Coding regions on vcDNA: vcDNA=SeqID_57896; Strand=+; Position=1-94
MEELVALSPESASAAGRSQRSWAPEHSEPST

SEQ ID NO: 131474 - protein, 57 aa, Heterodera glycines
  Coding regions on vcDNA: vcDNA=SeqID_57897; Strand=+; Position=1-174
FTDTPFHSKAIKPMLEKNVPNLLAFVKRMKQRFWPDWDTILDSLALNPPVYEEKQTK

SEQ ID NO: 131475 - protein, 93 aa, Heterodera glycines
  Coding regions on vcDNA: vcDNA=SeqID_57898; Strand=-; Position=1 -99,160-256,586-669
  Homolog annotation: Hit_ID=AAA91356.1; Match level="QueryCoverage =98%, HitCoverage=14%, E-value=3e-26, Identity=55%"; Hit description =Aldehyde dehydrogenase protein 11, isoform a [Caenorhabditis elegans] ref|NP_741082.1| triacylglycerol lip
RHANEIAEWEVRDNGKPISEAKADVLSCADTFEFYAGVNLSGEHIPYGGELSGRFAYTRREPFGVTASWKIAPAIACGNAILYKPSPLAPITS

SEQ ID NO: 131476 - protein, 344 aa, Heterodera glycines
  Coding regions on vcDNA: vcDNA=SeqID_57899; Strand=+; Position=1 -136,190-708,777-1156
MAFFIFSISKKLLSAPMLWFGLFLSLFAAINLSSGQLGTNDESKKGLFLMANEFLESGKMLLDELQNQTGNKQEENESDDGLKSQKANGKALEEKSDNFQQKAFEFLCGIEMKAKNDEKGNEKTKKDDNLLAFKELEEKRLNFCQNWKNGKSIWKGWKEAGISIVTSVNNLKLNQQIYGESLRTLAKMEIFNSKNKEEFGNFAKFGIDLLMKVTEILKDARISSLALADQSDHNQRKGNNTSRRRKRAFHGIFRREFSLEKCFLYLLLTCMSAGLGTDMVVRLAQHKVRVVSFGNSAPPPPFSTEGHHTTPLEGFEIFVAIFCFLTTLISLPMTIIEGFKIRRH

SEQ ID NO: 131477 - protein, 47 aa, Heterodera glycines
  Coding regions on vcDNA: vcDNA=SeqID_57900; Strand=+; Position=1 -7,744-880
MKLIALFVSACILLLRWLKKRLSNRSSAFFLCFCVGSMSGSASFHLN

SEQ ID NO: 131478 - protein, 58 aa, Heterodera glycines
  Coding regions on vcDNA: vcDNA=SeqID_57901; Strand=+; Position=1-178
KIEEKWKFQWESQTKIERKMKEFIERFDEFKRLYKGKQKGFAKELGISKEHYEDGKKN

SEQ ID NO: 131479 - protein, 87 aa, Heterodera glycines
  Coding regions on vcDNA: vcDNA=SeqID_57902; Strand=-; Position=1 -153,202-268,334-377
  Homolog annotation: Hit_ID=CAA74206.1; Match level="QueryCoverage =83%, HitCoverage=21%, E-value=9e-36, Identity=100%"; Hit description= serine proteinase [Heterodera glycines]
MLKLCLTIILVTIGYKSFSLSEHISEFSECGISDFEPEFPIAPKVEIGTNHIFKGKTIVDDKSLPWMARILSGDPELVGTYLKNKLS

SEQ ID NO: 131480 - protein, 120 aa, Heterodera glycines
  Coding regions on vcDNA: vcDNA=SeqID_57903; Strand=+; Position=1 -61,819-901,1063-1281
MSENGRNFRHLLIATKFWAKTLQKVNSLKNDKFNLGAFLSEPIPFTEKFQNFLVIHCISEQKELADSFCDFVEWRMRLQIIFSIDKKDAGGQSVATHLKPNIHREKCNLTTAKLLGISFR

SEQ ID NO: 131481 - protein, 29 aa, Heterodera glycines
  Coding regions on vcDNA: vcDNA=SeqID_57904; Strand=+; Position=1 -10,49-128
MGEGWMGGDEYGISHFHEHTISFFIDSTN

SEQ ID NO: 131482 - protein, 181 aa, Heterodera glycines
  Coding regions on vcDNA: vcDNA=SeqID_57905; Strand=-; Position=1 -72,124-597
MPQPERAQITHMSREGDKMPEKEKANSNSDTAEQQPKHQHELEIGQFRSPTAEENDGSEGFEVITREENGGHQTEEGEEEQKANEGEKMPKSNGNAENTGQGEGTQSAATTTTPTLASTTTTSGTETAKQMERTTEQPQSSPSEEGAGGGAANGSADTEVDILAARGPPAAGLAETKKGTN

SEQ ID NO: 131483 - protein, 59 aa, Heterodera glycines
  Coding regions on vcDNA: vcDNA=SeqID_57906; Strand=-; Position=1 -40,96-235
MATQSKDEKQSANVGESEKKSQGSNGEGEEKAIVFPTENAENGTTPATPEKAFLALFQD

SEQ ID NO: 131484 - protein, 339 aa, Heterodera glycines
  Coding regions on vcDNA: vcDNA=SeqID_57907; Strand=-; Position=1 -83,135-390,467-555,603-650,802-1117,1198-1424
  Homolog annotation: Hit_ID=NP_740892.1; Match level="QueryCoverage =100%, HitCoverage=42%, E-value=3e-75, Identity=44%"; Hit description= n-ethyl maleimide Sensitive membrane Fusion factor related (nsf-1) [Caenorhabditis elegans] emb|CAB09531
IQPFSFPSDQWIITSISLIVDFQKKQKPSNPSEPLDTNAMAQEFLMQFANTVFTVGQESPMEYVQQKRGTGRGKLPPGKVNLLDNNNTTTTYTLKLVVERMEGAINLNTAPEELSFGPLSPNAVVIFDRPENSQMNLIGRSIGKSSHRALVNPDWDFQHDEACPWHFALRPPGDGQNANRATDRQNVQRTRTKDCQWARNSEQVRPKLLTFVIRPDRFVGESEANMRKLFADAEEEWRRCGPNSGLHIIIFDEIDAICKQRGSMGGSSTGVHDTVVNQLLTKMDGVEQLNNILVIGMTNRKDMIDEALLRPGRMEVQLEISLPDEQGRVQILNIRTAPM

SEQ ID NO: 131485 - protein, 51 aa, Heterodera glycines
  Coding regions on vcDNA: vcDNA=SeqID_57908; Strand=-; Position=1 -66,289-378
MTYLLSICPQQFIEAHGTARNTMFFTFIFPIKCIQLKEIGIENIKCRCCFY

SEQ ID NO: 131486 - protein, 114 aa, Heterodera glycines
  Coding regions on vcDNA: vcDNA=SeqID_57909; Strand=+; Position=1 -341,403-406
MYEISADPTDKGVKNRVIYTDNGQFKWNIRNAVRDFDTNAKITVLLCLGDEYRVYGQFADYDAMEDEMGERFHEVFQVVYNNYPIYEIDETVPIEHDVPIEYEDEGHSTCTIQK

SEQ ID NO: 131487 - protein, 52 aa, Heterodera glycines
  Coding regions on vcDNA: vcDNA=SeqID_57910; Strand=+; Position=1 -133,192-217
MFPFRFLFVFAFALLTLCGFSHMTLAQPGSNGPIGEPNKMLRIRRENERKEN

SEQ ID NO: 131488 - protein, 101 aa, Heterodera glycines
  Coding regions on vcDNA: vcDNA=SeqID_57911; Strand=-; Position=1 -180,714-839
MPKQAEETKMLLERKMRETEMAAQRMAALQHQQQQKQQQQNGITTPGTATVAQQQQQQQQINPSHHPFSFAVHLLPHWSLVINLLILYQNTTLKSNNENGI

SEQ ID NO: 131489 - protein, 46 aa, Heterodera glycines
  Coding regions on vcDNA: vcDNA=SeqID_57912; Strand=-; Position=1-175
YILFILIFIYNSVQFSGVQISIGVQFSSVQFSVSNFLVSNLPGATI

SEQ ID NO: 131490 - protein, 103 aa, Heterodera glycines
  Coding regions on vcDNA: vcDNA=SeqID_57913; Strand=+; Position=1 -95,806-1022
MVQFCAVAVPLLLRLRALLTLAVQPHLLLLQRKSFITHFSCIIWHIDQSPPIFGAFGVRGKGMKRKQLYIEQDENLREIFATRADRHPLQYLRAIAYRMPDPL

SEQ ID NO: 131491 - protein, 165 aa, Heterodera glycines
  Coding regions on vcDNA: vcDNA=SeqID_57914; Strand=-; Position=1 -54,172-300,912-1223
  Homolog annotation: Hit_ID=NP_861967.1; Match level="QueryCoverage =86%, HitCoverage=25%, E-value=4e-24, Identity=38%"; Hit description =neurofibromin 2 isoform 6 [Homo sapiens] gb|AAK54165.1| neurofibromatosis type 2 isoform delE3 [Homo sapi
MGRMLEWLTEHGKPLRVKRDSLGQHLFDTVCKIIGLREIWYFGLCFTNRKGFTCWLQMDKRAILLASYAVQALYGDIGQQQQQQQPQQQQQADQQQQQQQQQLDLAKLLPVSVLQQYELTAEMWEQKIRNWWANNSGLSKEEAEEEFLCVAEELDMYGTQYYPIR

SEQ ID NO: 131492 - protein, 36 aa, Heterodera glycines
  Coding regions on vcDNA: vcDNA=SeqID_57915; Strand=-; Position=1 -104,1037-1043
MDQKTIFNQPCNSLSILSLCRNVPRGNEIRIFEALE

SEQ ID NO: 131493 - protein, 79 aa, Heterodera glycines
  Coding regions on vcDNA: vcDNA=SeqID_57916; Strand=-; Position=1 -61,518-696
MYVYQKKNNLQRIYFVEWKEDNETHSCWVLTEDTEALELVAKFIEECSMSSALDAFLGAPVMSHVAKLLQKNDEAISCT

SEQ ID NO: 131494 - protein, 51 aa, Heterodera glycines
  Coding regions on vcDNA: vcDNA=SeqID_57917; Strand=-; Position=1 -4,293-444
MYSIGPFPIGSVIGFSILKSRSRSHGPGLEKAEYPGLARVSYMDSELKLKI

SEQ ID NO: 131495 - protein, 44 aa, Heterodera glycines
  Coding regions on vcDNA: vcDNA=SeqID_57918; Strand=-; Position=1-132
MPYVDTVRRISRARSERGAKRVLVQKGAGFGGLFAALLTPVLME

SEQ ID NO: 131496 - protein, 218 aa, Heterodera glycines
  Coding regions on vcDNA: vcDNA=SeqID_57919; Strand=-; Position=1-657
MAINICDKKALVNQILGQADITVTTSGITVSGPRLSTPRFIPFDECGRCRACKATEVEVDTMVTKEGITLWCSRVSKSQFVPFDAVYDLPGHCFFRVKNKARVFNVPYGDLPSDTCTTPTPTTTTTTTQGTETDMQQQDLKRKAKVALDLVEAGLMARCHAGRRALEEGQNRNQCTRESTFSGIVGQQSDKQSRGGTELCPGRAQKRRREKQGGPWRH

SEQ ID NO: 131497 - protein, 42 aa, Heterodera glycines
  Coding regions on vcDNA: vcDNA=SeqID_57920; Strand=+; Position=1-126
MRECWISVPVIQNIFDEGGRENNFNRERNGKGVHVSSSLILL

SEQ ID NO: 131498 - protein, 33 aa, Heterodera glycines
  Coding regions on vcDNA: vcDNA=SeqID_57921; Strand=-; Position=1-100
MTIGSSVITYVIRHDGKAQEKPDDRITRNPSLR

SEQ ID NO: 131499 - protein, 193 aa, Heterodera glycines
  Coding regions on vcDNA: vcDNA=SeqID_57922; Strand=-; Position=1 -303,499-777
MSRGAPFIPKNAVLIQNLKAAMAAGTLAAFGSIPNNALEEIDTLLTGAFKKDFAAIYRNSRKVKTNALKLAELDIENLIAKHHPLSNFTWMAIPFMLPANILATATSAAMIPMEIADAEEKTVENVLRLIRNGILAGPTQAKLEKAKEELAAEEKWKRRNVFRPINMVKEIIKKRNEEKERKTMVRKESRKRK

SEQ ID NO: 131500 - protein, 213 aa, Heterodera glycines
  Coding regions on vcDNA: vcDNA=SeqID_57923; Strand=-; Position=1 -119,896-1238,1614-1793
MWSTHTKNESNAELIENVIKEHPEMLTEQKRNEIEMKADKKIETLKKLEKVHQTMEEEQKKLRKAMEFLRPQKVHPFDFLVGTVGIDKKGSKIPIGGLRHKISGRSVNEKKYLEMLDMPRAKEAMESENETCQALAKLVEQTLYIDDNGVVDPQGVELRGRLGAQIVNYVINKKDTVGLLKQLMWSVIGTSAIALFFDLFLWPTIISKDLSLN

SEQ ID NO: 131501 - protein, 557 aa, Heterodera glycines
  Coding regions on vcDNA: vcDNA=SeqID_57924; Strand=-; Position=1-1674
  Homolog annotation: Hit_ID=XP_307468.1; Match level="QueryCoverage =68%, HitCoverage=44%, E-value=3e-35, Identity=28%"; Hit description =ENSANGP00000016246 [Anopheles gambiae]
MANPSVQQLMDMVKQLLEAQQNAPPAGQQPSNVPSLPNVENFEFGEQSTDIEDWLQQFDFALDCAAPNLQDMLKVKLLMTKLSKEAFAEYKKSCIPKNVTDFDFAKTVEQLKSLFARPQSIWIDRYDCLRASKLEDEEFRAFVNRHKRLLRDFNFKKLKEEQFNCLMLLIAMKSPKDADLRKRILAKLAADGDLVRYDNMVEDLQVYLSTIAEAKALEQPVSSRNVYALKKKHKIRKNSDSSKGSSESSASQRSHGSQPKCWRCGKWHSPKRCSHGKSTCRKCNEIGHLERMCEKHKAWLKRNGEKKDGKAVNTFRLGGIFLPDSESRRKLIEIPLKMDGTEVEFVADFGTERTVVTKDAHRQIGSPWLSRCTERAKYHDGSTRPLLGKGQAKFSIGDRSCDGQFYVAKGTKNLLGIDMLHSLGLLDSFRKSLEGNVQVAEANTKSDSTDAQSENPKNKHRGNKPKFALGAKVIASLGLQPWRAGYVVNRQGTMYEIRFPDGTTGKFPEKGVEACVLDSDEEIFDGLDLREAPFDGKTSKGLVGIDCDQRKRENVIA

SEQ ID NO: 131502 - protein, 367 aa, Heterodera glycines
  Coding regions on vcDNA: vcDNA=SeqID_57925; Strand=-; Position=1-1103
  Homolog annotation: Hit_ID=XP_319741.1; Match level="QueryCoverage =89%, HitCoverage=76%, E-value=1e-31, Identity=26%"; Hit description =ENSANGP00000006515 [Anopheles gambiae]
MANPTVQQLMDMVKQLLEAQQNAPQVGQQPSNVPSLPNVENFEFGEQSTDIEDWLQQFDFALDCAAPNLQDVLKVKLLMTKLSKEAFAEYKKSCMPKNVTDFDFAKTVEQLKSLFARPQSIWIDRYDCLRASKLEDEEFRAFVNRHKRLLRDFNFKKLKEEQFNCLMLLIAMKSPKDADLRKRILAKLAADGDLVRYDNMVEDLQVYLSTIAEAKALEQPMSSKNVFALKKKHKTRKNSESSKGSSESSASQKSHRSQPKCWRCEKWHSPKRCSHGKSTCRKCNEIGHLERMCEKHKAWLKRNGEKKDGKAVNTFRLGGIFLPDSESRRKLIEIPLKMDGTEVEFVADFGTERTVVTKDAHRQIGSP

SEQ ID NO: 131503 - protein, 401 aa, Heterodera glycines
  Coding regions on vcDNA: vcDNA=SeqID_57926; Strand=-; Position=1-1206
  Homolog annotation: Hit_ID=XP_319741.1; Match level="QueryCoverage =65%, HitCoverage=61%, E-value=1e-19, Identity=25%"; Hit description =ENSANGP00000006515 [Anopheles gambiae]
KLKEEQFNCLMLLIAMKSPKDADLRKRILAKLAADGDLVRYDNMVEDLQVYLSTIAEAKALEQPMSSKNVYALKKKHKTRKNSESSKGSSESSASQKSHRSQPKCWRCGKWHSPKRCSHGKSTCRKCNEIGHLERMCEKHKAWLKRNGEKKDGKAVNTFRLGGIFLPDSESRRKLIEIPLKMDGTEVEFVADMGTERTVITNDAHRQIGTPWLSRCNERAKYHDGSTRPLLGKGQAKFSIGDRSCTGQFYIAKGTKNLLGIDMLHSLGMLDSFRKSLEGNVQVAEANTKSDSTDAQSENPKKKHRGNKPKFALGAKVIASLGLQPWRAGYVVNRQRTMYEIRFPDGTTGKFPEKGVEACVLDSDEEIFDGLDLREAPSDGKTSKGLVGIDCDQRKRENVIA

SEQ ID NO: 131504 - protein, 50 aa, Heterodera glycines
  Coding regions on vcDNA: vcDNA=SeqID_57927; Strand=-; Position=1-160
IPIKFFKILPINWLIFSEKLFINDQNFQFFPRRRLSAPPRPQNSYFFLEN

SEQ ID NO: 131505 - protein, 62 aa, Heterodera glycines
  Coding regions on vcDNA: vcDNA=SeqID_57928; Strand=+; Position=1 -42,91-199,667-704
MTKALRILTKILAAQSVIGLANGSSNHPCQSTNVADKKACHNALNLIPSQSNFRTIYSIHYE

SEQ ID NO: 131506 - protein, 114 aa, Heterodera glycines
  Coding regions on vcDNA: vcDNA=SeqID_57929; Strand=-; Position=1 -81,169-280,335-486
MSSKPETLVERMKHLLSSGDDADVLFLHVPAHRAILNSASDVFEAMFRFDTTKNATDNESAGGEAKGPVEVTDIDAHVFKVMLNFIYADDLSELNGDNAMAVLYTGQKISFLLC

SEQ ID NO: 131507 - protein, 135 aa, Heterodera glycines
  Coding regions on vcDNA: vcDNA=SeqID_57930; Strand=+; Position=1 -164,541-784
  Homolog annotation: Hit_ID=AAR85908.1; Match level="QueryCoverage =67%, HitCoverage=15%, E-value=5e-36, Identity=76%"; Hit description =Forkhead transcription factor family protein 7, isoform b [Caenorhabditis elegans]
MLGSAGGAASAVASRHRRITTERSLLPLSTDIAKNREFYRTHDVRPPYTYASLIRQAITESKECQLTLNEIYQWFTDTFVYFRRNAATWKNAVRHNLSLHKCKQKRMNDVPFLGLFVLPECLIIPEIRFPNYRKL

SEQ ID NO: 131508 - protein, 85 aa, Heterodera glycines
  Coding regions on vcDNA: vcDNA=SeqID_57931; Strand=-; Position=1 -136,180-301
MPSLIDVLLLVLFFFVLIGPPFPDEPVFERGLQNWMDARIQHLQNTIHAPPPPPPQAEGEEQGEELDENDWANPWPENWDPKIFW

SEQ ID NO: 131509 - protein, 781 aa, Heterodera glycines
  Coding regions on vcDNA: vcDNA=SeqID_57932; Strand=+; Position=1 -264,736-2816
  Homolog annotation: Hit_ID=NP_508324.1; Match level="QueryCoverage =59%, HitCoverage=18%, E-value=5e-48, Identity=25%"; Hit description =predicted CDS, peptidase family A16 and RNA-directed DNA polymerase and Integrase, catalytic domain and Z
INEVVIIHDETPRAMWKTGIIKNVITGKDGIIRGANVELPNKNVINRPLKLLYPLEINKNDGEENETLTNLITDHEQIGTVQKRKQAIKSLNLLHTQANSRIDYRCLGEGNLTIGTQKFCQEHECTDKHGTKFCFYEPHEKTYLVKSDREIIPIKAWGSIERIFYLANDTLMDELKRKKREFDPFENEQISAECIKGGIKINPTHATTELEILVDKYFILKRSPQSEEFISLPTKITMNEYKPVIKFIKGTSSPEYKNLTCSPSPICELIICRFCMEYIRNPQCVGQMHWALILIMIMLTLYVITLCLKIIRILYRFIVFIFLSVYNCCRKRKLKKIKIIKRKQFIYLIMISLLLNSPTIFSCDEVTNMVAGTNDCAIDQNGKIECIYDQTTQISITPEHKTCLKLDNEKMHSTIETIELSVESLTIICAERSEYFMRDYELLSSSQKRCSGAGKCTGQICQTLTMKEKNPEIGDHANKQPGYSYCVPSCGGWHCKCFLVTDGCLFYRTYTEPINRNIYEVVKCPTWTILATIKISLDPKTIHTVELKPGVLTHVKDSNLSLTLTSTSIPPTPLFGSKFIIDRSNAKAVIVDNENLLKNSLRCETKEKATKFSCTFPPEACQCHGGDSVVHCECEKNPLTEMFTRKDNILPLETQGSQVFFDTLLRAKIKLTTSLQVQVTLKGHKVKAIYDKNNCTVKTKSLEGCYSCTNGAEFKFTCTTNFGTALANVKCHSQNFQIPCDTKGNQQQIQLSFNQPSVKEKCEVICPDEKSEITIEATLNY

SEQ ID NO: 131510 - protein, 64 aa, Heterodera glycines; identical to SEQ ID NO: 129150
  Coding regions on vcDNA: vcDNA=SeqID_57933; Strand=-; Position=1-566

SEQ ID NO: 131511 - protein, 250 aa, Heterodera glycines
  Coding regions on vcDNA: vcDNA=SeqID_57934; Strand=-; Position=1 -304,355-803
MLLTFLKDRTEFEQLCKKLETQKLLKNIELVAQRRGNGVYDIGGTVEYLAQKYSAYFGAVSMMRDKWQCDEIEQEKRQKECERFKKYLTILYKHLFNVYIEVSDPELAQQIAAVRPNFQIANSKKAATIVDVLDSLCQIWAFYFGTKNGEKNENKLENLFKNSFELKLLNEKELENEKPTFGQKIEEIVDQMNIPEGFKQIIKGTKTNGEKGKSEFEEREGHFGTNESRIKSLREQFEEKMSEMTKDRKI

SEQ ID NO: 131512 - protein, 74 aa, Heterodera glycines
  Coding regions on vcDNA: vcDNA=SeqID_57935; Strand=-; Position=1 -92,410-542
  Homolog annotation: Hit_ID=CAE69293.1; Match level="QueryCoverage =82%, HitCoverage=12%, E-value=2e-09, Identity=49%"; Hit description =Hypothetical protein CBG15348 [Caenorhabditis briggsae]
MPLVLLSFVLLPLFPFLIVVAVSRLYFNRRRVSGSFAFFHPFCDASGGGERVLWLAINALQKKLITKAYFSNHI

SEQ ID NO: 131513 - protein, 50 aa, Heterodera glycines
  Coding regions on vcDNA: vcDNA=SeqID_57936; Strand=+; Position=1 -55,692-789
MRNSKNLKFRLFVRNRVHGGFEVAEHGYDIHFDQIRTPNPNYEHVGPQNH

SEQ ID NO: 131514 - protein, 108 aa, Heterodera glycines
  Coding regions on vcDNA: vcDNA=SeqID_57937; Strand=+; Position=1 -132,888-1080
MPKYGHKYGPKCQNMEKYGNMDINREIWKNMDIEASNQAKNMFFSQSETLSVEHFAMLTMYISENTFTFVNFIQNTRGAATRVQKLIGAAKIKSNFMETFQKKLRNPL

SEQ ID NO: 131515 - protein, 50 aa, Heterodera glycines
  Coding regions on vcDNA: vcDNA=SeqID_57938; Strand=-; Position=1-156
LHIIAEKIRDQFPNVDRLIAKTKAVFVKAPYRVKKFGNVSHMQFQPINLK

SEQ ID NO: 131516 - protein, 479 aa, Heterodera glycines
  misc_feature (19)..(19): Xaa can be any naturally occurring amino acid
  Coding regions on vcDNA: vcDNA=SeqID_57939; Strand=+; Position=1 -93,4687-4801,4955-5040,5099-5193,5240-5480,5645-5717,5778-5948,5990 -6088,6137-6231,6288-6389
  Homolog annotation: Hit_ID=AAC72366.2; Match level="QueryCoverage =96%, HitCoverage=33%, E-value=1e-166, Identity=67%"; Hit description= guanylyl cyclase [Heterodera glycines]
KRRRFILRQLYSSSTLLSXVVIATNVKTKNDSNRTGTKEGDVFSFATICVEMVNRETVWNGTERDDDVDEILYRLKRTNNTIPHRPQLRPREDTNQSLVHLIRDCWVHLIRDCWAEVPAERPRMDMMRTMLKQMVQDGNQNLMDYVFGMLEQYASSLEQVQDGNQNLMDYVFGMLEQYASSLEQEVEEKRKSDILLNRMLPRQVADKLKLGEAVEPESFQMATIFFSDVVSFTTLAGKCTPLQVVNLLNGLYTAFDGIIDTHDCYKIETIGDGYLVCSGIPTIGDGYLVCSGIPKRNGDQHAKEIAELSFAFLRTVSNFRVDHLPSERVNLRIGFHSGPAVAGVVGLTMPRYCLFGDSVNFHSGPAVAGVVGLTMPRYCLFGDSVNTASRMESNGKAGKIHISSSSNRFLGKIHISSSSNRFLTSVIGGYVTEPRGEVIIKGKGVGKGVMETFWLLGRIGEVHLPEGPSVSENAGRKSP

SEQ ID NO: 131517 - protein, 98 aa, Heterodera glycines
  Coding regions on vcDNA: vcDNA=SeqID_57940; Strand=+; Position=1 -61,288-521
MPSRPCVVPRIRNGLVLDLNPIRCAFPPRIASPNLANFPPSDRFVSAILSASIPNNSDISFGTLVAYECANGTVPRGGQSVAQCAANGQWTKVAMACQ

SEQ ID NO: 131518 - protein, 25 aa, Heterodera glycines
  Coding regions on vcDNA: vcDNA=SeqID_57941; Strand=-; Position=1 -24,157-210
MTTLAIFVKLLIFLKNYVKTVHKLT

SEQ ID NO: 131519 - protein, 33 aa, Heterodera glycines
  Coding regions on vcDNA: vcDNA=SeqID_57942; Strand=-; Position=1 -95,299-305
MKEFFTNFFPQFILHISRFFCISFMAIAKKDWG

SEQ ID NO: 131520 - protein, 263 aa, Heterodera glycines
  Coding regions on vcDNA: vcDNA=SeqID_57943; Strand=-; Position=1 -48,140-444,493-721,1036-1245
MHLSFSDDIDLDAIRKDFERLNPLPSAANESEVFARLRSTAFRLHTQNAFWCQFDLSEETKAKMEQCRMGNNPMAFVKRCIVLQELKKSTEAMEQNNEQMPSQIQLDFHVFTLPYVLPHYACLSLFDGEIHHGAIATSKQRAKISCAAVLCEVLVKMGWADVKRAKKRKNADGEKALKKKKRKGENGQTEDVEEGNVRLSHQFLLTLHPNESLDPRTHFFLASSAKSPIQLLKEVADRESFEVSYTKGNGRVLSQAHCPRAHN

SEQ ID NO: 131521 - protein, 201 aa, Heterodera glycines
  Coding regions on vcDNA: vcDNA=SeqID_57944; Strand=+; Position=1 -137,262-329,378-406,537-784,848-969
  Homolog annotation: Hit_ID=CAE66670.1; Match level="QueryCoverage =86%, HitCoverage=7%, E-value=5e-44, Identity=49%"; Hit description =Hypothetical protein CBG12009 [Caenorhabditis briggsae]
MHLPQQRFKQCHGDQLIGLQLPLRLNVLIDLPDDYSQLIKMTVNFRCPEIKELTNTVATLCLNCGQMLCSQGYCCQKVVNGRNVGACTAHLSKCRGSSGVFLRCVSEERNLLKIIALFSRRRIRECQIVCLLVTNGGELTRGCFKAAPYVDEFGETDPGFRRGNPMHLNRELYWRIQRLWLYQEIAEEIINQYELSSNRNI

SEQ ID NO: 131522 - protein, 384 aa, Heterodera glycines
  Coding regions on vcDNA: vcDNA=SeqID_57945; Strand=+; Position=1 -37,127-1242
  Homolog annotation: Hit_ID=DAA04499.1; Match level="QueryCoverage =88%, HitCoverage=24%, E-value=3e-24, Identity=27%"; Hit description =TPA: pol polyprotein [Schistosoma mansoni]
MLVVRMLMLTRIDYDEVFHNVTDASSTALGGLLLLHDAETRKSQTDHQLARWLIELQNYQVKIVHVAGKANTLADALSRAAEDKPLSEIYNVDELEEIIEFPVCLALAAHSRVVADPFLHTLTIRHEDGNTYEVNLLEEQAGDPEAAAYIAFVRDGEFPADLDEKEKELFGGLIFESLHSSLFTWWSFELQENNCQMQKIFLAQMYSDVLTWVKLCVTCQLRHNPTPAYREEMLMVAGDTLFAKVGLDLAGPFPVTQKGNKHILNIVCWFTKYVISVPVPDTKAQTIAHAFLTNCYLKYGGCVELITDNASAFTSEFFKEFCSMLYIDKKYACPHWSQGNASTERTFRTFHNILAKYISKTQPDFDEFLDAANFCYNTSVHAST

SEQ ID NO: 131523 - protein, 114 aa, Heterodera glycines
  Coding regions on vcDNA: vcDNA=SeqID_57946; Strand=-; Position=1 -106,169-407
MPKEPSSRAFLFKKWVSNYMNDVYTTDSKIIYCQAYPGFDTICDIGKILSGQKINFGMPPNLISLYKYAPLTSCDVERSFSIYKSILTDNRSRLSPENLEMLLICNVNLNNDLA

SEQ ID NO: 131524 - protein, 153 aa, Heterodera glycines
  Coding regions on vcDNA: vcDNA=SeqID_57947; Strand=-; Position=1 -88,288-445,526-609,751-882
MAKGSDNTDGGKMDEFIKNAKTMRAKIRTDLSRSIYESELTVQNCDEKLKEYFECKGAENPEFFKQFFGLTEMNELLSNLQKGTNWLPNLLAIETSEKMSELKNVAESKKLSFESKNVGIRKKKKWTPKGAIDIRSNPLVVEFVQRDIGVAKR

SEQ ID NO: 131525 - protein, 80 aa, Heterodera glycines
  Coding regions on vcDNA: vcDNA=SeqID_57948; Strand=+; Position=1 -110,284-416
MDFPWHLWPRYVVRVFVRVVRFMKNKNQKETNYYSFSLSVAEGHQIDELVNEINKSELDVNAQIGIQFREVLGRMLISYT

SEQ ID NO: 131526 - protein, 151 aa, Heterodera glycines
  Coding regions on vcDNA: vcDNA=SeqID_57949; Strand=-; Position=1 -178,816-1093
MRGLHLDLQTGGAVQWRDAAGGYEYAKQTLLNWQPTDLNKIKRNGMPDGTLMYPDFVLRHSSEQLMHDNNRQFLQEIQLISSNDVFKLKMASKMFLSGSFEVLDKFNSKINTFYGSNFEKINFREGIDAANVKENILHIIKIFLNILCKNL

SEQ ID NO: 131527 - protein, 157 aa, Heterodera glycines
  Coding regions on vcDNA: vcDNA=SeqID_57950; Strand=-; Position=1 -60,103-323,393-587
HPTYSFGTQREFFDLETGPGRLINVAADGNCFYNSLSVLLTGSELKENAGIIRRAITEYIESEVELNEMGIPWHGWWEMFHPGQTLYDSSGNENHKEPAKSASERHKWGSNVDFLAAAKLFQINVIVCSPNPQRKEDFGIQYVWNIYTPDMLDTVSI

SEQ ID NO: 131528 - protein, 16 aa, Heterodera glycines
  Coding regions on vcDNA: vcDNA=SeqID_57951; Strand=-; Position=1-49
EAIPEGFGLPINLGAS

SEQ ID NO: 131529 - protein, 103 aa, Heterodera glycines
  Coding regions on vcDNA: vcDNA=SeqID_57952; Strand=-; Position=1 -219,356-446
VANVYLCPITAGATPNVETELAEQRNVAECKQYSTNLWYDFYEINGVDKAGEYVLKLTESTKPSLIYVYEQKTVLQEGIRILFINDEAKLPNLEGSYHFRAPF

SEQ ID NO: 131530 - protein, 25 aa, Heterodera glycines
  Coding regions on vcDNA: vcDNA=SeqID_57953; Strand=-; Position=1-77
MGSRSNCDSTIIRAHQTMNGTTISK

SEQ ID NO: 131531 - protein, 185 aa, Heterodera glycines
  Coding regions on vcDNA: vcDNA=SeqID_57954; Strand=-; Position=1-556
MSANTDGQRLSPSPEDQLQFDEISLNMAPVHPMSYVLTPAEDAILSSSSAEQSPASGTSPTATVPPVAIAERIYHCQQQQRQQPTEATDSVKIEATDSAKGNVTLPETLPNPSRNTQQMPPAQQSPPPIYSAIYPPGTHPAVPSGHIPQLANCTPTYIIDASAIRSGRATDCEVSPTFLVHGTAG

SEQ ID NO: 131532 - protein, 101 aa, Heterodera glycines
  Coding regions on vcDNA: vcDNA=SeqID_57955; Strand=-; Position=1 -159,208-355
  Homolog annotation: Hit_ID=CAE66838.1; Match level="QueryCoverage =83%, HitCoverage=18%, E-value=1e-28, Identity=66%"; Hit description =Hypothetical protein CBG12208 [Caenorhabditis briggsae]
TFVLLNVPNYAFRLYEAVFDVQQTHLWQFAFFITYLLYYLHHAVLFYMYIFWSPQMKKQLMPTALKLLECYCFKTVPEFGHRQSQMSFHPAQHSKLVANRS

SEQ ID NO: 131533 - protein, 267 aa, Heterodera glycines
  Coding regions on vcDNA: vcDNA=SeqID_57956; Strand=-; Position=1-804
MKFTKKMLMIPEAEYLALRSVMNSGDYLQNEKASLDAKISQNLQDPDINEELKAKRHDWLYKERRTVKGILENRPQKVVIENHVPGPNVAPYLGLNTQSKPQETDEPRKIIIPRKRLKEQTPDPESDTDTLEELTREPQTTHTLKTPIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIAREKKPFKPLIWARL

SEQ ID NO: 131534 - protein, 129 aa, Heterodera glycines
  Coding regions on vcDNA: vcDNA=SeqID_57957; Strand=+; Position=1-392
ETNDPNAFYFTFTLRKYVNVNEKENHEQNVECVDYAEAKDPKLEQLFLEMKKGLEQLYLEIKKVEQKFDAYIYSKEKMEEELIPKMEDVVPKTEDVVPKIEEVVPKIEEVVPKMEEVVSNRCSTAAHGR

SEQ ID NO: 131535 - protein, 188 aa, Heterodera glycines
  Coding regions on vcDNA: vcDNA=SeqID_57958; Strand=+; Position=1 -29,263-449,1575-1805,2476-2595
  Homolog annotation: Hit_ID=AAN08587.1; Match level="QueryCoverage =64%, HitCoverage=26%, E-value=6e-33, Identity=59%"; Hit description =putative esophageal gland cell secretory protein 21 [Meloidogyne incognita]
MKTNCCWSKRGPSKFSNPCICPEQMITHLDIPFLDRNILQLWRHGDRSPLGTFKNDPNQEDAWPQGWGQLSAKGMAQHVKLGAKLKARYIDGLNFVNRRYLSKEIYVRSTDLNRTLTSAIANLIGFFDRGIAGTDYPSERQAQWWPHGWQFFADLSNLTGEQIDLFNFYLIPDTLFIEVKCTRDRREL

SEQ ID NO: 131536 - protein, 94 aa, Heterodera glycines
  Coding regions on vcDNA: vcDNA=SeqID_57959; Strand=+; Position=1 -8,214-289,816-1016
  Homolog annotation: Hit_ID=AAN08587.1; Match level="QueryCoverage =85%, HitCoverage=17%, E-value=4e-13, Identity=46%"; Hit description =putative esophageal gland cell secretory protein 21 [Meloidogyne incognita]
MGCYPHYTACVTVELWRNVTNGGEPYVKVLYWPPELAGFKDITHNITGCETNATLNQFVARSRIFKPMPSPDEYCKDTYFPSNTIVDPTFDQQL

SEQ ID NO: 131537 - protein, 195 aa, Heterodera glycines
  Coding regions on vcDNA: vcDNA=SeqID_57960; Strand=-; Position=1 -144,192-368,574-837
  Homolog annotation: Hit_ID=CAE67428.1; Match level="QueryCoverage =100%, HitCoverage=24%, E-value=1e-74, Identity=65%"; Hit description= Hypothetical protein CBG12918 [Caenorhabditis briggsae]
MKSLYNSTNGLVVMADSFDSTLFKQTFQKVFEKDADGNLKMTFNATLEVKVSNGLKVEGILGCCSSINAKNSMVSDTEVGIGGTTQWKFCSLTPRNTIAVAFEVSGQHGTGIPQGARAMLQFITQYQHSDGHRRVRVTTTCRSWADMEANKQSIGYSFDQDAGTVFMARLASWRAANENDSPDTLRWLDRSLIRL

SEQ ID NO: 131538 - protein, 40 aa, Heterodera glycines
  Coding regions on vcDNA: vcDNA=SeqID_57961; Strand=-; Position=1 -85,172-209
MRWEETDDEEGEEIETLGDDRSIIFGDQDTITFNRLFNAA

SEQ ID NO: 131539 - protein, 30 aa, Heterodera glycines
  Coding regions on vcDNA: vcDNA=SeqID_57962; Strand=+; Position=1 -6,1010-1096
MGAIRKHLGLPNDINQKIYHSEAPKWQRYG

SEQ ID NO: 131540 - protein, 18 aa, Heterodera glycines
  Coding regions on vcDNA: vcDNA=SeqID_57963; Strand=+; Position=1-57
NYQNYSDAYQNFQNCSGL

SEQ ID NO: 131541 - protein, 347 aa, Heterodera glycines
  Coding regions on vcDNA: vcDNA=SeqID_57964; Strand=-; Position=1-1060
  Homolog annotation: Hit_ID=NP_508324.1; Match level="QueryCoverage =97%, HitCoverage=12%, E-value=4e-50, Identity=34%"; Hit description =predicted CDS, peptidase family A16 and RNA-directed DNA polymerase and Integrase, catalytic domain and Z
HLIIRDHHQRNLHAGTMTTLAEIRKTYWIPKGRRIVDQIRKQCFYCKRYNAKPYQQPKMPQLPKSRVQITEPFQNVGLDYMGPLQVKSFTEKCWIILFTCFTTRGIHLELVTSLSVQHFLNAFRRFISRKGTPKNIWSDNASQLKLASKVLPEELKEMLKDESIKNYFEKENIKWIFSIELAPWQNGAIERLNQNVKSAMKKAIGRKLIEFDSFQTLICEIEALVNSRPITFIYDEINSYQILRPIDFILPHKNLCIPPILEVNETNDPTYSTYYDQTIELWKKTTKILDDYWKIWIEEYLPSLRERYKTENKNPKNCVKSFPEINEVVIIHDETPRAMWKTGIIKI

SEQ ID NO: 131542 - protein, 635 aa, Heterodera glycines
  Coding regions on vcDNA: vcDNA=SeqID_57965; Strand=-; Position=1-1908
  Homolog annotation: Hit_ID=NP_508324.1; Match level="QueryCoverage =88%, HitCoverage=21%, E-value=6e-48, Identity=24%"; Hit description =predicted CDS, peptidase family A16 and RNA-directed DNA polymerase and Integrase, catalytic domain and Z
MNEYKPVIKFIKGTSSPEYKNLTCSPSPICELIICRFCMEYIRNPQCVGQMHWALILIMIMLTLYVITLCLKIIRILYRFIVFIFLSVYNCCRKRKLKKIKIIKRKQFIYLIMISLLLNSPTIFSCDEVTNMVAGTNDCAIDQNGKIECIYDQTTQISITPEHKTCLKLDNEKTHTTMETIELSVESLTIICAERSEYFMRDYQLLSSSQKRCSGAGKCTGQICQTLTMKGKNPEIGDHANNQPGYSYCVPSCGGWHCKCFLATDGCLFYRTYTEPINRNIYEVVKCPTWTILATIKISLDPKTIHTVELKPGVLTHVKDSNLSLTLTSTSIPPTPLFGSKFIIDRSNAKAVIVDNENLLKNSLRCETKEKATKFSCTFPPEACQCHGGDSVVHCECEKNPLTEMFTRKENILPLETHGSQVFFDTLLRAKIKLTTSLQVQVTLKGHKVKAIYDKNNCTVKTKSLEGCYSCTNGAEFKFTCTTNFGTALANVKCHSQNFQIPCDTKGNQQQIQLSFNQPSVKEKCEVICPDGKSEITIEATLNYVSQQDKIINPSNNKKETPVLGTSLEQFSDIFNFIYTLIKTNLFNFLTILFTLIVMITFIICICPMIYPLLFKYFPFRRGNVATTRNRIIYI

SEQ ID NO: 131543 - protein, 125 aa, Heterodera glycines
  Coding regions on vcDNA: vcDNA=SeqID_57966; Strand=-; Position=1-378
MDKNIFSSIMLYDNSIHAVKSLNLLHSQADSRIDFRCLGEGNLTIGTKKFCQEHECTDTLGTKFCFYEPHEKTYLVKSDREIIPIKAWGSIERIFYLANDTLMDELKRKKENSIRSKTNKYPLNV

SEQ ID NO: 131544 - protein, 104 aa, Heterodera glycines
  Coding regions on vcDNA: vcDNA=SeqID_57967; Strand=+; Position=1-314
MAGTAVGSAATPMINGAVRGELLVEEEMRRREEERRDAQKALEKLKKEAQKAAERGGGEPPQQFPIPWALVILLMWTMLSAALFCIWETEWGYMTSIYFFFIAI

SEQ ID NO: 131545 - protein, 38 aa, Heterodera glycines
  Coding regions on vcDNA: vcDNA=SeqID_57968; Strand=-; Position=1-411
MKIERARFDEVLVRQKKSKHLKIYKNFKNENSCEIFWK

SEQ ID NO: 131546 - protein, 38 aa, Heterodera glycines
  Coding regions on vcDNA: vcDNA=SeqID_57969; Strand=-; Position=1-211
KRIERTRFDEVLVSQKKSKYLKIYKKFKNENSCEIFWK

SEQ ID NO: 131547 - protein, 117 aa, Heterodera glycines
  Coding regions on vcDNA: vcDNA=SeqID_57970; Strand=-; Position=1 -187,221-387
MANGTFAPQQTPFVLPHFANSDNISVQTVGTDQIHLGTATTRTPRQIGVRLGVDNYPENSGQILFSTPSVVRSSNSSIPTRNWRNSAETVAFHSAGECQRQKPGLMSLVGEWTNDFV

SEQ ID NO: 131548 - protein, 65 aa, Heterodera glycines
  Coding regions on vcDNA: vcDNA=SeqID_57971; Strand=+; Position=1-196
IIVDSESDSNLTRCPCCRCAQVNLICANCLNTNVVRIGKVREDKRRLLRSKSAICHLIQNALADE

SEQ ID NO: 131549 - protein, 364 aa, Heterodera glycines
  misc_feature (152)..(152): Xaa can be any naturally occurring amino acid
  misc_feature (159)..(159): Xaa can be any naturally occurring amino acid
  misc_feature (174)..(174): Xaa can be any naturally occurring amino acid
  Coding regions on vcDNA: vcDNA=SeqID_57972; Strand=+; Position=1 -99,154-370,599-873,1267-1634,1688-1783
  Homolog annotation: Hit_ID=NP_492946.1; Match level="QueryCoverage =96%, HitCoverage=9%, E-value=1e-49, Identity=35%"; Hit description =DYStrophin related (417.4 kD) (dys-1) [Caenorhabditis elegans] emb|CAB61005.2| Hypothetical protein F15D3.
RCFNFDICQNCFSQRTAKSHKLSHPMQEYCTPTSAGDDMTSAGDDMRDFTVIIKNKVRQGKSRIGYLPVEQINEGPPLECNDQTPQNAETEAMHQRMQLIAARLDKRQTEAANFLAHQHEAKSPNQLISQVEQASKEELGQMLQKLQYEHEXKEKHTKXIRKLSLEQRIEKGNXRAEGTESGGNAIPFRNEIHAEFILSTNTEMAVLAEAHHLRQHQKRLEERGIVLEDQNRQLQMQLERLQMLIQTQKRKGENGNWMIKKGRPPNTANNRRATVSQSARLYLLNRRGRHGHGNACAGDANQRDKAIGISSGQLGTEIRRMLRLRETVDELNMLRLRETVDELNRAMENFVVFTQNCAQKEQQQ

SEQ ID NO: 131550 - protein, 136 aa, Heterodera glycines
  Coding regions on vcDNA: vcDNA=SeqID_57973; Strand=-; Position=1 -56,161-513
MLKFCPSFERPMRNVVKCATTGESRGSGTTTSDGGGRNGFAGGVIQPKQSLLKGSTAQQQKRPTQPPIIRRNERKSATTDEKANAKGTENGNAMAIRSFSLHQHETGSSLSNALDSRCTKMAVVTIAAFVAFNWLA

SEQ ID NO: 131551 - protein, 335 aa, Heterodera glycines
  misc_feature (9)..(9): Xaa can be any naturally occurring amino acid
  Coding regions on vcDNA: vcDNA=SeqID_57974; Strand=+; Position=1 -47,109-271,317-478,526-654,707-871,931-1077
  Homolog annotation: Hit_ID=XP_312548.1; Match level="QueryCoverage =99%, HitCoverage=33%, E-value=4e-79, Identity=47%"; Hit description =ENSANGP00000014259 [Anopheles gambiae]
LNLALRNRXKRATAANVKILNAGAWSRSRDRSHLTLPRELEDLIPEVEDFYKKQHCGRKLNWAHHWSTGTVSFTSKAGRFDVSFTSKAGRFDLEVTTHQMAILFCWNDRPNDKLSFATIRLATELSEGELARSLLTLVNFPKVRMRLILCEIAQQPSLLTLVNFPKVRMRLILCEIAQQPLIPKSFNDSTLFWLNHEFCLIKNEKPQSRGKINLIGRLQLNQDIKNEKPQSRGKINLIGRLQLNQDAGIEQEHEEILQLRTFRVQEAIVKIMKTRKRLNQAQLQTEAQLQTELVDVLRNMFLPSRKLIKEQIEWLIEQKFLKRDDMDMNTFIYVV

SEQ ID NO: 131552 - protein, 57 aa, Heterodera glycines
  Coding regions on vcDNA: vcDNA=SeqID_57975; Strand=+; Position=1 -29,628-772
MFVVVLFCLCIKKENKTLANWSAIVPNTVLSCLLLINEFFQASRPRVVQSASAKNRH

SEQ ID NO: 131553 - protein, 213 aa, Heterodera glycines
  Coding regions on vcDNA: vcDNA=SeqID_57976; Strand=+; Position=1-642
  Homolog annotation: Hit_ID=NP_702892.1; Match level="QueryCoverage =66%, HitCoverage=11%, E-value=9e-10, Identity=28%"; Hit description =Plasmodium falciparum trophozoite antigen r45-like protein [Plasmodium falciparum 3D7] emb|CAD49281.1| Pl
MIIIVLICYVISNDKEKDKAHTSIGNSKAHKSDLYSDKSNLQPEDAQINQQHLNANRDSNKFDHNHNNGTNTNCDANQHDQHHHANGVDGDSDDNQLDQLYANHQLVQLHANGNNDHPENDNLYDNNNSDKSKIVDLDDEFRDQFPELTKLPELNGVEFVGNHIKYTNQPKSDTHKDKENYNSTRTYLREFNIYSVFVRWTDTAESFDIERKK

SEQ ID NO: 131554 - protein, 234 aa, Heterodera glycines
  Coding regions on vcDNA: vcDNA=SeqID_57977; Strand=-; Position=1 -408,844-1140
MKATEMLEKAQILYNGLITGKIDRNSATVWVEENAMVGILCSIEIADLKIDANFRELLMNLCQQLVQGNHIEANTVTNLDITVTQLLENVDVDHIIDELKQKISKSKFIGDKIKENLNKLLAHFNLALRIFLSSKQKTVTAASNAIASGQPMAGERRQKRMNNNNDNGNDWFRRRLSLTVLNVHDRSAGGSDDVSDWPAWVKCAFRALVCAVLLLAVIYVERRLGAATVSTSVA

SEQ ID NO: 131555 - protein, 25 aa, Heterodera glycines
  Coding regions on vcDNA: vcDNA=SeqID_57978; Strand=-; Position=1 -52,151-176
MEKACKIWRDYIDFSALEKASESLI

SEQ ID NO: 131556 - protein, 88 aa, Heterodera glycines
  Coding regions on vcDNA: vcDNA=SeqID_57979; Strand=-; Position=1-399
LFEYPKRTLEKIDFFVFGAVPPNRCAQIYGETESFRNSFPIACTLILRWIFAPHNCLSTPNGHLKKSIYLCFRGCPPEAMPPDLWRDR

SEQ ID NO: 131557 - protein, 253 aa, Heterodera glycines
  Coding regions on vcDNA: vcDNA=SeqID_57980; Strand=-; Position=1-759
  Homolog annotation: Hit_ID=XP_308192.1; Match level="QueryCoverage =98%, HitCoverage=62%, E-value=3e-76, Identity=54%"; Hit description =ENSANGP00000021557 [Anopheles gambiae]
MPAPNDIPSLRSFLGMVNHYQQYVKNMRFIRKPLDDLLKKEIDWSWSEGCENAFRKIKEILASDLLLTHYDPKMDIIVAADASELGIGAVIYHKFQDGNIKAIAHASKSLAPAEKNYSQIEKEGLALIFAVQKFHKMIYGRHFTLQTDHKPLVSIFGSKKGIRQCSANRLLRWSLILLAYDFTIEYINTKDFGQADALSRLIAKGNETEDEKIIAMINAETDFETNFGQTISKLPLKFSDLVAASERDENIIQ

SEQ ID NO: 131558 - protein, 122 aa, Heterodera glycines
  Coding regions on vcDNA: vcDNA=SeqID_57981; Strand=-; Position=1 -103,153-268,350-416,1347-1429
  Homolog annotation: Hit_ID=NP_507528.1; Match level="QueryCoverage =86%, HitCoverage=48%, E-value=7e-15, Identity=42%"; Hit description =microtubule-associated protein RP EB family member (5S541) [Caenorhabditis elegans] emb|CAC14409.1| Hypot
MTHSKFPPNLQLIEELKQKNTEIDELRNQLAESDEVISGLERERDFYFVKFAKFEKEIIISVFHFKAKLRKIEDSENVGSLEVASVLQILYETEEGFAPPTDDGTNGTSNDESGDIGTQLKD

SEQ ID NO: 131559 - protein, 52 aa, Heterodera glycines
  Coding regions on vcDNA: vcDNA=SeqID_57982; Strand=-; Position=1 -24,208-276,326-349,1622-1661
MALVTNIPLTSANVEPLSRHEMLTWVNLSLASEFAKLEQETIGHRKSDTRGK

SEQ ID NO: 131560 - protein, 210 aa, Heterodera glycines
  misc_feature (198)..(198): Xaa can be any naturally occurring amino acid
  misc_feature (208)..(208): Xaa can be any naturally occurring amino acid
  Coding regions on vcDNA: vcDNA=SeqID_57983; Strand=-; Position=1 -123,298-407,469-497,547-620,663-693,853-1032
  Homolog annotation: Hit_ID=XP_234900.1; Match level="QueryCoverage =88%, HitCoverage=30%, E-value=7e-44, Identity=51%"; Hit description =similar to serine/threonine-protein kinase LKB1 [Rattus norvegicus]
KPPKIIEGYLFGDLIGEGSYSKVKEVVHVRSLMRRAVKIIKDKRLRKIPGGEQNVHREIDVLRRLNHRNVVKVFDIFRIEEKQKLYIVIEEKQKLYIVMEFCVCSLQQMEFCVCSLQQMLDNCTEKMLSEFQAHLYFTQLIDGAHLYFTQLIDGLDFLHTKRIIHKDIKPANLLLSLDGILKICDLRDKYLCAKNNNXRAHSNSIYIXSI

SEQ ID NO: 131561 - protein, 95 aa, Heterodera glycines
  Coding regions on vcDNA: vcDNA=SeqID_57984; Strand=-; Position=1-286
MTINEAFSISKAHDDENLQPPVAAFSPFAIADTSQELHYSQPAPSSVDYFFWQSDEASSSSVCAEERRQMYEQYGGQKQMRRTENDKNTEQCQRN

SEQ ID NO: 131562 - protein, 50 aa, Heterodera glycines
  Coding regions on vcDNA: vcDNA=SeqID_57985; Strand=-; Position=1 -58,235-329
MPGFCLGQPNSMDLDPGFRSMDASNVGLSMGLDVLSRIKNDKFGCTKRSN

SEQ ID NO: 131563 - protein, 31 aa, Heterodera glycines
  Coding regions on vcDNA: vcDNA=SeqID_57986; Strand=-; Position=1-114
LGSSKQEAFRFSLNCSAANNFACFFVFYFVA

SEQ ID NO: 131564 - protein, 19 aa, Heterodera glycines
  Coding regions on vcDNA: vcDNA=SeqID_57987; Strand=+; Position=1 -3,427-483
MKGVRNFFLKNRIFPEILE

SEQ ID NO: 131565 - protein, 124 aa, Heterodera glycines
  Coding regions on vcDNA: vcDNA=SeqID_57988; Strand=+; Position=1 -76,229-331,750-945
MRGFSFDLSLASVFIFLLSCLLGVLGQNGTPESAMGRRRTPRWARPGFVTIYVLSDEVVGKTFPKTELSTVSSSANDHNSNHHHHHHNEHSQLSMTNMANQPHLIRIRNEGAGASVIRDNSIGV

SEQ ID NO: 131566 - protein, 120 aa, Heterodera glycines
  Coding regions on vcDNA: vcDNA=SeqID_57989; Strand=-; Position=1 -55,465-617,1232-1266,1299-1418
MGFFPPTIKADAEPPAVKQIYIPMLKKKQTMLSQKANYKSCRIMPIFSIQISEIGYHSKTQLNSGKWPAEILATFLKNRKNQFSIYQFEYIYKFDLGKKEFLNKCIKLNERYENANGKKR

SEQ ID NO: 131567 - protein, 305 aa, Heterodera glycines
  misc_feature (68)..(68): Xaa can be any naturally occurring amino acid
  Coding regions on vcDNA: vcDNA=SeqID_57990; Strand=+; Position=1 -137,760-1006,1312-1437,1682-1856,2110-2225,2308-2426
  Homolog annotation: Hit_ID=CAE73359.1; Match level="QueryCoverage =99%, HitCoverage=63%, E-value=4e-61, Identity=44%"; Hit description =Hypothetical protein CBG20791 [Caenorhabditis briggsae] emb|CAE73356.1| Hypothetical protein CBG20788 [Cae
ATGLRPSLNSDLTLTVTLENDEFVQSDFDFLVLHFPDEFMRGHGNRLKIKWANLKISQKYFKILLHIXIPFFASIFKFSPASLPCTCKSVTLERLPLFIGGRYCKYSRALPQSPWIGASDEEAPPAAVISEKIAGAMVRHFGADGSRFIASGREDIDVRMLGNGRPFAVQLLNARKTACLRSASAATALSALAAQINASEERTRDISVHALAHVSAKQAQQLNVGQEEKRKTYSALCCTRTPLVDDVPAHAARAPIPLQVAQRTVVRVLRRRPLIDRTRFVYTMRAFALDRHHFVLRLETQAGTY

SEQ ID NO: 131568 - protein, 35 aa, Heterodera glycines
  Coding regions on vcDNA: vcDNA=SeqID_57991; Strand=+; Position=1-106
MTYFLSAHGGRWFGGANANKSADIALCPICTMPKG

SEQ ID NO: 131569 - protein, 217 aa, Heterodera glycines
  Coding regions on vcDNA: vcDNA=SeqID_57992; Strand=-; Position=1 -444,627-744,815-905
  Homolog annotation: Hit_ID=AAM18623.1; Match level="QueryCoverage =98%, HitCoverage=80%, E-value=1e-123, Identity=79%"; Hit description= C-type lectin domain protein [Heterodera glycines]
MSHSLIKASWTDGKPVDYLSPTEWGAYKRPLTMDNAGGAGYNKENENCVFLGQWPRKVKEYLSLETALDKSGVDVLWMDVVCEKPEEYWAPHGAVCKMRAKEEEKGYGKDKYGAKEEEEEEDEELRKINKYVTIGSGNFIYANKNTYMILLLKDLYGKQLKEESRKKVCELYNGEYVKVKDEPKEAQEYLDKVLAKEKELYSDSSDHMFCRFTGIIG

SEQ ID NO: 131570 - protein, 22 aa, Heterodera glycines
  Coding regions on vcDNA: vcDNA=SeqID_57993; Strand=+; Position=1-67
MPFTAAVVQNAGESVEDVESAK

SEQ ID NO: 131571 - protein, 68 aa, Heterodera glycines
  Coding regions on vcDNA: vcDNA=SeqID_57994; Strand=-; Position=1-205
RAVSSLPPSYSLPMNSLSPFSSSVPHLPMPFSSSSSPSSASSSFSSSSAAPSDSLLLDYLFSGYDKRI

SEQ ID NO: 131572 - protein, 73 aa, Heterodera glycines
  Coding regions on vcDNA: vcDNA=SeqID_57995; Strand=-; Position=1 -40,95-220,312-390
MFERQLEANNTGYLVGDKLTWVDFYVASFADLALTFGRFDILDRFPRVLHHCRAVFSLPQLQQHIKNRPDTLF

SEQ ID NO: 131573 - protein, 276 aa, Heterodera glycines
  Coding regions on vcDNA: vcDNA=SeqID_57996; Strand=+; Position=1-831
  Homolog annotation: Hit_ID=NP_491240.1; Match level="QueryCoverage =86%, HitCoverage=18%, E-value=2e-30, Identity=35%"; Hit description =zn-finger, CCHC type and RNA-directed DNA polymerase  and Integrase, catalytic domain containing protein
MRRIFATHGLPEQIVSDNGPQFTSGEWHEYCNSRGIEHTLTPSYHPMSNGEAERFVQTFKHMMQRQKDGGVPCDEALHQVLGLYRVTPHPATNASPAEKLFGRKLRTMLDLARPTDENADQNKPKLSPTYRDRIKRNFDRGTRDRTFEIGQKVFVRNYRDGPKWFRGLIITKNGVIYLVRTLRGVWKRHAYQLKPDLTVEDQPDNESVDSDSDADDQQQEAEDEQNNGPAPPDLRRSQRTKKKPQIFDPSSGSLIRREGCDVFIPLFIYRLFFAVP

SEQ ID NO: 131574 - protein, 112 aa, Heterodera glycines
  Coding regions on vcDNA: vcDNA=SeqID_57997; Strand=-; Position=1 -115,196-416
MDQQQKIKTKRNKVKLEHDGALYVFDQLSTDGLKKFWRCRLHTDLNNVVQKLVGVHSCDMNAAHVECQRLVTGLKRRAAETCEAPATIRAQVLQNTCTPVLAAFPSKSATKK

SEQ ID NO: 131575 - protein, 55 aa, Heterodera glycines
  Coding regions on vcDNA: vcDNA=SeqID_57998; Strand=+; Position=1-190
TKLRLFKLYNMDQQQKIKTKRNKVKLEHDGALYVFDQLSTDGLKKFWRCEFHGPS

SEQ ID NO: 131576 - protein, 60 aa, Heterodera glycines
  Coding regions on vcDNA: vcDNA=SeqID_57999; Strand=-; Position=1 -46,167-306
AASRPRTGALRPFFKFCWAYTGASRPFLKFVGLLRQLRGLRRALRAPFLNFVGLIRALRA

SEQ ID NO: 131577 - protein, 153 aa, Heterodera glycines
  Coding regions on vcDNA: vcDNA=SeqID_58000; Strand=-; Position=1 -20,63-504
  Homolog annotation: Hit_ID=CAE74243.1; Match level="QueryCoverage =64%, HitCoverage=15%, E-value=9e-15, Identity=41%"; Hit description =Hypothetical protein CBG21928 [Caenorhabditis briggsae]
MSRFLTRLEAPGYHSIVDYPMSFSTIHDKIDNNMYLNLDQFKSDICLVSDNAMLYNNTGSVYFLAAQKLKVLAKYYFSEKYLLFLVYSLPFGKALTEEQLGIRLRRKEEQTPRQLKEKSGRERPLPFLRQSLAFIRVKIMKLILVTVKKLRKY

SEQ ID NO: 131578 - protein, 50 aa, Heterodera glycines
  Coding regions on vcDNA: vcDNA=SeqID_58001; Strand=+; Position=1 -77,136-211
  Homolog annotation: Hit_ID=NP_495544.1; Match level="QueryCoverage =100%, HitCoverage=21%, E-value=8e-16, Identity=76%"; Hit description= RNA polymerase II (2H665) [Caenorhabditis elegans] gb|AAC71124.2| Hypothetical protein F43E2.2 [Caenorha
MHKFEVAQIANLCPETAEEAKALIPSLENKMEDEELDELLKELHAKKTFQ

SEQ ID NO: 131579 - protein, 70 aa, Heterodera glycines
  Coding regions on vcDNA: vcDNA=SeqID_58002; Strand=+; Position=1 -60,706-804,836-889
MFTGDAYGIISRLIFFSFSKQFFLTKDKEITVVITYHKFDKFLNTFLLLALLKMIRMIFHGKIFQINVFF

SEQ ID NO: 131580 - protein, 244 aa, Heterodera glycines
  Coding regions on vcDNA: vcDNA=SeqID_58003; Strand=-; Position=1-732
MIVRSPPLTRQRAQNAGIILNQEGQEIFRENRNNTENGLRQNEDGMSEHSNFSEPMMNTEQIHDALLDVGQRNVRDGEEDKENENEQVDNANGFGGLNFENFENLEERTFNVHNRNVSLTDFDAGRMFENVRLERQQNLLPISFPIASTPVENRVANQMGMDQVRENFSVIARLEKELVINGEPQIVTRQQRNPTSVAQPQRVIHQMNLGRQNVQHQNYQHEYGTPSAPIQQYVQFVEQPNMNT

SEQ ID NO: 131581 - protein, 77 aa, Heterodera glycines
  Coding regions on vcDNA: vcDNA=SeqID_58004; Strand=-; Position=1 -227,448-454
MCQKYLPTFPLLDCADFDGAFDGPPTEVAKLSAEFARQNLSPSERAKAILRLFSDFSRQSAAHSFLFVFHNHFSKCL

SEQ ID NO: 131582 - protein, 160 aa, Heterodera glycines
  Coding regions on vcDNA: vcDNA=SeqID_58005; Strand=-; Position=1 -258,1452-1589,1741-1827
MNEKRQKKRRKRRRFRRKSQHLSKSAVGQPQAMELIDEIHSSAEEEEKEKEKENGAEEVVFVCTSTTSETEDEADEIEQQRQRQQQTMELVDEIHSTAEELGGEEEEVIFMCTSTASEEKEETQQQKKKERKEIASADCENGGALVKCEAAEEQPKEQRM

SEQ ID NO: 131583 - protein, 51 aa, Heterodera glycines
  Coding regions on vcDNA: vcDNA=SeqID_58006; Strand=+; Position=1 -97,337-395
MPLILCQMLLFAPWANFSRHSEKHGPLTKREKEKVTHRKTTFAINLEIWVF

SEQ ID NO: 131584 - protein, 106 aa, Heterodera glycines
  Coding regions on vcDNA: vcDNA=SeqID_58007; Strand=-; Position=1-321
  Homolog annotation: Hit_ID=CAE75230.1; Match level="QueryCoverage =90%, HitCoverage=100%, E-value=5e-18, Identity=68%"; Hit description= Hypothetical protein CBG23181 [Caenorhabditis briggsae]
MCRHQRPNRRSDNRRTEKGSGAFGGAAGMEKEANDKGKMGKKKKGKKKKGKKKKGKKKKGKKKKGKKKKGKKKKGKKKKGKKKKGKKKKGKKKKGQIKNKMGRIDH

SEQ ID NO: 131585 - protein, 663 aa, Heterodera glycines
  Coding regions on vcDNA: vcDNA=SeqID_58008; Strand=-; Position=1 -140,224-443,617-847,905-992,1045-1214,1311-1629,1830-2006,2076 -2326,2381-2637
  Homolog annotation: Hit_ID=NP_502422.1; Match level="QueryCoverage =91%, HitCoverage=60%, E-value=0.0, Identity=61%"; Hit description =beached 1 (103.9 kD) (4N439) [Caenorhabditis elegans] emb|CAB07677.1| Hypothetical protein VT23B5.2 [Caenor
MFRCARVQGLDIMEGLLLFGKDHFYVVDGFTLLKTREIRDLDFLPEQFHDPIIPYIFHDPIIPYIAMGCRSRPLSTKVNRQCNKFAYDDIKEVHKRRYLLQQIALEVFSTDGRNFLLAFPRKVRDHVFQKLVSMAKNASSDVAQFMNEQKKLRPTETSSSLIAQLLTGQQQSITHKWQRGEISNFHYLMYLNTLAGRSYNDLSQYPVVFPWVLADYDSDRIDLTNPSIFRDFSKPMGAQNPDRLAQFLKRFAQNPDRLAQFLKRFREWDDPGGTPPYMYGTHYSSAMIVLSYLVRLEPFTQQFLKLQGGHFDGGHFDLADRMFHSVRDAFWSAARNNMADVKELIPEFFFLPEMFLNENAFDLGIKQNGTRLDDVLLPAWAHGDAYEFVRLHRQALECDFVSEHLHEWIDLIFGYKQTGDAAREANNVFHHLFYETSIDIETIEDPLTRNATLGFINNFGQIPAQLFKKPHPQRKILLPPPVSPVPGPPPVSPVPGLTVPRLFYHCPEALRVSARPVKELRTAVGEIVVGERGNQAVVLEQNKVLVPPCYFLAWGFYDRSVRFGAVGNEKSSCVLETNSSCVLETNDVYEITCMATTDGRQMFAGLSTGNSFVLRPSKCHRIPSLGTVFVWSLSLSPAPSSVSASLSVSKSLPSARLVPKRAL

SEQ ID NO: 131586 - protein, 708 aa, Heterodera glycines
  misc_feature (91)..(91): Xaa can be any naturally occurring amino acid
  Coding regions on vcDNA: vcDNA=SeqID_58009; Strand=-; Position=1 -135,202-338,578-1040,1101-1240,1307-1454,1498-1686,1784-1953,1987 -2020,2076-2214,2261-2616
  Homolog annotation: Hit_ID=NP_502421.1; Match level="QueryCoverage =98%, HitCoverage=64%, E-value=2e-85, Identity=32%"; Hit description =WD repeat FYVE domain containing 3 (4N439) [Caenorhabditis elegans] emb|CAA21779.1| Hypothetical protein
RSVADAIERAQFCPEVIVSLLATIRATIHRQFEAEESGEQNANDWLLQLFNFLYQLLQLFNFLYQNSSQFFAICHTEAILITLMTILIFNXLINVKSFVVGQRSADGAFVRRTDRGKFHFQKTPFRLFSHLLLSAFVCFLRMPFFNNLLQYALPLQYMDCNGPTHNRQNLLFTELVNACLDHFMASKMFFLNSLGSAGRSPGGKAEPIVRVHSASVVRFLSRVIDTVWNCLYKGNPIRIFKCFLKALFITFNKAAAQLQCTNKAAAQLQCTDAHIASLFRLILYLLSRPIDNVDTQMCVLDTLAEIVRNNQQLFLTPNPTWTRFYAALVHLVFMLSDRPQFDLQDRRNRELERGTAQVSICAQSVWGILWQHKKVSICAQSVWGILWQHKKAVLEEWLKKGNLVDLFTSRAKCGEAANRAWLQFVDSQTVGAFSQSDSDSSAVRLLNAQKMLPTQLQTKLSRVARSGLRKLRKSTAMSSFANTSADDVESKQGLEVEPETFYMWIRVEPETFYMWIRVHISVHISLVRELIRNRCQRYHEWHSHVRKWSIQEWHNAETELIRERGLWGPNHGSLLDKFQLDITEGPRILWGPNHGSLLDKFQLDITEGPRIRRKLVPNPDFYRHYPYRPYLEGPNAKPLRAKVAISRDAKAYWERMSKTRAETMDERIVDFKAGLMPSPGGAITDQSVEGMGSDQSQNGSDQQPIESV

SEQ ID NO: 131587 - protein, 37 aa, Heterodera glycines
  Coding regions on vcDNA: vcDNA=SeqID_58010; Strand=+; Position=1 -18,129-224
MRAVPKCRRFSADDSVTTIQCEDDSVPTIQCRRFSVR

SEQ ID NO: 131588 - protein, 117 aa, Heterodera glycines
  Coding regions on vcDNA: vcDNA=SeqID_58011; Strand=+; Position=1 -240,286-399
MTKSIMTHAGGGFSSSFIFYKALTKMSPNENSDRPYQQTDNVQPVQLPQQQPDEDTELRAQIEDAEEDLLLNWWRKDPTMIRFLFGHRRAPAIEAALLQRAEREAEILRQYAENQQQ

SEQ ID NO: 131589 - protein, 21 aa, Heterodera glycines
  Coding regions on vcDNA: vcDNA=SeqID_58012; Strand=+; Position=1 -45,328-348
MFHPNFTHSVSNSSTDMPFEN

SEQ ID NO: 131590 - protein, 26 aa, Heterodera glycines
  Coding regions on vcDNA: vcDNA=SeqID_58013; Strand=-; Position=1-78
MNGGGDWAINGDWGINGDWGIIRENT

SEQ ID NO: 131591 - protein, 25 aa, Heterodera glycines
  Coding regions on vcDNA: vcDNA=SeqID_58014; Strand=-; Position=1-76
MSLASLLIVSFFQLYFSLTNKSLFS

SEQ ID NO: 131592 - protein, 80 aa, Heterodera glycines
  Coding regions on vcDNA: vcDNA=SeqID_58015; Strand=-; Position=1 -291,462-500
SVAGRRKLRTHESFFSWLSLSHMESARTLAQCLSEMARHANNETEPQRNVIKRKTSCSSGDLQQNQPSFASEQMDDNDTA

SEQ ID NO: 131593 - protein, 85 aa, Heterodera glycines
  Coding regions on vcDNA: vcDNA=SeqID_58016; Strand=-; Position=1 -11,63-309
MNRRWICTDIWMDIFPHFDCPQLGLKLALFSPRFDILVDKHFDVKNELTLWRTITICKDIGMPKPKFFVHGKSEGFPLPDRPLPL

SEQ ID NO: 131594 - protein, 330 aa, Heterodera glycines
  Coding regions on vcDNA: vcDNA=SeqID_58017; Strand=-; Position=1 -138,586-819,915-1535
MISNPIERVIYGYGELNTNILNLQRTGKIGWQCASHCTQWRPSAEQNICNVKKAKIVIREASDDQILCLVEICLNILKGRVPLDPRHLKMLKKHAQVLRHLTRTRCSRSAKKVLLQHGYGLSAIHTKRYLLVPEEIYQSLAAPPPSDGTPIGLVRTRIKQIKNDDRINEEERAVKYEQEIKRLNKLTRDEAERPVGVKLENLSDVVDAVLKPVNIKRPIVVATRRHLKVGRARKETVAELEDDDDDQAPRSSNSNKRQPTQTEILNLIYKNAQSLGVSAEGQVLRAGGRPFITSIVDDIVSHLLNKDKRSQNKEPTAFKNLLKGQGKIHS

SEQ ID NO: 131595 - protein, 79 aa, Heterodera glycines
  Coding regions on vcDNA: vcDNA=SeqID_58018; Strand=-; Position=1 -114,572-697
MTKVNKLSVDGTGNGANVQQCGATSGGGCGTENGYGLTQRQIHRAPAPKWGCRRHWPNVAEPIAGIPPHAVHVANAEFG

SEQ ID NO: 131596 - protein, 21 aa, Heterodera glycines
  Coding regions on vcDNA: vcDNA=SeqID_58019; Strand=+; Position=1 -49,227-243
MNAVATVAEDEHTTEKGKKKN

SEQ ID NO: 131597 - protein, 24 aa, Heterodera glycines
  Coding regions on vcDNA: vcDNA=SeqID_58020; Strand=+; Position=1-76
VTGVSIIAVLFLVFLMPLQNLVRF

SEQ ID NO: 131598 - protein, 108 aa, Heterodera glycines
  Coding regions on vcDNA: vcDNA=SeqID_58021; Strand=-; Position=546-872
MSELLRISIAPMVVRLKMYIETAQENLGKELADQSVRADLIAERQNLCKTISLLEKYNGKWEAIFLRVKGQALQDEEQNYRDFKPEGKAFMHWVDQAARAWATLLKGL

SEQ ID NO: 131599 - protein, 41 aa, Heterodera glycines
  Coding regions on vcDNA: vcDNA=SeqID_58022; Strand=+; Position=1-390
SKGLTLKLTTKNFCHYIDNQKKFFPNQRFFKYVLIIVLIVQ

SEQ ID NO: 131600 - protein, 36 aa, Heterodera glycines
  Coding regions on vcDNA: vcDNA=SeqID_58023; Strand=+; Position=1-111
DFFLHIVSDSFVDPRTPSWQKEVLTVGIESKKTISD

SEQ ID NO: 131601 - protein, 38 aa, Heterodera glycines
  Coding regions on vcDNA: vcDNA=SeqID_58024; Strand=-; Position=1 -45,812-883
MISDHLRSCAVGSKMLLLEIGYGPDPYTYFYGSVVRNT

SEQ ID NO: 131602 - protein, 111 aa, Heterodera glycines
  Coding regions on vcDNA: vcDNA=SeqID_58025; Strand=+; Position=1 -75,262-522
MPMFAEQAHNAKMLLEFGIGIGLSKLLHKPKYAQRALKLRHIFLDRPMNALDEANFRLSQIIRRSDGSKGKGEKRREFVGRKGTEKGAMESFHLDWTFILLAVITFLFLDK

SEQ ID NO: 131603 - protein, 37 aa, Heterodera glycines
  misc_feature (36)..(36): Xaa can be any naturally occurring amino acid
  Coding regions on vcDNA: vcDNA=SeqID_58026; Strand=-; Position=1-245
THFVFINFEKFWTFRGFLLFWTFRGLDTLWGCQRNXG

SEQ ID NO: 131604 - protein, 72 aa, Heterodera glycines
  Coding regions on vcDNA: vcDNA=SeqID_58027; Strand=+; Position=1 -112,164-267
  Homolog annotation: Hit_ID=CAE68939.1; Match level="QueryCoverage =100%, HitCoverage=10%, E-value=3e-16, Identity=59%"; Hit description= Hypothetical protein CBG14919 [Caenorhabditis briggsae]
MGRVVSAFVKKKTDGQWHRIGKRNPQWPQLFQPREEPGKLVIEKGDFMAGTCRYDSSDKKEIVPMGSMGMNE

SEQ ID NO: 131605 - protein, 67 aa, Heterodera glycines
  Coding regions on vcDNA: vcDNA=SeqID_58028; Strand=-; Position=1-202
MLEEEEEEDEEEDEGDTFGNKTPSGERQEEGEERKRTDVEFGGQTMADSPTLSEGSLAQMGNGNDKE

SEQ ID NO: 131606 - protein, 210 aa, Heterodera glycines
  Coding regions on vcDNA: vcDNA=SeqID_58029; Strand=-; Position=1 -160,351-589,685-918
  Homolog annotation: Hit_ID=CAE65264.1; Match level="QueryCoverage =90%, HitCoverage=72%, E-value=5e-32, Identity=38%"; Hit description =Hypothetical protein CBG10155 [Caenorhabditis briggsae]
MRQASFYAVARGRAVGVFNTWQKCNDSINGFSGAKFKKFPTLEQANDFIGKHRETLNSGGKVISKKGPPVRTMIVKSAATTFAERRLTRNTAMFGVEASNSLAASNLVSVDDGFTTVVYTDGACSRNGFVGAKAGFGVFWSDGHPDNVSAPVNGPATNNRAEYLAVISALEKATARNIRRLVIRTDSALLIQSVQMPCQLNVYDVVKIDD

SEQ ID NO: 131607 - protein, 80 aa, Heterodera glycines
  Coding regions on vcDNA: vcDNA=SeqID_58030; Strand=+; Position=1-595
HCLACNFTLEESKGTIFFEFLALNDSVYKIKIGGILQFFQDWKAWLTAKTRDSTWYVILPPPVVTSPFRKKNSKFLWKNL

SEQ ID NO: 131608 - protein, 67 aa, Heterodera glycines
  Coding regions on vcDNA: vcDNA=SeqID_58031; Strand=-; Position=1-216
  Homolog annotation: Hit_ID=AAC24579.1; Match level="QueryCoverage =100%, HitCoverage=100%, E-value=6e-27, Identity=89%"; Hit description=14-3-3-like protein [Heterodera glycines]
NSPQKKEYFVSQAFDDAIAELDTLNEDSYKDSTLIMQLLRDNLTLWTSDTAGDEQEAGGEAGEAGGN

SEQ ID NO: 131609 - protein, 132 aa, Heterodera glycines
  Coding regions on vcDNA: vcDNA=SeqID_58032; Strand=+; Position=1 -171,226-341,439-550
  Homolog annotation: Hit_ID=NP_495843.1; Match level="QueryCoverage =79%, HitCoverage=9%, E-value=2e-16, Identity=35%"; Hit description =putative protein of bilaterial origin (2I960) [Caenorhabditis elegans] pir||T19713 hypothetical protein D2
MAPTADPSATRCAPASLASAQLHSANAAQHSADHLCFFLCPIEQGLCRVQVAGVWTKYGQPGPLLNGTVVSMTALPSLLRQTICNVARRKAAELESYQMTHVRRRHAIAEFGRRFPSRLNYTDFVEQLISDN

SEQ ID NO: 131610 - protein, 77 aa, Heterodera glycines
  Coding regions on vcDNA: vcDNA=SeqID_58033; Strand=+; Position=1 -65,144-312
  Homolog annotation: Hit_ID=CAE57199.1; Match level="QueryCoverage =100%, HitCoverage=33%, E-value=1e-10, Identity=47%"; Hit description= Hypothetical protein CBG00049 [Caenorhabditis briggsae]
MEQARLTVQQLRQEANLQRKKVSEVAREFGVCFLNLNSFWHFDSLVEYCEGHKEGDCLFTGRMDHNPYQEKKSCVLI

SEQ ID NO: 131611 - protein, 83 aa, Heterodera glycines
  Coding regions on vcDNA: vcDNA=SeqID_58034; Strand=-; Position=1 -159,290-382
MPLIRSPDPQRLIGMEQSKADKRSEVAKLIPIRCQFFAIFGDHFLRLKIVLFLFKIASFLLNEECDFLKEDIIYKKIACKQTN

SEQ ID NO: 131612 - protein, 65 aa, Heterodera glycines
  Coding regions on vcDNA: vcDNA=SeqID_58035; Strand=+; Position=1 -87,799-909
MFLCSFFICFQSLYFWDKFRQSAGQRIATDFVSKGYSTPSYGHHWTNVWPNIYWTRCSSKTMKIW

SEQ ID NO: 131613 - protein, 302 aa, Heterodera glycines
  Coding regions on vcDNA: vcDNA=SeqID_58036; Strand=-; Position=1 -542,993-1207,1288-1440
IKLNEMFSLSVSLFKCLIVSLIFQFSNGNEEKFGRKRKLEIQSEEVERKRIHFGQEKHHIGNSLALASADNEQKPQNLQNPLHFLFNPPTESDRREFCEEWHYVYEQGTNFGAEFDFPSEEFGPGGVVPIESDGNCGFRSLSWILTGTEANHRQIRADIMEFLNSELINSEDDPAKSNWWEMFFTTKEEARQYAETKRTAAENVGEQAKWFNEVDAFTASKLYGINVIICKKEKEDNNFTWQYYSPLMTPDNLDAAQERTRMSAFIYNSPAHFEVILEPKERKTFGQQALNMRRKFVIYEED

SEQ ID NO: 131614 - protein, 95 aa, Heterodera glycines
  Coding regions on vcDNA: vcDNA=SeqID_58037; Strand=+; Position=1 -46,1224-1465
MTQANGNGVGKWTTDSDCPNACVSVEYTADFAVHELTLEKLNTRVDDAIQTKCMAEQLQLVDKFNEHKFPNGGGTDPWARDGRQTKMSEKMMKNN

SEQ ID NO: 131615 - protein, 27 aa, Heterodera glycines
  Coding regions on vcDNA: vcDNA=SeqID_58038; Strand=-; Position=1 -20,157-220
MPIDSQIRKSVDLTMLFRWTKSVKVNI

SEQ ID NO: 131616 - protein, 105 aa, Heterodera glycines
  Coding regions on vcDNA: vcDNA=SeqID_58039; Strand=-; Position=1 -144,195-370
VNLLKKRPAVENKGKLKRVSSLDDLSRRSRTKRAKEIARNLSHLFRPGIPVPEIDKVVRQARHQANFISPKKPPGKWTKKGRTRRQERISPLLDIQVTLVGCVDI

SEQ ID NO: 131617 - protein, 127 aa, Heterodera glycines
  Coding regions on vcDNA: vcDNA=SeqID_58040; Strand=-; Position=1 -96,633-920
MMGTTTISKKNATSSTSNSEKLKREAFVFGLKKGLCHHPALSDFISEVSGSIDRQVDAARSAGNFIHKRHKRYVLQDAVIMRILADAKYDNDAEIHDAMTALGLQVEGYAGKLKDYENMEDSSMDVA

SEQ ID NO: 131618 - protein, 119 aa, Heterodera glycines
  Coding regions on vcDNA: vcDNA=SeqID_58041; Strand=-; Position=1 -186,432-605
MAIKYGPKIAKYGHKMAKISKYGNKWQKCQNMDIHFSKLSAKFLQIYWLKFHMRYISKFFDSKFWRKNDFLKTVSGFGLKKANLAAGGRSNRGFLERCQNMDIKYGQNAKIWTNMEIWT

SEQ ID NO: 131619 - protein, 51 aa, Heterodera glycines
  Coding regions on vcDNA: vcDNA=SeqID_58042; Strand=+; Position=1-155
LQIYWLKFHMRYISKFFDSVRRFDKDGFRFAISRSTFGNWSRIFSAITCNH

SEQ ID NO: 131620 - protein, 28 aa, Heterodera glycines
  Coding regions on vcDNA: vcDNA=SeqID_58043; Strand=+; Position=1 -30,217-273
MLLLSLARHLKKILMSQFNFAEMKKKYI

SEQ ID NO: 131621 - protein, 100 aa, Heterodera glycines
  Coding regions on vcDNA: vcDNA=SeqID_58044; Strand=+; Position=1 -44,105-361
MVPLISSHIKQIFQRTVANTSRSVSNWLAKEKEAIESANQQQDESSETETDEQSHEHANTTSNRAAQRARSMQRQTQNAAARQPSRAQRQSADERHGSSS

SEQ ID NO: 131622 - protein, 267 aa, Heterodera glycines
  misc_feature (9)..(9): Xaa can be any naturally occurring amino acid
  Coding regions on vcDNA: vcDNA=SeqID_58045; Strand=+; Position=1 -59,123-163,209-271,316-377,421-466,694-782,835-929,1047-1156
  Homolog annotation: Hit_ID=CAE60719.1; Match level="QueryCoverage =99%, HitCoverage=35%, E-value=3e-82, Identity=64%"; Hit description =Hypothetical protein CBG04391 [Caenorhabditis briggsae]
YFFDYLILXRVTGGELFKDIVAREYYSEADASDIVAREYYSEADASQCIQQILESQCIQQILESIAYCHDNSVVHRDLKPENLLLASRAKDLKPENLLLASRAKGAAVKLADFGLAIEVQGNSESWDFGLAIEVQGNSESWYGFAGTPGYLSPEVLKKDPYGKPVDIWACGVILYILLVGYPPFWDEDQHRCGVILYILLVGYPPFWDEDQHRLYAQIKNGAYDYPSPEWDTVTPEAKSLIDSMLTLNPQKRITADQALKVPWICVR

SEQ ID NO: 131623 - protein, 162 aa, Heterodera glycines
  Coding regions on vcDNA: vcDNA=SeqID_58046; Strand=+; Position=1 -84,496-699,4248-4448
  Homolog annotation: Hit_ID=NP_501901.2; Match level="QueryCoverage =40%, HitCoverage=11%, E-value=4e-12, Identity=56%"; Hit description =UNCoordinated locomotion UNC-43, DEfecation Cycle abnormal DEC-8, calcium/calmodulin-dependent protein ki
DRSRVASVMHRQDTVDCLRKFNARRKLKAVISAVAIVNRMSHCMSPQNSRTTVPSPSPSPNSAAQPDIGWSVKGPTNNNGIAACADSSGGTSANNGKGWTSTNSISTTVGLGEGGQGIFKVFNKRMNNLRPSNSTRRNNRRDQTSPPPNPHDHSEPECSPVG

SEQ ID NO: 131624 - protein, 131 aa, Heterodera glycines
  Coding regions on vcDNA: vcDNA=SeqID_58047; Strand=-; Position=1 -173,451-578,715-809
MRLTDEPNFQGELESSEMFGENEGKKIAAVKKGQNEFVEFVEPRQHQNNRHKEWMDKRVRSSRIDDPFNEFTRYSPAGPTKDKLKKSGSPIFGQSGDDTLENTGHSVGAGGGQCERQRRRHGRNGPQLQRF

SEQ ID NO: 131625 - protein, 60 aa, Heterodera glycines
  Coding regions on vcDNA: vcDNA=SeqID_58048; Strand=-; Position=1-206
IYECYKVQKIVRTKYINQILLKWISTIKRVCLMEFSGMTNNLLGRILAADQYSVCVGFSS

SEQ ID NO: 131626 - protein, 102 aa, Heterodera glycines
  misc_feature (40)..(40): Xaa can be any naturally occurring amino acid
  Coding regions on vcDNA: vcDNA=SeqID_58049; Strand=+; Position=1 -307,672-801
  Homolog annotation: Hit_ID=NP_501886.1; Match level="QueryCoverage =91%, HitCoverage=37%, E-value=2e-13, Identity=39%"; Hit description =thymidine kinase (29.7 kD) (4L44) [Caenorhabditis elegans] emb|CAA19501.1| Hypothetical protein Y43C5A.5
FYQPFQNVAMLIPLAEKIEKLSAVCRCGQSASFTFRMSEXHELEMIGGQELYRALCRTCVVEYNHVKEQLLNGLKKNGNVSLAKKRKASDATAHPTLRIDTV

SEQ ID NO: 131627 - protein, 354 aa, Heterodera glycines
  Coding regions on vcDNA: vcDNA=SeqID_58050; Strand=-; Position=1-1067
  Homolog annotation: Hit_ID=NP_608540.1; Match level="QueryCoverage =100%, HitCoverage=66%, E-value=3e-55, Identity=29%"; Hit description= CG2839-PA [Drosophila melanogaster] gb|AAF51469.2| CG2839-PA [Drosophila melanogaster]
KEKPKGKEKRRKSQRKRKGKEKRRKAKVKEKEKKRKRKAKKSQSKRKGKAKGEGKAKEKRKEKPKGKEKRRKSQRKRKGKEKRRKAKVKEKEKPKGKEKRRKSQRKRKGKEKRRKAKVKEKEKKRKRKAKKSQSKRKGKAKGEGKAKEKPKEKKRKRKAKKSQSKRKGKAKREGKAKEKPKEKKRKRKAKKSQSKRKGKAKREGKAKEKPKEKKRKRKAKKSQSKRKGKAKREGKAEGKAKREGKAKEKRKEKPKGKEKRRKSQKRRKSQRKRKGKAEREGKAKEKPKGKEKRRKSQRKRKGKAEREGKAKEKPKGKEKRRKSQRKRKGKAEREGKAKEKPKEKPKGKEKRRKN

SEQ ID NO: 131628 - protein, 75 aa, Heterodera glycines
  Coding regions on vcDNA: vcDNA=SeqID_58051; Strand=+; Position=1-226
  Homolog annotation: Hit_ID=NP_497206.1; Match level="QueryCoverage =36%, HitCoverage=1%, E-value=3e-10, Identity=88%"; Hit description =nematode-specific EB region and pancreatic trypsin inhibitor precursor family member (171.6 kD) (3B124) [C
MNQRLFGDGFSGAAMSAGRRVQRLPGKLLHMFGELGKGSNCNRTLKLQNTGNGNTCPVNYECYFDGYVWGCCPTK

SEQ ID NO: 131629 - protein, 166 aa, Heterodera glycines
  misc_feature (58)..(58): Xaa can be any naturally occurring amino acid
  misc_feature (62)..(62): Xaa can be any naturally occurring amino acid
  Coding regions on vcDNA: vcDNA=SeqID_58052; Strand=-; Position=1 -128,263-437,534-729
  Homolog annotation: Hit_ID=NP_495768.1; Match level="QueryCoverage =96%, HitCoverage=24%, E-value=4e-40, Identity=47%"; Hit description =thyroid peroxidase precursor family member (2I692) [Caenorhabditis elegans] emb|CAA91388.1| Hypothetical
LFDVSDMGSWNIQRGRDQGIRPCKDYRQICGMARLKSFQDWPDTKREKRKRRKANYYXLPNXDIDLYVGGLMEEPVDGSLLGPTFSCIIGEQFRRTRDADRFFYLNPLMYSPDQIASLRQITFSSVICATGEDFRAINPSAFLVEDGQNAVPCASIPQLELSPWRD

SEQ ID NO: 131630 - protein, 33 aa, Heterodera glycines
  Coding regions on vcDNA: vcDNA=SeqID_58053; Strand=-; Position=1 -91,593-603
MVFRGRESCQFSGHFPKSVRNDKRPFDQPLGFT

SEQ ID NO: 131631 - protein, 113 aa, Heterodera glycines
  Coding regions on vcDNA: vcDNA=SeqID_58054; Strand=+; Position=1 -135,177-341,389-430
  Homolog annotation: Hit_ID=CAE60702.1; Match level="QueryCoverage =87%, HitCoverage=78%, E-value=2e-30, Identity=64%"; Hit description =Hypothetical protein CBG04365 [Caenorhabditis briggsae]
MVRFQITEATYPAVGRKVVCHYVLTLENGQKIDSSRDRGKPFEFTIGKGEVIKGWDEGVAKVVIFTFQLKFSFPQMSVGQRAKLTISPDMGYGAKGIPGTIPGNSTLILRRGN

SEQ ID NO: 131632 - protein, 29 aa, Heterodera glycines
  Coding regions on vcDNA: vcDNA=SeqID_58055; Strand=+; Position=1-90
TRRSRVPEREALSPRHQNSTEYNKANCAP

SEQ ID NO: 131633 - protein, 288 aa, Heterodera glycines
  Coding regions on vcDNA: vcDNA=SeqID_58056; Strand=-; Position=1 -108,373-553,1121-1500,1865-2062
MVAPIGLLHRRQILLADRMIRIQKMLQLEGQFQAVKHSDSSISAVSMKSDSEKSDGEIKEKMAKNYAEHSFNKNDQMLVQKWEEIERNLREQYEKRGAEHYRKRLEIADPYDAGQLIVREHGMKRIILIPREDEIARTVYRIESRGAGGEIKEKALGKSVEQSWRNAKKCLKFVTSNVKEQQGKNDRQLCKMPILTNERAEAYQQWAAIGREMQRRGIPPLYERNGEIMDENELMLLLEKAFNALVNGESKIPRMPKKVKRTETLTKYHTKIANEKRTNEQRMPEQSN

SEQ ID NO: 131634 - protein, 323 aa, Heterodera glycines
  Coding regions on vcDNA: vcDNA=SeqID_58057; Strand=-; Position=1 -37,286-422,845-943,1233-1732,2324-2522
MTQIAAKQAAKKNTTVTEEEASDNDEKYYTLPSSHDDRTRSQKPKFPPTISLTTENEELRKLNDFSARDPDLWLNDQQNTEPPNWHCARLMGSERRLCEEWKAIHRAIVRFIIFFAIKNANAFVPKIVVDDQLLATVAVRPRLWPAHAQIDTIQTGIGTMPNFGRKPPFLNGKPAYEKRGGMALTFAMLRVKDAYKWHGTFVEDALKFTNKAMVEKVEGWANFVGNFLHTPTYVWAYHYKGTDFEVNDVPKVEEILKIARELLVPILQNNLVLDGIVDDDPNFPEPPLPIVVRNTANTKQIKNTLLPKTDDKYVNTLVLSMDI

SEQ ID NO: 131635 - protein, 36 aa, Heterodera glycines
  Coding regions on vcDNA: vcDNA=SeqID_58058; Strand=-; Position=1-108
MRLPFLSPVIQTTYNISASHTPDDDMSPPNYSMAHM

SEQ ID NO: 131636 - protein, 31 aa, Heterodera glycines
  Coding regions on vcDNA: vcDNA=SeqID_58059; Strand=-; Position=1-101
VLQKFFVIKKHDNLLSGVLKVANHESDMYFD

SEQ ID NO: 131637 - protein, 93 aa, Heterodera glycines
  Coding regions on vcDNA: vcDNA=SeqID_58060; Strand=+; Position=1 -103,151-282
  Homolog annotation: Hit_ID=AAO92289.1; Match level="QueryCoverage =100%, HitCoverage=61%, E-value=3e-35, Identity=83%"; Hit description= FMRFamide-related peptide precursor [Heterodera glycines]
YGARQLRAPKPKFIRFGRSGQKMIPFSRSFSTETQYGDEGINQLDALVDQYGDEGINQLDALVDAVDKLYQSSPEIRAFKTAPKRAQKFIRFG

SEQ ID NO: 131638 - protein, 194 aa, Heterodera glycines
  Coding regions on vcDNA: vcDNA=SeqID_58061; Strand=+; Position=1 -366,421-639
MSSDCGLHKYQIIVIEKSVLGLGWDGFWADNWTAFSLLLTLIDNKNSTATKNKINSFKRPNQTMIWPFVLGLLMSLGHSAPVVNTRTELALHQSIAKGQGTTASTAKSTMTTAIAVIEHHSKENTRALTVFKREEKSWTSILLSLLKGIGGIGTFILDLGKDIIKDVLKTVTEKLIDHALKEGVGQGVIIKNML

SEQ ID NO: 131639 - protein, 126 aa, Heterodera glycines
  Coding regions on vcDNA: vcDNA=SeqID_58062; Strand=-; Position=1 -316,562-626
MDPSNGFYNREADKVTLTIDAITVKDEKMEKFVSESNKSEWTLSLEIEKMSEFLRELKWTERKSETVTYIKGLPWKIFAQIRMKSEGNDNEKWLGIFLLCTAPTEEIDGLGRSPFQQKRGQSDICH

SEQ ID NO: 131640 - protein, 94 aa, Heterodera glycines
  Coding regions on vcDNA: vcDNA=SeqID_58063; Strand=+; Position=1 -223,319-380
MYKVLLYRLLSTSSRANLDTFPMSIINVPNVQIRQCLGNCTGYSKSPEIPQKFGLVWYCSMPTTSSVVKMPNGTENSSFEKSGKRILNNAGPSI

SEQ ID NO: 131641 - protein, 72 aa, Heterodera glycines
  Coding regions on vcDNA: vcDNA=SeqID_58064; Strand=+; Position=1 -106,198-310
MKIDGKNVHINLRNWHLPYFVYKEKEDEFKMEEAEVEVNIRKLNELVNLVKPDDEKVMGNFEIVHYLYICFY

SEQ ID NO: 131642 - protein, 130 aa, Heterodera glycines
  Coding regions on vcDNA: vcDNA=SeqID_58065; Strand=-; Position=1 -249,361-504
MAILLKPTPTEYNRRQCPAISKPVRGAVQPRPVSLSFLSLGLLQPRDLAASPRLLQTRRDNARRDHRQALTLKRSASIIHSPQMGCKSGEERQTVSCTMFIILSFLLFMYYIAFFFLLIVIFSNEMQLIR

SEQ ID NO: 131643 - protein, 178 aa, Heterodera glycines
  Coding regions on vcDNA: vcDNA=SeqID_58066; Strand=-; Position=1 -274,1023-1285
MIRLLDDSSTQPKSDDSSTQPKSHDSSITRFVLFNDSNTQPIGETIGRDPGIAHPDRIPIYPEDFFSGCRGIFGICSNLFFLHFCAKFLFKYLNLKNGHFLKNYRDFNPAGSRGIGKWSGGIPVRDSDEIPIPINPDEFKKSLGTDPEVGIPNLIPRDPEEIPRDPDPVRSLIFTSFL

SEQ ID NO: 131644 - protein, 68 aa, Heterodera glycines
  Coding regions on vcDNA: vcDNA=SeqID_58067; Strand=-; Position=1-207
MNAHRAVNAYSNRVRNFMAELDEADLWNEQNMARVAIHECGHTLVVWFLRHSERLIEVDLRFDLDMIC

SEQ ID NO: 131645 - protein, 199 aa, Heterodera glycines
  Coding regions on vcDNA: vcDNA=SeqID_58068; Strand=+; Position=1 -184,234-509,555-604,695-785
  Homolog annotation: Hit_ID=XP_470349.1; Match level="QueryCoverage =47%, HitCoverage=16%, E-value=5e-22, Identity=58%"; Hit description =putative nicotinate phosphoribosyltransferase [Oryza sativa (japonica cultivar-group)] gb|AAO41132.1| put
IRFEFEGLKYKGELHNIIFRFCCLDLEYIQHIALPYAESAFFDYLRSEFNCKGVKISAVPEGSIVFPRVPLIIVEGPLAVCQLLETPLLNLVNYASLVTTNAARFRLVCFVCFSFKCFRLRLLANPSVCSNLAFDVLRGPMALCQRRNIALSEALIAPAICWPANCTAFRPMKPMKRPKFAASKMTKWSTYSHCPKDQT

SEQ ID NO: 131646 - protein, 64 aa, Heterodera glycines
  Coding regions on vcDNA: vcDNA=SeqID_58069; Strand=-; Position=1 -84,401-511
MRGAHGSELFRAAHGGWVTVSSSLWLLKTDCKENKTIQNRLGQPKLYCCWCWYWLLLPLDTNTG

SEQ ID NO: 131647 - protein, 31 aa, Heterodera glycines
  Coding regions on vcDNA: vcDNA=SeqID_58070; Strand=+; Position=1-93
MKRRSCKSGVDDQCVGPPIESRPCNDEQCPY

SEQ ID NO: 131648 - protein, 94 aa, Heterodera glycines
  Coding regions on vcDNA: vcDNA=SeqID_58071; Strand=+; Position=1 -203,264-345
MPMMPFECVVNESTKEKLTLTKANENEWDIDWIMKRCKIGETAAVQQHKEGDWNNVFIWLFAGTNCIGPLSPPPPAEEDEAGQSITKGPSSADK

SEQ ID NO: 131649 - protein, 125 aa, Heterodera glycines
  Coding regions on vcDNA: vcDNA=SeqID_58072; Strand=-; Position=1-379
CPRFPLIFAELVSRCFSLQIILPQIRSVVAELLLWLDRSDQKRIIILAKALRAYLSALNEWFPNLKPLVTNLSKTNEKYANLEETEGEKDGHGEEERAEKVDGHKKQWEGDPNYPLVKDVVSILN

SEQ ID NO: 131650 - protein, 252 aa, Heterodera glycines
  Coding regions on vcDNA: vcDNA=SeqID_58073; Strand=-; Position=1 -580,621-774,1016-1040
MQFYNLFFILSLSFIISPIDETLLVKSFGFNAKVWPTFDEIFGQGWENEKMDKIQITIKMINELNFADSNNVLNNNQLDDQQKREIVHKFHAIKKGIKKRGKYSQKIWNRIELKIAKKLGISRNKIYKWKKELGIKIKNDQNYYEMKRKEFIQRIDEFKRMSAVNGKQKQFGKELGISERTFRKWKKEFGIKWGGNQYSNGEKARKLKIYYKMKNEKNSSFSDKQISEFLKISERTLRNWKNKNFPLEFKLS

SEQ ID NO: 131651 - protein, 79 aa, Heterodera glycines
  misc_feature (66)..(66): Xaa can be any naturally occurring amino acid
  Coding regions on vcDNA: vcDNA=SeqID_58074; Strand=+; Position=1 -57,327-439,1081-1152
  Homolog annotation: Hit_ID=CAE63826.1; Match level="QueryCoverage =92%, HitCoverage=20%, E-value=3e-26, Identity=71%"; Hit description =Hypothetical protein CBG08377 [Caenorhabditis briggsae]
FADIQRSPLTVCFPEYKGQQNQTECINYIQWNFEHMNRSRQRETYCHHTCATDTNNANFQIFSCLXMNLLRNFSRLRHN

SEQ ID NO: 131652 - protein, 46 aa, Heterodera glycines
  Coding regions on vcDNA: vcDNA=SeqID_58075; Strand=+; Position=1 -45,197-238,472-525
MVSKLLPVILCCLFLASFALCSPKAADVLKFKREAAISSCGAVRHI

SEQ ID NO: 131653 - protein, 398 aa, Heterodera glycines
  Coding regions on vcDNA: vcDNA=SeqID_58076; Strand=-; Position=1-1197
  Homolog annotation: Hit_ID=NP_920205.1; Match level="QueryCoverage =91%, HitCoverage=23%, E-value=1e-38, Identity=32%"; Hit description =putative DNA helicase homolog [Oryza sativa (japonica cultivar -group)] gb|AAP52492.1| putative DNA helica
MVNGLLCTSFTEAAIMHGLLEDDKIWDKTLAEAALSRWPDQMRWLFVSILVYGQPSNAIELWNKYKDQMYNPQGIITPAQHKVAEDRALADIDWRLHNFGYSCVHFGLPDPPTSIAKNTDAAIEEFFFGDDDLNLPPGQPNPRPQPNTPPPLNSDQQNVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSADFKQSLPVVPHEGLTAQVTACFQTSPLFGQFTTMKLTINQRLGQGQQAFLQMCRQIGLGETGEHFWIPPQFLVKSKEELIDYVYPNFQQLLGK

SEQ ID NO: 131654 - protein, 417 aa, Heterodera glycines
  Coding regions on vcDNA: vcDNA=SeqID_58077; Strand=-; Position=1-1251
MEQRRNNPRFTGEKITNEDEFVQGHQLNEQTLEILEQMIQVHHPAAQAYKQAREQLTELLQQQTPEELRFFRMTLLNERRAPAGLKDPKLHPHQIITPSTGEGMFAIHADPTGAPPPKGIWVENKQGQLNEIAPFSPWTDSLTYPLIKPMGDDGYTTGVKYAKPPSRKRKGAQNASGLFDSEAESDNESCETQSIALSDAGSVADSDAESVASVSSQHRRIDKSKQFISLRDYCKYYLAIRDENVELQYHHILSCGGGLGQRWILDQAAKIDWQIATFLHRPDMDLRISTPKNLLQYLVNQYNRQKARQNPNAQQKTVDDIGSVVRLSEHNVNSLQYWKKMYEDCNTVFARCHDAKKARLFITFTNNREWPEFKENIYKNGQVFTDRFDMWMRVWSSKIAEFREELYDKKFFGTIPW

SEQ ID NO: 131655 - protein, 270 aa, Heterodera glycines
  Coding regions on vcDNA: vcDNA=SeqID_58078; Strand=+; Position=1 -121,218-265,321-428,484-532,673-827,935-1029,1240-1411
  Homolog annotation: Hit_ID=NP_502809.2; Match level="QueryCoverage =94%, HitCoverage=44%, E-value=7e-54, Identity=45%"; Hit description =guanylate-binding protein (58.7 kD) (4P759) [Caenorhabditis elegans] emb|CAB09000.3| Hypothetical protein
YCTINFEIVVISMAGAYRKGKSLLLNFFLDYLYKMQYTQQELELEEWITDDDIVEGFLYKSGQKRCTAGIWIWGFLYKSGQKRCTAGIWIWAEPILIDTPNGERYAVLLMDTQMDTQGCFEQPSGGNACAALLALSTMLSSVQCYTMAEGIPDEALAVLSSFVDYGKLASAEAKEFGKPYQRLAFLIRDFKLTDEMIYGVEGGNRLLVRTIQKSVANSAPLAEVRRHIRQCFKDGISCYLLPHPGPKVAEPNSGFRGQVKGGGKTEGGGG

SEQ ID NO: 131656 - protein, 160 aa, Heterodera glycines
  Coding regions on vcDNA: vcDNA=SeqID_58079; Strand=+; Position=1 -108,162-289,346-529,580-642
MTTKEIAESDDGRVFKVDLGNLTQVTSLCTKWKAHFTNVRQVMESGGGGEPCVSTRTSAAGGGGFPVWLIVLIVVIVICVLGAGAGIAVFMVRRRSAEAEGGDAPADPIGTFTSKADKTDEMDNIPASKDDDTAPAASMGGMQMSYAAMGASTAPGKSMV

SEQ ID NO: 131657 - protein, 36 aa, Heterodera glycines
  Coding regions on vcDNA: vcDNA=SeqID_58080; Strand=+; Position=1-111
CDVCGNFTEQIADQFLRVVSDCLEVDRLPIVDLDQT

SEQ ID NO: 131658 - protein, 133 aa, Heterodera glycines
  Coding regions on vcDNA: vcDNA=SeqID_58081; Strand=+; Position=1 -146,369-552,944-1015
MPKCLLLFFAYLPPAWSIGHGNYFGHHEGLGVGLAHNYVSKYGIPMNLSDEQLDELKWRPKRHTKLDGTQMINSSGQQNCSDENFILSTLLRDYDKFRIPGGGNVRVEVEKYFCRRSASVATNLEPIRMFCEQ

SEQ ID NO: 131659 - protein, 63 aa, Heterodera glycines
  Coding regions on vcDNA: vcDNA=SeqID_58082; Strand=+; Position=1-192
EEFIQRFGRQFGITEEFIRSNSQRMKEFKQQVTEGKQREEYAKLLHEQMEFESARRFREKYGL

SEQ ID NO: 131660 - protein, 57 aa, Heterodera glycines
  Coding regions on vcDNA: vcDNA=SeqID_58083; Strand=+; Position=1-361
QRKQLAKHKSEHQRTECQLKFGGSVPFLLFENFLCFPILRTVSLLRVCQHIEASAFI

SEQ ID NO: 131661 - protein, 152 aa, Heterodera glycines
  Coding regions on vcDNA: vcDNA=SeqID_58084; Strand=-; Position=1-459
MTANQTHRHSHQKRRFSVRFLGVFLMGKDKWTTTYGGEQIGSQKNAFERKEEEKEERKEDKEAGGRHGAKRQKGNGQIVKLRGQKGDGQIAKLRGERVSLDEEEGHGLAFEREQRNEVPMARRNGGNERPKGKRIRTLSKQHYQMKAEASMC

SEQ ID NO: 131662 - protein, 122 aa, Heterodera glycines
  Coding regions on vcDNA: vcDNA=SeqID_58085; Strand=-; Position=1 -184,238-444
KWRLKRILSLAKTARVLLSLPSFASALSLLSPLSECEISIISLCECEPSAGAAVRKSKAFFIPLGQFRRSFGKGKSPSPSVGISLRKSERSGAFGKGKVSRRSLILHKFGRDQIQKDCARLL

SEQ ID NO: 131663 - protein, 137 aa, Heterodera glycines
  Coding regions on vcDNA: vcDNA=SeqID_58086; Strand=+; Position=1 -75,125-164,206-257,1024-1096,1151-1240,1406-1486
  Homolog annotation: Hit_ID=NP_498776.1; Match level="QueryCoverage =55%, HitCoverage=80%, E-value=2e-23, Identity=61%"; Hit description =heat shock protein (hsp-12.2) [Caenorhabditis elegans] gb|AAA27953.1| Heat shock protein protein 12.2 [Ca
MAKRNSRMVNALSTILNKRKELGTNDAFRVRIRSLDQMGNTNCYFSPVQCYFFEERQIFKMENIEITHEWSGQQWDWPLQHNDGVVKVHNTPEKWEVGLDVAFFTPNEIEHEARSDVHGSVSREINRSYKLPNDVNT

SEQ ID NO: 131664 - protein, 30 aa, Heterodera glycines
  Coding regions on vcDNA: vcDNA=SeqID_58087; Strand=-; Position=1-90
MCRLLPLFLTLFAVLVALCVSVEGQQPSAE

SEQ ID NO: 131665 - protein, 75 aa, Heterodera glycines
  Coding regions on vcDNA: vcDNA=SeqID_58088; Strand=+; Position=1 -105,323-445
MQLLEIIVSEKTSKEALAVAAKLGLDQKKLIVVVKISKFRLRLPQNFVLGMPPLVRIFYMVGDHEYGIQPDNSIP

SEQ ID NO: 131666 - protein, 33 aa, Heterodera glycines
  Coding regions on vcDNA: vcDNA=SeqID_58089; Strand=-; Position=1 -41,106-166
MRINITGSDKIGDGLLNGLLGLSEWKLRNGRSV

SEQ ID NO: 131667 - protein, 138 aa, Heterodera glycines
  Coding regions on vcDNA: vcDNA=SeqID_58090; Strand=-; Position=1 -146,556-829
  Homolog annotation: Hit_ID=AAQ65051.1; Match level="QueryCoverage =97%, HitCoverage=37%, E-value=5e-34, Identity=52%"; Hit description =Mvl [Drosophila yakuba]
LFAVVEANFYYFVECAIALCCSFFINLFVVAVFAHGLFGKTNADIVRNFQNLRESAAGARQATVPNNTDLVEADIYKGGIFLGCQFGMFALYVWGVGIMAAGQSSTMTGQSINQFWLSVFLMLRIPTMIKLVINSTTA

SEQ ID NO: 131668 - protein, 83 aa, Heterodera glycines
  Coding regions on vcDNA: vcDNA=SeqID_58091; Strand=+; Position=1 -55,103-299
MTKIIKDFSVYLMTINFERMISDQNLGSFYMELLNWNIQFLFVLFHYRGAAVRAAEHNFRMKHNLTRLQLLFNSGHIMSSNIT

SEQ ID NO: 131669 - protein, 77 aa, Heterodera glycines
  Coding regions on vcDNA: vcDNA=SeqID_58092; Strand=-; Position=1 -123,189-296
MSAFFVVALPVLLAVLTEAQNFGGQGGALNAPLPFGGPINPEQLPHMLHHPNLKSGEDIEAAFQNGGGQVAGVQHQQ

SEQ ID NO: 131670 - protein, 114 aa, Heterodera glycines
  Coding regions on vcDNA: vcDNA=SeqID_58093; Strand=+; Position=1 -142,543-745
MFSDVWMGIFPLFDRPQLGLKLALISPRFDVLVDKHFDGQTRIFSNFVGFAMMFGWKFCPVLAMLNSASNRALFLPRFDLLVDKHFNGKREFFQISISFFVFTFFVKVIDFLVT

SEQ ID NO: 131671 - protein, 43 aa, Heterodera glycines
  Coding regions on vcDNA: vcDNA=SeqID_58094; Strand=+; Position=1-129
MTFGWTFSLFWPCSTRPQIRTDFASFQCVGGQTFSMAKADAAQ

SEQ ID NO: 131672 - protein, 102 aa, Heterodera glycines
  Coding regions on vcDNA: vcDNA=SeqID_58095; Strand=+; Position=1 -122,485-671
MFGWTLSLFDRHQLGLKLALLSPHFELLVDKHFNGISNLGNTCAMTFGWTFSLFWPCSTRPQIGIAFATFQCVCGQTFSMAKADAAQVLNFFKLTGQMFYKL

SEQ ID NO: 131673 - protein, 33 aa, Heterodera glycines; identical to SEQ ID NO: 126595
  Coding regions on vcDNA: vcDNA=SeqID_58096; Strand=-; Position=1 -81,173-193

SEQ ID NO: 131674 - protein, 325 aa, Heterodera glycines
  Coding regions on vcDNA: vcDNA=SeqID_58097; Strand=+; Position=1-977
MPSKQRNLRKNEQERYQRRTEKSVSRDTSPVSVGSADGNGEASASLRGTTTPSLSALQISTPASSIGSKKRGRPLKAGAKPILATQETVSSIDTPRTAVTQSDQGSPCKKRGKVSECDQPTFANEAIALTPVSTQSRGGRPAKKIRGPGRGRLSDSMSKSSEMDINLENAPIPATSHTVSEKIDFSTVQINFATSRNFACKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPGHWTLIVHDVQFGTHFADSLPTTYG

SEQ ID NO: 131675 - protein, 107 aa, Heterodera glycines
  Coding regions on vcDNA: vcDNA=SeqID_58098; Strand=+; Position=1 -34,79-365
MNETMPNQIPESKFCFLSLNIIVYFCQLTLDRLGHRNEIMVEMSQKFGNAKQQLENALSEEKAEKQLNEAAQKGFEEAQRRFEIAKQEKETAEAALKKAEEKRKQLE

SEQ ID NO: 131676 - protein, 210 aa, Heterodera glycines
  Coding regions on vcDNA: vcDNA=SeqID_58099; Strand=-; Position=1 -46,95-377,433-733
MEQVSAIDGAELLYCDTDSIYYVNKMGGPCVAEGEALGQMKREHTDRRIVEFVAGGPKNYGIRHTARDGTDERANLKIRSFRLSYTAQQLLTFEAMKDLTLATYNIDGPIDDALDNATFTCTEAANIVPYASTSRKLIAMCTPISTRMRPTKTTGPSMPRGAFGLGCRRVPLAIWRMMDSRTKDNGRTDEREILWSKIPHSPDTLGGSDV

SEQ ID NO: 131677 - protein, 67 aa, Heterodera glycines
  misc_feature (21)..(21): Xaa can be any naturally occurring amino acid
  Coding regions on vcDNA: vcDNA=SeqID_58100; Strand=-; Position=1-202
SITLCIHQLRVVNIVGVQTLXQRISVERLQNTLGGIYDPTIFPALRCKLSNGVTCLVYISGKVIVTG

SEQ ID NO: 131678 - protein, 175 aa, Heterodera glycines
  misc_feature (9)..(9): Xaa can be any naturally occurring amino acid
  misc_feature (16)..(16): Xaa can be any naturally occurring amino acid
  Coding regions on vcDNA: vcDNA=SeqID_58101; Strand=+; Position=1 -229,868-973,1031-1187
  Homolog annotation: Hit_ID=CAE57134.1; Match level="QueryCoverage =74%, HitCoverage=73%, E-value=4e-25, Identity=40%"; Hit description =Hypothetical protein CBG25058 [Caenorhabditis briggsae]
LEPKRQTHXRELKGHXSFMGSAQCLECIQCDRQTLWYSPEENERHIGRCQRGLIPPSQCANSSHTHCIFSYFKQGGDSVITITERRCGTADQISGCTLYKSMRAKRHLIAGPPSHRRRETNPLPPSHRRRETNPLVVEVCTGGCKENGCVNGVGGGGEAKWTMAWIVVIGWVAWW

SEQ ID NO: 131679 - protein, 49 aa, Heterodera glycines
  Coding regions on vcDNA: vcDNA=SeqID_58102; Strand=-; Position=1-221
KFLKICRLIAFFECFRIIPRMFNLVEKEKSYGRKIRSTTFRLTTFCPTP

SEQ ID NO: 131680 - protein, 146 aa, Heterodera glycines
  Coding regions on vcDNA: vcDNA=SeqID_58103; Strand=-; Position=1 -40,103-266,331-475,616-707
MRQFGRQLQMRMRGKINLKFYAFLIILSLVTPATCARHGSVIVMMNNRVKTEAFVTTNWATTNADANLDFLAKIASFNMKKARTNANWTVRMGPPAKMLRQNSANVRQNLAAFCAKSKSPTPANLNRAPRGQFAHRQMTISNFLDN

SEQ ID NO: 131681 - protein, 192 aa, Heterodera glycines
  Coding regions on vcDNA: vcDNA=SeqID_58104; Strand=+; Position=1 -44,104-220,283-377,913-1037,1088-1212,1277-1350
  Homolog annotation: Hit_ID=CAE59320.1; Match level="QueryCoverage =54%, HitCoverage=26%, E-value=3e-23, Identity=51%"; Hit description =Hypothetical protein CBG02662 [Caenorhabditis briggsae]
NDSGVGLTDRSGKGDSKNESTSTEETANLSSGGGDEFSFSGGTSLASATASGEDSKFVPFRPFIRSVSIHGVQQYHDLELIKYSDTPARLALLGNTSKYPITLAEIVRRVSPPECLNTSFLSGILRRAKNKDGGKRFRTELQQFNCGVDLQTGRRKTGAITTFTALCERESVQLAKDFDKLAKDECHGFPEK

SEQ ID NO: 131682 - protein, 73 aa, Heterodera glycines
  Coding regions on vcDNA: vcDNA=SeqID_58105; Strand=-; Position=1-370
LISSQKSCQFKTAKKTEFSKFFISIFFYSSKFSVIFSRLIEPVKSFRMISRLFDSVNNFKSYIDSKLAQTELA

SEQ ID NO: 131683 - protein, 74 aa, Heterodera glycines
  Coding regions on vcDNA: vcDNA=SeqID_58106; Strand=+; Position=1 -15,298-402,445-503,558-603
MLMLICYSPCEFDDDLPSPDELSARVEFINLKNAQIRQQLKNRANEIKKVAEQPKPAQIRAFLCPSMAEIGNCD

SEQ ID NO: 131684 - protein, 188 aa, Heterodera glycines
  Coding regions on vcDNA: vcDNA=SeqID_58107; Strand=-; Position=1 -201,455-687,733-865
MAMSAAVLGGLVGAAGGYGDAALCGTARERTTHLALKQPQQQQQEMAQAAAAQLTADEQRRQQQQQQSSSPTRPLGLGRPSVAGGVGGNGTRHFQRSQQQQMHQQQTNMDQCCAGDNTSPMAHAQQQHQMNSFNGLLRAVQSNDSAAVDGLLGLRGSMAMKQQQQQHGHSGMELNEQLQLVSAQLMNR

SEQ ID NO: 131685 - protein, 19 aa, Heterodera glycines
  Coding regions on vcDNA: vcDNA=SeqID_58108; Strand=-; Position=1-59
PVPGFFAVPVEKLGPGPDF

SEQ ID NO: 131686 - protein, 94 aa, Heterodera glycines
  Coding regions on vcDNA: vcDNA=SeqID_58109; Strand=-; Position=1-283
LNDFERKERAKAEHALALNLLESAVYDYSAKLEEEAFNSFGTDEELVLIREQTAKLKDWLDDMPDDVGVDELKQKRREFVAPIRKLKNRQRQKE

SEQ ID NO: 131687 - protein, 142 aa, Heterodera glycines
  Coding regions on vcDNA: vcDNA=SeqID_58110; Strand=-; Position=1 -105,239-481,680-760
  Homolog annotation: Hit_ID=AAH55318.1; Match level="QueryCoverage =83%, HitCoverage=10%, E-value=5e-23, Identity=47%"; Hit description =Minichromosome maintenance deficient 2 mitotin [Mus musculus] dbj|BAC40178.1| unnamed protein product [Mus
MAEAHAKMHLRNFVNDDDVSVAMKILLQCFISTQKASVMRQMKKVMAKFNIEKQKQIKKFWKQLSYKRDNNDLLLFLLKQLVNEHIVYERVRHGGGISESADIDTIAIPESEFLEKLKFLPHLLFIRDLNGNRMDGTPAIFY

SEQ ID NO: 131688 - protein, 221 aa, Heterodera glycines
  Coding regions on vcDNA: vcDNA=SeqID_58111; Strand=+; Position=1 -230,275-415,464-758
  Homolog annotation: Hit_ID=CAE58606.1; Match level="QueryCoverage =97%, HitCoverage=42%, E-value=1e-59, Identity=54%"; Hit description =Hypothetical protein CBG01773 [Caenorhabditis briggsae]
MLITKPDIEETIGQIMAMAYLYPSHPRMTAFWIGPTPTIMIYSATLLESITGNTDHLNKGFSYEFLRPWLGNGLLTSCAEQWRPRRKLLTPTFHYDILKLFLHIFNHQSSILVQKLHKISQENKGLVADVSPLVSLCALDIICETSMGQSVNAQFESDSEYVRAVLRINDIIQRRQCNPLMWLDTLFNWFGDGKEHSWALEVLHSFTHKVQSNRQFAKSNE

SEQ ID NO: 131689 - protein, 96 aa, Heterodera glycines
  Coding regions on vcDNA: vcDNA=SeqID_58112; Strand=-; Position=1 -11,58-337
MNRRWICNDVWMDIFPSFDRPQLGLKLALLSPRFDALVDKHFDGKSELTIWRTIEIRKDKGPEPKLSVQMDDKCVPFPLPDRPLPSKICFKWLRIE

SEQ ID NO: 131690 - protein, 320 aa, Heterodera glycines
  Coding regions on vcDNA: vcDNA=SeqID_58113; Strand=-; Position=1 -11,75-350,402-798,1695-1973
  Homolog annotation: Hit_ID=AAL78214.1; Match level="QueryCoverage =46%, HitCoverage=75%, E-value=7e-12, Identity=30%"; Hit description =putative esophageal gland cell protein Hgg-20 [Heterodera glycines]
MNRRWICNDVWMDIFPSFDHAQLGLKLALLSPRFNALVDKHFDGKSELTIWRPIEISKDIGTKPKLSVRMDDKFVPFPLPDRPLPSKIRFKNLRIEYIDHSVIAFLRSNHQIFDKRGINLHLWLPLSNTTNGQPIWDVFVREIWPIFSENIRHLGVCNGILFDKLRRLTSHSILTDLDQLNSIYSGDLLPEASKWLHSPRKDGQPKRFRFGRNLNAQADFDWVNSFKEHFLRANAISSISYEIHFPVRVPSMQIVPFELVNEWTKEKLTLAKENEWGIGWIMKRSKIIGETAAVHWKDGNWDNNCNNVIIWLDSDTNCIG

SEQ ID NO: 131691 - protein, 161 aa, Heterodera glycines
  Coding regions on vcDNA: vcDNA=SeqID_58114; Strand=-; Position=1 -233,735-987
MTKEMAKFFVDNFLLKVIGNKKAVVLLDSWPQWKTAIGGAAPTGPSSSTDFARDNICLETIPPGCTGFVQPCDLYLFRVGELNFRRRKKYGRHNHQATDAHIGFTFFENDIEKAKRKSFISRPEASFSKNKKKFIIQRGGNLPTLKVSFGSPMVTWVPLLC

SEQ ID NO: 131692 - protein, 51 aa, Heterodera glycines
  Coding regions on vcDNA: vcDNA=SeqID_58115; Strand=+; Position=1-155
LQIYWLKLHMRYISKFFDSVRRFDKDGFRFAISQSTFGNWSRIFSAITCNH

SEQ ID NO: 131693 - protein, 92 aa, Heterodera glycines
  Coding regions on vcDNA: vcDNA=SeqID_58116; Strand=+; Position=1-362
KKNKIIIYRVGELNFRRRKKYGRHNHQATDAHIGFTFFENDIEKAKRKSFISRPEASFSKNKKKFIIQRGGNLPTLKVSFGSPMVTWVPLLC

SEQ ID NO: 131694 - protein, 94 aa, Heterodera glycines
  Coding regions on vcDNA: vcDNA=SeqID_58117; Strand=+; Position=1-367
KKNKIIIYRVGELNFRRRKKYGKHNHQATDAHIGFTFFENDIEKAKRKSFISRPEASFSKNKKKFIIQRGGGGNLPTLKVSFGSPMVTWVPLLC

SEQ ID NO: 131695 - protein, 57 aa, Heterodera glycines
  Coding regions on vcDNA: vcDNA=SeqID_58118; Strand=-; Position=1-174
AIITESAVFCRDEENHRTMEKRTDDRTSKALSIRHYEEAVQRNRGYAKRKDILFGHW

SEQ ID NO: 131696 - protein, 156 aa, Heterodera glycines
  Coding regions on vcDNA: vcDNA=SeqID_58119; Strand=+; Position=1 -116,172-307,380-596
MENPRQKPSKVLAEIRANTKDETFVSMGTDLALVAVMRRQKRKIYGNMDRVNPLSVVLPDALLIKDGESTLLYDSRAHRQGESDLLDVLKRARKISVDGTFKVSPAAWTQCFVIGAFVNRRLALCVHALLPGKQRKYYEEALNAVKAVMAPNTPAH

SEQ ID NO: 131697 - protein, 333 aa, Heterodera glycines
  misc_feature (63)..(63): Xaa can be any naturally occurring amino acid
  Coding regions on vcDNA: vcDNA=SeqID_58120; Strand=-; Position=1-1004
  Homolog annotation: Hit_ID=XP_318550.1; Match level="QueryCoverage =100%, HitCoverage=35%, E-value=1e-63, Identity=37%"; Hit description= ENSANGP00000020240 [Anopheles gambiae]
IKYINTSSFRQADVLSRLIANYPRPEEDILIANICTETDCYINVILQTATDQLPITEAEISEXTPKDEVLRKISDYTKNGWPQKCTEPDLSPYFPKRKEILEIDGVLLYGKRVIVPSQLRERIIKALMAHPGIVRMKALARQHVYWPGLDLEIERMVRQCEDCQSAQKSPPKAPLAPWTSCSRPFQRIHIDFAGPCSDGHSYLILIDSFSKWPELYRMDRISTPATLHVLRSIVYRLGFPEEIVSDNGTQFHAAEFKEFCDEFGIKHTFTPPYHPQSNGQAERFVDTQRAMKKCAKDGKFWAEKMLLAYRTTLNSALNGLSPDQLFFGRRLRT

SEQ ID NO: 131698 - protein, 210 aa, Heterodera glycines
  Coding regions on vcDNA: vcDNA=SeqID_58121; Strand=+; Position=1 -88,207-388,1302-1662
  Homolog annotation: Hit_ID=AAH60357.1; Match level="QueryCoverage =51%, HitCoverage=52%, E-value=9e-09, Identity=30%"; Hit description =MGC68745 protein [Xenopus laevis]
IHEKCGRVRAVGFAPDMQIVSIQQEDSVIEFVLLQEGKVVGTFRHNCTAKGAVVLGVHWLSNSQVAFVTDLGCEFFCVYAYKRTLKMTQRNVRFVHCQNVQSTLIFDLKLCTDRPICSTKLCLPSVPNALSSDSVNADDGNENKSAGDLPHNQQHANRVLSIGDAFLYNSAWKMCMPDVVVDLQYELFTRVQLQLESAEHALTGEGGHDL

SEQ ID NO: 131699 - protein, 121 aa, Heterodera glycines
  Coding regions on vcDNA: vcDNA=SeqID_58122; Strand=-; Position=1 -162,624-826
  Homolog annotation: Hit_ID=XP_396854.1; Match level="QueryCoverage =58%, HitCoverage=7%, E-value=3e-13, Identity=46%"; Hit description =similar to CG32434-PB [Apis mellifera]
NAGPWRSAADQLGLCTEQSPGVGTVVHGTARDQQTNDRRVPRHIALTIPYRRAKAFAQHYVACNRNRLCALDTPDSMYILAFAVIMLNTDLHTPSLKDSRRMKLDEFVQNLYRLEEARHMD

SEQ ID NO: 131700 - protein, 162 aa, Heterodera glycines
  Coding regions on vcDNA: vcDNA=SeqID_58123; Strand=+; Position=1 -105,322-423,646-927
MSKTARHCRCRKRRRRRHHYGAHFARYFRADGKRLVYCSAVGHNHPLICHNGAAQLRKKKDFTPQPPIKLERSEFDEENEISPFNRQQQLAPEAFASVARPCHNTLRVRHALADARALECAGMSHKKAEVWVSVHAFKRMMRKAEKNLKVKKEETNAKQFAK

SEQ ID NO: 131701 - protein, 90 aa, Heterodera glycines
  Coding regions on vcDNA: vcDNA=SeqID_58124; Strand=-; Position=1 -123,215-361
  Homolog annotation: Hit_ID=CAE70669.1; Match level="QueryCoverage =71%, HitCoverage=37%, E-value=3e-16, Identity=56%"; Hit description =Hypothetical protein CBG17377 [Caenorhabditis briggsae]
MTQPQSIPTPILLSLLLNKYIDVNLLGYPREVTQGERFEQEANDETLVKRLMGRGRSDDNVETIKNRLHTFVESTKPVVDHYGKQGKLVK

SEQ ID NO: 131702 - protein, 97 aa, Heterodera glycines
  Coding regions on vcDNA: vcDNA=SeqID_58125; Strand=+; Position=1 -52,201-286,462-595,698-719
MIITLKIRMLSDQRRVDDHLPIKQCPLCSAKLDQPYEQELEKHIAEEHKIPANIVQRLIKTEIDDQHNQAIIDQEEHQQQQKSPSVGHPNSFLSLSI

SEQ ID NO: 131703 - protein, 263 aa, Heterodera glycines
  Coding regions on vcDNA: vcDNA=SeqID_58126; Strand=+; Position=1 -214,753-1112,1840-2058
PSGDDGMLNNIIAALANNPTTPPSSSTAPATAVDDPTASSSSNNFGAQLLPIFPHQCRHCSIAFRTAEHLQAHALAHSPAKFRLWHRCDAPPCATGGTDSDAAGTSADNIADQQTTTASALFPTKRALERHQRTTAHAGGDDGTAGGGGHFCDICADGQRFASDTALMAHFNTEQHLVKARGGSGGGAQNGPSNAPGSVPSCSSASSASPCSSSFTSKAVKRPSSSSSSSGKHLPYTCNVCAQSFGQPGTLDTHLRWAAVEIN

SEQ ID NO: 131704 - protein, 111 aa, Heterodera glycines
  Coding regions on vcDNA: vcDNA=SeqID_58127; Strand=-; Position=1-336
MAATAGGAVVASGVCRCPLMPLQGPFCGEKCRCRRRLLVRDVVGTCASRVGICAAGGAWRRIAAVPKAKFGRRMGQCVGLEKIDQFWHCDKSPEAYDPTSRLVVSIAEIWL

SEQ ID NO: 131705 - protein, 103 aa, Heterodera glycines
  Coding regions on vcDNA: vcDNA=SeqID_58128; Strand=-; Position=1 -162,526-676
ISLEYLLLPPRSALVEAPAGPTPKAFNATTTTLLHVMARLRDKHVYKPMTVEYSYPGGNFGGNQLLDGSISLSPLYPSQTIDLHVRIASDFHQSFLWLHPAQE

SEQ ID NO: 131706 - protein, 43 aa, Heterodera glycines
  Coding regions on vcDNA: vcDNA=SeqID_58129; Strand=-; Position=1-133
ESADGHTKAFMDLIRFILPMEEPEGSEEREGAKAETEEGAEEA

SEQ ID NO: 131707 - protein, 152 aa, Heterodera glycines
  Coding regions on vcDNA: vcDNA=SeqID_58130; Strand=-; Position=1 -209,263-511
MALLSDRFDVLVDKHFDGKSELTIWRTITIRKDEGPKAKLSVLIDDKCVAFPFPDRPLPTKIRFNSLWINYIDHSVLTFLRSNKQIIWPLFAKSIRHLSFLYGDDLDKLRRRISPTILTDLDQLNSIDSVGLFPDGIADDGPLFRHFAVPPL

SEQ ID NO: 131708 - protein, 20 aa, Heterodera glycines
  Coding regions on vcDNA: vcDNA=SeqID_58131; Strand=-; Position=1-59
YRICSNYGPVSINTAVSNYP

SEQ ID NO: 131709 - protein, 109 aa, Heterodera glycines
  Coding regions on vcDNA: vcDNA=SeqID_58132; Strand=+; Position=1 -194,230-365
MEQLSEIYAIRALLRHYWKKGTNAEETVRKICAVEGPNVVDIETAHNWFSRFESGHLTLEPKKTIILGKCQIFWQPISGFHVGPGPRFPGQKPWKRQVQEKSRLFEAWT

SEQ ID NO: 131710 - protein, 27 aa, Heterodera glycines
  Coding regions on vcDNA: vcDNA=SeqID_58133; Strand=+; Position=1 -55,989-1017
MSTSPGLGLRVAQQEYYVSLRCYDGTE

SEQ ID NO: 131711 - protein, 62 aa, Heterodera glycines
  Coding regions on vcDNA: vcDNA=SeqID_58134; Strand=-; Position=1 -123,183-245
  Homolog annotation: Hit_ID=NP_505578.1; Match level="QueryCoverage =90%, HitCoverage=19%, E-value=9e-12, Identity=53%"; Hit description =acyltransferase (5K510) [Caenorhabditis elegans] emb|CAA98276.1| Hypothetical protein T06E8.1 [Caenorhabd
MHAFQSTLDLYVLSMFWPSKCTVMMKKSLQYVPFFNIGATLSNCIFVDRFTRENAKQALDKS

SEQ ID NO: 131712 - protein, 130 aa, Heterodera glycines
  Coding regions on vcDNA: vcDNA=SeqID_58135; Strand=-; Position=1 -111,174-371,430-514
  Homolog annotation: Hit_ID=NP_502296.1; Match level="QueryCoverage =84%, HitCoverage=22%, E-value=1e-14, Identity=42%"; Hit description =HCV NS3-transactivated protein 1 like, possibly N-myristoylated (53.1 kD) (4M871) [Caenorhabditis elegans
KGLDGVAEELSMEMHRIGARNFGRDDRIGTVNGKSLLAPFLEEPLVCWLNTLPTALKTGFGLPTNDGTANKFLLRNALRSLGVPECFVQRPKRAMQFGQFFVMHTDGQNGERGEWRPKVKRAQICEKLML

SEQ ID NO: 131713 - protein, 24 aa, Heterodera glycines
  Coding regions on vcDNA: vcDNA=SeqID_58136; Strand=-; Position=1 -50,367-391
MSRCLRMLGSGVYEMIKCCDGACE

SEQ ID NO: 131714 - protein, 44 aa, Heterodera glycines
  Coding regions on vcDNA: vcDNA=SeqID_58137; Strand=-; Position=1 -94,418-458
MTLTRIFRRILTFTSIYRTILTLTRIFQNYSELFWCLPEFSEQF

SEQ ID NO: 131715 - protein, 44 aa, Heterodera glycines
  Coding regions on vcDNA: vcDNA=SeqID_58138; Strand=-; Position=1 -94,146-186
MTLTRIFRTILTFTRIYRTILTLTRIFQNYSELFWCLPEISEPF

SEQ ID NO: 131716 - protein, 95 aa, Heterodera glycines; identical to SEQ ID NO: 130684
  Coding regions on vcDNA: vcDNA=SeqID_58139; Strand=+; Position=1-656

SEQ ID NO: 131717 - protein, 68 aa, Heterodera glycines
  Coding regions on vcDNA: vcDNA=SeqID_58140; Strand=-; Position=1-207
NKKIDFSSVRWGTQQLMGSKNPTQNKVQAIGSYSEGFGLPINLGASVRGDCPENKKIDFFKCPFGVLK

SEQ ID NO: 131718 - protein, 100 aa, Heterodera glycines
  Coding regions on vcDNA: vcDNA=SeqID_58141; Strand=+; Position=1 -116,371-557
MAKESGGRNWMRKRRRGRSGRRRRSRGMYSTYQSLENWRKLLQKCLISAVNNLIKTLEIPFNATKQFAFRVRVYGDEYFDNKYTASLKMCSIKTFKALNP

SEQ ID NO: 131719 - protein, 109 aa, Heterodera glycines
  Coding regions on vcDNA: vcDNA=SeqID_58142; Strand=+; Position=1 -47,102-377,449-455
MSDNPCKVEKQMAKAIFISGDGWLAVFHLLPPSQLGLGIALISPRFDHFVDEHFKTRKWALGNIRIRSKIGQNGTKEMEIINSDLKLLPIAQNPPPKKVIGFNRISIRT

SEQ ID NO: 131720 - protein, 74 aa, Heterodera glycines
  Coding regions on vcDNA: vcDNA=SeqID_58143; Strand=-; Position=1 -57,144-311
MLVAAAKHSNGLNNDDKEKPPPPIHSTESHQNVLLMPTNSSCSLNGRLLADMDMDGGTLLSVEEVPIFEFENGK

SEQ ID NO: 131721 - protein, 36 aa, Heterodera glycines
  Coding regions on vcDNA: vcDNA=SeqID_58144; Strand=+; Position=1 -4,149-255
MIRPIPGSKRSPNHDHGLCVMISRFDWASRLIGGCS

SEQ ID NO: 131722 - protein, 181 aa, Heterodera glycines
  Coding regions on vcDNA: vcDNA=SeqID_58145; Strand=-; Position=1-543
  Homolog annotation: Hit_ID=XP_550305.1; Match level="QueryCoverage =75%, HitCoverage=9%, E-value=9e-17, Identity=39%"; Hit description =helicase-like protein [Oryza sativa (japonica cultivar-group)] dbj|BAD68127.1| helicase-like protein [Oryz
MKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQ

SEQ ID NO: 131723 - protein, 64 aa, Heterodera glycines
  Coding regions on vcDNA: vcDNA=SeqID_58146; Strand=-; Position=1 -34,226-386
MKKSLIYCYSNGNRFATLELKIILVHVFRRLRFSTTIPFEKNRPALEAVSRLELGCLLHVHAAS

SEQ ID NO: 131724 - protein, 236 aa, Heterodera glycines
  Coding regions on vcDNA: vcDNA=SeqID_58147; Strand=-; Position=1 -165,484-603,1298-1723
MGHCAASLDHADLVLTELENIAKWEHTKKGISGGVGGAAGSGSSSSGGGIFSYIRETIVREAHLETLNLIALSVHPSRIRDYKFEPRYECLTYVKLDALCVFGFPHFTPLRQGEWTFQPAFVGHLYSFAGQRLPSVGHSKNGQPTDGECQGWPKAIAMANAFKNGPTSAKSGGSGGEHQQQRQRAANRRQMGKRGADNGDGNGKADGKACQLNIFCCIKKGLPGFCPVSAIWLKCD

SEQ ID NO: 131725 - protein, 61 aa, Heterodera glycines
  Coding regions on vcDNA: vcDNA=SeqID_58148; Strand=+; Position=1 -25,113-273
MTNKTLKKVPYIRIRPTKDKTPTVLSPLRSRQIEKMFKMRELANSTNSLSLSGGSNRLKVF

SEQ ID NO: 131726 - protein, 88 aa, Heterodera glycines; identical to SEQ ID NO: 124691
  Coding regions on vcDNA: vcDNA=SeqID_58149; Strand=+; Position=1 -96,135-305

SEQ ID NO: 131727 - protein, 88 aa, Heterodera glycines; identical to SEQ ID NO: 124691
  Coding regions on vcDNA: vcDNA=SeqID_58150; Strand=-; Position=1 -96,135-305

SEQ ID NO: 131728 - protein, 279 aa, Heterodera glycines
  Coding regions on vcDNA: vcDNA=SeqID_58151; Strand=-; Position=1 -297,350-376,438-477,779-905,1039-1129,1180-1313
  Homolog annotation: Hit_ID=CAE70599.1; Match level="QueryCoverage =79%, HitCoverage=55%, E-value=2e-47, Identity=47%"; Hit description =Hypothetical protein CBG17273 [Caenorhabditis briggsae]
LTIEIRLWELRFHLLSVNFLLSFIKLCCFNPKSSIKNDINYINFSPIFFPGKANTDNLSVDELWRAKHLYDSAFHPQTGEKLLLIGRMSAQVPANTIITGGMLSFYKTGGMLSFYKSTPAVVGWQFSTPAVVGWQFINQTYNATVNYSNRSGDALSGAQLLQAYLMATGGKIKKNFSKKISIQKMPPIWGRLVPFAAVAFANCVNIPMMRRKEFVDGVQVVDSNGVPLGQSRKRKEFVDGVQVVDSNGVPLGQSRKLAWWAIPQVVVSRIGMATPGMGE

SEQ ID NO: 131729 - protein, 119 aa, Heterodera glycines
  Coding regions on vcDNA: vcDNA=SeqID_58152; Strand=-; Position=1-359
MVHQISDPNTVKFDDFIILEQIGMGENFNHFHGVPPYQRGYGRQRGGGVGDVLRYLWRAILPKIKSIGTLLGKEALATGSRVLDTSKNGESPKSALISQVKKGIHNLTENGGIEGNMEL

SEQ ID NO: 131730 - protein, 54 aa, Heterodera glycines
  Coding regions on vcDNA: vcDNA=SeqID_58153; Strand=+; Position=1-165
EKGEIKISKMKRVEEQLLEYRRTRKAALEQQRVDGDGKSDMPMSLNGQEGFWDI

SEQ ID NO: 131731 - protein, 484 aa, Heterodera glycines
  Coding regions on vcDNA: vcDNA=SeqID_58154; Strand=-; Position=1 -201,281-430,801-931,1061-1237,1279-1363,1509-1655,1885-2111,2565-2901
  Homolog annotation: Hit_ID=NP_508601.1; Match level="QueryCoverage =77%, HitCoverage=91%, E-value=2e-81, Identity=40%"; Hit description =GLutamate Transporter, Sodium-dependent, ATP synthase subunit (53.4 kD) (glt-2) [Caenorhabditis elegans]
MPNLGHYRIVGGSRVLENSNGSPGFLRQNLLLILTVSAVGIGVLLGVGLRQVEPNYRMIKLIGFPGELLMRMLKCVVVPLIVASLVTGLAQLNIRDSGRIGGIAVLYYLVTTTIAVMTGIFLVLTIRPGDLGHDTNGNGYLGNGSNTKPTDTMDTMLDLIRNMLPDNLLGTALRQQQTAYYCVIDGRKTTSRALCEKHTVHLPEAQRDRFIRTELQNIDGSSNILGIIVCSIIVGIVLSQMGDKARTMIDFFSVLDQVSMRIIGWLMWYSPIGIASLIAAKVLEVERLGDTLSRLGLAMAVAFGTASSAATLPTTIRCLEQHLSIDRRVCRFVLPVGATINMDGSAMYEAVATVFIAQMVGRTLNIGQVMVIRDRFRTSINVLGDAYGAAIVHHHCREHLSPAADQKLMNGFVVANNELKLMLKNDGIGLITFPGNGVAIGTNNHLLLVEKENADKNDEGSSRSSAASEGSADGRRPLVNADYS

SEQ ID NO: 131732 - protein, 89 aa, Heterodera glycines
  Coding regions on vcDNA: vcDNA=SeqID_58155; Strand=+; Position=1-558
AFLIIEINRKKALSTWVGASSMLDVYFLYLFKVFIFGNFQKILYKKYLYNKTRTSPMNRLKKQTKYKFKKKLNFAFGILCFTSLSFLNI

SEQ ID NO: 131733 - protein, 36 aa, Heterodera glycines
  Coding regions on vcDNA: vcDNA=SeqID_58156; Strand=-; Position=1-148
KSGMGLGIRPGCDLKSNFWSGKIHTSYPIRALLLII

SEQ ID NO: 131734 - protein, 90 aa, Heterodera glycines
  Coding regions on vcDNA: vcDNA=SeqID_58157; Strand=+; Position=1 -121,658-809
MNTINNRQIAPIPQTLSEARQKLRQRPRVKFNEEEEVINPAPPPSVDRRFARRCAFLPLRHSHWFTCARFADSQRGARLGIVGEGAFFVF

SEQ ID NO: 131735 - protein, 68 aa, Heterodera glycines
  Coding regions on vcDNA: vcDNA=SeqID_58158; Strand=+; Position=1 -18,288-476
MLLSPALLIMQYNAFKPRREAGQFQNFVPHFTVESPSTLLDNYVSMSTVAFGQLWNGKMGISDGGALF

SEQ ID NO: 131736 - protein, 62 aa, Heterodera glycines
  Coding regions on vcDNA: vcDNA=SeqID_58159; Strand=-; Position=1-387
LLIMQYNAFKPRREAGQFQNFVPHFTVESPSTLLDNYVSMSTVAFGQLWNGKMGISDGGALF

SEQ ID NO: 131737 - protein, 148 aa, Heterodera glycines
  Coding regions on vcDNA: vcDNA=SeqID_58160; Strand=-; Position=1 -54,441-611,666-887
MEHQQSLLPKYFAFFGIKDNSYGVPGEERFFLLTKNLFPEKYKDEKNSGKNEQQQQFALDFTYKFDVKGSLDHQKLSAKKRNASKHPMFRYLDLYDENEQQMSADERKKIEVTKEGCFFRNGIMLEDETYEKFIGILGRDTVVRGECH

SEQ ID NO: 131738 - protein, 202 aa, Heterodera glycines
  Coding regions on vcDNA: vcDNA=SeqID_58161; Strand=-; Position=1 -423,593-778
MTFYDYYNAFPMPSSFIRVLLFLIGIFLVTILATPSPQIDVGVSVTNRTEAIRQGLIHALSTITSTIDFGKVFHDNVPSIKQDRNSRRSIEYKMPMPTLLELGQKFTLGADGKRQFEFTAYGMQAFSKLADLWNLPMQQLITSLRMGKLHQISNPNGRLSNMDIFIKTVDQQFFIKDVKTGMETLKNKQRKALKKTRPKGGD

SEQ ID NO: 131739 - protein, 87 aa, Heterodera glycines; identical to SEQ ID NO: 129152
  Coding regions on vcDNA: vcDNA=SeqID_58162; Strand=-; Position=1 -753,1097-1166

SEQ ID NO: 131740 - protein, 315 aa, Heterodera glycines
  Coding regions on vcDNA: vcDNA=SeqID_58163; Strand=+; Position=1 -162,231-355,410-585,633-738,778-887,942-1029
  Homolog annotation: Hit_ID=CAE65078.1; Match level="QueryCoverage =98%, HitCoverage=28%, E-value=1e-70, Identity=49%"; Hit description =Hypothetical protein CBG09936 [Caenorhabditis briggsae]
LESTLKSYIDSLSELTVELRIEANDGLTELNKLRNRACCQPLDKHQSSLDIVARYYDQLCYYDQLCAMETKLPITPTQNPVSFKWKDAFDKGSLFFSRASLTLNDSSFLNDSSFERACVLFNCGALMSAIASNQQTNTDEELKTVAHLFQQSAGVFSKLKDTVLASVHQEPTSDLLPDVHQEPTSDLLPDTLTALLTLMVAQAQEAIYIKAAKDKLKSTSLLKIAAQCADFYQDAQKAAKDKLKSTSLLKIAAQCADFYQDAQKLMNRETVKRIWEKEWVQTVTGKEWVQTVTGKGLVFASLAQFHAAEAALDEQ

SEQ ID NO: 131741 - protein, 73 aa, Heterodera glycines
  Coding regions on vcDNA: vcDNA=SeqID_58164; Strand=+; Position=1 -81,391-531
MFQVVFEMKKKQLEEEKKKQEEQENTLNAEREAKNNGGGANGQHSNGKAGGDIYLSASKTENGTGGGGGSCGG

SEQ ID NO: 131742 - protein, 312 aa, Heterodera glycines
  Coding regions on vcDNA: vcDNA=SeqID_58165; Strand=-; Position=1 -141,1014-1182,1419-1515,1571-1680,2037-2269,2458-2566,2989-3067
PQCRPPPPHLSHHRSLQLFLLLSRVGQDREFLAKPGPGPEKQGPGPRCPTHSGVIQSPPVYSDGLNMAFAPVFAFHFPDRTQMNFRCQIQTCNKLDNECQGLTPPNCQQNIVGLGASSGEGYSAPPTGPVVPYTINPPPTPNFVMPTLASSVGVGAYLQQPMLQHPPFIGAGGNPSQVLQGLQRPWPRSSSSKKGAKHRAETRRDTDNEQQNGGEQQAGTGTKAVAPTAQGRREQMELEHRILMATQQLKHNEDGSWPPSLVIFGTGNKSAGSAAARRFFRPIPAEERELRQRQRRAEEHTQVPFGDMNPFW

SEQ ID NO: 131743 - protein, 165 aa, Heterodera glycines
  Coding regions on vcDNA: vcDNA=SeqID_58166; Strand=+; Position=1 -209,517-703,777-873
  Homolog annotation: Hit_ID=NP_499618.1; Match level="QueryCoverage =97%, HitCoverage=14%, E-value=2e-51, Identity=61%"; Hit description =E1-E2 ATPase, putative E1-E2 ATPase (3N488) [Caenorhabditis elegans] emb|CAB11550.4| Hypothetical protein
FPAAIGQFLLRGAKLKNCRWVFGVVVYTGHDSRLLMNSTSAPLKTSRIDVMTNQRIVILFLMLVLITIVSVIGAEVYNKWFLDGHWYIGAIGHWSFWWNMLTFFILYNNLIPISLQVTLEIVRFFQASYINQDIFMYDEASDVSATARTSNLNEELGQVQFLMTE

SEQ ID NO: 131744 - protein, 53 aa, Heterodera glycines
  Coding regions on vcDNA: vcDNA=SeqID_58167; Strand=-; Position=1 -85,349-417,703-710
MLLCSKISHFLLLLLGALLLLSFISMGNVSKNPQNGFAKNGQIVSKIQIKGVF

SEQ ID NO: 131745 - protein, 137 aa, Heterodera glycines
  Coding regions on vcDNA: vcDNA=SeqID_58168; Strand=+; Position=1 -8,538-943
MLGNSQVQTVQCIRLAKEFPDAQFLVHIDEEHSEEQMQWRGAREHVGVEQRKMTLAKDTVKCTVEHLVGVIGHQKIGVMHLQKSKTTIIKWKKQFGISKKRITEEEKKEKMKIYSQIKRENAKMCDNEIAKIVNTII

SEQ ID NO: 131746 - protein, 210 aa, Heterodera glycines
  Coding regions on vcDNA: vcDNA=SeqID_58169; Strand=+; Position=1-633
MKLFPLLLLIILFLIVKIGSEKKKLQQQKSFGEIFGEKWEEKEEEKRNELKKREIIGKFNKIKEKIKQKGRKYSTKEWHKIDGKIAKKLGTNRNKIYKWIKELCLYKYKTKTDDDKLEIIQKYITMTNEYKQIRKYSPNEWNKNYAEICKKIGVGYGTICRWKKQFGIRKTEKEKMEKMKIYPKMSDETIAKTMKINRNNFLKWKKQFEE

SEQ ID NO: 131747 - protein, 103 aa, Heterodera glycines
  Coding regions on vcDNA: vcDNA=SeqID_58170; Strand=-; Position=1 -145,731-897
MFPECRLVTADPAAEINANLTRQIGGTFVQAAVGGETATGQPVNFWGKATLNYISTNYRQIIRLEIGNEKDLTMKSGRRLCTEFSQPNSINLSIQNPKNFFLN

SEQ ID NO: 131748 - protein, 65 aa, Heterodera glycines
  Coding regions on vcDNA: vcDNA=SeqID_58171; Strand=+; Position=1 -102,147-242
MKTLRRQQAAAVGQSPIVVHSVGTGLPRNQPIHQRQQVCTVPSHEVIYDVPCTGEDQQEGSEDSF

SEQ ID NO: 131749 - protein, 93 aa, Heterodera glycines
  Coding regions on vcDNA: vcDNA=SeqID_58172; Strand=+; Position=1 -129,191-343
MVKKTIPHFTINNLSPSVPDEVDCEMPDERVLHLECFESGDYGMMELYGPDRAKEMLIDLRDYAEANGMPCQHVKMLLYKLDKGLIKWKGTKP

SEQ ID NO: 131750 - protein, 234 aa, Heterodera glycines
  Coding regions on vcDNA: vcDNA=SeqID_58173; Strand=+; Position=1-705
MAINISDKKSLCNQILGQTDITVTSSGITISGPRLSTPRFIPFDEAGRCRCCKGTESEIDTVITKEGITLWCTRIEKAQFIPFDVVYDLPGHCFFRLKNKSRVFNIPYGDIPSSDTHTTKRRTNDQQHELKRKAKVALDLVEAGLMADAMQDGARWKKAKTAINVLGNLLLAESLDNTSANVKNDVADIKKEEEATVAEEHKEDDDDQQKEDLGDIDKTLDDFFNSIKASTANM

SEQ ID NO: 131751 - protein, 227 aa, Heterodera glycines
  Coding regions on vcDNA: vcDNA=SeqID_58174; Strand=+; Position=1 -153,449-499,548-615,672-994,1211-1299
  Homolog annotation: Hit_ID=AAC95573.1; Match level="QueryCoverage =90%, HitCoverage=33%, E-value=3e-13, Identity=28%"; Hit description =orf 48 [Ateline herpesvirus 3] pir||T42963 hypothetical protein 48 - ateline herpesvirus 3 (strain 73) ref
DVNSLESGPVEDDEEEEEEEEVGRVTSGGCSRIEFSRVSRSWAKNWTRVEGSKAKAETESIRSRQIISDEENSLESGPVEDDEEEEEEEVKIPRRKRTKKKKKKKRLHYDDDYGNYDDEDYDDYDDDEDDIYEDSDYGTYEDDYDSYEDDYDDEPADMEPDYDSEEEEYDYVDEGGGGNNGIGTGVSRPKRCRDTTRETKQMRLYCSDEDYEEDMHQRCPVTCRFCK

SEQ ID NO: 131752 - protein, 120 aa, Heterodera glycines
  Coding regions on vcDNA: vcDNA=SeqID_58175; Strand=+; Position=1 -211,612-763
MATTRPFPDTAHGPHSRDIVPETASTLPTRHFLRSGNDRPSRRKIVPTDPPPHPSIPNKRTSGISNNFFGGLKIFSLFVKANRACEELRMIPTMFDLDDKEKSCSGKACWGQIVTAELNA

SEQ ID NO: 131753 - protein, 49 aa, Heterodera glycines
  Coding regions on vcDNA: vcDNA=SeqID_58176; Strand=+; Position=1-149
MKLSGQFLCLRPISSLIRNSSGLRFTLLKKLLSTTNASKSSKDYSERIT

SEQ ID NO: 131754 - protein, 96 aa, Heterodera glycines
  Coding regions on vcDNA: vcDNA=SeqID_58177; Strand=-; Position=1-289
  Homolog annotation: Hit_ID=CAG01478.1; Match level="QueryCoverage =75%, HitCoverage=6%, E-value=7e-09, Identity=43%"; Hit description =unnamed protein product [Tetraodon nigroviridis]
MGNIDVGLYASKDAFAKDIQLIRNNAIEYNPDTDMDSKQIRHAANALVDMTEALFSMEMDDDFPTKLEEARKLVEEAKRWTEKMESAEKDDGTRNG

SEQ ID NO: 131755 - protein, 43 aa, Heterodera glycines
  Coding regions on vcDNA: vcDNA=SeqID_58178; Strand=+; Position=1-130
MRFWLSRKNKGDDAVNDTDLELEFSNKLDDLENDNKAEGIIGD

SEQ ID NO: 131756 - protein, 31 aa, Heterodera glycines
  Coding regions on vcDNA: vcDNA=SeqID_58179; Strand=-; Position=1-93
LVMGLHTCTCGVVVKLSTFHNFSPGFNSPLG

SEQ ID NO: 131757 - protein, 43 aa, Heterodera glycines
  Coding regions on vcDNA: vcDNA=SeqID_58180; Strand=-; Position=1-129
YGTERLPISDIFGVGIPTSEIFDEKSEIFLIFFFKKLVSFVQF

SEQ ID NO: 131758 - protein, 268 aa, Heterodera glycines
  Coding regions on vcDNA: vcDNA=SeqID_58181; Strand=-; Position=1-806
  Homolog annotation: Hit_ID=CAE60690.1; Match level="QueryCoverage =99%, HitCoverage=89%, E-value=4e-12, Identity=23%"; Hit description =Hypothetical protein CBG04347 [Caenorhabditis briggsae]
MSGQIRAKIPLLNRVLIKEIQKIKSKLEEGNFEYDKNNFDDCSRIFNKTKEIIQRIEPNFEKLKILHQKWQNLMRRMNKTEWNSEWKLQKIFREKHNYLKTIKEIDEILDTIKDINLEVKRRLKALKPNSSSESDQENESIDEEQENDDEEAGEEEDEDEKEYDSDQEDESQEMHSSDQTHRNRIPFVHQRSRIKLPAQTLTHFSGKFSQWPSFWDDYKSSVHNDSNMENIQKLKYLRGLLHDEPYRIVSPYPLTSKNYPIIIKLLKS

SEQ ID NO: 131759 - protein, 122 aa, Heterodera glycines
  Coding regions on vcDNA: vcDNA=SeqID_58182; Strand=-; Position=1 -277,888-979
MQVTLKGHKVKAIYDKNICNIVTISLEGCYSCTSGANWTLSCKTNFGTALANVKCPSQKVQVNCDKEGKEQQIQLTYNKQNIIENCEVICPDEIEIVKGKNGKTTINGKNGKIQRDKHKNKF

SEQ ID NO: 131760 - protein, 125 aa, Heterodera glycines
  Coding regions on vcDNA: vcDNA=SeqID_58183; Strand=-; Position=1 -75,127-331,383-477
MRKVIGKRFIEFDSFQTLTCEIEALILRPIDFILPHKNLCIPPILENEETKDPTYYPKKTSYDQTIELWKKTTKLLDDYWKIWTDEYIPSLREQLNEIVIIHDQTPRAMWKTGIVKNVITGSDGI

SEQ ID NO: 131761 - protein, 82 aa, Heterodera glycines
  Coding regions on vcDNA: vcDNA=SeqID_58184; Strand=+; Position=1 -94,435-589
VDVSGFRPEEINVEVIGNEIIVNGEHREQNDIIMLFFDDSLPPPTQANRSTVSSRAVCSSRRASKRRASSASWTAVACASAE

SEQ ID NO: 131762 - protein, 287 aa, Heterodera glycines
  Coding regions on vcDNA: vcDNA=SeqID_58185; Strand=-; Position=1 -287,402-483,623-1117
  Homolog annotation: Hit_ID=CAE59214.1; Match level="QueryCoverage =43%, HitCoverage=12%, E-value=7e-21, Identity=42%"; Hit description =Hypothetical protein CBG02527 [Caenorhabditis briggsae]
MIAGLGCAAASGVTNSSSSSSPYYGGVGGDEQPTADSGGVVRMDLGWTTTRHNNRNANNGQHKKQNGEATKTTEQEEREQYSNNEFILLVNLIASRVFYDFCRDNYWCGAVRNKIQTKLATIHSMVFVQIVKVAVALFHRDAGAVQVGPGHHHGPKLCGCTRPTVNEWGIWCDFDIKYDGMIRLVLETRVNLMKLKSVSESSSTATTPSSSCPIISGAGGAIDPTATLTIKNGAVDEQQQQRQRHSCGGCCATSAGGGTAPQTMPTSTTTPLLPRSSCSTYRIAPNR

SEQ ID NO: 131763 - protein, 128 aa, Heterodera glycines
  Coding regions on vcDNA: vcDNA=SeqID_58186; Strand=+; Position=1-387
MESFLKVLKESEETLRDLLAQIELDHLVPNSAEKLVELKDGKLIESPSLENIQKQTEQFVNNGQHSQEAIDMAKDALSSMNTIKNGQLFFHLSIENLKIITVEKKQKKMPKILALLSRIKISGKKKKT

SEQ ID NO: 131764 - protein, 442 aa, Heterodera glycines
  Coding regions on vcDNA: vcDNA=SeqID_58187; Strand=+; Position=1 -202,243-451,560-707,754-893,943-1569
  Homolog annotation: Hit_ID=NP_494302.1; Match level="QueryCoverage =47%, HitCoverage=16%, E-value=2e-12, Identity=27%"; Hit description =predicted CDS, putative protein of ancient origin (2C878) [Caenorhabditis elegans] gb|AAB95006.1| Hypothe
MSSELNELQSPPRVYLEGLVDAVDERVREAFLNNMMAFNNLFAFASTHGEKAPPEQMGGRLDTCKYNGEFSFLFSDLIAPGVRRPSFAQVYTLTPEDALNVREGALHTAVAPHIRRTIIQRLEALMRANPFGQTFQTIALLTDRHLKGVPLQGRTDITVIERADAPTAKQVAVIWVEEDGLPPQISAFWVSDKAGKMRELKSGMPQIDPCCFPLLHPLGTLGWRWFMKKRGSENAHHEMQQQEEPDLDQISDDELGDEVPIDDIVGTQKNDEEIDEMPELELELDNDVAEEQEEPDMNAVGSSTAQPNPGRNENEDVIFDHEVETRGGRTNISERQFYRYRMALRGSGKNTFHWLWFARRLAEYFTISVLNRIERNDLEHLKAIQVKKNYRQLLAREYIAAMEKGVRQQGPNAKLGRVFLMPQTFAGSRQYYQGKYADLMTM

SEQ ID NO: 131765 - protein, 87 aa, Heterodera glycines
  Coding regions on vcDNA: vcDNA=SeqID_58188; Strand=+; Position=1-265
SSTLLLSFCQVDELRGPTAAAIVAVEPNEQQLNTPAQAMVNTARLTFEEAIFPEVPLTALQLLAFVIKARHNCGTFVHCSTNFSKFT

SEQ ID NO: 131766 - protein, 64 aa, Heterodera glycines
  Coding regions on vcDNA: vcDNA=SeqID_58189; Strand=-; Position=1-197
SRSASAICLAWNGANGGHSNGSMRTVRNVCPMSAHKGSKEEEKRRRIPLPTSTDSLIWKGLSKN

SEQ ID NO: 131767 - protein, 86 aa, Heterodera glycines
  Coding regions on vcDNA: vcDNA=SeqID_58190; Strand=+; Position=1-257
  Homolog annotation: Hit_ID=CAE71733.1; Match level="QueryCoverage =94%, HitCoverage=6%, E-value=7e-31, Identity=75%"; Hit description =Hypothetical protein CBG18715 [Caenorhabditis briggsae]
FPSSSASNGLNPLLQERFVFHVRHPELSLLRFHVEDGDFVGPKTDPFIGQAVFPLDSVRCGFRSVPLRNQFSEPLELSALLVHVEM

SEQ ID NO: 131768 - protein, 115 aa, Heterodera glycines
  Coding regions on vcDNA: vcDNA=SeqID_58191; Strand=+; Position=1 -128,316-534
MSAIENDETKSRIWQQLKTKLHSTMVAFGSGSVQLPKLMDTFRHDWGSELTSYAVQLGFGCNDAAVYKMLLTMPDEIESGFISATGTFAFKVIPKAETSENLTKIDQSNQYQEFV

SEQ ID NO: 131769 - protein, 83 aa, Heterodera glycines
  Coding regions on vcDNA: vcDNA=SeqID_58192; Strand=+; Position=1 -145,200-304
HKQIENILRSSRGRLPPNGHPPIVRKISIRSQVQQVVQKEQQVQVVQEDEQSHDLQKPKQSSNAKDESEDIIGQLIEQFKRLK

SEQ ID NO: 131770 - protein, 170 aa, Heterodera glycines
  Coding regions on vcDNA: vcDNA=SeqID_58193; Strand=+; Position=1 -112,185-277,329-437,688-744,1159-1243,1303-1361
  Homolog annotation: Hit_ID=NP_508609.1; Match level="QueryCoverage =98%, HitCoverage=52%, E-value=3e-37, Identity=46%"; Hit description =unidentified Vitellogenin-linked Transcript (32.2 kD) (uvt-5) [Caenorhabditis elegans] gb|AAL11464.1| Uni
VFVFVPSEQTYRNLLDFALVYGSFDGGDQGLLNAYFSTWRESDATHRLPFTYNVTTVAIYGYAAALKRFAPNIKIIHFLGKQKPWALLYGDGAAGMAFVSDYHKQWYQLYANIVQQLLPPSSSSHGATAIPGRAPAGGGYEAWEAGSPDYLGADSFANIQKAIEKALKGE

SEQ ID NO: 131771 - protein, 82 aa, Heterodera glycines
  Coding regions on vcDNA: vcDNA=SeqID_58194; Strand=+; Position=1 -13,149-381
MKDETVQRIVDLHVGVDMLKILDNYAEGFSGVLKDLSAKNGQATTFNAMFTTAYLNILSSLSNKCYVSIEEGPFGRIGSIII

SEQ ID NO: 131772 - protein, 56 aa, Heterodera glycines
  Coding regions on vcDNA: vcDNA=SeqID_58195; Strand=+; Position=1-168
MSELKDAPTHWSGMDENREEEMMREIMTNGPIQISVNAYDDIYNYGESSNRINVYV

SEQ ID NO: 131773 - protein, 100 aa, Heterodera glycines
  Coding regions on vcDNA: vcDNA=SeqID_58196; Strand=+; Position=1-305
VGFVCTDVEAALEARLSSAKDNLIRFGDEIYIKLSGDHGQSCTKITVSFSQAARSNSPSNNFVCAVFPTKDSRENLERYGITLWEQIDGIGTLAGKRVKW

SEQ ID NO: 131774 - protein, 238 aa, Heterodera glycines
  Coding regions on vcDNA: vcDNA=SeqID_58197; Strand=+; Position=1 -291,367-553,599-744,814-904
MMGITKPPLLLSIGFDRIIPAPFHVFQGIGNALIRELEQQEGCVEIAQHFFRRFGARREQFRKRDMTGNSIRKILVHASEMEHLFSTDWPITICRTLAEPLSPNDLDELEERVNDFKSFLSAQERMRGFLSKKPKAHLLLSHFVPFAREHKFLGLLDEQGDEALHSVWRRLEQLWKCMPDADQILQQLEHHFVNNWLLDTGKIDEMKQRQSDQREEHDELDQSEEEIDEISLIISLID

SEQ ID NO: 131775 - protein, 521 aa, Heterodera glycines
  Coding regions on vcDNA: vcDNA=SeqID_58198; Strand=+; Position=1-1563
  Homolog annotation: Hit_ID=NP_920205.1; Match level="QueryCoverage =82%, HitCoverage=28%, E-value=1e-44, Identity=30%"; Hit description =putative DNA helicase homolog [Oryza sativa (japonica cultivar -group)] gb|AAP52492.1| putative DNA helica
MWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEESGNKIKIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEKFFFGDDDLNLPPGQPNPRPQPNTPPPLNSDQQK

SEQ ID NO: 131776 - protein, 36 aa, Heterodera glycines
  Coding regions on vcDNA: vcDNA=SeqID_58199; Strand=-; Position=1-111
HPISFVHVVQPKVLFYGGHQLCAAKVGPHSVPVLSS

SEQ ID NO: 131777 - protein, 123 aa, Heterodera glycines
  Coding regions on vcDNA: vcDNA=SeqID_58200; Strand=-; Position=1 -117,161-287,522-649
MAELNSVCELEWRIFDFSQTVEGRVRHPKSFAWKILAMAEVLSEYDTVGWVDTSVLFSSDNLEPILTQIQNGKIGPVQLLTRKEDPPQFESKFVILHKTESTRQMMKWLVFILIGAVTNIYWH

SEQ ID NO: 131778 - protein, 245 aa, Heterodera glycines
  Coding regions on vcDNA: vcDNA=SeqID_58201; Strand=+; Position=1 -228,312-472,534-632,678-925
AKKGRAVPSARFFSVLLLLFFGRTGAKTNAKSIAVGRNFGQFATFTGPTTDGSRTKCTGTDQSKHLMGDSIERGGGSEDNAKESAPPADQSNGIKMENDNSREENGGDEVGDGEEEDNFGETLGQIFMLSKQIAENGVGCAPAKNNGKSHQNAIGTEQQMTENDLPIRFLLNEWMLKGGPSMMTNGEGTAEANAANNAIGIGTDGNAFRHHPSPPAPKRMRWTEENGTATAASQQNGGGDQFDIF

SEQ ID NO: 131779 - protein, 104 aa, Heterodera glycines
  Coding regions on vcDNA: vcDNA=SeqID_58202; Strand=-; Position=1 -210,460-561
MCPVRLELFCSEGPLLMEPFRVDCFHRDELDPLLAEHFWEHGKPLPYLREIQTLRQFKTDYYAVLVAGRTQSQMHYMLDLSSSNNVNIEGELKVNQTVPANTLR

SEQ ID NO: 131780 - protein, 21 aa, Heterodera glycines
  Coding regions on vcDNA: vcDNA=SeqID_58203; Strand=+; Position=1 -61,340-344
MGVVEETRAGRNIGHCENGKE

SEQ ID NO: 131781 - protein, 82 aa, Heterodera glycines
  Coding regions on vcDNA: vcDNA=SeqID_58204; Strand=+; Position=1 -101,161-503
TVCARQKRTLIKWFPAGTDTQSVVHFCDQPTVTIFIILMMLPSTHSVFLSPRHRVDARVRLQFGGHENAEDGVVEAAQRVID

SEQ ID NO: 131782 - protein, 80 aa, Heterodera glycines
  Coding regions on vcDNA: vcDNA=SeqID_58205; Strand=-; Position=1-241
MSEFGISIEQILRFWANTMNVFIDDNNLTAVDRMESQNVIDPLFGAWLDQLRVKEIMGLFWERNYGSCCGNKDVLSSEIT

SEQ ID NO: 131783 - protein, 451 aa, Heterodera glycines
  misc_feature (201)..(201): Xaa can be any naturally occurring amino acid
  misc_feature (207)..(207): Xaa can be any naturally occurring amino acid
  Coding regions on vcDNA: vcDNA=SeqID_58206; Strand=+; Position=1 -87,190-294,431-583,640-704,851-1124,1182-1359,1420-1575,1641 -1726,1785-1907
  Homolog annotation: Hit_ID=CAE62805.1; Match level="QueryCoverage =90%, HitCoverage=93%, E-value=1e-107, Identity=50%"; Hit description= Hypothetical protein CBG06980 [Caenorhabditis briggsae]
MDNCALQYAVENISRYVYDKLGERCAMVSIVLPTVVIYGLILLLGILGNLCTCLVILRNKCMQNPTNYYLFSLAISDLLLLVLGLPMELHGVFGAVYPYKFGEFICKGRAFLIEFTSYAFTSYASILTITCFSVERWLAICFPLRIKIFSTLDRAVKVIVAVWLCAFLAASPVLSIVVVNKLPVPDWATDQPWLPLVSHFXLLLANXSCQVSSDGQLLIGTETCAMDFMRPFAQAQRNFIFIAFTIFFLLPALLITLVYFHIVYRLCASGDRSLTASAKQKTRSRKSLLKILVPVVVMFFLCWLPFHVQRLLPVVVMFFLCWLPFHVQRLLSVYLNESSNEQYNSAIHTLFSIVFYISGYCYYSYCYYSNSACNPILYNILSAKYRIAFCKTILGERFAHKILSGRNRARILGERFAHKILSGRNRARDSAIAGGNGLNSNLNSKVSTGGS

SEQ ID NO: 131784 - protein, 78 aa, Heterodera glycines
  Coding regions on vcDNA: vcDNA=SeqID_58207; Strand=-; Position=1 -193,593-636
MPDWLRSFGLENILGSMNGTKGTKTAGADDGVAGEDTGNALAQLFGRSGGGSGSSANGGEAGGTENALKRTKFYLYVN

SEQ ID NO: 131785 - protein, 210 aa, Heterodera glycines
  misc_feature (22)..(23): Xaa can be any naturally occurring amino acid
  Coding regions on vcDNA: vcDNA=SeqID_58208; Strand=-; Position=1 -244,577-725,770-983
  Homolog annotation: Hit_ID=NP_492694.1; Match level="QueryCoverage =80%, HitCoverage=39%, E-value=5e-82, Identity=88%"; Hit description =casein kinase gamma (46.4 kD) (1K804) [Caenorhabditis elegans] emb|CAB60309.2| Hypothetical protein Y106G
GTSKSQYYPILFGLSVNLMIIXXITTTLKVGKKIGCGNFGELRLGKNLYNNEHVAIKLEPMKSKAPQLHLEYRFYKLLGQTEGLPQVHYFGPCGKYNALVMELLGHSLEDLFDLCDRKFTLKTVCMTAMQLLRRIEYVHLRRIEYVHSKHLIYRDVKPENFLIGRSSTRKQHILHIIDFGLAKEYIDCDTGSHGCYGNPLDYWSRKFFLK

SEQ ID NO: 131786 - protein, 88 aa, Heterodera glycines
  Coding regions on vcDNA: vcDNA=SeqID_58209; Strand=+; Position=1 -230,275-311
GNGQQFLFRKISLFIQRLATVSAQCRADVSHLFCSLTRLVQSLKTECPGADEGMAQCAECRRKTDILYRENKWVLTWIDSLGKMPSGI

SEQ ID NO: 131787 - protein, 88 aa, Heterodera glycines
  Coding regions on vcDNA: vcDNA=SeqID_58210; Strand=-; Position=1 -123,761-901
MAWTSSASAKRPFRSAAMGTPNAFQRTRKYFVARRDTKRRMKYPELFDSDPTTTASDQLSLSQSSHQRSAEEKQRERSGEEAAESAEE

SEQ ID NO: 131788 - protein, 85 aa, Heterodera glycines
  misc_feature (3)..(3): Xaa can be any naturally occurring amino acid
  Coding regions on vcDNA: vcDNA=SeqID_58211; Strand=+; Position=1 -139,401-483,737-808
  Homolog annotation: Hit_ID=XP_314661.1; Match level="QueryCoverage =95%, HitCoverage=17%, E-value=4e-09, Identity=36%"; Hit description =ENSANGP00000005009 [Anopheles gambiae]
KVXLKKLRKQKCLDELKKAIIAEGKYVKCVVYKIPEKQQTPYGGQMKSFPHFICCKICRFPDLLTHHQLRPVAQCLHPFNKAQKM

SEQ ID NO: 131789 - protein, 31 aa, Heterodera glycines
  Coding regions on vcDNA: vcDNA=SeqID_58212; Strand=+; Position=1-93
MGSKNPTQNLSTGYREAIPEGFGLHINLGAS

SEQ ID NO: 131790 - protein, 86 aa, Heterodera glycines
  misc_feature (17)..(17): Xaa can be any naturally occurring amino acid
  Coding regions on vcDNA: vcDNA=SeqID_58213; Strand=+; Position=1-289
GSYSRRIRSPHKSGRIXSGGLPRKKKIDFFKCPFGVLKQLLGSKNPNAGIKVQGYSESYSRKGFGLPINLGASGSGGLPPKTKKRF

SEQ ID NO: 131791 - protein, 249 aa, Heterodera glycines
  Coding regions on vcDNA: vcDNA=SeqID_58214; Strand=+; Position=1 -57,189-305,460-654,719-811,856-980,1089-1251
  Homolog annotation: Hit_ID=CAE65675.1; Match level="QueryCoverage =95%, HitCoverage=34%, E-value=8e-88, Identity=69%"; Hit description =Hypothetical protein CBG10741 [Caenorhabditis briggsae]
MLRKKLTNHKIFIPHSNYLCILQTEGSSVPKAFTFDGVYFIDSTAEQLYNDIVYPLVESVIEGYNGTVFAYGQTGSGKTFSMQGDQQLDAAQRGVIPRAFEHIFEAIATTEHTKFLVHVSYLEIYNEEIRDLLGDKCQKLDVKEHPEQVDLGGGGVYVAGLSLHVCHDVSDCERLMTTGFNNRHVGATLMNKDSSRSHSIFSMYVEALDENGNIRMGKLNLVDLAGSERQAKTGATGERFKGGKPKQIM

SEQ ID NO: 131792 - protein, 454 aa, Heterodera glycines
  Coding regions on vcDNA: vcDNA=SeqID_58215; Strand=-; Position=1 -208,495-763,1095-1296,1340-1893,1937-2068
  Homolog annotation: Hit_ID=NP_001004509.1; Match level="QueryCoverage= 62%, HitCoverage=19%, E-value=1e-44, Identity=36%"; Hit description =si:busm1-180o5.3 [Danio rerio] emb|CAD60788.1| novel protein similar to DNA polymerases [Danio rerio]
MITWSVADGFEPMSEFVDWILGFKRFETVAFAHYGGRFDSHFVLKELTERGVETELMMADLKIYQMKARGEQLKVYCENDVEILMEAILKFRQLFLEITDGMDVLKDSVTIAGVVMRIFRTKFLRENHLPIIPEGGYERAENQSKIAVKYFEWLAQSKRECDVKENLKKNREMKRFFDAVPDKGPINPRDAYAGGRTMPFCLYAKATEEVEISMFDIISLYPFVNYDTPYPVGVPKIVVSREFDVNWTVPDDVPYDGLLKVKVIPPKELLYPLLPMHIDNMLLFPNCYTCAKKTKKEFVLAKDVKKCNHRPERRALIGTFTSIELRKSLALGYRVIGFYRAYHFEQFDSQLFKGYVRMFLKIKVEASGWPSEVRNEEEKRAFIEMYKAKYNIWLEYDKMVFNPGLRMIAKLGLNSLWGKFSMRNTLSVTEIVNNLERWTELIKDDTIEFKDRLR

SEQ ID NO: 131793 - protein, 62 aa, Heterodera glycines
  Coding regions on vcDNA: vcDNA=SeqID_58216; Strand=-; Position=1 -103,1570-1655
MQRSRRDPTPPTSPKRMRAPTPRPIVGLPIPVVEGASNCQSVGAKSTANDPLAKTTMDWETN

SEQ ID NO: 131794 - protein, 157 aa, Heterodera glycines
  Coding regions on vcDNA: vcDNA=SeqID_58217; Strand=+; Position=1 -358,512-627
MDVTLPVSNSAGEWIGEERRDGVVLYAPWTDEWHVQQQQQQQQHQQQQHQQQQQQNEVQQQQQQLVRRTGTGWTRFPAWNEPLVANDWREKEENLIQRKRLQRENPEYWAQILEEEKRAVCCWGREDSGWKFWRRALVNDVGMGLKVLRLTMIGDGI

SEQ ID NO: 131795 - protein, 62 aa, Heterodera glycines
  Coding regions on vcDNA: vcDNA=SeqID_58218; Strand=+; Position=1 -183,662-667
MGATPGEVLEEETEGLEEEDVCKKGKPESADAGPEVEQLKKMLRDSGQMPMDNAPLPLPRWK

SEQ ID NO: 131796 - protein, 76 aa, Heterodera glycines
  Coding regions on vcDNA: vcDNA=SeqID_58219; Strand=-; Position=1 -72,246-357,1340-1386
AAKQSWEDYRKRNDSIIVDLLHGQQNQHQVRAVLLPVRAGADQGAQGPIDDRFYAGREMGKDASMPTRTKKGQLAQ

SEQ ID NO: 131797 - protein, 197 aa, Heterodera glycines
  Coding regions on vcDNA: vcDNA=SeqID_58220; Strand=-; Position=1-594
MNSEENFENCQSQEHQQTATTTTPPPSSPVYNNNNNDDGGIDDNGGTTTAAGTVGGNSSELLADTSDIGDDNGTTMATVGSSSGSSNEMVSNHGGGGDDEFSRDSGGGAGGGGDDFVGAPLDEEGNMYGPWPKEAYEGEENRLSFDGGKRVKTYDRENVYMRMEDNNNAAAGMASSSSTSRNSAPRPYSTRYSQAML

SEQ ID NO: 131798 - protein, 97 aa, Heterodera glycines
  Coding regions on vcDNA: vcDNA=SeqID_58221; Strand=-; Position=1 -225,277-483
TVEAGVNKTGQFRMGYILFIPSNSCTELICWPHTLLFKFELGIKADDDRRQCCKVQRRSWPRPPISSCAWRRAWMTFGNAFAPHPFAHNQRQQVRQH

SEQ ID NO: 131799 - protein, 20 aa, Heterodera glycines
  Coding regions on vcDNA: vcDNA=SeqID_58222; Strand=+; Position=1-60
ENIDHSPQTQKCLKTVRIDV

SEQ ID NO: 131800 - protein, 31 aa, Heterodera glycines
  Coding regions on vcDNA: vcDNA=SeqID_58223; Strand=+; Position=1-138
FLLHINQQIMTSSNLRNSLKSACETRWCQGY

SEQ ID NO: 131801 - protein, 329 aa, Heterodera glycines
  Coding regions on vcDNA: vcDNA=SeqID_58224; Strand=+; Position=1 -84,135-262,594-857,1023-1258,1383-1649
  Homolog annotation: Hit_ID=AAG23825.1; Match level="QueryCoverage =95%, HitCoverage=26%, E-value=1e-128, Identity=72%"; Hit description= guanylyl cyclase [Heterodera glycines]
LINDRWQVKISYFGLRWLKNVQKIETKDFLWLSPEFLWLSPEQLRKMGDNTNNNNNDQQIDGSKQPDIYTLALIFTEMVNMCPCWEENGANEHGENVRRAADEHAAAAAAVFNRRRETAQQHAARQPRERNAEEIAYLVKRGGTVPLRPTIRPALDELKPELLHLIRDCWVEAPNERPTIEKVRQKLRQMNAGRSINLMDHVFGMLEQYANKLEEDVHERTRELEEEKRKSEILLYRMMPRQVADRLKLGQSVEPEHFECVTVFFSDIVKFAELSNQMRPLQVVNLMNELYTIFDAIIDEHDMYKVESIGENFFKIKNRQMKCLNFGAR

SEQ ID NO: 131802 - protein, 87 aa, Heterodera glycines
  Coding regions on vcDNA: vcDNA=SeqID_58225; Strand=-; Position=1-264
QIDNLSIKKRHGNMLIDCKKNKIPNFQKQIPNFQWFIVSSLFSQMVAAPLSKWNSLRRFFLWLMKPTITMIMSRTVGTAKRMSTKRR

SEQ ID NO: 131803 - protein, 61 aa, Heterodera glycines
  Coding regions on vcDNA: vcDNA=SeqID_58226; Strand=-; Position=1 -70,341-456
MGQKSRNMDIKLHKYGHKFFQIKGDFVRFLASLLLPGDRSDAQCGDEGEAAAIGHFERIGH

SEQ ID NO: 131804 - protein, 76 aa, Heterodera glycines
  Coding regions on vcDNA: vcDNA=SeqID_58227; Strand=+; Position=1-229
RRGTAWEHKKPEMDEIQEFNEKLMKKFRLNTREKLAIPHQIQKPPKCFPLKLHFCLFLYAPRILGKILQRKAAKNR

SEQ ID NO: 131805 - protein, 74 aa, Heterodera glycines
  Coding regions on vcDNA: vcDNA=SeqID_58228; Strand=+; Position=1 -126,331-429
MAKTDDGTKHSETKKILTANFYTKWSENEAKDRKFHWKLLITCSKMPTPTTKPKFGSAVSEFKRWPMQMPSTRR

SEQ ID NO: 131806 - protein, 128 aa, Heterodera glycines
  Coding regions on vcDNA: vcDNA=SeqID_58229; Strand=+; Position=1 -141,346-591
MVKALVQMKEDISIVMKQWIGAMKRQMLANGGAKYDISVDNLLNIVESLVDIIEAKHKNVSRHRHISNLTFSVAFFRQVIGHCSPPLTLENIPIRSKRLQIICEAIRNFCNSAIYELSQFLCLYGRRK

SEQ ID NO: 131807 - protein, 41 aa, Heterodera glycines
  Coding regions on vcDNA: vcDNA=SeqID_58230; Strand=-; Position=1-124
MRKGLWKNSHRQLMKEWHRKEEGEEAEGEDEQKAGRPARVG

SEQ ID NO: 131808 - protein, 44 aa, Heterodera glycines
  Coding regions on vcDNA: vcDNA=SeqID_58231; Strand=+; Position=1 -18,69-182
MLNQQNKEVKVAMVLFSLIHLFAAAFDSPQCNLGLKLFSIEGGK

SEQ ID NO: 131809 - protein, 100 aa, Heterodera glycines
  Coding regions on vcDNA: vcDNA=SeqID_58232; Strand=+; Position=1 -90,211-318,392-498
PISSLFAGAALFCRGLSYRNRAFFSNAALRDEKETKCHWSEEIETVVDRPNMRFERVLGKTEYYRNLGAVRNGRSSIKLRVEVCRYTSERTFCERNVCQN

SEQ ID NO: 131810 - protein, 67 aa, Heterodera glycines
  Coding regions on vcDNA: vcDNA=SeqID_58233; Strand=+; Position=1 -77,132-258
MGKSDAKTSEKEDKREGGEGEQSAKKMKQTEPIQPTLNHEATIGPQHLAIRRIRYPQMMEQRTGKFN

SEQ ID NO: 131811 - protein, 54 aa, Heterodera glycines
  Coding regions on vcDNA: vcDNA=SeqID_58234; Strand=+; Position=1 -33,81-212
MANLDNFENNTFYLTFKDAHPSLSLIGCATIFGITASFGILFHFSVIFVTIKTK

SEQ ID NO: 131812 - protein, 249 aa, Heterodera glycines
  Coding regions on vcDNA: vcDNA=SeqID_58235; Strand=+; Position=1-747
  Homolog annotation: Hit_ID=AAA59875.1; Match level="QueryCoverage =92%, HitCoverage=68%, E-value=1e-34, Identity=40%"; Hit description =mucin
MSDDDDDMRAQKGTLIIDPKSPSPIATPPVPAVKPLTTTTTTTPTPPAVKPVTTTTPAPQSSAKPSAQQQKPTPVLPKPSAPQTSEPKIATTTTPGPPKTAITKPTTLPPPSSPPTVPLQRKPTTTTTPQTSTPTTTATPTPTQPITTVHTPKNTKTTTTTPIPQTTTKTTTQVSPTPKIPSPKPPAVKLPPPTSTTHPPQPEPTTTTTAPTKTFTSSPTTGAVIGLPSKEKQIPTVDEPVSAALTLER

SEQ ID NO: 131813 - protein, 138 aa, Heterodera glycines
  Coding regions on vcDNA: vcDNA=SeqID_58236; Strand=-; Position=1 -56,113-289,369-469,586-620,673-720
MAKGKRKWHASDEQLAGNYFVPSPQSLHLSPPRPSAAVTVEEQAIIIPSNNIQPSAKAAHYTIFNLYFPKNPKFNVFRSDKELGASSAAEEIDTISDLLEMSKANRPAEKSEKASAGGGKDLVVDEIADLLIDAIKDL

SEQ ID NO: 131814 - protein, 120 aa, Heterodera glycines
  Coding regions on vcDNA: vcDNA=SeqID_58237; Strand=+; Position=1 -71,122-413
MAWKAGMPDCRRLLPLPIAKMNRRWICGDVWMDILPSFDHAQLGLKMALLSDRFDILVDKHFDGKTTKLTIRRTIELKRRKGQKRKYMPMVIVCNFRSTTVRCPTKSALITFGLSNSNIL

SEQ ID NO: 131815 - protein, 122 aa, Heterodera glycines
  Coding regions on vcDNA: vcDNA=SeqID_58238; Strand=+; Position=1 -108,797-1054
MCRVQEWERLNAISEQSVDTELASRFKRSAKIDQYQAQKDGLIEIDLHITSNEESENKCLRACMENDGCATFKRNENSEIVEEWNKLRNLVLTICVNKMLIPVLRRESHENLIEEAKEFVIM

SEQ ID NO: 131816 - protein, 132 aa, Heterodera glycines
  Coding regions on vcDNA: vcDNA=SeqID_58239; Strand=+; Position=1 -81,220-354,404-542,593-636
MGLIMSRSRSRYRSRPSAPLAKPAIEMPLAIPPLPKKDHKTSTEAGNSAGFIEDSWMAEVVTNCEQRAADGQFKANATIEKEVVDDLPVTPNDNGKYLDKEVVDDLPVKPKDNGKSHYVLTTIPEEEEKEKE

SEQ ID NO: 131817 - protein, 139 aa, Heterodera glycines
  Coding regions on vcDNA: vcDNA=SeqID_58240; Strand=-; Position=1 -79,151-491
MPPNNRRFKGIPKKRHQIGGVAHWSAAHHRSDSRTFFIKHHQKQHQKRQIMLLQQQQQIHKKEMEIMQQKQIESLQKVKHLGKLYIEALHQHLRVCAEHQQKQQQFHEHSFTTTEELGEAFSQMAVNADGGLMWYFVVF

SEQ ID NO: 131818 - protein, 92 aa, Heterodera glycines
  Coding regions on vcDNA: vcDNA=SeqID_58241; Strand=-; Position=1 -133,174-319
MSEQFVQHQRPEDGVKEAKKPRVDDRFLWKITRGQFMLAIRLCSDDWDKLFHNKEKVRRLDIGRVGVGFKMCEKWCKINWITNERCQKTKEG

SEQ ID NO: 131819 - protein, 176 aa, Heterodera glycines
  Coding regions on vcDNA: vcDNA=SeqID_58242; Strand=+; Position=1-531
MVLVIEFCAQILGCSPKSLRDKLNHPEDRVKALKELIGKKVRTTYKDRNGMQKTFFIDGISDQGAALTPTYGRLRQPYNINIAAHFYARHRIKLHLPYVPCVVEKFSGSGEDRYYPMELIEIVDDDYKERWLGKLFTEIEDDSIHVKRFGRIEEAEEIDDNNDGRDECSQSAYIYW

SEQ ID NO: 131820 - protein, 102 aa, Heterodera glycines
  Coding regions on vcDNA: vcDNA=SeqID_58243; Strand=-; Position=1-309
MGFKLRRNGQEEFVLKLRGITLNYDVMQNQSLCYDTFKEEVLRYAETGEYEPINVIYPNFLRPDIRGGGHVTSGPLQKCYRRYVGKGIVGPNYNVLNFGHTL

SEQ ID NO: 131821 - protein, 49 aa, Heterodera glycines
  Coding regions on vcDNA: vcDNA=SeqID_58244; Strand=+; Position=1 -18,65-196
MTQARKSIAIGNLFGLLLDFATSSPTPWVMKRPICCGIFYRQHMPLSAI

SEQ ID NO: 131822 - protein, 23 aa, Heterodera glycines
  Coding regions on vcDNA: vcDNA=SeqID_58245; Strand=-; Position=1 -39,526-558
MDIKPTTGQFQRSKPTFETDHFE

SEQ ID NO: 131823 - protein, 67 aa, Heterodera glycines
  Coding regions on vcDNA: vcDNA=SeqID_58246; Strand=+; Position=1 -35,400-433,604-738
MLILVLFFIILICVLFQQVDYNNLQYSFLKHNNRICELVASAAGSPYNFRALHLVLFEVKQLSPEFR

SEQ ID NO: 131824 - protein, 78 aa, Heterodera glycines
  Coding regions on vcDNA: vcDNA=SeqID_58247; Strand=-; Position=1-234
MRIDKQFLIIRIRQEQCHKNIKEQRNNEKQKLNGEWSIGISETKKERSTKHQRTQQHFDRSNINHKSADFLSQISPSV

SEQ ID NO: 131825 - protein, 139 aa, Heterodera glycines
  Coding regions on vcDNA: vcDNA=SeqID_58248; Strand=+; Position=1 -240,569-748
MNELSTLAWYPAAEFLEFERINKAYSFNVPAFSVDTSTTDGPKYTQIMNALSEQLQQHVAKANLLISLNEKIPQFDVEVEKPIPGQKVTKLNDLHALWVLIDMQLDDIRSIFNSIEQFRLRCWAVAEPKAAATAASSGN

SEQ ID NO: 131826 - protein, 34 aa, Heterodera glycines
  Coding regions on vcDNA: vcDNA=SeqID_58249; Strand=-; Position=1-103
MMRGRREGKGRARHSGGNGGGRAEQANVEGGGGG

SEQ ID NO: 131827 - protein, 93 aa, Heterodera glycines
  Coding regions on vcDNA: vcDNA=SeqID_58250; Strand=+; Position=1-282
  Homolog annotation: Hit_ID=AAO74123.1; Match level="QueryCoverage =92%, HitCoverage=87%, E-value=1e-09, Identity=29%"; Hit description =ORF95 [Pinus koraiensis] ref|NP_817285.1| ORF95 [Pinus koraiensis]
MAMALVAMALVAMALVAMALVAMALVAMALVAMALVAMALVAMALVAMALVAMALVAMALVAMALVVMALVAMALVAMALVAMDMVAMATAVE

SEQ ID NO: 131828 - protein, 104 aa, Heterodera glycines
  Coding regions on vcDNA: vcDNA=SeqID_58251; Strand=+; Position=1 -21,78-369
MSNKQQKNANFGQRWQLESNTSGSDSKTFLWGQPPDFGFTAKTRNDLVGPLPPSQGVSPSKKKPSSKSRVDAFRPPWEDSSEEEKEGTATEGKGTEEKRWDMEE

SEQ ID NO: 131829 - protein, 118 aa, Heterodera glycines
  Coding regions on vcDNA: vcDNA=SeqID_58252; Strand=+; Position=1-354
DHPDLAAAFRIASETYSHGYNTANASKALDRFVKRKLLCVEQMQCLAKEAPTAWNSTVQICRKFITVPSIGVQNTKFEGHGATLKEAVDNCDLAILYELFDFDVIKEANVEINNMQRK

SEQ ID NO: 131830 - protein, 125 aa, Heterodera glycines
  Coding regions on vcDNA: vcDNA=SeqID_58253; Strand=-; Position=1 -103,220-376,436-537
  Homolog annotation: Hit_ID=CAC33829.1; Match level="QueryCoverage =100%, HitCoverage=37%, E-value=5e-47, Identity=72%"; Hit description= annexin 2 [Globodera pallida]
FVQLHLIFGEYQKVIGHPIEQAIQQQFSGDTRDGYLAVVECVHNRHAFFAKVLQNSTKSFLGIGRRDSDLIRLIVTRAECDMVEIKEQFMQEQFMQMFNTPLEKAIESNCSGPYKDGLLTLVKGN

SEQ ID NO: 131831 - protein, 547 aa, Heterodera glycines
  Coding regions on vcDNA: vcDNA=SeqID_58254; Strand=-; Position=1-1644
  Homolog annotation: Hit_ID=XP_320889.1; Match level="QueryCoverage =91%, HitCoverage=63%, E-value=2e-54, Identity=26%"; Hit description =ENSANGP00000012033 [Anopheles gambiae] ref|XP_313651.1| ENSANGP00000013044 [Anopheles gambiae] ref|XP_314
MDKTLADILEKLTQAIKQQKAPSTTQTAQNITLPDIQTFSPNSAEEFEEWLERFQFALDCAASNLDDEQKVKLLMTKLSPTAFSEYKRFCLPDEITKFNFADTKSRLLKLFSHPPSLAIDRYECLKACRDDGEEFGAFVNRLKALLRKFRYSELNEEQFKCLVLLTSLKSSSDAKLRQHILARLTVEDAKVNKTAKLFDSVVDDLNTVLKTEAEAKFLEQPKLKINAVQHTKSSPTKQQNQTNFSRSHKISSTSKRKNPPNNCFRCGELHWAQNCPKKNNVCRKCQRSGHIERQCDKIQAYHKNKRSQNPKVNIVMLPDTFINSVQSAGLMNAPILMNDKSIDFVLDSGTEIIVVTNQTYNDIGRPPIQACQEEGRFFDGTRCKFLGRGVANFQFNGIRTELPYYVAKSGTINLLGLTALDRFGFLEEMKRLIGTKNINQIWSTDSTKIRDTIANFENKYKQIFSEGLGLCTKMKGQLMLKSGANPIFKRARPVPYATLPTINAEMDRLEKLKVITPVDHTDWSAPILVVKKANENSKIMRRFFHRA

SEQ ID NO: 131832 - protein, 43 aa, Heterodera glycines
  Coding regions on vcDNA: vcDNA=SeqID_58255; Strand=+; Position=1 -97,999-1033
MWKTFLITYLCDQFDYGFLCSHTYMCMYSHKIERKKENRKAEN

SEQ ID NO: 131833 - protein, 46 aa, Heterodera glycines
  Coding regions on vcDNA: vcDNA=SeqID_58256; Strand=-; Position=1-140
MTRQKQRKKGPTNARINNGTNQRKAKGKADITERRTDKRTKIGRRT

SEQ ID NO: 131834 - protein, 109 aa, Heterodera glycines
  Coding regions on vcDNA: vcDNA=SeqID_58257; Strand=+; Position=1 -78,211-462
MPKVVLVVDEGYFHAVHHNQLRPLTELEIGTDGQGRGWSAEVQHFVSESLRKVAMRSDCRVELLLQKGGSWQYAEGGKIPTCTAKLLIDGADFAAQMALMGIGHSKAME

SEQ ID NO: 131835 - protein, 95 aa, Heterodera glycines
  Coding regions on vcDNA: vcDNA=SeqID_58258; Strand=-; Position=1-656
LFEYPKRTLEKIDFFVFGAVPPNRCAQIYGETESFGNSFPIACTLILRWIFAPHKCLSTPNGHLKKSIFLFSGQSPRTDAPRFMGRPNPSGIASL

SEQ ID NO: 131836 - protein, 322 aa, Heterodera glycines
  Coding regions on vcDNA: vcDNA=SeqID_58259; Strand=+; Position=1-966
  Homolog annotation: Hit_ID=NP_494191.1; Match level="QueryCoverage =87%, HitCoverage=28%, E-value=1e-33, Identity=33%"; Hit description =peptidase family A16 (2C417) [Caenorhabditis elegans] gb|AAB71060.1| Hypothetical protein R52.2 [Caenorha
MEFIVKAMPIVTLNSMDEAELSKKKLSLPSRPRQPDILLGMDVRHDLKIRDETEKLPSGFTLSTSRVGRMISGYGQVQGPMDMSVQVTYTGALISALQCANSRRDADEEIEEQIKTFFGLNIIGLSDNPEEEDKGEVMRTFRKGLTFKEGRYECGLPWNERVKDLPTNFQQARARLCGTVKKLRELNLVEEYQKIFNEWERNGIIERVPDPTQTTGPVHYLPHRPVIKMDKATTKIRIVMDASAKPANRKGAPSLNECLHTGPLLLNELTGILLRWRRMKDLILADIEKAFLQLSVREEDRDATRFLWLEDPQKTEISSPTY

SEQ ID NO: 131837 - protein, 223 aa, Heterodera glycines
  Coding regions on vcDNA: vcDNA=SeqID_58260; Strand=+; Position=1 -72,566-685,738-948,1196-1249,2438-2533,2617-2666,3328-3396
  Homolog annotation: Hit_ID=CAE57516.1; Match level="QueryCoverage =98%, HitCoverage=73%, E-value=1e-56, Identity=56%"; Hit description =Hypothetical protein CBG00491 [Caenorhabditis briggsae]
MITGAAQMEGTILVVAITDGPMPQTREHLLLARQCGIPQENICVFLNKVDEVSDAETRELVEMEVRELLNEFGYPGDTAPIIAGSALCALEGTKPELGEESVKQLLDTIDNFSIPKRTKEDEPWMPAEKVYTIKGLETFRKTVDQAEPGDQLVACGVFLEALPESEGEIRDKKWRKMQMRGVMERVGFNPFGNRSFERACKPDYTNSPKDNPAEALFKAEAKA

SEQ ID NO: 131838 - protein, 85 aa, Heterodera glycines
  Coding regions on vcDNA: vcDNA=SeqID_58261; Strand=+; Position=1 -160,498-595
  Homolog annotation: Hit_ID=CAE73708.1; Match level="QueryCoverage =100%, HitCoverage=26%, E-value=3e-11, Identity=44%"; Hit description= Hypothetical protein CBG21221 [Caenorhabditis briggsae]
MKLLIFDDYEAMSAFGAQLVARRINNALEQRKVTAGAANVPNGRSLYSVGLPTGGTPLGLYCKLTEMHKAGQVSFANVVTFNMDE

SEQ ID NO: 131839 - protein, 109 aa, Heterodera glycines
  Coding regions on vcDNA: vcDNA=SeqID_58262; Strand=+; Position=1 -69,169-252,704-880
MCWSTNICLDKALWRVIVAKNINPHTDGPAFYPLISTISLGSHTVLDFYDQGLLFETFYRLERHFYLFRIALVPLRLFSSVIKQSDDSVPVENGHFSMRLFTAKWQARA

SEQ ID NO: 131840 - protein, 37 aa, Heterodera glycines
  Coding regions on vcDNA: vcDNA=SeqID_58263; Strand=+; Position=1-113
MAAKAPLFCYLFAWFCAIIVAAPYGAAVSVEDATILD

SEQ ID NO: 131841 - protein, 225 aa, Heterodera glycines
  misc_feature (8)..(8): Xaa can be any naturally occurring amino acid
  Coding regions on vcDNA: vcDNA=SeqID_58264; Strand=+; Position=1 -30,873-1013,1203-1298,1349-1460,1512-1543,1589-1690
  Homolog annotation: Hit_ID=NP_505734.1; Match level="QueryCoverage =98%, HitCoverage=41%, E-value=1e-59, Identity=53%"; Hit description =protein phosphatase (pph-1) [Caenorhabditis elegans] pir||T18936 phosphoprotein phosphatase (EC 3.1.3.16)
LYRHLISXEIWRHGVDVSESEVRALCMLSRDLLLSQPTMLELSAPLKIVGDIHGQFSDLLRLFHACGFPPKSNYLFLGDYVDRGPRSLETIILLLCYKIKYPVNFFLLRGLETIILLLCYKIKYPVNFFLLRGNHEVASLNRIYGFYNECKTRMNIKTRMNIRVWKAFQDVFNCLPVAALINGKIFCRVWKAFQDVFNCLPVAALINGKIFCCHGGLSPHLRTLE

SEQ ID NO: 131842 - protein, 146 aa, Heterodera glycines
  Coding regions on vcDNA: vcDNA=SeqID_58265; Strand=+; Position=1 -39,94-144,187-341,383-577
AIGRQLITDFHPAVKNVASASQNLLRSFQSLSHHFYEYTAALYALGFSGINSDEFEVREQSKTLQTVTEVLKKVHSEQIDWMDYFTAMALTINQNSKTEKERLKALISGFSERERQLSKAIHRGKQMPDTRSNFYETELEAMRDQQ

SEQ ID NO: 131843 - protein, 405 aa, Heterodera glycines
  Coding regions on vcDNA: vcDNA=SeqID_58266; Strand=-; Position=1-1215
  Homolog annotation: Hit_ID=CAE56152.1; Match level="QueryCoverage =64%, HitCoverage=31%, E-value=4e-26, Identity=28%"; Hit description =Hypothetical protein CBG23765 [Caenorhabditis briggsae]
MMDVPNSFNTSPGFFENLAQSLLDLKIQDNRNYKNEEPRSGAMNALTHIKPKTTAMDCQVENELAKGSSSESPACGPETKTNIPKTSNWERPSVRSKVASLMFITLMLVGMILPFTTANMPHLPMHPLVCQTQNGGKIWQLPAVTGCSKLSIDHSKAPVVRTFDVFSPNLFEHSADAWACRKVRKSVRKYTSITNVPIQETLEPLMLQMTPSECKQMAENGKCSLGLLINDSGLSHTDKKLDFSPRMWLIGSFSWSTVSTENCYLFKTKIMSQHGSTVMQSPLGLVNNCEFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQ

SEQ ID NO: 131844 - protein, 204 aa, Heterodera glycines
  Coding regions on vcDNA: vcDNA=SeqID_58267; Strand=+; Position=1-655
  Homolog annotation: Hit_ID=CAE73289.1; Match level="QueryCoverage =91%, HitCoverage=22%, E-value=3e-19, Identity=27%"; Hit description =Hypothetical protein CBG20708 [Caenorhabditis briggsae]
MLQMTPSECKQMAENGKCSLGLLINDSGLSHTDKKLDFSPRMWLIGSFSWSTVSTENCYLFKTKIMSQHGSTVMQSPLGLVNNCEFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREM

SEQ ID NO: 131845 - protein, 45 aa, Heterodera glycines
  Coding regions on vcDNA: vcDNA=SeqID_58268; Strand=+; Position=1 -27,84-179,451-465
MPMVVNFGRTGDAQRTGQVGGRRSMPPSVVPANLGGVPPYQETTK

SEQ ID NO: 131846 - protein, 152 aa, Heterodera glycines
  Coding regions on vcDNA: vcDNA=SeqID_58269; Strand=-; Position=1 -315,670-815
PTGVLTIEEVNSVYQHYSHPKLSDATGLIKLKFPTHQRYKNEGTIEMEIEKVSEFAVEEVGSGRFSDAMDIGRFPWKIMAQIETKNESNEKWLGFYLSNDGLENGSFKIFFIYFVYRKSNSSLIRYWISKFLAGTYSTDGKIIFKNNLSKKD

SEQ ID NO: 131847 - protein, 75 aa, Heterodera glycines
  Coding regions on vcDNA: vcDNA=SeqID_58270; Strand=-; Position=1-228
MIGRAVRNRPFIFEGIFKFILYPRKMAISFFEKFYTSQKRLRMRRRAVHNRHFISQRIFIFRGYPRKMAISFFEK

SEQ ID NO: 131848 - protein, 108 aa, Heterodera glycines
  Coding regions on vcDNA: vcDNA=SeqID_58271; Strand=-; Position=1 -155,223-393
CIGQFAKLLTRIDGMEAQINGLKEKDEEGSLSSSVPAAVEDDDIGEHSDSTRQQTEGHNQNFEFGQRQFVDYTGYASPTSAASSVKSSPKKTAEEEGQQQSSSSSKRH

SEQ ID NO: 131849 - protein, 41 aa, Heterodera glycines
  Coding regions on vcDNA: vcDNA=SeqID_58272; Strand=+; Position=1 -42,620-703
MKFLLFYEFSFYHKEFMDNKGVFIYAEWLVCMIMDTHLENL

SEQ ID NO: 131850 - protein, 114 aa, Heterodera glycines
  Coding regions on vcDNA: vcDNA=SeqID_58273; Strand=-; Position=1 -63,278-559
MPTPFRLLLRHLALCVSEWEEVLYMAFLAIQGMFIDLNSGRRRPITKEKQRRRLRHGFCPSSASLSDEAATENQQKEVGHGTEAAEEEHVEEEEETEHQLFMISSSSSSEEEDF

SEQ ID NO: 131851 - protein, 116 aa, Heterodera glycines; identical to SEQ ID NO: 127487
  Coding regions on vcDNA: vcDNA=SeqID_58274; Strand=+; Position=1-351

SEQ ID NO: 131852 - protein, 94 aa, Heterodera glycines
  Coding regions on vcDNA: vcDNA=SeqID_58275; Strand=-; Position=1-772
IDFFKCPFGVLKQLWGAKIQGKNKVEVYRSYSRRIRTPYKSGRIGSGGLPRKPKKIDFFKCPFGVLKHLWGAKLQRRIKVQTIGKLFPKDSVSP

SEQ ID NO: 131853 - protein, 156 aa, Heterodera glycines
  Coding regions on vcDNA: vcDNA=SeqID_58276; Strand=+; Position=1 -102,181-549
MNFKKRFLLQHFLTILCHLFWHLNLAQHFAQKTACLSQTLVAPKTKAPFVGPTKFHRTTPRAVPKTTFGIVPKTEETFGFVPFARNVDHFGTNCTNIFFPAEVDKFLLNITARPYEIACNDYEKRAKIDEPIPSDYWSGGRLVNACMAVPSEKCEK

SEQ ID NO: 131854 - protein, 304 aa, Heterodera glycines
  Coding regions on vcDNA: vcDNA=SeqID_58277; Strand=+; Position=1 -45,1410-1509,1537-1664,1705-1808,1853-2116,2648-2720
  Homolog annotation: Hit_ID=NP_492109.1; Match level="QueryCoverage =98%, HitCoverage=35%, E-value=1e-28, Identity=29%"; Hit description =metalloprotease III family member (1I107) [Caenorhabditis elegans] emb|CAA96596.1| Hypothetical protein C
PCDIYGADCVPIRNFMSVVAGHELMHALGFVHEQSRSDTRNYVILRKNIIFHLLIIKYSKIDQYTQNFGFPYDFGLRKNIIFHLLIIKYSKIDQYTQNFGFPYDFGSVMHYESGGNHKKYERYDLITLPRFYYDLITLPRFYQQTIGQRERISFKDAAIINQIYCKDSCKGHEDKCQNGGYLNPNDCTIYCKDSCKGHEDKCQNGGYLNPNDCTKCHCPDGYGGKYCKELEESEQLMNSTIKAIINKFEDLNCEDLSGIPRELVANQSAVLLKTKAKCVGTIFIQFLYIKCTEILKKFSRRRLS

SEQ ID NO: 131855 - protein, 199 aa, Heterodera glycines
  Coding regions on vcDNA: vcDNA=SeqID_58278; Strand=+; Position=1 -61,398-597,784-879,933-1175
MDRIYQGSHGITTISDRHSWGNAKLINSNKCVNTDNLYAEKRNPGTSGLKCYDGVKHQFYDCSCHGDKKCLAEEKWAHDAFLCPIIKVNGIQIQGSRQQVFTDPKDFRYDWTRIEIDCYKAEASTVSFWGYSKPYTKEIIRVDEIHCLTYKAAGVTPPSQKRFKSLQVEEQLSMKLNPSTLLDNASSLIHVFVPFVGHP

SEQ ID NO: 131856 - protein, 333 aa, Heterodera glycines
  Coding regions on vcDNA: vcDNA=SeqID_58279; Strand=+; Position=1 -37,407-1388
  Homolog annotation: Hit_ID=XP_318550.1; Match level="QueryCoverage =98%, HitCoverage=35%, E-value=7e-76, Identity=42%"; Hit description =ENSANGP00000020240 [Anopheles gambiae]
LKIFKNFIHLPFFVVGLRPRWALILSNYEFDIRYINTTAFGQVDMLSRLIANYPRPEEDILIAKICTESFIGTILQARINHLPVTATEIAEMTEKDEILQKVAKFSKEGWSQKCNPDLAPFFPKRNEILQIENCLLYQNRVIIPTILRDRTLKALHMAHPGIVRMKALARQHVYWPGMDSAIEKLVKSCEECQIAQKAAPKAPLSPWNATKRPFERVHIDFAGPCQDGHVYLLLVDSFSKWPEVYQMNTMTSKATISVLRLIIHRLGIPEEIVSDNGRQFRSSEFSEFCKEFGIRHMFTPPFHPQNQVERFVDTFKRAMQNEKDKNGLRNAPV

SEQ ID NO: 131857 - protein, 101 aa, Heterodera glycines
  Coding regions on vcDNA: vcDNA=SeqID_58280; Strand=-; Position=1 -99,723-928
MMEEALSEMETMLNEYREENSALKGQLVERREGTEKNLLARKVQEIQRGIGEGAEQIEEMSGESDMEEQMGRKVSELEQELRVAKEVSLKMHNELEVAEEK

SEQ ID NO: 131858 - protein, 29 aa, Heterodera glycines
  Coding regions on vcDNA: vcDNA=SeqID_58281; Strand=-; Position=1-88
MDPEKARQHIPEPAIFTYASKDAILYALG

SEQ ID NO: 131859 - protein, 464 aa, Heterodera glycines
  Coding regions on vcDNA: vcDNA=SeqID_58282; Strand=-; Position=1-1395
  Homolog annotation: Hit_ID=EAL49477.1; Match level="QueryCoverage =64%, HitCoverage=44%, E-value=6e-26, Identity=31%"; Hit description =hypothetical protein 42.t00003 [Entamoeba histolytica HM-1:IMSS]
MIAEVERLLTRKRSAPVHASFGNIDDDDEEEGEILDVSFVEEEEDNMGEAPLNPLSYLTKQSAAQQETLRHEKWAQEERKRREEEQRKQRENERRRREEEEMRRKTEKDRRKTAEKAAKEKKAKEEKEASEKKAREEKLAREKKEEQRIAKEKKGEKETKDKKAEEERVAKERKAEEERVAKAEAERVAMVTKAEEERAAKAEAERAENETKKKQAEEKQLEELKRQQQLHETDDYHFVNAVHKYRVRHSELPWEAPEFNPSAHIQQNIGEFRELFEQEVYDENYAVKTREEKEELIELVKGFRFYFTEQIGRFELKVFNGKISHITLTDQLAYVLGYEQEQQIRNEELAKYAVDLGGGVSHLCIYLNSGVIESMIVGNTFANLLQVIAVEGKSGSVVEKDFQAPLFHKIIAREVDVLDVEIRTLTGRLGSSAGQLFLITYLREVPFEFGQVVLTLQFKKVLTF

SEQ ID NO: 131860 - protein, 41 aa, Heterodera glycines
  Coding regions on vcDNA: vcDNA=SeqID_58283; Strand=-; Position=1 -31,76-170
MKKAKAMEAEVDESPKKQPTNVFEYPTIFWKLARPKVLANI

SEQ ID NO: 131861 - protein, 355 aa, Heterodera glycines
  Coding regions on vcDNA: vcDNA=SeqID_58284; Strand=+; Position=1 -217,260-835,882-1156
  Homolog annotation: Hit_ID=AAA93301.1; Match level="QueryCoverage =92%, HitCoverage=90%, E-value=5e-51, Identity=35%"; Hit description =HASI
MDKKINKIYTDPANPGGYAGASALYAAVKEKHPKLKRAEFEDFLQRNTTYTLFKPKREKFQRLRTVPTGFMTDVQADLADFQALSRKNSGYRYLLLAVDVLSRRMFGAPVKSKRPADMKRAFEELFEQMPRVPDTLYTDRGLEFVAKPLKEFYAEKGIQKFETSSKKKADVAERAIRTLKTRLYKYFSANNTSVWVDVVPKFLSAINNSVCRATVLRPNEISDANAREVWKRVYGEGLAQLDKTPKIRAGETVRIPEPKHIFEKGYIPNYSDHVYTVDVARSTNPQHYLLKDYYGTKFKRKFYLPELTKVQVDENTMYRIEKKYKERVRDGKSEILVKFIGFPEKYWVTNEEINE

SEQ ID NO: 131862 - protein, 432 aa, Heterodera glycines
  Coding regions on vcDNA: vcDNA=SeqID_58285; Strand=+; Position=1 -600,659-947,1104-1513
MDHPRINESELAFPIPSGIIVSGPSSSGKTQLVLRLLRHANVMFDPPPKAIGMCKGRFCAVGCCYLVWAYGEYSTQIPDLERQGVAPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLTTRRESFLPPKMVKREQKIGERVVHNYDYLKKLGKTTSEKKRRHLLNSAGCEELLTLVEICLNVLNGSFCLSRKQKQRLAPFAKDIRQLARVRSESAKETKNDDDDDIAERTNLGFVKRQVTAAVQKRKENVSERNAMYNQYLRRYLKMRKEHKERPVRVQLSNGAQLLNKTVETGVQVRPGPDEPKDKSVMVTDEDEEEEIEVPKFLTPTSQTQGSSRSPRTNKKAANSKN

SEQ ID NO: 131863 - protein, 208 aa, Heterodera glycines
  Coding regions on vcDNA: vcDNA=SeqID_58286; Strand=-; Position=1-627
  Homolog annotation: Hit_ID=NP_701342.1; Match level="QueryCoverage =99%, HitCoverage=27%, E-value=3e-15, Identity=29%"; Hit description =MAEBL, putative [Plasmodium falciparum 3D7] gb|AAL10509.1| erythrocyte binding protein 1 [Plasmodium falc
MNKKGRLIESKEKSGKIYKSHSFFKMELLSKEEEESLKRLKRKLEHQLLRVQQSVTESEKWKSGTSDDDPVRPQEWEENEEETTKKGEEMKKKEEEEKKGREGKEKETEKKKEEMKQKDETETKRSLSVGTTKDDEISIVDSEERERDAFEKPPKPTNERMAFWESTLNNEAKKDLREDKEKALKNTGQGIVVSSRKRTVNEAANFVK

SEQ ID NO: 131864 - protein, 92 aa, Heterodera glycines
  Coding regions on vcDNA: vcDNA=SeqID_58287; Strand=-; Position=1 -146,242-374
MWHKTALAQQRVVYNGEMGDRQQQQQQQRRNGERDETTTHRKERKATEEFSPLINFSQFEANPKKKSAEETKSRTDEEEEGTAQRAGWGNDE

SEQ ID NO: 131865 - protein, 60 aa, Heterodera glycines
  Coding regions on vcDNA: vcDNA=SeqID_58288; Strand=-; Position=1 -113,523-592
MTTELPRTTTIPMLCDSPVLKQDILKCFPTVLKWTKRINSWARFSDQKGFYPNACQKIGY

SEQ ID NO: 131866 - protein, 26 aa, Heterodera glycines
  Coding regions on vcDNA: vcDNA=SeqID_58289; Strand=+; Position=1-80
TGESQSIGMVVVRGNSVVIMEPMERI

SEQ ID NO: 131867 - protein, 104 aa, Heterodera glycines
  Coding regions on vcDNA: vcDNA=SeqID_58290; Strand=-; Position=1 -47,98-365
MSHNPKEAKKEMEKAIFISADCWLEVFRLLPPFQLGLGIAMISRRFDYFVDEHFKTRKWTLGKFKIGPNGTKEMKIVNSDEKELPIPQIPLPKKVIGFGFIEIT

SEQ ID NO: 131868 - protein, 57 aa, Heterodera glycines
  Coding regions on vcDNA: vcDNA=SeqID_58291; Strand=-; Position=1 -117,576-632
MEHILSASRRVGGPRKTGFARDESLGSSLQKLWWSINGDFLIEAFLGAQYYRMLLYT

SEQ ID NO: 131869 - protein, 399 aa, Heterodera glycines
  Coding regions on vcDNA: vcDNA=SeqID_58292; Strand=+; Position=1-1199
  Homolog annotation: Hit_ID=CAA82797.1; Match level="QueryCoverage =80%, HitCoverage=49%, E-value=4e-22, Identity=26%"; Hit description =gag protein [Ascaris lumbricoides]
MSGPIQKGIINALKALDNAKSATSLLLHPDPDLSNWENAVNLEAQFDRVVKEIRTMEMQMDSLRDSSNAWIELLAHLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLEKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPAFLRSILNKKGEDPANWTTTKFRDVLNEAVRKEVQIQEVMGEYGHHYVQPKAEVVSAAPVQAPRTPNQRSRRPNQPMALRDMTFIASSLDEGHRHQ

SEQ ID NO: 131870 - protein, 502 aa, Heterodera glycines
  Coding regions on vcDNA: vcDNA=SeqID_58293; Strand=-; Position=1 -299,436-979,1338-2002
  Homolog annotation: Hit_ID=CAE69590.1; Match level="QueryCoverage =100%, HitCoverage=23%, E-value=1e-117, Identity=44%"; Hit description=Hypothetical protein CBG15812 [Caenorhabditis briggsae]
YIHPRTGEAIDLASAANQGLVDVTLAETLPNGVVHPGTGEKVSVRRAVEAGIVDSRTGEVRHPFTGERLSWVDLTRKVYSAITQNGVYDPRKGYAVSVASAFADGLIDTRAVAYLNPITQEQLSLEEAHQRGIIDAQTFNSLTTPALLDHRTHRRLNLVQAVDARLIDPRAKTVQLSPDRVVPVKQAVDEGALPRDVGEQLQRVDKLTFVEAVSRGLIDAAQGTFTDAESGRQMSIADAVSHGLIDTGSISGPDTDGAEAATNLARIIQSEEFDERSGRVQDPQTRLYLPFGAAVNQRLVDPDSLLHDLDSSKTMTLREALSMDLIDSHGRYVPKHAKGAVGAQTVPLKEAVQRGLIALIGSPMQAALAVSEALKRRDVEGYKFRLEPLDDSTLQRMSSAGYDTLSGTSGATGRPRGYEETVVRTRRAPEPSLSVRVRSSDGSDSLLRGSRARSDVDPLALVDFQTDFLKLLQAQGFDVDEKCVENPSTMRLMSIREAVESG

SEQ ID NO: 131871 - protein, 96 aa, Heterodera glycines
  Coding regions on vcDNA: vcDNA=SeqID_58294; Strand=+; Position=1 -159,227-358
MGFSDCVLPSHFSHTIENFNVHLIVHIQLSSASSTQFDVSKNQLMQTSPNASPGYNAINNNPANQNDHNYHANVNVNPDNINHLLVGVSRNYEMCP

SEQ ID NO: 131872 - protein, 122 aa, Heterodera glycines
  Coding regions on vcDNA: vcDNA=SeqID_58295; Strand=-; Position=1 -170,260-458
MPVLQNGNEREEAKFAYELDKTFLDDKNAEKVAKMLNGQTLKVGGRMGEENSGQSSRHMPRDMAHFDDHLGSGGIAVEEQMNNYYPSDYSFAHLWEYLNSNNLSQQMPRGRRKKRVIKKAIN

SEQ ID NO: 131873 - protein, 43 aa, Heterodera glycines
  Coding regions on vcDNA: vcDNA=SeqID_58296; Strand=-; Position=1 -96,334-369
MEEDGLKLELNKLGMKRVRQTEPTLRMEMVEMHFAHRNCFKKW

SEQ ID NO: 131874 - protein, 69 aa, Heterodera glycines
  Coding regions on vcDNA: vcDNA=SeqID_58297; Strand=+; Position=1-208
MNRKKIEILQKCRKRKFLNNNDGENATTSEQCEHNDNNNDRDEDFGEEHAIIKFELGKTQKGGNCLWSE

SEQ ID NO: 131875 - protein, 184 aa, Heterodera glycines
  Coding regions on vcDNA: vcDNA=SeqID_58298; Strand=+; Position=1-552
  Homolog annotation: Hit_ID=EAA16908.1; Match level="QueryCoverage =93%, HitCoverage=68%, E-value=1e-30, Identity=37%"; Hit description =Drosophila melanogaster CG8797 gene product-related [Plasmodium yoelii yoelii]
MRAFSSPSWPISCPIFLLLIVLQNSLLINAFFGWGGCEDETQIGVAQIIGQKQQQKENQEKQQQEQEEKQNQEKQQQEKQQKEQQEKQNQEKQNQEKQQKEQQEKQNQEKQNQEKQNQEKQNQEKQQKEQQEKQNQEKQQQEQEEKQNQEKQQQEQQQQQQEHTDTQYFGNSDSQHRNTTNTSA

SEQ ID NO: 131876 - protein, 133 aa, Heterodera glycines
  Coding regions on vcDNA: vcDNA=SeqID_58299; Strand=-; Position=1 -133,198-466
DLNYNMRTLTDLYMIIFILSIALPIFTRGNGPVNALGNGIIDVRANTDQNAPANALGNGPANALGNGIIDVRGNDGMPIEMAHDNVTIIKLSANTDQNAPANALGNGPANALGNGIIDARGNGWMPVEMTMLQ

SEQ ID NO: 131877 - protein, 276 aa, Heterodera glycines
  Coding regions on vcDNA: vcDNA=SeqID_58300; Strand=-; Position=1 -366,1375-1839
MSTFDEKHERSEPTVLLDALQTGGTDSTVDLMDAAAQGIVSREKRAETSQIPLREKMDDKDTYQNKLDNYFSTLKGEDLELLDELGRNKLNDEIANMFDEDRTILDATKELGLEAWIQAYKKVDWSTLSPSSAELVQFGGFNIFRGVPYQRGAGVGAVFRSLMRYLLPIGKQIGTALGRQGLESGNRVLTNVLDGKDLKESLVNESKSGLKNLLEKAANNIEAQKGQGFDFKRYKSEQMPKIARARHKPINKMHSSISPPMLGKKKRVRVDSLGPY

SEQ ID NO: 131878 - protein, 643 aa, Heterodera glycines
  Coding regions on vcDNA: vcDNA=SeqID_58301; Strand=-; Position=1 -944,1070-2057
  Homolog annotation: Hit_ID=AAA93301.1; Match level="QueryCoverage =45%, HitCoverage=78%, E-value=6e-52, Identity=39%"; Hit description =HASI
MHHTKRYVLVPEEIYQSLTATSGASQDGSPMGLVRARMDQLKNDDTINEEEKSIRYEQEFKRLNKLKRDEEERPVDVRLQNLREIADAAAPALPTTTASLAGPVVQMTQQQQQQQQKQQQAKRKPTSAFRRTMVGRHLQQQQRQRRRLIVNKRGGGGDDDDESAGDEQPKTRVDDDDDDDDDEFWEDASPRVLRSAQQTASASTTKSHANYTLTKQGVMALIRRNADALGVSGEGKIKRADGRPLKTSNVERIVAHLLNRDSRSEYKDPPVGLREFTERAQQNAQLSKYLFTKHQFGKGKKHKKSTALKFKPKLCRKDVQNFLSTQRTYTLHRQAKRRYRHLPTLAPGLHTEWQADLAIFDRLGKQNAGFRYLLVCIDTLSRQLFVEPVKSKTSASMIKAFDAVLKRAKYVPWKLLTDQGREFTARAVQEYFRAKAIEHFCMFTSPQFHAGMAERANRSIKERLYRYFTERDTYKWVDVVQDFVRAINHSYNSSLGARPVDVNFKNAESFRQMLYDKAKKMVKGVQKFKVGDRVRIEKYKHVFQKGYLPRFTNELFTVAEVHADRSPIVYRLRDDHNETLKGWFYANDLCKTLKNKERMYDIERVLRRKKGKDGVEYGFVKWRGYSTRFNSWIPLNSITSKNI

SEQ ID NO: 131879 - protein, 112 aa, Heterodera glycines
  Coding regions on vcDNA: vcDNA=SeqID_58302; Strand=+; Position=1-339
MDIIRATDWICCNANANANSTLATNTTEMDQQDDNNKPSTPPPETAAMATAVVVDPKGDEEEEEEINWLRLIDEVEQQEQQQEPNKEEEEEQHNGEEKAAQSTGGGGDGYFF

SEQ ID NO: 131880 - protein, 135 aa, Heterodera glycines
  Coding regions on vcDNA: vcDNA=SeqID_58303; Strand=-; Position=1 -44,82-445
MKELTLATYNIDGPIDDLIDNDDLYVYGSGGGGEHRAIRVTFPQIGRSVHADLYTHEAHKDYRPFYAKGRVRPGMQTRPFGYQEEQQQQQQQQAPQQQQTQAQPMMMMEELEMMTMMIPKQNPDPTQPGHSGWFR

SEQ ID NO: 131881 - protein, 329 aa, Heterodera glycines
  Coding regions on vcDNA: vcDNA=SeqID_58304; Strand=-; Position=1 -56,130-413,465-750,787-1150
  Homolog annotation: Hit_ID=NP_507780.1; Match level="QueryCoverage =87%, HitCoverage=16%, E-value=2e-11, Identity=26%"; Hit description =predicted CDS, DNA polymerase type B, organellar and viral family member (5T899) [Caenorhabditis elegans]
MAPNPGLRLIAKTLANSLWGKLAQRVGGTEVRYTRTPAEFHRLLEDPSLDKLDFVHVSDRMDRCVVRKRPEFAKAPPTNCLPVAIYVTSYARLHLYGYMEQVLALDGSELLYCDTDSIYYVNRMGGGQCVREGEALGQMKRERTDRRIVEFVAGGPKNYGIRHTARDGSDERANLKVRSFRLSYSAEQLLNFDAMKELTLATYNIDGPIDDLIDNDDLYVYGSVGGGEHRAIRVTFPQIGRSVHADLYTHEAHKDYRPFYAKGRVRPGMQTRPFGYQEEQQQQQQQQAPQQQQTQAQPMMMMEELEMMTMMIPRQNPDPTQPGHSGWFR

SEQ ID NO: 131882 - protein, 63 aa, Heterodera glycines
  Coding regions on vcDNA: vcDNA=SeqID_58305; Strand=+; Position=1-191
MGAPKCATVIVTAHPLDGHRAKGRLPTPKAVHPIPAVLNVRLSNGPARTLHLRHPDALAQRKR

SEQ ID NO: 131883 - protein, 179 aa, Heterodera glycines
  Coding regions on vcDNA: vcDNA=SeqID_58306; Strand=-; Position=1 -370,419-588
MKEEANDQKKRETIQKFEAIKEKLKQKGKYEWKNSVKIECKIAKLLGVNRDKIYKWKKELNLNKTKKKSFYEAKKQEFIERIDELKSLYGQRKQKEFAKELGISKDTFFKWKKELMANYHKSHMKNKYSNEDKQKKMKQYFEIKGKYPKTKDKIIAKKLSIAYETLKMWKKKFSSLNDF

SEQ ID NO: 131884 - protein, 140 aa, Heterodera glycines
  Coding regions on vcDNA: vcDNA=SeqID_58307; Strand=+; Position=1 -387,1394-1432
  Homolog annotation: Hit_ID=S16366; Match level="QueryCoverage=98%, HitCoverage=84%, E-value=4e-35, Identity=43%"; Hit description =collagen alpha 2(IV) chain precursor - pig roundworm sp|P27393|CA24 _ASCSU Collagen alpha 2(IV) chain precursor
DGVSGLIGIKGEKGYGLAGAKGDAGIPGFPGTKGDSGMPGLPGSPGLTGEKNRGKLQKKKLLLQGPPGLPGFPGINGDNGLPGIGLPGLPGEKGISGVPGKPGRQGTPGERGLDGVPGVPGMKGDEALPNISSKFGRILL

SEQ ID NO: 131885 - protein, 78 aa, Heterodera glycines
  Coding regions on vcDNA: vcDNA=SeqID_58308; Strand=+; Position=1-239
  Homolog annotation: Hit_ID=AAC47437.1; Match level="QueryCoverage =100%, HitCoverage=58%, E-value=2e-34, Identity=66%"; Hit description= COL-1
EAGAPGQPGQPGAPGQPGAPGQPGPKGPPGAPGQPGNAGGNGQPGQPGQPGNPGERGICPKYCAIDGGVFFEDGTRRR

SEQ ID NO: 131886 - protein, 96 aa, Heterodera glycines
  Coding regions on vcDNA: vcDNA=SeqID_58309; Strand=+; Position=1 -72,273-363,436-563
  Homolog annotation: Hit_ID=AAO85459.1; Match level="QueryCoverage =67%, HitCoverage=34%, E-value=1e-09, Identity=42%"; Hit description =putative gland protein G20E03 [Heterodera glycines]
MLDRPRFRTVGAAGNYRAIPEGPGCKSVVCAEGYKCTVGASVEKIGDRPFAQSVSLPQCVVNGGSLKDVRTKIRGGPGVINAIIKKWIYYTYGSNQ

SEQ ID NO: 131887 - protein, 117 aa, Heterodera glycines
  misc_feature (100)..(100): Xaa can be any naturally occurring amino acid
  Coding regions on vcDNA: vcDNA=SeqID_58310; Strand=+; Position=1 -34,88-191,375-437,489-542
  Homolog annotation: Hit_ID=NP_495434.1; Match level="QueryCoverage =82%, HitCoverage=22%, E-value=3e-25, Identity=63%"; Hit description =predicted CDS, i-36 protein family member (2H279) [Caenorhabditis elegans] gb|AAF39761.1| Hypothetical pr
GKVMLTTVMNNGFVTVEEGPAGGSRIRFFVTVEEGPAGGSRIRFKLVDIGRISFSRDLPVHDVREWTQLDHNHFEARLDMETLTHGMQEHTVIVYTKVMXLTHGMQEHTVIVYTKVM

SEQ ID NO: 131888 - protein, 44 aa, Heterodera glycines
  Coding regions on vcDNA: vcDNA=SeqID_58311; Strand=+; Position=1 -58,160-236
MSKLYYPPPNWKPKPSKKSAGHSTVMATTRAATCELINWSFKSN

SEQ ID NO: 131889 - protein, 17 aa, Heterodera glycines
  Coding regions on vcDNA: vcDNA=SeqID_58312; Strand=-; Position=1-66
HKHLFDLFYHIHNLIKI

SEQ ID NO: 131890 - protein, 84 aa, Heterodera glycines
  Coding regions on vcDNA: vcDNA=SeqID_58313; Strand=-; Position=1 -150,199-302
MHWQNPKSPQSPQCQDPLNSAILRWELPRQKDTTWSVLFERAQALADQFPVKLEKETDGLPQIVDFSLTQNSLEQVFMSLTNVD

SEQ ID NO: 131891 - protein, 564 aa, Heterodera glycines
  misc_feature (89)..(89): Xaa can be any naturally occurring amino acid
  misc_feature (215)..(215): Xaa can be any naturally occurring amino acid
  Coding regions on vcDNA: vcDNA=SeqID_58314; Strand=-; Position=1 -131,326-473,633-1066,1453-1640,1826-2105,2258-2521,3142-3310,3395 -3507
  Homolog annotation: Hit_ID=NP_499115.1; Match level="QueryCoverage =97%, HitCoverage=66%, E-value=6e-96, Identity=34%"; Hit description =CEll Death abnormality CED-7, ATP-binding cassette transporter, cell corpse engulfment protein (191.4 kD)
TRNTDLLNKLVPVLIMCILITLMPSFLLKLMVEERSSRFKHQLLLTRLHPIIYWASFLLLHLNIYALFCFCISLPIFVYGILEGGRLRXVLFALFFWIYHPWLCCASFLFKTVQSVTRALLVLIVLSLVGIGIVLLFESLFPVMDWVPTTLNVVFFLLLPPYDFSKCLPYEISFTVFCPSSALVIQQKGGGKGVIEAEYGICSSKILFQFLINNXHLSPVNGLYRLVYRNFDPGIFPLKKTKMSPEEREFVKQEGVENFVLYINELSKYYGNVPAIDGITFGVQRDDCFGLLGNGAGKTTTFDILSGIKFATSGTAAISGVCVSKHPPIGYCPQFDALPMELTGREVLHLIAQLNGFSEVSQKTETILKCIQMDKQADKRIKHNSGGQRRRISLGVALLTCANFVLLDEPTAGIDPGTRRDVWHLIRAIRQGTAVLLASHSMEECEALCSRIAVLNRGRLAGIGTAQHLKSRNMTDKYIDKIRNPRSRRSAKTRNSAILRWELPRQKDTTWSVLFERAQALADQFPVLDFSLTQNSLEQVFMSLTNVDVLFRLGFKRFSVSLRL

SEQ ID NO: 131892 - protein, 35 aa, Heterodera glycines
  Coding regions on vcDNA: vcDNA=SeqID_58315; Strand=-; Position=1 -29,459-537
MHNHYIKRILLSMLEGLWRMASRNALVVQLQRFWP

SEQ ID NO: 131893 - protein, 103 aa, Heterodera glycines
  Coding regions on vcDNA: vcDNA=SeqID_58316; Strand=-; Position=1 -129,237-379,646-685
  Homolog annotation: Hit_ID=CAC83611.1; Match level="QueryCoverage =88%, HitCoverage=33%, E-value=5e-40, Identity=81%"; Hit description =EXPB1 protein [Globodera rostochiensis]
MGCLSNTKTAGPIDSYLGKPVKNSIFTFYGAGGRGACGLDAGVPKMSAAGSGQLFKSDGQWKDACRADKQYMLDDPICKNICIKVDYNGKTCHAHLHEMPVER

SEQ ID NO: 131894 - protein, 80 aa, Heterodera glycines
  Coding regions on vcDNA: vcDNA=SeqID_58317; Strand=+; Position=1-264
NERNIIDKNKYKLDFKKFESLSATSLLLSSLQYDSFHNRLEHWLVAEPQVKDGSPGVNPLIGLGDIRRMNHPPPVVSRQL

SEQ ID NO: 131895 - protein, 293 aa, Heterodera glycines
  Coding regions on vcDNA: vcDNA=SeqID_58318; Strand=-; Position=1-879
  Homolog annotation: Hit_ID=CAB62280.1; Match level="QueryCoverage =100%, HitCoverage=89%, E-value=6e-36, Identity=35%"; Hit description= hydroxyproline-rich glycoprotein DZ-HRGP [Volvox carteri f. nagariensis]
MTPPPPPTESAEHINGLQPPPPPRENVGPVPPPPPPAESAESVSELPPPPPPPSLQPSLPLSLPPGANVATFLHSPPPPPPPPPPPPRPFHPPSLPPQGNRNFLRSPPCLLPPSPSGTVAFLHTPPPPPPHPRPAIPPLMMPITTATTPTPMRHFASPHPPSLYPLRVTSPAMFARSIGSPLPPRMTLPDSMMHFGPPHTSPLPPRMAPPVTMMHFGTSRPSPMPFRMAARQMFPSAAAPPQRMTAPTSFLPTMASPPPLICAPSSSAAAPPRLPQSQPMAATTDATTPQSSK

SEQ ID NO: 131896 - protein, 38 aa, Heterodera glycines; identical to SEQ ID NO: 130624
  Coding regions on vcDNA: vcDNA=SeqID_58319; Strand=-; Position=1-438

SEQ ID NO: 131897 - protein, 194 aa, Heterodera glycines
  Coding regions on vcDNA: vcDNA=SeqID_58320; Strand=-; Position=1 -401,446-626
  Homolog annotation: Hit_ID=NP_493879.1; Match level="QueryCoverage =52%, HitCoverage=24%, E-value=9e-16, Identity=41%"; Hit description =transposase family member (2B289) [Caenorhabditis elegans]
MESFCCVCKAIYGGTHSCSVCKLPCHTFYGDSGGVENEGFGGKVVCHNCVNEEGNATIAEGSENDEQEPQNNKENEGTPTKDKKRHRNNDVMKKLEAVEWAQKNSINAAAKKFKVYRKTIRDWIAHEDKLRKQIMSPNGGKRMRLDGAGRPVHRPDIDTELAEWISEKQKNKQPVSRSIIRQKAAALFMDTDIK

SEQ ID NO: 131898 - protein, 97 aa, Heterodera glycines
  Coding regions on vcDNA: vcDNA=SeqID_58321; Strand=-; Position=1 -159,764-898
MTTAPQAAAATALSALQNPLSLARLPPAHGSGLKTAPAGSAQSLADRYRITKKCLFFPVSGCPLGPGPELFKFRNRDRDLKGPGIPGPVPLHSNLHP

SEQ ID NO: 131899 - protein, 323 aa, Heterodera glycines
  Coding regions on vcDNA: vcDNA=SeqID_58322; Strand=+; Position=1 -62,116-191,246-292,343-428,474-567,620-697,748-976,1083-1134
  Homolog annotation: Hit_ID=NP_504661.1; Match level="QueryCoverage =100%, HitCoverage=49%, E-value=1e-103, Identity=43%"; Hit description=f-box only protein 11 (5H14) [Caenorhabditis elegans] gb|AAC48052.3| Hypothetical protein K04A8.6 [Caen
SDPIVRLNKIHDGLHGGIYVHEKGKGLIEENEIYHEKGKGLIEENEIYGNTLAGIWVTTGSSPILRKNRISSPILRKNRIHSGKQVGVYFYDNGHGLLEENDIVGVYFYDNGHGLLEENDIFNHLYSGVQIRTGSNPKITRNKIWGTGSNPKITRNKIWGGQNGGVLVYNSGNGVLEDNEIFDDNEIFDNAMAGVWIKTDSNPTLRRNKIYDGRDGGVCIFNRGRGLLEDNDIYDGRDGGVCIFNRGRGLLEDNDIYRNAQAGVLISTESSPILRRNRIFEGRAAGIEITNGATATLEYNWLYMNRYGLLATDVRPSLRDNRI

SEQ ID NO: 131900 - protein, 109 aa, Heterodera glycines
  Coding regions on vcDNA: vcDNA=SeqID_58323; Strand=+; Position=1 -130,332-531
MDNEAAGTDGEAVEDEEVMTDADFERAMEQLREEGGEDVNELLTDAAHGAGQRHGRGLVRTTADEQRPETSGDKPEQHESACHGVERDRVFFDHYRLIDYQIIYRSLLY

SEQ ID NO: 131901 - protein, 24 aa, Heterodera glycines
  Coding regions on vcDNA: vcDNA=SeqID_58324; Strand=-; Position=1-80
RTLSTAVRQRSSKIYSMPQILWAG

SEQ ID NO: 131902 - protein, 24 aa, Heterodera glycines
  Coding regions on vcDNA: vcDNA=SeqID_58325; Strand=-; Position=1-80
RTLSTAVRQRSSKIYSMPQILWAG

SEQ ID NO: 131903 - protein, 28 aa, Heterodera glycines
  Coding regions on vcDNA: vcDNA=SeqID_58326; Strand=-; Position=1-149
IFYRFLNVWIFFWLTKTSSNLALSILIQ

SEQ ID NO: 131904 - protein, 134 aa, Heterodera glycines
  Coding regions on vcDNA: vcDNA=SeqID_58327; Strand=-; Position=1-691
FEYPKRTLEKIDFFVFGAVPPNRCAQIYGETESFGNSFPIACTLILRWIFAPHNRLSTPNGHLKKSIFSFSGQSPRTDAPRFIGETESFGNSFPIACTLILRWIFAPHNCLSTPNGHLKKSIFLFHKYFFQKEL

SEQ ID NO: 131905 - protein, 101 aa, Heterodera glycines
  Coding regions on vcDNA: vcDNA=SeqID_58328; Strand=+; Position=1 -61,101-345
MFRYDEKFPASVTQSPADEKASQKEGNSPVEIPDVFLTYIIKKFFWQTLRWPLDNVSRKEWTVRRRITDKCLAKHWSKFDFQSLIWIFWLILVCNFTCALQ

SEQ ID NO: 131906 - protein, 152 aa, Heterodera glycines
  Coding regions on vcDNA: vcDNA=SeqID_58329; Strand=-; Position=1 -219,392-487,530-673
MEQEIKQKKLAVVHAGRSIDSALISIELSLLPFAADLSAQLEQFYGAINVNEMKQIATQIAEQMICALIEPIDMADFTSGAESSVQSSAQRLINLNFKLYNGLYKKVPGIGIFLQKTKAFVRIIIELMRGFVEKAREIGLNRAKIEKCEDGQ

SEQ ID NO: 131907 - protein, 45 aa, Heterodera glycines
  Coding regions on vcDNA: vcDNA=SeqID_58330; Strand=+; Position=1 -38,116-215
MRKALLCLLLDIHGGHFVEQLTKGHFVEHFVLFQIGLIIFSRKIF

SEQ ID NO: 131908 - protein, 183 aa, Heterodera glycines
  Coding regions on vcDNA: vcDNA=SeqID_58331; Strand=-; Position=1 -271,373-653
MSFLFGHCPFSLSLFCFFLFLCFSLLVLADEFAENGQNGALKSQSQPKERRLRNRPRDFLSECVTGYRERIEFHCQFPNMDKPCLRENAEDSVHQLDVLAAECCASPRLCSVDDIESFCCRTMDCLGLCYGDSFLAQIQSRFRYADILLKRHSSKGAAEKRGRRTTEEEEEEEKRDEDDDDDE

SEQ ID NO: 131909 - protein, 20 aa, Heterodera glycines
  Coding regions on vcDNA: vcDNA=SeqID_58332; Strand=-; Position=1-62
SESKIFNAEMRFLSTFLQNN

SEQ ID NO: 131910 - protein, 185 aa, Heterodera glycines
  Coding regions on vcDNA: vcDNA=SeqID_58333; Strand=+; Position=1 -184,233-374,417-520,574-701
  Homolog annotation: Hit_ID=NP_507780.1; Match level="QueryCoverage =92%, HitCoverage=12%, E-value=2e-11, Identity=29%"; Hit description =predicted CDS, DNA polymerase type B, organellar and viral family member (5T899) [Caenorhabditis elegans]
MEPGAKKSRKRKNAENTDGEAMEVDEEEDAVDEDAENNWMLGYEEAGEKPESVTTYAYAHAGSRYDHVLVYGEMLRMGVRPELIRQGNHLLEMKARKTGVYTPTVFRDSYKLIPIKLANFVKTFGLEIEGVENKKYFPHKFNKGGKLRHSLGNLPPMEDYYPSGLFPAERAKFEQWYDETRENWF

SEQ ID NO: 131911 - protein, 37 aa, Heterodera glycines
  Coding regions on vcDNA: vcDNA=SeqID_58334; Strand=+; Position=1 -10,225-328
MTFSKRAQDLAEEGGLAEMMDIFRTTTAAERTEAAER

SEQ ID NO: 131912 - protein, 205 aa, Heterodera glycines
  Coding regions on vcDNA: vcDNA=SeqID_58335; Strand=+; Position=1-618
MQKFYCDNYAKKFRHIKKSRRGEEFALCIVCNDDINLLSIGKAAISQHQNTGKHQKAAKAANRFLNSIPKDELQKLNTEQKWMKLFEADLPHLYKLVSIVLSVPVSNAFVERVFSLCGSQWTDVRNSLKVETVKALVQTQINFDLTCPEMYQMLISNHKLLDQIGGWDKFCGTGSRGINPANPAFKICGIPCGIAGFWKIRKNFN

SEQ ID NO: 131913 - protein, 102 aa, Heterodera glycines
  Coding regions on vcDNA: vcDNA=SeqID_58336; Strand=-; Position=1 -120,390-527,589-636
  Homolog annotation: Hit_ID=CAE59953.1; Match level="QueryCoverage =100%, HitCoverage=13%, E-value=8e-10, Identity=36%"; Hit description= Hypothetical protein CBG03441 [Caenorhabditis briggsae]
LSVCLIEAESLNVHICHPIIPSLSPAQIQLNLQSTVLNFAIAFRIENVNIDFENFVIIDDIEVAGGDQCGDLAAKLENKLLDQFLPAPMLSSLLSRPIHSAQ

SEQ ID NO: 131914 - protein, 82 aa, Heterodera glycines
  Coding regions on vcDNA: vcDNA=SeqID_58337; Strand=-; Position=1 -110,154-292
MKNGQMCRLGTVAFVDYYQFLCASLARNGREMKTEKEKIEEIGRENRESKKAKEIKEKKKRKRSDTERKDREDVCGVQCEKR

SEQ ID NO: 131915 - protein, 129 aa, Heterodera glycines
  Coding regions on vcDNA: vcDNA=SeqID_58338; Strand=-; Position=1 -234,284-439
  Homolog annotation: Hit_ID=EAL49477.1; Match level="QueryCoverage =100%, HitCoverage=26%, E-value=2e-10, Identity=35%"; Hit description= hypothetical protein 42.t00003 [Entamoeba histolytica HM-1:IMSS]
MSKTEMLLKEENGKISELEMKMKDEKETFEAKLEKMKKEGEKEAQKGEEILRRAEKEKREMNLEMEAIKKERDGRKEEVEKLREQIIAFEEEKGHLKLELKSVKRELKGLKQIEAQMKGGEEKGKSPRK

SEQ ID NO: 131916 - protein, 95 aa, Heterodera glycines; identical to SEQ ID NO: 125597
  Coding regions on vcDNA: vcDNA=SeqID_58339; Strand=-; Position=1-702

SEQ ID NO: 131917 - protein, 51 aa, Heterodera glycines
  Coding regions on vcDNA: vcDNA=SeqID_58340; Strand=-; Position=1 -61,160-251
MSISTNSINYKDDFTPAENGEVNGGAISLDNDGQFDGKNSEQSVTDQQQFK

SEQ ID NO: 131918 - protein, 51 aa, Heterodera glycines
  Coding regions on vcDNA: vcDNA=SeqID_58341; Strand=+; Position=1-156
AVPAPVSLSGYGVELAIKSTEYKAIDDSNDQKTGGDEPAQNLHGFNFSLLR

SEQ ID NO: 131919 - protein, 78 aa, Heterodera glycines
  Coding regions on vcDNA: vcDNA=SeqID_58342; Strand=+; Position=1 -177,666-722
DGKWLENEHRNATITFKNISVLELFFGITNGNDVIKLNGVQMFEEYSNSAPYCDMKKIEVMGDVILLDEPELNVPPPK

SEQ ID NO: 131920 - protein, 1299 aa, Heterodera glycines
  Coding regions on vcDNA: vcDNA=SeqID_58343; Strand=+; Position=1 -1323,1703-2165,2507-4513,4838-4941
  Homolog annotation: Hit_ID=XP_471435.1; Match level="QueryCoverage =42%, HitCoverage=59%, E-value=1e-71, Identity=32%"; Hit description =OSJNBb0012A12.10 [Oryza sativa (japonica cultivar-group)] emb|CAD40092.2| OSJNBb0012A12.10 [Oryza sativa
MAFDQMDCDDEKLLDFEEETPVNESVKSLTKEEEEKVLKELGIVSEKPKICRSFSSPNNFCADRVSVLKTALIERSIVGSERGNVKVLIHNKGPEPLILEKGMKVAYAEKLDEIFNPNVELFPLEFDRMFVSQKFIRSTAKFERNLRNKELISILNNKIGALSDSEKDKMQQFWLGFSDVFALNEFELTQTDLFPHEIKTENATPIKTAPRPIPFGVRTKVTEMINDYLKREIIRPSNSPWASPIVLVAKKDGSIRFCLDYRKLNSVTIKDSYPIPNIDQILMYLGNKHYFTVLDLMSGYWQVRVKEEDIEKTAFTVPGGLYEFLVLPFGLGNAPATFQRLMNKILSEYINEFVFVYLDDILIASETFEDHMLHLRKVFEKLNENGMKVKAEKCGFALDQTPYLGHILTREGLAKDPEKYKPIKEFPMPKTIKELQRFLGMHFIAWLPTIVYTDHKALPQMFKSKNSVGNSKVDRWIMELGAPFQLEVIYKPGKENHVADALSRAFNSKTLTLEEKGSENCAYISAVLTPEIPKLPISVSKEEWVEEIKNSELAFIWNFLVKKELPHELKTHQKLLESLGKFTVDEKILYYLNSDKVIPIPNKKAETVSQEFVEKWVLKFGAPEAIHSDLGGEFVNSILKEITEKLLVSRSTTSGYDPNANGLAERLNRTIIEMVRKTSTSPWEWDLRIPYVTFSHNITPNESTGFSPSTLFFGRALNFPTNVTAPKRPNPLYTIDLDEYLQFFRENYELLVKEASKNIAKAQFIQKKQFDSKPNVQPGKYKLGDRVMVFFRPSAQIKHSKLSWNYFGPYKIKALSPTAAWVVPVNKEESEQIKVPIEHLVHTPIELPNETFLPKQRRGKIFKNMPPSENGKETSQKKINSVLTKCIFSENVAPAKLALSAHCSGIEQHSNCSCILLEEVFPNLPAMDPLRRVQLSSLGELIPISIAKQKGILLGHIRSWANSDEESASLLRHIPNFSPDIQNFIPPILMWVDRCAVAFQTLKNTGMKVVQQEICSKNPLHRFGELISEAFEEVKAKNIIGFSSMESEKFLCYGDSSVREFASKLETKTIIFKNTLEMAEAFKNTYFTTKVQEILILIGNDDLDQGLVLNDVEEAIRKIIVHANKFSIKTIFIPPPFHYSKRILHGKLLNLLAKMLPNDGKIVLAMKRGNRSLAEVTRFGNLENRRTVNENGKLKPPGIHFTISFLTDVFGMTTPVKMSSESGSSGIRTPATSNSRAPSLLNVQIPSPIIPHPRQEQNAYRRFNPLAFSLHQIRCLSVDVKTRKRSSFADPGEVCGDQT

SEQ ID NO: 131921 - protein, 20 aa, Heterodera glycines
  Coding regions on vcDNA: vcDNA=SeqID_58344; Strand=+; Position=1-65
TDQKRTKLCRDTERKRNNLF

SEQ ID NO: 131922 - protein, 91 aa, Heterodera glycines
  Coding regions on vcDNA: vcDNA=SeqID_58345; Strand=+; Position=1-1125
LFEYPKQTLEKIDFFVFGAVPPNRCAQIYGETESFGNSFPIACTLILRWIFAPHNCLSTPNGHLKNRFFCFRGSPPEPMRPDLWGDRILRD

SEQ ID NO: 131923 - protein, 191 aa, Heterodera glycines
  Coding regions on vcDNA: vcDNA=SeqID_58346; Strand=+; Position=1 -199,245-460,510-667
  Homolog annotation: Hit_ID=XP_392800.1; Match level="QueryCoverage =88%, HitCoverage=21%, E-value=2e-57, Identity=63%"; Hit description =similar to ENSANGP00000021534 [Apis mellifera]
KKGKTMVMDSDRDKILVSELMTFKGGLDKVISDCFNSNEKFLHALKDSFDFFINTRANKIAELIGQPKFMDSKLRTGNKECSEEELDEVMDRVIVLFRFVQGKDIFEAFYKKDLAKRLLLGRSASVDAEKAMLSKLRTECGAGLTQKLEGMFKDMDLSRDFCKTFKQVAIKWILGICLLFFSISRQTTLEM

SEQ ID NO: 131924 - protein, 155 aa, Heterodera glycines
  Coding regions on vcDNA: vcDNA=SeqID_58347; Strand=-; Position=1 -189,278-383,441-610
  Homolog annotation: Hit_ID=NP_508537.1; Match level="QueryCoverage =100%, HitCoverage=6%, E-value=9e-66, Identity=76%"; Hit description =spectrin (spc-1) [Caenorhabditis elegans] gb|AAB53876.1| Spectrin protein 1 [Caenorhabditis elegans] pir|
HEGIQRVTELKDQLLEAEHEQSAAIEQRHRAVIQRWQQLLANSLERRRKLTEAQAHFKQIEDLYLTFAKKASAFNSWFENAEEDLTDPVRCNSLEEIRALREAHTEFQKSLVGAEDDFRQLQELDRQIKSYNVGPNPYTWFTIEALSETWQNLQK

SEQ ID NO: 131925 - protein, 73 aa, Heterodera glycines
  Coding regions on vcDNA: vcDNA=SeqID_58348; Strand=-; Position=1 -96,151-275
  Homolog annotation: Hit_ID=XP_455629.1; Match level="QueryCoverage =98%, HitCoverage=28%, E-value=2e-12, Identity=44%"; Hit description =unnamed protein product [Kluyveromyces lactis] emb|CAG98337.1| unnamed protein product [Kluyveromyces lac
MHPIRLTVALNFAILQFEVQKSPADACQTAQRAYDDATSDAQTTGESICAESVTIMGLLQDNISYWSGNTSKT

SEQ ID NO: 131926 - protein, 91 aa, Heterodera glycines
  Coding regions on vcDNA: vcDNA=SeqID_58349; Strand=+; Position=1 -165,299-409
MQYNAFKPRREAGQFQNFVPHFTVESPSTLLDNYVSMSTVAFGQLWNGKMGISDGLLIMLYNAFKPRRAAAPLLCTILVFKIGSGLFGFLK

SEQ ID NO: 131927 - protein, 76 aa, Heterodera glycines
  Coding regions on vcDNA: vcDNA=SeqID_58350; Strand=-; Position=1-388
GGTVPKFCTTFYCGKSKYLIGQLRVNEHSRLWPVVERKNGNIRWGALFSKNSSFRLTIPPFCALFRFKIESFFFVF

SEQ ID NO: 131928 - protein, 66 aa, Heterodera glycines
  Coding regions on vcDNA: vcDNA=SeqID_58351; Strand=+; Position=1-202
FVNLLVDRSVNFDADAMQLKYALICRLVEAAPSALNDGQMEMLRDYCTKGPFWGAPVVEVATEEAA

SEQ ID NO: 131929 - protein, 169 aa, Heterodera glycines
  Coding regions on vcDNA: vcDNA=SeqID_58352; Strand=-; Position=1 -118,168-219,266-605
  Homolog annotation: Hit_ID=NP_503034.1; Match level="QueryCoverage =95%, HitCoverage=44%, E-value=1e-54, Identity=64%"; Hit description =CYcloPhilin (36.4 kD) (cyp-13) [Caenorhabditis elegans] emb|CAB55151.1| Hypothetical protein Y116A8C.34 [
MSYTTNFPHSRKRTVYVGGFGEEVNEKVLTLAFIPFGDIVGISIPLDNETGKHRSFGFVEFELPEDAAAAIDNMNDSEIYGKTIRVNFARPPKVNERSQRPIWADDEWLKQYGQGSGQGEPGENGGEKLNETERMAGEEGDEEEEGRDSSQQKLPKVYLGIKIGIRLAF

SEQ ID NO: 131930 - protein, 426 aa, Heterodera glycines
  Coding regions on vcDNA: vcDNA=SeqID_58353; Strand=+; Position=1 -1002,1076-1356
  Homolog annotation: Hit_ID=NP_758033.1; Match level="QueryCoverage =100%, HitCoverage=45%, E-value=1e-47, Identity=30%"; Hit description= DNA topoisomerase IV subunit A [Mycoplasma penetrans HF-2] dbj|BAC44437.1| DNA topoisomerase IV subunit
ENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDEKGFAQVDIEKANSPEDLWSRVIAASQSFKKVAFREQVADEEGCSSARKPSSDQPCYDQPSFRGGGDQHRWDSSGWSSCRGEAKEDQQWIDDDKSDEKRLSNRN

SEQ ID NO: 131931 - protein, 365 aa, Heterodera glycines
  Coding regions on vcDNA: vcDNA=SeqID_58354; Strand=-; Position=1-1095
  Homolog annotation: Hit_ID=AAS38911.1; Match level="QueryCoverage =90%, HitCoverage=84%, E-value=4e-46, Identity=47%"; Hit description =similar to Leishmania major. Ppg3 [Dictyostelium discoideum]
MSTCAKPFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSMIRMNRDQSLVRRRRMIRILHCFRLRDDRDQSL

SEQ ID NO: 131932 - protein, 153 aa, Heterodera glycines
  Coding regions on vcDNA: vcDNA=SeqID_58355; Strand=+; Position=1-463
  Homolog annotation: Hit_ID=NP_758033.1; Match level="QueryCoverage =98%, HitCoverage=40%, E-value=1e-18, Identity=33%"; Hit description =DNA topoisomerase IV subunit A [Mycoplasma penetrans HF-2] dbj|BAC44437.1| DNA topoisomerase IV subunit A
EGCESSDDDERVTDRDSSEDENSEGCESSDNDERVTDRDSSEDENSEGCESSDDDERVTDRDSSEDENSEGCESSDDDERVTDRDSSEDENSEGCESSDDDERVTDRDSSEDENSEGCESSDDDERVTDRDSSEDEKGFAQVDIEKGGNAFKI

SEQ ID NO: 131933 - protein, 228 aa, Heterodera glycines
  Coding regions on vcDNA: vcDNA=SeqID_58356; Strand=-; Position=1 -27,1016-1677
  Homolog annotation: Hit_ID=AAS38911.1; Match level="QueryCoverage =100%, HitCoverage=84%, E-value=8e-31, Identity=46%"; Hit description= similar to Leishmania major. Ppg3 [Dictyostelium discoideum]
LHICDISRSFSMSTCAKPFSSSDESRSVTRSSSSDDSHPSLFSSSDESRSVTRSSSSDDSHPSLFSSSDESRSVTRSSSSDDSHPSLFSSSDESRSVTRSSSSDDSHPSLFSSSDESRSVTRSSLSDDSHPSLFSSSDESRSVTRSSSSDDSHPSLFSSDESRSVTRSSSSDDSHPSLFSSSDESRSVTRSSSSDDSHPSLFSSSDESRSVTRSSSSDDSHPSLFSSS

SEQ ID NO: 131934 - protein, 96 aa, Heterodera glycines
  Coding regions on vcDNA: vcDNA=SeqID_58357; Strand=-; Position=1 -91,464-663
MAFGESICWAMAKRKKARIGRGTERPMAVQGTSAPWNSATKQRTSGNSHAHASLSSLRSTYGSMAMDDETAAAMDMPNHTGRSHSRDRRGEEAGSE

SEQ ID NO: 131935 - protein, 77 aa, Heterodera glycines
  Coding regions on vcDNA: vcDNA=SeqID_58358; Strand=-; Position=1 -99,518-652
MCHCLAYIAVIDSVVEPKALQIGTNGYNLVNVEVQRPYLKKRVHVGVCFSPLFYMEHWQLVVLAKERERLATIELGE

SEQ ID NO: 131936 - protein, 34 aa, Heterodera glycines
  Coding regions on vcDNA: vcDNA=SeqID_58359; Strand=-; Position=1-102
MAPGHLDSGHLDSGHFDSGHLDNEVIWTEPDNWT

SEQ ID NO: 131937 - protein, 18 aa, Heterodera glycines
  Coding regions on vcDNA: vcDNA=SeqID_58360; Strand=+; Position=1-56
PYRDRDLSFSKPGTGNRD

SEQ ID NO: 131938 - protein, 89 aa, Heterodera glycines
  Coding regions on vcDNA: vcDNA=SeqID_58361; Strand=-; Position=1 -103,545-711
MACNICFDDIKIDQLCFCEDPSCKTDKPDNDRTEDTLKKRLTKDKTSIKSINGLMNLSERCIAKFGGGHIERSNLLFLKIFVKIEFSKL

SEQ ID NO: 131939 - protein, 157 aa, Heterodera glycines
  Coding regions on vcDNA: vcDNA=SeqID_58362; Strand=-; Position=1 -20,137-588
  Homolog annotation: Hit_ID=CAE75515.1; Match level="QueryCoverage =98%, HitCoverage=43%, E-value=1e-30, Identity=50%"; Hit description =Hypothetical protein CBG23530 [Caenorhabditis briggsae]
MIGSTARVAPNAFRNRRGCGGGGGGGCGGGCGAPPPSGGGAIKLTLGCEGPPPQAPAPCGCGGGCGGGCGGGYGGGCGAPPPSGGGAIKLTLGCEGPPPQAPAPCGCGSGCGCGCGGGCGAPPPSGGGAIKLTLGCEGPPPQAPAPCGCGGGCGGGC

SEQ ID NO: 131940 - protein, 733 aa, Heterodera glycines
  Coding regions on vcDNA: vcDNA=SeqID_58363; Strand=-; Position=1 -1335,1578-2202,2290-2528
  Homolog annotation: Hit_ID=CAE56152.1; Match level="QueryCoverage =26%, HitCoverage=24%, E-value=6e-19, Identity=28%"; Hit description =Hypothetical protein CBG23765 [Caenorhabditis briggsae]
MIVLDSGRQATMYEGLDLFLDQMRRDNNKEEEEDEAALAIGEEAARNQRNWSSNPRCHYCDRAGHFAYNCHQRRANFRGNSNQSFRQGRWSNQQPRQSQGQWQNRQNPVNVMDATSSSNASPGIFENLAQSLLDLKIQDNRNYKNEEPRSGAMNALTHIKPETTAMDCQVENELAKGSSSESPACGPETKINIPKTSNWERPSVRSKLASLMFITLMLVGMTLPFTTGNMPHLPMHPLVCQTQNGGKIWQLPAVTGCSKLSIDHSKAPVVRTFDVFSPNLFEHSADAWACRKVRKSVRKYNSITNVPIQETLEPLLLQITPSECKEMAENGKCSLGLLINDSGLLHTDKKLDLSPRMWLIGSFSWSTVSTENCYLFKTKIMSQHGSTVMQSPLGSVNNCQFKAGQCEMEDKTLLMWDTNTTRACDFSKIVTWKGLQLDNIWISEETIKSICDYMLETRRWAATALLSDPTTFARKLFQSGKLVAKVAGPELIKVWPCIELQAHDYEFAKIGNSVDSEFECFDKIPIKFRVKDNKRMAFIDPRTMILSSDARLAPCSEYRKQLIFVRGSLYEVDQIDAQVKQVNANRIDGFSLNLSLAPTYARHSFLHLALVNVSDFIGQFYDANFARESELTFQLKSEDTVITKTLSEQWEQVNFLIRFGLMIRDEYVGRGTTRRMTFGGNKTQKIVKSPAHLNMMDLNASVEFGNEIELSPVKLIEPAQTQTHKIAGKRKRP

SEQ ID NO: 131941 - protein, 32 aa, Heterodera glycines
  Coding regions on vcDNA: vcDNA=SeqID_58364; Strand=+; Position=1 -48,481-531
MGLQKLLKQLFKVVYSYFYLFATYNKVLIPLL

SEQ ID NO: 131942 - protein, 95 aa, Heterodera glycines; identical to SEQ ID NO: 125597
  Coding regions on vcDNA: vcDNA=SeqID_58365; Strand=-; Position=1-660

SEQ ID NO: 131943 - protein, 71 aa, Heterodera glycines
  Coding regions on vcDNA: vcDNA=SeqID_58366; Strand=-; Position=1 -78,219-356
MGSRKVGMTMVGENNERWQMDDEQRKPKALSNVDEKRMVSLIESTKSANIGRKERARTMPTKSVSFWDDKI

SEQ ID NO: 131944 - protein, 36 aa, Heterodera glycines
  Coding regions on vcDNA: vcDNA=SeqID_58367; Strand=-; Position=1 -78,375-407
MAVPPAGLGPGTAGAAVMEWLRKKTMDQEFALQVFS

SEQ ID NO: 131945 - protein, 127 aa, Heterodera glycines
  Coding regions on vcDNA: vcDNA=SeqID_58368; Strand=-; Position=1 -243,456-596
  Homolog annotation: Hit_ID=CAE66975.1; Match level="QueryCoverage =75%, HitCoverage=18%, E-value=7e-28, Identity=60%"; Hit description =Hypothetical protein CBG12371 [Caenorhabditis briggsae]
ARTPPPPPWDLPCFPPSISLKLPLPSICKLRPLIVQFCANDPQTLLSACRLVEGKCDGVDLNLGCPQLIAKKGRYGAFLQESPELIESMISAVHRHCHLPISAKIRVLHNLSSTIEYARRIEAAGAR

SEQ ID NO: 131946 - protein, 267 aa, Heterodera glycines
  Coding regions on vcDNA: vcDNA=SeqID_58369; Strand=+; Position=1-801
  Homolog annotation: Hit_ID=AAA93301.1; Match level="QueryCoverage =68%, HitCoverage=49%, E-value=9e-25, Identity=33%"; Hit description =HASI
MDGSTSTTKRTQTEIDTNRPSARIKAKITKTQRNETGEIQGARRIDASVSNEGSQAEVDGPANSRNGNPNQKPASQATKMEKSIENVLERLYNDPKSPAAFAGVDRLWLEAKKELGNKIRKNDVKHYLEGHRTYTLMRPRRVNFLRARTTAAGFMTDCQVDLADFQSLSRHNSGNRYLMVVIDVLSKRIFVTPLRTKKSDDMVEGFKRVFSTMPMKPHRIFSDKGTEFRNQQLKKLFDEEEVEKYESTHSEKKAALAERAIRQIRNR

SEQ ID NO: 131947 - protein, 40 aa, Heterodera glycines
  Coding regions on vcDNA: vcDNA=SeqID_58370; Strand=-; Position=1 -38,105-189
MCEFFAYIALNKILSVVEEHRIEELVNETNKSVLDVNEQS

SEQ ID NO: 131948 - protein, 731 aa, Heterodera glycines
  Coding regions on vcDNA: vcDNA=SeqID_58371; Strand=+; Position=1 -2139,2991-3047
  Homolog annotation: Hit_ID=NP_498959.1; Match level="QueryCoverage =45%, HitCoverage=15%, E-value=2e-45, Identity=32%"; Hit description =zn-finger, CCHC type and RNA-directed DNA polymerase  and Integrase, catalytic domain containing protein
MRADCVNAVLKCRICAHTRNPRANAPELRPVITAEPFELICMDILSIGMSERGNRYVLVMVDHFTKYLITAAIPDKSVESVAKAFVEQLVLVFGKPKRIHSDKGAEFVNKTMEEISQILGVEKSTTAGYDPNANGQAERANQTILNMLKRSTDSNWSWDDRLPFVTFAFNITPSETTGFSPYNLLFGRPVNFPSSDNVNFTVNPSYTIDEESYLQLFRENLLKILENAKNNSDKSRERMEKWFNSQPKVTLQKYQKGERVMVIFPGANKRSTHKKLKWNIFGPYQILEISKSSAKVTPADKKNADPICVPLERLIRAPDGLPNISTTPRGKNAYKNVLNVMTILIFEEKSMEFEQENFLGKTKTSSGTMNFSEEEEKMDIAEAEIKWTMTCEGGGHVLCKKLLAGDLDPVLSKTQGIGAMVVQTPLQGLITLFILRSNVSMSASKDLLKVANQLEKLGGIAKLQAILTSDPDFELLKYVEERGDAVRSGRCPGIEEVEIIWKNWVSSCASAHEALKRTGFGQICLEAPISLSELPEADRIGWEKVFNAGTWALEKVRATVVFGKTTLVHQPRVIIGDSSAAQLCGEANNQIVAHFIGTVQGTLGDVIRALDKSVLTSKVTSALIILGRDALIKGQTVAQIMEECERIKSICGQFEHVRFVWIPPPYVREKHAQYNELIPGLERIAAEWFIALTENGRSLIEMWRFGDTFDMTRLLNMKYVHSLQITMNTEF

SEQ ID NO: 131949 - protein, 106 aa, Heterodera glycines
  Coding regions on vcDNA: vcDNA=SeqID_58372; Strand=+; Position=1 -31,917-1206
MLFDALNISIGLDIKGVGNGKHICIYTLLEGDSPLDLFTKDGKRLCGEDYSEIEEEKELMEQKNDEMGGTSKKNEKGEEEAESKKGKNAKIGETNGKEKKKTDTTA

SEQ ID NO: 131950 - protein, 77 aa, Heterodera glycines
  Coding regions on vcDNA: vcDNA=SeqID_58373; Strand=+; Position=1-234
  Homolog annotation: Hit_ID=EAL48648.1; Match level="QueryCoverage =98%, HitCoverage=20%, E-value=3e-12, Identity=41%"; Hit description =hypothetical protein 64.t00001 [Entamoeba histolytica HM-1:IMSS]
MKRRNRRGEREGEAEERRRERKEKEEGEDKKEERKRKEQEEERREEEKEWRGKEEGEDKKEERKINEQEEERRKRKE

SEQ ID NO: 131951 - protein, 148 aa, Heterodera glycines
  Coding regions on vcDNA: vcDNA=SeqID_58374; Strand=-; Position=1 -92,138-263,319-407,462-602
  Homolog annotation: Hit_ID=NP_503512.1; Match level="QueryCoverage =97%, HitCoverage=23%, E-value=1e-44, Identity=57%"; Hit description =GLYcosylation related (68.1 kD) (gly-7) [Caenorhabditis elegans] gb|AAF60620.1| Glycosylation related pro
YLERIAYDVVVSYPFLPPNDVWGEAKNPATGKCIDTMGQAVPGTMGATPCHGYGGNQLIKLNTEGQMTQGEWCIRPTDGWGGRLRTGHCTKGTVDGPFKYDRETKQIRNKQSGKCLVVEKDPSSSVLTFSECDASNELQKWQWAEKFA

SEQ ID NO: 131952 - protein, 224 aa, Heterodera glycines
  Coding regions on vcDNA: vcDNA=SeqID_58375; Strand=+; Position=1 -292,1250-1632
MLGIFFLFALFAFSDGVLKAQKCEDCSNLNRFWTNLCKNAVPMFKNAVNGVQKFVCRLSQLDELLDIILQVDFEKSVRNRASFFVNTYFSWILHGLNNPLGDEQQYDTVHCSVIESANYLEHRFGIHLVELWHNPTEFGEINSKIVPLINLARNHLIGDGQKQQQQKKKKRTEDSGKERKKEGGRKDEQKRTVPTEEGTNSTGTNGILDNWSNLAGRKGLRNKN

SEQ ID NO: 131953 - protein, 203 aa, Heterodera glycines
  Coding regions on vcDNA: vcDNA=SeqID_58376; Strand=-; Position=1 -180,426-857
MYELLRQAWPTFSPTSFAIDFETAARNRTVNAFPGCAINFCFFHFVRNLQKKIKEQSLWQVAQQLQPRPNGTWSQPLFPPEQWNVYTRTLNGEARTNNYAEAEHHSLQGAFNCRHPSIWHFIDVLRREQKGTDGKYASFIAGLEPPQKAKKYQVADERIFNLVQNYNPVNPNYDNDHNYHINQNHHIILEFLRGISRNYHMNP

SEQ ID NO: 131954 - protein, 173 aa, Heterodera glycines
  Coding regions on vcDNA: vcDNA=SeqID_58377; Strand=+; Position=1 -72,123-276,731-869,1825-1981
  Homolog annotation: Hit_ID=CAE63319.1; Match level="QueryCoverage =35%, HitCoverage=9%, E-value=3e-16, Identity=59%"; Hit description =Hypothetical protein CBG07710 [Caenorhabditis briggsae]
MTVGGVPEAIKDHCERICLLAIGMIWEARSVIDPISKKGLKVRCGLHSGNIVAGVVGVRMPRSGGNPAHLSGREIDESTNSIDGYEELTAQMELKGTKQGEGVAKMIEGLFDDRRMDRRSTTNGKPQKFVSTHVVAMEARRTQTLARHRVTAGTVLTMARLGTLQAELTRRAF

SEQ ID NO: 131955 - protein, 724 aa, Heterodera glycines
  Coding regions on vcDNA: vcDNA=SeqID_58378; Strand=-; Position=1 -225,280-397,453-592,638-739,784-813,876-1001,1090-1171,1221 -1292,1362-1559,1647-1807,1859-1967,2011-2137,2168-2232,2291 -2428,2478-2536
  Homolog annotation: Hit_ID=NP_502737.1; Match level="QueryCoverage =96%, HitCoverage=93%, E-value=0.0, Identity=31%"; Hit description =MEGF6 (4P83) [Caenorhabditis elegans] emb|CAB60454.1| Hypothetical protein Y64G10A.7 [Caenorhabditis elegan
CPCEWSRISTLKPTQSDALNSFLLLLPLSIFECPLGLFGPNCLSHCLCANGGQCDASRGVCRCAAGWAGESCEFLCPFCPFGLFGLNCSEKCECSNGANCNRTDGKCQCLPGWQGKRCDQPCPCDQPCPEGTFGLNCSEQCQCQNGAKCHHISGHCQCSAGWRGRKCSRACSKGFFGQNCAQICQCPSKGSCDHACSKGFFGQNCAQICQCPSKGSCDHISGQCECPKGLTGSACSEVCLTGSACSEVCPPGTPPGTFGVGSSQKCTCGPNEQCDPETGKCFCKAGQMGKNCEIGCPTGKFGVGCEECQCENGAQCHSETGECACPPGFLGCACPPGFLGTRCEVPCPANRYGPSCACANLCDCQNGARCDPRSGECRCAPGFTGPHCTQMCRAGRFGQNCKEKCQCEDPTNCDPKTGQCKCGSGWIGPTSGWIGPTCQQQCPQGKYGFNCSMECDCHGSAGCDPTSGCCHCPKGRYGFRCQFECPPGQFGLQCAESCHCCPPGQFGLQCAESCHCQNGASCDPVTGQCLCPPGFQLKIIKRNANYTFLNILPKCEQLCPLLKIIKRNANYTFLNILPKCEQLCPLGSFGAHCLLRCECGHLPCDSVSGACDCPPGCDSVSGACDCPPGRIGRNCEEVCPEGFFGKECQRCPEGFFGKECQRQCECYNGARCDAENGKCQCTPGYLGATCQNELKDPDRVAKRGDPDRVAKRGDLPDYERRKRR

SEQ ID NO: 131956 - protein, 97 aa, Heterodera glycines
  Coding regions on vcDNA: vcDNA=SeqID_58379; Strand=-; Position=1 -162,647-778
MTRIAQTSTSAARAAPIANSHAKMPTADFVACAPRECNWPRTDEAANRRRTCQMLVIMAASACRANSLANIAKMAADATGRRAVAYVRRDGMVSLKQ

SEQ ID NO: 131957 - protein, 88 aa, Heterodera glycines; identical to SEQ ID NO: 124691
  Coding regions on vcDNA: vcDNA=SeqID_58380; Strand=+; Position=1 -96,135-305

SEQ ID NO: 131958 - protein, 70 aa, Heterodera glycines
  Coding regions on vcDNA: vcDNA=SeqID_58381; Strand=-; Position=1 -183,242-271
MCTRSIGTGGGIECAENGDAAIAPRTKRRQQTDDDEVPQGTVTRRTTGDRIRDRDGFRRRARRRIFLIVK

SEQ ID NO: 131959 - protein, 105 aa, Heterodera glycines
  Coding regions on vcDNA: vcDNA=SeqID_58382; Strand=+; Position=1 -191,236-364
ELILDGACKDPPIAIVEPNTANVHSIEALEDGAAFFDLLVPGYNDSRSCNYYTLSDDKVYCNAVNGKIGIGDFVWLEGSEEVPREFTMQQLRFDPFLMSNTNRFD

SEQ ID NO: 131960 - protein, 86 aa, Heterodera glycines
  Coding regions on vcDNA: vcDNA=SeqID_58383; Strand=+; Position=1 -175,225-312
KCYEHKDTVVPMIGREVPKLGGGGTADDVRCQSAAIDSGDQQQQHLGDRIALDGTSIGFPVKMLAPLLVAKGSNGNGTPFEIKVLF

SEQ ID NO: 131961 - protein, 129 aa, Heterodera glycines
  Coding regions on vcDNA: vcDNA=SeqID_58384; Strand=+; Position=1 -105,423-707
MSKKARHCRCRKRRRRRHHYGAHFARYFRADGKRLLERSEFDEENEISPFNRQQQLAPEALASVARPCHNTSLRVRHALADARALECAGMSHKRAEVWVSVHAFKRMMRKAEKNLKVKKEEKNAKQFAK

SEQ ID NO: 131962 - protein, 632 aa, Heterodera glycines
  Coding regions on vcDNA: vcDNA=SeqID_58385; Strand=-; Position=1-1899
  Homolog annotation: Hit_ID=NP_502799.1; Match level="QueryCoverage =71%, HitCoverage=64%, E-value=1e-14, Identity=21%"; Hit description =putative nuclear protein, with 2 coiled coil-4 domains (4P607) [Caenorhabditis elegans] emb|CAB16521.1| H
MDDFYIVIPSNTPGPGNTASNFTVRLPHTLELDSKWSVALSAIIYPYSFPSISVDEDDSISVKLVNPNYREDAGNSDVESQKFINLSVKIPNVQFQSVQSLQKTLNQIIQNAYDKKFGGSSLNDGTPTKRAKRQTELSESGAGVIEVENFFTRNPFDYWQQIGELRKKHYQLRERVEKMTKEYNSTADDERKTLLSTELGVFQGRETFLKEHLHLIEEEAKRRDGEQQEANEQRLIDRFFARYPDNYREQLDEWRSSYLRDVLDLQTKMGEYEGVKDLKKLEELNSQTERMRNSIHVFGRKMEILNNAALQRDQKKSQEDFERLSHEQNLTFVQEFFQANPVNYWQAIQKNYEALQLEYTKKRELREKLEFETDATERDSLQRQIESIQRLIDYRRKRFAALEYEAKKRDAQTGKANSGLSAVAEGSNRTSSTRTDSFSPDEPSNPDEAINSKNNHQNTTTTATAILSSETPAEQNLADQDNSIADKNELGTPPLSGLEQSGDAATSVTQAEDGGNLPQAAALSSNNPKFVVKQSTVATERRKEKIIEKLIDEQVDRMVDGTHAQQKMLQEEGKDNDSQHRISTYKLIEEVLHGEHGQLMVQQRESKMAAEFAYNEITQRFGIRMGPRSNAR

SEQ ID NO: 131963 - protein, 95 aa, Heterodera glycines
  Coding regions on vcDNA: vcDNA=SeqID_58386; Strand=-; Position=1 -11,80-356
MNRRWICNDVWMDIFPSFDRPQLGLKLALLSPRFNALVDKHFNGKSELTIWRPIEISKDKGPEPKLFVWFDYKCVPFPLPDRPLPSKILFKSLEI

SEQ ID NO: 131964 - protein, 129 aa, Heterodera glycines
  Coding regions on vcDNA: vcDNA=SeqID_58387; Strand=+; Position=1-390
  Homolog annotation: Hit_ID=NP_113997.1; Match level="QueryCoverage =95%, HitCoverage=15%, E-value=2e-15, Identity=38%"; Hit description =cyclic nucleotide-gated channel beta subunit 1 [Rattus norvegicus] emb|CAA04133.1| cyclic nucleotide-gate
MKIALGKEERRKRKRGKGKIRRKKEGEKEEEKDENSIGEGGETEEKERKRKNSKQEGGEKEEEKDENSIGEGGETEEKERKRKNSKQEGGEKEEEKDENSSGEGGETEEKERKRKNSKQEGGGERGGKG

SEQ ID NO: 131965 - protein, 45 aa, Heterodera glycines
  Coding regions on vcDNA: vcDNA=SeqID_58388; Strand=-; Position=1 -34,66-169
MELNLRHSPMKFPTKTLAAVNETLLRNALKLATNFEYCYAKFVDI

SEQ ID NO: 131966 - protein, 73 aa, Heterodera glycines
  Coding regions on vcDNA: vcDNA=SeqID_58389; Strand=+; Position=1 -121,745-845
MSQNSASPASMPCTSWKWRKKRGRHSSEAALPMAMWRSNGKFPRTTRIFVIPVIKWHYNDKMSDSHAFLAMIE

SEQ ID NO: 131967 - protein, 99 aa, Heterodera glycines
  Coding regions on vcDNA: vcDNA=SeqID_58390; Strand=+; Position=1-297
MAPGDNGIIYDVPMVGVSVGLSRTGSNGGIVFFEVVLADPFYTNSSKGTTFVTAGGGYLDIHATDSLKNAYGAAKVIMREQRNNYLDKAHLHLNVVAAA

SEQ ID NO: 131968 - protein, 60 aa, Heterodera glycines
  Coding regions on vcDNA: vcDNA=SeqID_58391; Strand=+; Position=1 -130,310-362
MCSIAFTLSVGSLLNIPPTISHKHSGPILGSKYNYAGFFVLVVSYNLVNTRTNKIILCSF

SEQ ID NO: 131969 - protein, 48 aa, Heterodera glycines
  Coding regions on vcDNA: vcDNA=SeqID_58392; Strand=+; Position=1 -41,98-203
MLEPKREGPTDGVRLDKELLFPSPGLCHFKIKVSDLILLGIFKKTLLE

SEQ ID NO: 131970 - protein, 95 aa, Heterodera glycines; identical to SEQ ID NO: 130684
  Coding regions on vcDNA: vcDNA=SeqID_58393; Strand=+; Position=1-676

SEQ ID NO: 131971 - protein, 215 aa, Heterodera glycines
  Coding regions on vcDNA: vcDNA=SeqID_58394; Strand=+; Position=1-648
MHMTKLCMKTAMGEKTIEPEITTRVLREMAHVEFTDLYDSDFEATQLQPTQTESLQPLVLIGTDYFADFDIKTEKRLPSGFWVANSKVGRLIFGKGNLSKPKMAKKVTSTAISQEAVEVQLQNDDDGLNSMVKQFFDLEAAGMADAAHPTENEQWLDHFNKELHFNMEEKRYEVALPWNNRAEELQPNYGLARGRLDNNLKKLDKEKFQLYDQII

SEQ ID NO: 131972 - protein, 156 aa, Heterodera glycines
  Coding regions on vcDNA: vcDNA=SeqID_58395; Strand=-; Position=1-469
MARTALSGSATRQRSITDNSNSNCFAVDAAILGTEQQCSARQRMNASAMAKISLQKQCFPPECCYTQCSTDAPQKCHDDNDAQKAVDAVHLRSLNCFFSSFCPPFRHFLPPKVLLRLCLLFLFAVGGCPIVPGGVSATARSRRTLVPLGMDKQMFP

SEQ ID NO: 131973 - protein, 52 aa, Heterodera glycines
  Coding regions on vcDNA: vcDNA=SeqID_58396; Strand=-; Position=1 -40,93-211
MSNSVCMVAKVRMGLMATSGRRKSGSKHRNIVGLRGSELIIFEKSRSHTIGI

SEQ ID NO: 131974 - protein, 188 aa, Heterodera glycines
  Coding regions on vcDNA: vcDNA=SeqID_58397; Strand=+; Position=1-567
  Homolog annotation: Hit_ID=AAO52058.2; Match level="QueryCoverage =90%, HitCoverage=28%, E-value=5e-10, Identity=26%"; Hit description =similar to Dictyostelium discoideum (Slime mold). Homeobox -containing protein (Fragment)
MDNFIKKSEGVCMNNQFQHEDKIPKQHQQQQQQDQQHQTDVIEHDHCYARPTNQLWKLKRQKYMLTFKLCKMCAQELYNRKDDITECNDGGVDLNFHLCKHCTMLNMRLSDMNSVQFMAYHPRNNNYNNTNNSNKNRNNKNNDNDENDSQNNFWYDNYGPTYCRGGPRNNYMQGKRKCLERIDMDDMN

SEQ ID NO: 131975 - protein, 46 aa, Heterodera glycines; identical to SEQ ID NO: 124738
  Coding regions on vcDNA: vcDNA=SeqID_58398; Strand=-; Position=1 -62,474-552

SEQ ID NO: 131976 - protein, 37 aa, Heterodera glycines
  Coding regions on vcDNA: vcDNA=SeqID_58399; Strand=+; Position=1 -35,250-328
MCRKVLAEREIADIVNYAELLKKKLKQKMGRKLKEFG

SEQ ID NO: 131977 - protein, 173 aa, Heterodera glycines
  Coding regions on vcDNA: vcDNA=SeqID_58400; Strand=+; Position=1-522
MKLHLLFVLFIFLITQINQIGTEKKKLEQKSFDEIFGEKWEEKEEEKRNELKKREIIGKFYKIKEKIKQKGRKFSKKEWNKIEIKIAKKLGTNCQYIYKWIKEFGLYKYKSKTNEEKFKIVQEFIELTNDYKQKRKYSPKEWQQNYAEICKKIGVNRDIIYKWKKQFGIRVKE

SEQ ID NO: 131978 - protein, 32 aa, Heterodera glycines
  Coding regions on vcDNA: vcDNA=SeqID_58401; Strand=+; Position=1-96
HLVMELHTCTCGVVVKLSTFHNFSPGFNSPLG

SEQ ID NO: 131979 - protein, 229 aa, Heterodera glycines
  Coding regions on vcDNA: vcDNA=SeqID_58402; Strand=+; Position=1-690
MKFCILLFLFLIALIIPIESANEKLQQKSFGEIFGEKWQEKEEEERNELKKREIIGKYYKIKEKIKQKGRKCTAKEWNKINAKIAKKLGTNQTYIQKWIKELGLNQRMQKSYKSKTDEQKIEIVQKFIAMKNEFKQKRKYSRKEWQQNHKEICKEIGVNERTINRWKKQFGISKKRITEEEKIEKMKIYSQIKRENAKMSDNEIAKIVNTSNANNCNWKKQFGEEMFEN

SEQ ID NO: 131980 - protein, 72 aa, Heterodera glycines
  Coding regions on vcDNA: vcDNA=SeqID_58403; Strand=-; Position=1-219
MPTNQPMSRWSDDRFGTKCHHNCCQKRWTEAAIRAAAVVGADIVGTFAGIAAVGALAEQSYRHSKKQNKLKN

SEQ ID NO: 131981 - protein, 89 aa, Heterodera glycines
  Coding regions on vcDNA: vcDNA=SeqID_58404; Strand=+; Position=1 -93,238-411
MRSFNSKSHQYDSSKNFQELLSPRLFQRRQQNGGTIVQRVLQQQQFQQMFQQYQLQQQQQRESPPPSTVFGNSCDGTLCQSDRLTSDSS

SEQ ID NO: 131982 - protein, 291 aa, Heterodera glycines
  Coding regions on vcDNA: vcDNA=SeqID_58405; Strand=+; Position=1 -176,232-507,559-979
  Homolog annotation: Hit_ID=AAL78214.1; Match level="QueryCoverage =47%, HitCoverage=73%, E-value=1e-11, Identity=30%"; Hit description =putative esophageal gland cell protein Hgg-20 [Heterodera glycines]
MFMICCAILLKYWDRFKKPPKQQRGHRKIEKVPETVITICLDEIPDNQNEAEEKMAKAIFISADCWLGVFDLLPTSQLGLGIAMISHRFDYYVDEHFKTRKWTLKFIRIRYKIEENGTKQMEIVNYDWKPMPIPQNQLPRKVIGFERIIITFIDRNVIAFLRHFRSLFASFCPISLAISTTNERISEFIFHIWPMLGKNCRVMELPAPIFRRLRHFVPSILKDCISLRVINTYSYGFFTEFPADDSATATDGQAVAKWLFTPRPDNVPKVFKCYLDKDDANLTSKVEAFKT

SEQ ID NO: 131983 - protein, 33 aa, Heterodera glycines
  Coding regions on vcDNA: vcDNA=SeqID_58406; Strand=+; Position=1-100
MVSPPSGSSALFPVGTAVCAAAIRADFIAATVC

SEQ ID NO: 131984 - protein, 18 aa, Heterodera glycines
  Coding regions on vcDNA: vcDNA=SeqID_58407; Strand=+; Position=1-56
YREAIPEGFGLPINLGAS

SEQ ID NO: 131985 - protein, 244 aa, Heterodera glycines
  misc_feature (7)..(7): Xaa can be any naturally occurring amino acid
  misc_feature (162)..(162): Xaa can be any naturally occurring amino acid
  misc_feature (184)..(184): Xaa can be any naturally occurring amino acid
  Coding regions on vcDNA: vcDNA=SeqID_58408; Strand=+; Position=1 -51,933-1627
  Homolog annotation: Hit_ID=XP_320889.1; Match level="QueryCoverage =98%, HitCoverage=36%, E-value=3e-41, Identity=35%"; Hit description =ENSANGP00000012033 [Anopheles gambiae] ref|XP_313651.1| ENSANGP00000013044 [Anopheles gambiae] ref|XP_314
AKGCETXKWSCPRLRPRALQADFSDVFGPGLGRCTKKAHLILKPDAHPTCKARPVPHGALNAVNEELDRLLQIGAIKRIEFSHWAAPILAVMKKNGKTRVSIGFSTGLNNLLELNHLLPRPEDIYTAISCYVYFSNLDLDAYIVTGIPGTFAYLDDGIIASXKLEEHISLLYKLFKQIQEFCLXIQLERCKFIQPGCFFSAHFISVKGTRPDPGRSEAIRQMPPPHDLSNLRTLGALNYYGRFI

SEQ ID NO: 131986 - protein, 316 aa, Heterodera glycines
  Coding regions on vcDNA: vcDNA=SeqID_58409; Strand=+; Position=1-948
  Homolog annotation: Hit_ID=CAE64509.1; Match level="QueryCoverage =99%, HitCoverage=76%, E-value=4e-63, Identity=39%"; Hit description =Hypothetical protein CBG09244 [Caenorhabditis briggsae]
MPRLKPRKTQKRRLKRMPRLKPRKTLKRRLKRMPRLKTRKTQKRRLKRRTRLKPSKEAEEKAKKDAEAKAKKDAEEKAKKDAEAKAKKDAEEKANAEAKAKKDAEEKAKKDAEAKAKKDAEEKAKKDAEAKAKKDAEAKKKDEEMKKQKAKPEEKPEAPAEAVAVVPEAMKAEETKEKLKQEEKPVEVPPSPAEKKRKEAEEKKAQKDAEAKAKKDAEEKAQKDAEAKAKKDAEEKAKKDAEAKAKKDAEEKAKKDAEAKAKKDAEAKKKEEEMKKQKAKPEEKPEAPAESVAVVPEAKKAEETKEKLKQEEKPVE

SEQ ID NO: 131987 - protein, 242 aa, Heterodera glycines
  Coding regions on vcDNA: vcDNA=SeqID_58410; Strand=+; Position=1 -105,205-279,487-678,785-864,911-952,1062-1230,1386-1448
  Homolog annotation: Hit_ID=NP_492485.1; Match level="QueryCoverage =100%, HitCoverage=35%, E-value=6e-98, Identity=76%"; Hit description= heat shock protein (70.4 kD) (hsp-70) [Caenorhabditis elegans] emb|CAB03871.1| Hypothetical protein C12C
DAGAIAGLNVLRIINEPTAAALAYGLDKKLTGDKNILIFDLGGGTFDVSILSIAEGSLFEVRSTAGDTHLGGEDFDALLVDHLKAEFKRKNGGRDIGANPRAIRRLRTAAERAKRTLSSSTEATIEVDSLFDGMDFHTKISRARFEELCMPLFRKTLEPVEQALKEMIANCCIFRDAKLDKRSINEIVMVGGSTRIPKVQKLLKEFFNDRELNLSINPDEAVAYGAAVQAAILSGVKDETTK

SEQ ID NO: 131988 - protein, 215 aa, Heterodera glycines
  Coding regions on vcDNA: vcDNA=SeqID_58411; Strand=-; Position=1 -208,383-487,982-1316
MSKITIDYASNNIKVFNSFADASIQNSIMHGLKKEIDEAIKSLAFHWQISLNEIVPNKKEPKELLKELKTEEKQHESHYEKRLLKLMADYSVCLNGFDKPKSGKKRRRRRDDGSGWSKKTIFGLLLGALFVIFLIFVLAKMNHCLCDPRGDDNDHKGHDNSDSDGDQSRDIEIGSPSAGEHRPAAARHGGAGANSGSESDHSVEQVFNGSQKMRQ

SEQ ID NO: 131989 - protein, 139 aa, Heterodera glycines
  Coding regions on vcDNA: vcDNA=SeqID_58412; Strand=-; Position=1 -162,213-467
  Homolog annotation: Hit_ID=AAC47437.1; Match level="QueryCoverage =98%, HitCoverage=48%, E-value=5e-55, Identity=70%"; Hit description =COL-1
MDFDGRIKAYRFVAYSTVSFSIISLLSVCFTLPMLKSYVSNVGLKMDSELSSCQSNAKDIWSEVSQLKGLPLIVSGNRTARQVYGGSGGYGSCQDCCSGGGPGPAGPPGQPGRPGNPGAPGSPGQPGHSVQTPCEAVHP

SEQ ID NO: 131990 - protein, 418 aa, Heterodera glycines
  Coding regions on vcDNA: vcDNA=SeqID_58413; Strand=-; Position=1-1270
  Homolog annotation: Hit_ID=NP_508646.1; Match level="QueryCoverage =97%, HitCoverage=20%, E-value=6e-49, Identity=32%"; Hit description =predicted CDS, RNA-directed DNA polymerase  and Integrase, catalytic domain containing protein family mem
FRIAFSRLFHISTKISRGTQYFNGCNEILQDYLNRGIIRKYPDKCPHFLPHHTVVGKRLRIVFDASSHERDSRSLNDTLFAGPNLQDLAGKLIQFRATIYPVWADIEKAFLMISLKESDREFSKFLRTRDPNSPLSGNNLVIYRFRRITFGIVSCPFLLAATLQHHLETTPGTLAKEIQQHSLLYVDNLLLLAECPEEAREKAIEAQKIFSSAKMRLRDFVAADSRILSVVPSEDHLSETEPLVLGQKWILSSDTLFFSFPIVPSPEKLTRRIILKTIASFFDPLGLCSPCLVGAKLFFQSMWEKSRGWDEPIPDKEQIPWQELRNDWHGQTITIPRHTFRTKNSTLQLHVFSDASPNAFARATDGNFSSSLVYSISSKPRKMGKDQPDGLTIPRLDLLGVLLGVRAAKFVKTHFSYE

SEQ ID NO: 131991 - protein, 202 aa, Heterodera glycines
  Coding regions on vcDNA: vcDNA=SeqID_58414; Strand=+; Position=1 -114,870-1151,1198-1229,1276-1320,1413-1546
  Homolog annotation: Hit_ID=NP_506018.1; Match level="QueryCoverage =87%, HitCoverage=20%, E-value=2e-36, Identity=46%"; Hit description =aspartyl(D) tRNA Synthetase (89.0 kD) (drs-2C) [Caenorhabditis elegans] emb|CAB04078.1| Hypothetical prot
MALPDGWPCSGPLLDLAEKFAQRLLPAFSTNTGMPYGTTLVGRVEDAVRIMASYGQILRHLGVPPEFYNLPNREPVKSFVFISIGCIYSPLPPKVIGRAAYPLRPEIPESLLYLHRATNDPAYLTMAASIVDTIDQIAKTNCGFGTVRDVGTGSVEDRMESFFLAETAKYLYLIFDEHNFMHSVGSAKAKLVETTGGPCVIE

SEQ ID NO: 131992 - protein, 381 aa, Heterodera glycines
  Coding regions on vcDNA: vcDNA=SeqID_58415; Strand=+; Position=1-1148
  Homolog annotation: Hit_ID=XP_320889.1; Match level="QueryCoverage =89%, HitCoverage=41%, E-value=7e-48, Identity=32%"; Hit description =ENSANGP00000012033 [Anopheles gambiae] ref|XP_313651.1| ENSANGP00000013044 [Anopheles gambiae] ref|XP_314
SALSLLSTPASTNAIRTRPQQWRESKTKAKSANAVQQNHPAQQKPATGGKAIRGQPTQPCGSCVGTDHWRSDFRFREATCHTCQKQGHIANVCRKGAFTTKNQRRSFHTVQVKATCLQIGTTQGRWWKILVEINGTKIEMNVDTGAQTTVLTIEKWTKLGQPKLLPTDIENRNCNDVTFNTIGKFTCLDSIKGQPTKKLTAYVTEELNYDLFGLPWIEATEMIPKEIMFPETHTSVGIRASSAAPFQEIADVKSLTTALKENFPDVFGKELRQCTKIKAQLILKSDGRSVFCKARPLPHGSLEAVNTELDRLLQIGAINPIEFSHWAAPILAVKKKNGKIRVCIDFSTGLNNALELNRHPLPRPDDIYAAISGAAFSQIWT

SEQ ID NO: 131993 - protein, 228 aa, Heterodera glycines
  misc_feature (13)..(13): Xaa can be any naturally occurring amino acid
  Coding regions on vcDNA: vcDNA=SeqID_58416; Strand=+; Position=1 -147,199-275,323-527,594-746
  Homolog annotation: Hit_ID=NP_356643.1; Match level="QueryCoverage =92%, HitCoverage=51%, E-value=3e-52, Identity=52%"; Hit description =hypothetical protein AGR_L_1708 [Agrobacterium tumefaciens str. C58] ref|NP_534483.1| biotin synthetase [
IKAQLNPENLCPXKGLDFYNHNIDCSKDFYHKIITTRRFDERISTIEKVRSAGIKVCVRSAGIKVCCGGIIGMGENNEERVKMLVTLANFALVTLANFAPPPESVPINKLMPFPGTPLANAPAPDPFDFVRTIATARVLMPMAYIRLSAGREQMADELQALCFLAGANSLFFGEKLLALCFLAGANSLFFGEKLLTASNPMPEKDKELFQRLGLKREQIEEKKAERND

SEQ ID NO: 131994 - protein, 66 aa, Heterodera glycines
  Coding regions on vcDNA: vcDNA=SeqID_58417; Strand=+; Position=1 -161,289-325
MAVPTADDTPPKSSSDAFKRLASKRRKYRSKCSTKRCLTTLNSMTDDGRTNTQNTFGFEMTIFFDM

SEQ ID NO: 131995 - protein, 143 aa, Heterodera glycines
  Coding regions on vcDNA: vcDNA=SeqID_58418; Strand=-; Position=1 -87,313-453,987-1190
MLYVLFRSVMLVQKFTIDDPFAPSDVNLQSIIICNSLFRHLLGHVLIIDRFLATVRTNSYEKFSKFGFTLAWSSTTVSDNVKTAKQLSPTFLCLFLSNLFINFLYSAIAFNMVTENYQISLMRAFGIWADAVFGAAIELTMMT

SEQ ID NO: 131996 - protein, 829 aa, Heterodera glycines
  misc_feature (42)..(42): Xaa can be any naturally occurring amino acid
  Coding regions on vcDNA: vcDNA=SeqID_58419; Strand=-; Position=1-2505
  Homolog annotation: Hit_ID=NP_491240.1; Match level="QueryCoverage =99%, HitCoverage=71%, E-value=1e-165, Identity=36%"; Hit description= zn-finger, CCHC type and RNA-directed DNA polymerase  and Integrase, catalytic domain containing protein
VNDKPVSLVADTAARKTIIQLATWESLGNPKFKTGKTYGKLXTGHNFSLMGSFDCLVEFMGIKLSLECFVAPKGELNLFGLPWIRAFEYALNCPWPQPCRSFVLNQFLAITHSTDLANELKSKFPSVFSPELGHCTKMLAHLYLKSDSRPIFCRARPVPHGAVETVNAELDRLLTIGAIKPVDFSRWAAPIVAVKKKSGDIRVCIDFSTRLNECLELNRHPLPRPDDIFNAVRGTSVFSQIDFKDAYLQIVLDEESKQLVGLNTHRGLFQYQRLPFGIKSAPSIFQKLMDELTAGLQGMFVYLDDFIVATDTAENHHKILSKSFKRLHEWGLRVKLNKCKFLCNELKFLGHIITSDGIRPDPERSRTIKDMPAPTDDQTLRSFLGAINYYSRFVSQMREIRAPLDELLKKDVQWHWDEQQMAFEKAKQIINSDLLLTHYDPTRPIIVAADASNKGLGATISHTFDNGTEKVVEHASRALTSAERNYSQIEKEGLAIIFAVQKFHQRWALTLSNYDFNIKYISTKNFGQVDVLSRLISQHRESQQNEDKVIAQMDMEESSNSKWPSICSKQHLINCRSLPKRAIDLDIDRWVRNCEECALAAKAPPKVPLQPWPASTQVYERLHMDFAGPCADGNKYLVVVDSFSKWPEIIKMKSTTAHLLIEQFVWLFSRYGYPKEIVTDNGPPFKSHEIFTFCSSHGIQQTFAPPFHPQSNGRAERFVDTLKRQMKKCARDPHWVQNSLLAYRTTPNASLNGRTPAELFLGRPVRTVLSLIKPTQKQKQGPVLNEQNSKMAKQFNKHHGARNRNFSIGDIVQFINYRGPSKTWLRGTI

SEQ ID NO: 131997 - protein, 42 aa, Heterodera glycines
  Coding regions on vcDNA: vcDNA=SeqID_58420; Strand=-; Position=1 -122,190-196
MSENRRSHERNWRKREEMKKINDHRKRERKWKRNEREIKLCF

SEQ ID NO: 131998 - protein, 48 aa, Heterodera glycines
  Coding regions on vcDNA: vcDNA=SeqID_58421; Strand=-; Position=1 -52,281-372
MVEGKMEQLKAETEAVEEILQELFNSNLTKCNDEYKSQSMNKYLVECE

SEQ ID NO: 131999 - protein, 54 aa, Heterodera glycines
  Coding regions on vcDNA: vcDNA=SeqID_58422; Strand=-; Position=1-165
IEKRREAVRKRICPCFLRLKSAIDDQYNEKKKVVKREQNNNENNTTKNHRLMKP

SEQ ID NO: 132000 - protein, 255 aa, Heterodera glycines
  Coding regions on vcDNA: vcDNA=SeqID_58423; Strand=-; Position=1 -181,403-465,515-602,655-762,803-967
  Homolog annotation: Hit_ID=NP_506570.1; Match level="QueryCoverage =99%, HitCoverage=59%, E-value=1e-39, Identity=39%"; Hit description =DeHydrogenase, Short chain (37.2 kD) (dhs-22) [Caenorhabditis elegans] emb|CAB02732.1| Hypothetical prote
LYLTCIGLIVFIILFAIRQWIKGAQFREKVSARGAVAIVTGANSGIGKQLVRELNLRYVKVYMACRSVSQGQATARELFSRGCDMTRMIVRHCDLADFGCDMTRMIVRHCDLADFSSIHQFVKEFNRDEPKLDILINNEPKLDILINNAGIMFYPRFTKTVDGHELTWQSNFLGHFLLTELLLPKLERSEEGGRIQSNFLGHFLLTELLLPKLERSEEGGRIVNVSSSVHLRADSVDPEVVESPRRFGIIATYAR

SEQ ID NO: 132001 - protein, 160 aa, Heterodera glycines
  Coding regions on vcDNA: vcDNA=SeqID_58424; Strand=+; Position=1 -298,351-535
MELSEEMDNLGTNLEDKSDKLDQENENIKWENWKEIVGKLHFRKFGIAIVKGRIENWEKLGQKQKTLALSNIVEKREKILEEFERNLEQIEKAEKQRKLDKNIFCQYQSDTNLSEFIEKKDKINFSEKNSQLFPSEKWQEINSVKEFERTNLEEKEKVEI

SEQ ID NO: 132002 - protein, 20 aa, Heterodera glycines
  Coding regions on vcDNA: vcDNA=SeqID_58425; Strand=+; Position=1-61
MCKRKELRKKTYEEKEANGY

SEQ ID NO: 132003 - protein, 96 aa, Heterodera glycines
  Coding regions on vcDNA: vcDNA=SeqID_58426; Strand=+; Position=1 -11,86-365
MNRRWICNDVWMDIFPSFDRAQLGLKLALLSPRFDALVDKHFNGKSELTIWRTIAIHRKDKGTEPKLFVKMGYKFVEFPLPDRPLPNKIRFNHLRI

SEQ ID NO: 132004 - protein, 47 aa, Heterodera glycines
  Coding regions on vcDNA: vcDNA=SeqID_58427; Strand=-; Position=1-143
MPPSADGHRSFELTCGRCPTLRGSCLTSHAFGVLPYVGAVVYRSVLH

SEQ ID NO: 132005 - protein, 65 aa, Heterodera glycines
  Coding regions on vcDNA: vcDNA=SeqID_58428; Strand=+; Position=1 -109,500-588
MSSFGNDSQNTTSFSPNWSTADTNSTVITVAYFLVSDGAYLHRRTPLFLVFEKIAPKKAFLKSKK

SEQ ID NO: 132006 - protein, 63 aa, Heterodera glycines
  Coding regions on vcDNA: vcDNA=SeqID_58429; Strand=+; Position=1 -125,458-524
MMEFEVAPILRHHAVRISFKCAECGDTTFKTFDFNSRGRWGMFGRYGEHKSILDKKTFICHTK

SEQ ID NO: 132007 - protein, 165 aa, Heterodera glycines
  Coding regions on vcDNA: vcDNA=SeqID_58430; Strand=+; Position=1 -269,1005-1233
MWALLPLNFLLNQFGLCSVVKLNMIDTALCPCPLTNMKVQNVEHIEVIKDHEEEKLNECPRNCVVLSIRCKCNAEMRRTYELTKYGTRKNIGRPERERSVHSLKTGIGMELVKVEIIFATMPAKFDEIHFNQRHWARRFFYASKQFWKCFALRGIIPWASWSHRK

SEQ ID NO: 132008 - protein, 67 aa, Heterodera glycines
  Coding regions on vcDNA: vcDNA=SeqID_58431; Strand=+; Position=1 -172,316-347
MSVFGNKDEQLNFKTICIWQRNAAENGGQWWTNEGTFCWNQLKLKWQFKSEVAFLLIFLFFSLSITF

SEQ ID NO: 132009 - protein, 39 aa, Heterodera glycines
  Coding regions on vcDNA: vcDNA=SeqID_58432; Strand=-; Position=1-117
MSMCWAEPWNSAPIWPTLVQSFPSPLSTMTIKWTENIRS

SEQ ID NO: 132010 - protein, 28 aa, Heterodera glycines
  Coding regions on vcDNA: vcDNA=SeqID_58433; Strand=-; Position=1-84
MYAARARAAKAEKRQAQLRKAARARAGN

SEQ ID NO: 132011 - protein, 18 aa, Heterodera glycines
  Coding regions on vcDNA: vcDNA=SeqID_58434; Strand=+; Position=1-56
YREAIPEGFGLPINLGAS

SEQ ID NO: 132012 - protein, 115 aa, Heterodera glycines
  Coding regions on vcDNA: vcDNA=SeqID_58435; Strand=+; Position=1 -117,220-450
MTKDYPTSLFEEDRQYFGILDNEVMQQKDITEQALLFRSMIKALHHHILVEKEAAAAGIYREIDVLVRNHRVVPANEIANAMSEFCIWFNTTQENNDTDAATFAANSHNRFERPH

SEQ ID NO: 132013 - protein, 70 aa, Heterodera glycines
  Coding regions on vcDNA: vcDNA=SeqID_58436; Strand=+; Position=1 -20,667-859
MRDSARNRSALCPDWIKAFKIGINHQFVCHLPNKQQSFLFPSTFSNFSFASIGKMSLYWTRLIRNGKGGT

SEQ ID NO: 132014 - protein, 84 aa, Heterodera glycines
  Coding regions on vcDNA: vcDNA=SeqID_58437; Strand=+; Position=1 -90,172-336
MFIKPVLYSSIYFGWFFYPFVGYSNDDHHQYEHWLHVVHNIAVAFLSPAIYLFFASKLFFNVQSNRRQFAVVASELNSMQKRVW

SEQ ID NO: 132015 - protein, 91 aa, Heterodera glycines
  Coding regions on vcDNA: vcDNA=SeqID_58438; Strand=+; Position=1 -82,155-273,321-444
KYSRRLFNVTRLICLSNVHSILNWVMRIMPVVTTGRRGSLQPFGLFTPRPIKETITWLTFALLDCKRTNCNKRRHCPICPQLTFCNGDYCF

SEQ ID NO: 132016 - protein, 339 aa, Heterodera glycines
  Coding regions on vcDNA: vcDNA=SeqID_58439; Strand=-; Position=1 -144,196-925,996-1141
  Homolog annotation: Hit_ID=CAE70196.1; Match level="QueryCoverage =97%, HitCoverage=14%, E-value=0.0, Identity=93%"; Hit description =Hypothetical protein CBG16670 [Caenorhabditis briggsae]
MILRYVKAKADWWTNSAHYNRERVRRGATVDKTVCKKNLGRLTRLYLKAEQERQHNYLKDGPYVSAEEAVAIYTTTVHWLESRRFSPIPFPPLSYKHDTKLLILALERLKEAYSVKNRLNQSQREELALIEQAYDNPHEALSRIKRHMLTMRSFKEVGIEFMDLYSHLIPVYDIEPLEKVTDAYLDQYLWYEADKRRLFPSWVKPADTEPPPLLVYKWCQGINNLQSVWDTSEGECNVLLEAKVEKMYEKMDLTLLNRLLRLIVDHNIADYMTAKNNVTINYKDMNHTNSFGIIRGLQFASLIVQYYGLVLDLLVLGLRRASEITGPPQVEHYSFCVTL

SEQ ID NO: 132017 - protein, 76 aa, Heterodera glycines
  Coding regions on vcDNA: vcDNA=SeqID_58440; Strand=-; Position=1 -24,68-182,245-270,319-381
MPAPPNASDLNVEANGLSEDFMFDMTKAEIPAETFKKIVAWMEEHKGQPVPEFEEDPNTFERKWLPQNDFQQNFFK

SEQ ID NO: 132018 - protein, 324 aa, Heterodera glycines
  Coding regions on vcDNA: vcDNA=SeqID_58441; Strand=+; Position=1 -124,233-467,513-635,694-964,1035-1146
  Homolog annotation: Hit_ID=NP_509658.1; Match level="QueryCoverage =97%, HitCoverage=17%, E-value=5e-65, Identity=46%"; Hit description =multidrug Resistance Protein (mrp-4) [Caenorhabditis elegans] emb|CAB02667.1| Hypothetical protein F21G4.
GNIIFSHGDEHFYDKVMSACSLYQDMEILPQGDQTEIGEKGINLSGGQKARISLARAVYQNCDIYLLDDPLSAVDSHVGAQLFNQVIGPSGMLRNKTRVLVTNEPSCLKYSDFIVILADGRVISEGTYAELGRVISEGTYAELTKSGILARLMEDVESDRVKSVSVPTEKGVKKHNKEGEEDNKKHNKEGEEDNISDDTDETFMDNAADVENLLGTSAMSTVSGIARRKYSTSSTMFRRQRLVRADSVISSYNYPSVQRHLTGIEKVETGRVKPVIYLRYFQAMGFSVKPVIYLRYFQAMGFSLSILFLLRLTLSTAASMSRNL

SEQ ID NO: 132019 - protein, 50 aa, Heterodera glycines
  Coding regions on vcDNA: vcDNA=SeqID_58442; Strand=-; Position=1 -78,314-388
MRNAKKFEYAKGEMRKAKPRHIPATEKNFPKSLEIFSCILEYPDQHEEVI

SEQ ID NO: 132020 - protein, 82 aa, Heterodera glycines
  Coding regions on vcDNA: vcDNA=SeqID_58443; Strand=-; Position=1-271
  Homolog annotation: Hit_ID=CAE74190.1; Match level="QueryCoverage =62%, HitCoverage=45%, E-value=9e-17, Identity=71%"; Hit description =Hypothetical protein CBG21865 [Caenorhabditis briggsae]
FEFPFQASAVRLLICEWSVRIGANLIVPFLRLRSHNVDFWTFDILADEQVRQGLKSYSDWPTYPQVYLDGELLGGLDVIREE

SEQ ID NO: 132021 - protein, 129 aa, Heterodera glycines
  Coding regions on vcDNA: vcDNA=SeqID_58444; Strand=+; Position=1 -104,260-284,334-523
  Homolog annotation: Hit_ID=CAE74190.1; Match level="QueryCoverage =99%, HitCoverage=61%, E-value=6e-32, Identity=52%"; Hit description =Hypothetical protein CBG21865 [Caenorhabditis briggsae]
FPFPKKDPNSRLKRLINTARLTLFMKGTPEGPKCGFSRQIVDLLRSHNVDFWTFDILADEQVRQDLLRSHNVDFWTFDILADEQVRQGLKSYSDWPTYPQVYLDGELLGGLDVIREELNEQNFVDKLPK

SEQ ID NO: 132022 - protein, 111 aa, Heterodera glycines
  Coding regions on vcDNA: vcDNA=SeqID_58445; Strand=-; Position=1 -93,796-886,1015-1164
MIFLARKPFKFVRKNDDRAKKEAKDSSKKTHKNHFFSNLLMAASSSAAYPVLFFTQKRAGDDKLWVFYWLSDESKFGIASFPDTVYEMDADRNTRRAFLGTLPRVWWESTG

SEQ ID NO: 132023 - protein, 52 aa, Heterodera glycines
  Coding regions on vcDNA: vcDNA=SeqID_58446; Strand=+; Position=1 -49,773-882
MYIATSQSYNGISGEPMIPMTDKNRNLPPVHFSVNSGADFTWFNASNTDDCR

SEQ ID NO: 132024 - protein, 153 aa, Heterodera glycines
  Coding regions on vcDNA: vcDNA=SeqID_58447; Strand=+; Position=1 -45,571-768,1330-1419,1468-1596
MAVPLPFSVNVSTIGSVEESEARTTYTYGNVTVRPFILRNRRHHNFNFIVEDLVDPNLFLRSDQNNGRIGLVSIRVGNAAQAWDVVQVRFLSDNLETWTEVMERFERAVTAIEDGRPPTPVNSPSPVQEVVSANNSGEKLPSLNGSNEEEEAN

SEQ ID NO: 132025 - protein, 99 aa, Heterodera glycines
  Coding regions on vcDNA: vcDNA=SeqID_58448; Strand=-; Position=1 -180,666-746,1037-1075
MFEEGRTKIKQVNDESATVCYAFKHFLEFPRVDDATARRQRIDRLVKFFIDEALEKKRMEQGKQQQVSVSNNWSTNGLPQNKKSPIKKNGNMVFIGRGI

SEQ ID NO: 132026 - protein, 124 aa, Heterodera glycines
  Coding regions on vcDNA: vcDNA=SeqID_58449; Strand=+; Position=1 -202,248-420
  Homolog annotation: Hit_ID=CAE59092.1; Match level="QueryCoverage =99%, HitCoverage=48%, E-value=8e-29, Identity=54%"; Hit description =Hypothetical protein CBG02384 [Caenorhabditis briggsae]
VPYLRSSIRRFPVDEQRVPWNVPLVDYSPCDYTADSVHGKPWADPSEPSKCKFNSMDDGVNRVSFHGSYNLDTDGRPLNPFGRTGLRGRGLFGRWGPNHAADAIVSRRLANGQLQFVAIERRDT

SEQ ID NO: 132027 - protein, 59 aa, Heterodera glycines
  Coding regions on vcDNA: vcDNA=SeqID_58450; Strand=-; Position=1-194
ENIDHRPQTQKCLKTVRIDVKRFEMGWKNRIRGALALFQDEKCRKWSAKLNWDSSDRAI

SEQ ID NO: 132028 - protein, 46 aa, Heterodera glycines
  Coding regions on vcDNA: vcDNA=SeqID_58451; Strand=-; Position=1 -101,447-486
MSIFENSEIPALQAKNIAPIDIYRPFKRKWGLIFPKCPKKSVPIGI

SEQ ID NO: 132029 - protein, 216 aa, Heterodera glycines
  Coding regions on vcDNA: vcDNA=SeqID_58452; Strand=-; Position=1-648
MYSFTTASILLVCFMGLIGLAELGDDFFDELWKMNKVITNKKQNSIQKEVKVEEVDYEKIENESFEDEKRTNLTQKVKKEMEFGDEKVDLEKYAKKEPIFDEEEEEKIPRECAEENIVPTYSTEEEMENKIGKFKSLNFQNWKRADKIAIINQFISMRNEYKQRSDYRQQDCGRIEQKIANELEIPRKRIYRWRRALGLGPEFLGFHLFFFCGYHM

SEQ ID NO: 132030 - protein, 26 aa, Heterodera glycines
  Coding regions on vcDNA: vcDNA=SeqID_58453; Strand=+; Position=1 -54,135-161
MGQDQGSRIFAGDLRVYQKNRDLFAN

SEQ ID NO: 132031 - protein, 27 aa, Heterodera glycines
  Coding regions on vcDNA: vcDNA=SeqID_58454; Strand=-; Position=1-80
IFSRFAISRGPHNVRLRNRRHSQEALP

SEQ ID NO: 132032 - protein, 120 aa, Heterodera glycines
  Coding regions on vcDNA: vcDNA=SeqID_58455; Strand=+; Position=1-363
MGKVKVRQTEERTKETEERTKETEERTKGNGRTDKGNGRTDKGNGRTDKRKRKNGQRKRKNGQKETEERTKETEERTKGNGRTDNKLTSMSNDRMFKSRRERSKMFQWQEWFLLVIGGFG

SEQ ID NO: 132033 - protein, 394 aa, Heterodera glycines
  Coding regions on vcDNA: vcDNA=SeqID_58456; Strand=-; Position=1 -29,568-690,804-962,1263-1485,1746-1928,1973-2190,2331-2532
  Homolog annotation: Hit_ID=CAE63948.1; Match level="QueryCoverage =95%, HitCoverage=37%, E-value=3e-51, Identity=28%"; Hit description =Hypothetical protein CBG08530 [Caenorhabditis briggsae]
FSELKQTEPAKGSEAPEGKGATSGFKCGGELVPRWTANTLRNPTPTWACGYRNNERCKWTLRRPMFETIVMNVTAIELEQHPNCQYDFLSLSIKNLETEDELSSRFYRGFSLNYSLVCGSTEMARPKRSMDSVLSSPGYPNPPMTNKNHSCHWNILLLSRRDLNIRSLDMDVSLLSPRDWQSNECSTDSLDFSHFPFFRESATAKTSNSFCGQEQFNLTISGGYVFIRFRSTFSRGRGFKLALVESVHDCASSLIRGFKLALVESVHDCASSLIRLDQLTPLRLLSSPEFPHLSPNSLDCQWILSAPPGRRLKFTVDPKTFLLMGTRDDCAGDFLEVRDGPSEASPLVGRYCKNEAPSSIFSTGEHLHVRYVTGSWGRDGHMLSLISDHYLAGN

SEQ ID NO: 132034 - protein, 305 aa, Heterodera glycines
  Coding regions on vcDNA: vcDNA=SeqID_58457; Strand=-; Position=1 -270,337-463,526-713,826-962,1140-1335
  Homolog annotation: Hit_ID=CAE63948.1; Match level="QueryCoverage =90%, HitCoverage=7%, E-value=1e-42, Identity=36%"; Hit description =Hypothetical protein CBG08530 [Caenorhabditis briggsae]
MFNHSPSINPLDLLFIYFSACEKDLTALNGTISPPNFPNPSPRPFKCTYRIIAGPRQAIRINFDQIGISTDFNTCNYHRERHAQMEDYVEFSGGHPSNEVANRRYVCARYPFIAPDGEMVVSSGIRPFSITYSTSGAASNKGFLLSYELINIGCGGVLSIGSDEVAGEAPQLTSPNYPDSYMAFMFCVYFLQVPTGRAVRLSFDVFDVENVAHRDNCEFDSVTVYDEFFEDEQNHGKVLGNDRSLSGAGFAARFQAVDLASHCDRTFTAPEAQFDFDASEFAQSDNCVYRIVVLFYLNIYSFALF

SEQ ID NO: 132035 - protein, 54 aa, Heterodera glycines
  Coding regions on vcDNA: vcDNA=SeqID_58458; Strand=+; Position=1 -97,198-265
MPPSGTVPAKGEAPQTFDPCVEQSRLGAKLGYEEMAPNSVQGNSDHRFPRVHSA

SEQ ID NO: 132036 - protein, 106 aa, Heterodera glycines
  Coding regions on vcDNA: vcDNA=SeqID_58459; Strand=+; Position=1 -23,73-166,765-881,1063-1149
  Homolog annotation: Hit_ID=NP_508849.2; Match level="QueryCoverage =66%, HitCoverage=11%, E-value=9e-12, Identity=51%"; Hit description =phosphatidylinositol type II-like (XF592) [Caenorhabditis elegans] gb|AAM69079.1| Hypothetical protein ZC
MVILDYIIRNTDRGNDNWLICYTPPTTKAKEGNGKQRRRTDKGFDKKTFNKQLSVVYGQIFNLREALRERKTPAQLVQMTPLYIIEMKKNVFKQKVHTRSPLFSCC

SEQ ID NO: 132037 - protein, 207 aa, Heterodera glycines
  Coding regions on vcDNA: vcDNA=SeqID_58460; Strand=+; Position=1 -420,528-717,853-866
MLSITQPILYTYLFPLNSHTETAKAAESRIGIPFIIRHINSYLAAKNKEPTADAKVNKAFARKAQEIFTEAYKGLAKHGTFFGGDGMGRSVCILMAFKRLIEGILPLCMTDKNCSNLEQLKKWSANKNCATDECKMNAFNEQRNFMASIHLEMLRLYIGEQSEFAEFIRKTPGAKNRMRKLLVKEANYEELMESYSATVQNEEGFYF

SEQ ID NO: 132038 - protein, 41 aa, Heterodera glycines
  Coding regions on vcDNA: vcDNA=SeqID_58461; Strand=-; Position=1 -33,208-300
MDPIMGIERMVALVDSIVISPPTDSLQIFNSPDIQAMTRKQ

SEQ ID NO: 132039 - protein, 29 aa, Heterodera glycines
  Coding regions on vcDNA: vcDNA=SeqID_58462; Strand=+; Position=1 -75,192-206
MVNGFLKWCLYINYHKVIWSICGLMWPNG

SEQ ID NO: 132040 - protein, 128 aa, Heterodera glycines; identical to SEQ ID NO: 125618
  Coding regions on vcDNA: vcDNA=SeqID_58463; Strand=-; Position=1-784

SEQ ID NO: 132041 - protein, 366 aa, Heterodera glycines
  Coding regions on vcDNA: vcDNA=SeqID_58464; Strand=-; Position=1 -40,668-770,812-861,922-1083,1129-1284,1330-1381,1427-1533,1596-1768
  Homolog annotation: Hit_ID=NP_510580.1; Match level="QueryCoverage =98%, HitCoverage=85%, E-value=6e-55, Identity=36%"; Hit description =rhodopsin-like GPCR superfamily (XQ289) [Caenorhabditis elegans] emb|CAB04539.1| Hypothetical protein F59
ANSLSDVFHCFVISLSFADLFCSLLIIPFSLFSSLRPGWHFAGDNSALCKCTVYVLCKCTVYVHVMLICSTVYIFAWISVDRYVYIFAWISVDRYSAFMKPSRYEVAHTATRCKCWIFFSWATSLLIACPILIAKMESKYSPQLELCLLNWTSTMAYSVTMESKYSPQLELCLLNWTSTMAYSVTLAVLVLVPSLCTMAFTSAAIIAAVNKPDELEDLQRTILDTDPNFVLEDLQRTILDTDPNFVISLFIFVSFLLSWLPIIVFQLCPIRISLFIFVSFLLSWLPIIVFQLCPIRWWASDLSMMQFAFSWLAAFSWLAIGGGSSKLLIYRHFSIIRYYLSTSASPVLSSGGSSAVFREISSNSFP

SEQ ID NO: 132042 - protein, 80 aa, Heterodera glycines
  Coding regions on vcDNA: vcDNA=SeqID_58465; Strand=+; Position=1 -47,182-377
MKGKEKGTKGEKEREIDEENGNEAVTGGSMKIGQEGAREQKIVLSKHWHNQIGAKSKSLKREKGKECRSEKEKGKGSPFR

SEQ ID NO: 132043 - protein, 44 aa, Heterodera glycines
  Coding regions on vcDNA: vcDNA=SeqID_58466; Strand=-; Position=1-211
MNNHNKGGGGRSAFTCRCRPQFPFRRMNLPPPLPPPPPTIQRPP

SEQ ID NO: 132044 - protein, 386 aa, Heterodera glycines
  Coding regions on vcDNA: vcDNA=SeqID_58467; Strand=-; Position=1 -267,330-429,598-782,835-1142,1190-1490
  Homolog annotation: Hit_ID=NP_998392.1; Match level="QueryCoverage =97%, HitCoverage=45%, E-value=2e-31, Identity=26%"; Hit description =zgc:77308 [Danio rerio] gb|AAH66557.1| Zgc:77308 [Danio rerio]
MFATRFNGFAQQDSHEFIAFLLDGLHEDLNRRINHRQISNNRMDETEKREDNEEEGQCAEDGKSEEQNAIEEKRRKEPKVSEEADTSKQQTAEEAWEEYKRVNDSIVTDLLHGQLKSSLTCNVCGKVSVKFDPFCFLSVPIPPRPLKESSSIMPMPTNGQILKTAVKSRKSSDNLMQLTAREEERHRNAVENLTLTQRSLRSNYYGLEYLLACLHCALLISLSVMLPFQWFLIIAREWLIRPWTGWATELYRHFFSGPISLEQCLGSFFSVDYLHGDDMYKCEQCKRLRNGTKLCSLTRLPQVLVIHLKRFRNEGMYNVKLGSKVAFPLTNLDLRPFIHSEAQFDPPECPNPTKYDLCGLITHKGQNLECKFTLNKMDYETMTEFL

SEQ ID NO: 132045 - protein, 156 aa, Heterodera glycines
  Coding regions on vcDNA: vcDNA=SeqID_58468; Strand=-; Position=1-469
MENSRRYMTRQELRRLLDNGVAVEIEDNEINVAHQQGLRTNWTDYAAENFEASRNFQPAAVFLENHQREIAFSSLRVPIRTSSPNNQNRDPVAPPAQNFVLQNMLPRRLDNDTLSLAGEEVELDQHNENELLGLPLDGRGRTDSMLEHQVSAIHPR

SEQ ID NO: 132046 - protein, 66 aa, Heterodera glycines
  Coding regions on vcDNA: vcDNA=SeqID_58469; Strand=+; Position=1 -84,289-405
MALYCHPFFVEVHSFNSKKKWCKMQRPTSMQTEMIVDEKLQNFSKAKSHDPFFMNKKHGQFYVYFL

SEQ ID NO: 132047 - protein, 16 aa, Heterodera glycines
  Coding regions on vcDNA: vcDNA=SeqID_58470; Strand=+; Position=1-48
HAKTATRKWPRENVLA

SEQ ID NO: 132048 - protein, 46 aa, Heterodera glycines
  Coding regions on vcDNA: vcDNA=SeqID_58471; Strand=+; Position=1-138
QKNSVWAIHKKLSVGDPQKISVWAIHKKSQGGRSTKNLSVGDPQKI

SEQ ID NO: 132049 - protein, 503 aa, Heterodera glycines
  Coding regions on vcDNA: vcDNA=SeqID_58472; Strand=-; Position=1 -1044,1091-1556
  Homolog annotation: Hit_ID=NP_701342.1; Match level="QueryCoverage =100%, HitCoverage=37%, E-value=1e-19, Identity=24%"; Hit description= MAEBL, putative [Plasmodium falciparum 3D7] gb|AAL10509.1| erythrocyte binding protein 1 [Plasmodium fal
MPKSAEESPLKSAEEMTKSIDAEEMRKSAEETQKNAEEMPKSEGDMRKSAEETQKNAEEMRKSAEETQKNAEEMPKSEGDMRKSAEESPLKSTGELPLSFSEMPKGSLQKMKSLPKDMSASIGEMPKDVLQKMRSLPVNMPGNIEEMPKHALPKVPSINALPPHDEEMRKSAEEVEESPLKSTEESPLKSTEEMRKSAEEVEESPLKSTEESPLKSTEESPLKSTEETPKSAEEMPKSAGKLPPNFSEMPNGSLQKVKSLPKDMPANTDEVPKDVLQKMRSLPLNMHGHADEMPKIPPINAVPASVEKIFNEEQEKLSAKPEITAKNDKTVQESREEPGQKNENQENELNANDRDKIQSPNFLTPNSTFRDVSDSMDDEFFSAETELRRMSRESSENMAKMLKKNSLGDDNAKEISMERTENTEEIPQDTPTKLPSLNAIPSIAEEMPKTDDAMQKSAEETQSDISEGVLPKVPSINTLPSKDEEMPKSAEESPLKSAEEMTK

SEQ ID NO: 132050 - protein, 62 aa, Heterodera glycines
  Coding regions on vcDNA: vcDNA=SeqID_58473; Strand=+; Position=1 -61,302-389,475-514
MSISNNSINDGDDLTPAENEEVNGDAISLDNDGQFDGKNSKLSLIDNSLRNFVKRLPKWKWN

SEQ ID NO: 132051 - protein, 28 aa, Heterodera glycines
  Coding regions on vcDNA: vcDNA=SeqID_58474; Strand=-; Position=1-84
MCCVGSILCVLKGCGQSVRGLSVSNGQS

SEQ ID NO: 132052 - protein, 246 aa, Heterodera glycines
  Coding regions on vcDNA: vcDNA=SeqID_58475; Strand=+; Position=1 -182,304-456,533-709,754-860,906-1029
  Homolog annotation: Hit_ID=NP_502354.2; Match level="QueryCoverage =97%, HitCoverage=23%, E-value=3e-41, Identity=39%"; Hit description =yeast SEC homolog (109.3 kD) (sec-24.2) [Caenorhabditis elegans] emb|CAA92988.3| Hypothetical protein ZC5
SDRALQGASLSDCREALINAVVDPTVCYQRSHGQVGSMLRMPPEGGLQYMPIYILGLLKNRAFSDSLQRVTIDERVATFLLFKNAPLEVLLLELCPALYAFHQILYCEPNQDGQVPFPDRLPPTYEHISQNGIYLLDIGTFVYVYVGSALNVCILRSLFGTDSFAKLDSDSTVIEIDTSQSKHLHAFLRHLQEQRGNMYAPAKIIKDDSPRREAFTRRLIQDRSDSSHSYNEFMQFLQREVSKASK

SEQ ID NO: 132053 - protein, 159 aa, Heterodera glycines
  Coding regions on vcDNA: vcDNA=SeqID_58476; Strand=-; Position=1 -109,761-948,1008-1190
  Homolog annotation: Hit_ID=CAE68825.1; Match level="QueryCoverage =84%, HitCoverage=25%, E-value=9e-34, Identity=48%"; Hit description =Hypothetical protein CBG14784 [Caenorhabditis briggsae]
MLGRFTKSVDKSKSESLEERSQPALSVEKKERPKTAAKECFFNGVHAPPQLSLSDVELYGFSEYWFSVDDVLSLGGKYEHDKFEQKAKEFCGQPWAVIKRKVKAHFYQKADSERLETQCFKSAWIHAVLHNGFHVDEIQHHFQSAFRINGQEVQWVLII

SEQ ID NO: 132054 - protein, 126 aa, Heterodera glycines
  Coding regions on vcDNA: vcDNA=SeqID_58477; Strand=+; Position=1-381
MVFNRRIALPAHRAIGFCKHLSKGTDQFGLKGNSEKQLDEMPKIRGIILGLREEFNTFVIEIMLTRIENEKGANENGTNKSLEKMNEILKFLEEKNGSAFCDQSIIESAKRNSTIGGEKHNTFLIE

SEQ ID NO: 132055 - protein, 78 aa, Heterodera glycines
  Coding regions on vcDNA: vcDNA=SeqID_58478; Strand=-; Position=1 -126,182-292
MSAYMGSGPAEPAPSSGAAETSPSSGVASAYMGASPAHEPPAHEKSRNRAPTCEKMQQRPADGWTKPEERATCQKMQR

SEQ ID NO: 132056 - protein, 58 aa, Heterodera glycines
  Coding regions on vcDNA: vcDNA=SeqID_58479; Strand=-; Position=1-176
TSIDNDMIRFAFILSLQNDSPSSSRIDKAANCKHHTDENDEKLEELLLILNDNTIKRD

SEQ ID NO: 132057 - protein, 208 aa, Heterodera glycines
  Coding regions on vcDNA: vcDNA=SeqID_58480; Strand=-; Position=1 -93,294-479,629-802,904-1076
  Homolog annotation: Hit_ID=CAE57242.1; Match level="QueryCoverage =90%, HitCoverage=9%, E-value=2e-41, Identity=45%"; Hit description =Hypothetical protein CBG00120 [Caenorhabditis briggsae]
MASDIQMMHLKRAFDWYEEMKSQLEIIRFKKQALENESVEVNSRLANEESRAIELQKERKRTEAECESLRKNITDMDVGMRKLEAEKQAKDNQLRTLADELHKQELTESKLAKERKQQQELAAKLQNDLQMEAERNAAEKAHRQKLQQTLESVENEMDRERRARAEQEKARRKFEGEVRIARENLDEMGKQRQDMETSLKRKEADLFA

SEQ ID NO: 132058 - protein, 105 aa, Heterodera glycines
  Coding regions on vcDNA: vcDNA=SeqID_58481; Strand=-; Position=1-330
PGLKCPAEAKNFFYFWKKIENFPKKLPIDRAQKTMFWKWSSFFWENSLKNPKIQKPENRFLGLARKILKIFEILKFGKIGLLKLYNKSAGHPALRSKPNELLAWY

SEQ ID NO: 132059 - protein, 80 aa, Heterodera glycines
  Coding regions on vcDNA: vcDNA=SeqID_58482; Strand=+; Position=1-243
LSLLSLFSVSYVSFIFWQLFGGPRSPEDICDWERLWGFFHCLWVWVRLTLLAIGWAWIAMQYFIGALCCRVALNFVKNRY

SEQ ID NO: 132060 - protein, 291 aa, Heterodera glycines
  Coding regions on vcDNA: vcDNA=SeqID_58483; Strand=-; Position=1 -301,544-1068,1135-1184
  Homolog annotation: Hit_ID=CAE71967.1; Match level="QueryCoverage =50%, HitCoverage=6%, E-value=4e-60, Identity=76%"; Hit description =Hypothetical protein CBG19038 [Caenorhabditis briggsae]
MAREEQPVSLEQAENVLKRHQDFMTTMDANDEKMRAVVQMGDQLCADGHYAADKVHKKARNIEERRAANREKAQAMLDKLREAVQVQQFLSDCEELREWIEEKMIRAQDETYRDAKTISSKFMRHQAFQAELAANKRRLEEAKPKAPGGGRIKVPIPTVCCSDSPRGGTTRGGKARIPRDDRPGSAATVAAVGTIGTDDGGKGTAIVRHQPTTALCAIHRRSWHEVPCTSNHWHFVTGQRLGPANRATDRRAALGAARFDHRRLGHATAATVGAGNGTQSDALGVVAGHGA

SEQ ID NO: 132061 - protein, 140 aa, Heterodera glycines
  Coding regions on vcDNA: vcDNA=SeqID_58484; Strand=+; Position=1-423
MIISKLLLLLLSEVFYLIPLGSSDRSDKTKQMHIDHPNKSESMGSSDHSDRTKQMHIDHPNKSVSMNSSDHSDKLKQMHIDHPNKTESMDSSDHSDKLKQMHLDHPNKSESMGSSDHSDRTQNKCILITKQIRSMGSLIL

SEQ ID NO: 132062 - protein, 2400 aa, Heterodera glycines
  Coding regions on vcDNA: vcDNA=SeqID_58485; Strand=-; Position=1 -243,289-500,545-758,803-1147,1191-1667,1717-1992,2038-2346,2392 -2778,2829-3276,3327-3983,4031-4176,4452-5225,5465-6276,6325 -6890,6938-7102,7144-7410,...
  Coding regions on vcDNA: Position=...7458-7553,7603-7770,7812 -8067,8111-8218,8265-8541
  Homolog annotation: Hit_ID=XP_550305.1; Match level="QueryCoverage =42%, HitCoverage=67%, E-value=5e-90, Identity=27%"; Hit description =helicase-like protein [Oryza sativa (japonica cultivar-group)] dbj|BAD68127.1| helicase-like protein [Ory
MPHVHICLILDWEAMRVGGRIRTPEDYIGEYICAEIPPKPDENARDEHLQRHLYTTVTTKNIHTCAEHRCLVDGKCVKKFPKPYEYDNVYSENAYPRYRRRPPPPSGEEAQQNPEQFGRVFEYKDRYGKLIKKDNAHVVAYNPFLSSKYKTHINVEFVAGDGCVKYLCKYVMKGADMAFIKISGQEGTLAYDEYHQLRLARYITSMEAVMSMWGTPLVKRSHIVDELDVHGPEGHRIAVDQAFDDEEERAGALVEAAEKEEERRKTGEERNTQLTAYFAFNKQRSSTDGPLHLTYATAYKKLRYDKKNRRWQPYVIGALEGLKLCRLKTVSPTNMDLLAIRLLLLVVEDPTGWEDLRRHNGTVHRTFVEAAQARGLLNDNELWMRTIREAFATKKRPKQCIRWLAVFFATANLSKPMDLFDYVMEISNTWLTVWSLNNATPEAKRQYVLRALEWFLLANGVHPDSDKREDGTFQTACEKIGLPRPDGVQLTKDDYIQLVFFRDDLVNARLPEEMRADNANTSMRKRYADIYTADPKPNNEQQMLVDAVFDGVKAANELRKGDFDDKDLNMPRLFMVTGEGGAGKTFTYNKIIAKVKAAGFNFLPMATTGIAAELLYEGQTVHKRLCRQRHIDASTSLNVDLESNFAEMLRKIDGMLIDEISMQNRDVLEYVDRLLRFVVPTDLLKSLPFGGKAVVIGGDWKQLTPVVPGGGHLDQYNASVKNSALFKHFTTHRLVTNHRLQSGQQQYRDFLRRVGTGVINDIQQRVKLPKQIVEPDRDALLQFVFPQELLDKPIENWQKLSERAILCPLNKETFELNNKIMDMMNAGNNNDNIDRIYTAITVPIVDDVDALQLENIAANINQENLIRQTPPGIPQHQLRVKVGAVMMVTNNISVEEGLCNGTRVQVLKLYENIIRCKILTGTHRGDEHDLHKARFQFGGDPKALHEGPIRCERIQFPLRPGSVMTINKSQGQTLSHVGVLLDKSQCFSHGQLYTALSRVREDTNIRVCTKNTGRRVKNIVMLELLDKEDLDTATMGPPDDPNDPVKIDTINYFNNSLVKYPRGPPPDHDSDDDDDDGKGPPKPPTSAFRTPTTRSRRPSSPDEPLADDITLDNLRKIKIVMGDITKQRADMLVSDKRGNTDNAILRACEPNSEGLQQQLKTIRQTIQGRVPDGYVAVTPTYGNLTEKAKFIAHVATPNCKGRDHTADDIQSLKQCYTKSLQELINELKKNGEQQTQIIIKRKISERKGTKGSRASSAASSCRSLSPVSSLAATTPPKTAAKTPQITPTTKDTHAKKHLAIDSKPGPSNRSSGESVAVVPPPVPKVQQKKSTAQNDQHAEATTSSTTASKAFLMRAQPDGNCFFNAICLTLFGSENHADQLRKRMCTFLRTILADQRLFLRQNPNYNTRESFLRRIDRMLLHGTDEGITTLEEYAGRREQERDWAQVNDSMLLAMLLQRPIVIIMTTLTQREIEQQRPQWNDNRQHLYVYFPDGEMRAPRSSAERAGNEVVYDDNYVPAALTPAAAMGSPAQPQPTTTAQPSREVLDSGPLKMAKQQPASQQPAAAPSVEVNRRGNKLEIHSESPRKTLLLAAKYAVAMNTETLKENISEAEKAKKQHLLQQCTASIHRLSEHIRAATDAEFQAKQQQAMFESIRQTPVSSDSAALQKSFDKLRKPLAELYNAIRNYLMLWQALRQIDSAKSSLASLKDWQDDFEFCSDRLQTLGEQWKEADDKFEDKFSKVYNDCENFNSPKKKGSSFFSPLKSLPKFMKSKKDSQDQQHLDALLSALRRILSEKKDEIEVEMKKKRTVRTSQTATRRRQLDEPTRRRTSASPSKIRASDVNVERAKKAAAAAESRFSTPAKMTSAEKSQLQREQQQQRRNEEAKKQMDARLAIVQQHLHKQIDRQNNLAVRNLQWDREAKMEQRIIQRYHAFRAMVDEEFRAAVQQGATIDFEQFLNSDAAIRSLCEEILEMAGQDADADVEELMAQHQAVIERQQRALAEQQYWRKFAGDASAEQPLRPTELELEIQRYNREHQEQERRLAEERIQKEQREAEMLERKMRRIKLEQPKSQQHLAKDSTRKRTQQQAQISTPTKAETKKSGKNGTLPSPGNARKQPQHAVSRLYFSEANAEPEHVESASSMLTTEQPIAIIQPDPEAIRAREIIDQRLNIQEADYVEDVHCGSDDKAPGPHPNFNVVHMEIVSSKKEGQWRDNNETCGVCTEPLLRGDLVTQLPCDTNVKHIFHTICLRRSLTTNRTCPKCRRPVNIPDNIWPTKDSHSQSYKDYFAEQSQSATSARPPDDDFVIRAWSVYEDLRNGQRDAYGSVIRQPIAPRRAFQLVIDQIREGSSDLGDRQLEWDITDPRNDEEQGLHMCETLLRERMEEDEKEEKEKKEKKYLEF

SEQ ID NO: 132063 - protein, 53 aa, Heterodera glycines
  Coding regions on vcDNA: vcDNA=SeqID_58486; Strand=+; Position=1 -54,160-267
MSNSLARSCVISSNAFCSYKSSEAMEDRFDLIRPLEDRGVSLSDELGGPIITN

SEQ ID NO: 132064 - protein, 128 aa, Heterodera glycines
  Coding regions on vcDNA: vcDNA=SeqID_58487; Strand=-; Position=1 -201,251-433
MPTKTHFLPAKESSTAFFYARRGTQRERSPSPCGGVRVTPSPERLARPSGVEVPPNTDLTVFKKPIPGRNWDEDRRKRNELLSAYSFAQDRGIAAQLRRLITEMKVFAEEAKKNVAHSRGVGIEVQGK

SEQ ID NO: 132065 - protein, 230 aa, Heterodera glycines
  misc_feature (208)..(208): Xaa can be any naturally occurring amino acid
  Coding regions on vcDNA: vcDNA=SeqID_58488; Strand=+; Position=1 -142,1318-1455,1751-1840,1905-1983,2184-2364,2766-2796
  Homolog annotation: Hit_ID=XP_326598.1; Match level="QueryCoverage =100%, HitCoverage=23%, E-value=2e-53, Identity=45%"; Hit description= predicted protein [Neurospora crassa] emb|CAD21337.1| conserved hypothetical protein [Neurospora crassa]
ETGKERERERERERERERERERERERERERDRERERERERERVRVREREREREKEWYFRSLENYEKEREKERDFRFWEIIREREKELEKERDLEREKEREKERDFEIWENYENEREKERDFRLEREKEREKERDFKIEREKEREKERDFKIWENYENEREKEREKEREKERDFRIWENYEKEREKERDFGFWENYEKEREKERDLNYXREREKEREKEREREREKEREKE

SEQ ID NO: 132066 - protein, 109 aa, Heterodera glycines
  Coding regions on vcDNA: vcDNA=SeqID_58489; Strand=-; Position=1 -65,197-461
MQSFFPVGTHFTKKNQSQFIFRNALKYSELVRLCVIIGNMLFKCSMLFQMLVIATKVMIGVTQNIFCKTRLVTCFSNVQCFFRCWLIATKVLVGVTQNIFFTQKLVTCF

SEQ ID NO: 132067 - protein, 293 aa, Heterodera glycines
  misc_feature (10)..(10): Xaa can be any naturally occurring amino acid
  misc_feature (60)..(60): Xaa can be any naturally occurring amino acid
  misc_feature (68)..(68): Xaa can be any naturally occurring amino acid
  misc_feature (236)..(236): Xaa can be any naturally occurring amino acid
  Coding regions on vcDNA: vcDNA=SeqID_58490; Strand=+; Position=1 -51,745-1058,1378-1545,1616-1937
  Homolog annotation: Hit_ID=XP_326598.1; Match level="QueryCoverage =94%, HitCoverage=15%, E-value=5e-46, Identity=40%"; Hit description =predicted protein [Neurospora crassa] emb|CAD21337.1| conserved hypothetical protein [Neurospora crassa]
GILEFEKNLXKVKGKGNEREKERDFRIWENYEKEQKERDFRFWEIKREREKEREKERDFXIWESYEKXRKRNRIFDFGKLEKEREKERDFRIWENYEKEREKERDFGIWENYEKEREKEREREKEREKERDFKIWENYENEREKERDFRFWEKREREKERDFRIWENYEKERDFEREKEREKERDFRIWEREKEREKERDFRIWENYEKEREKERDFRFWEKREREKEREKERDFXIWESYENEREKERDLNYEKEREKERDFRIWENYEKEREKERDFRFWEIIKGKGKRNG

SEQ ID NO: 132068 - protein, 235 aa, Heterodera glycines
  Coding regions on vcDNA: vcDNA=SeqID_58491; Strand=+; Position=1-708
  Homolog annotation: Hit_ID=AAN87269.1; Match level="QueryCoverage =95%, HitCoverage=9%, E-value=1e-22, Identity=31%"; Hit description =ORF [Drosophila melanogaster]
MLDTTAESFLKVLRRFISRRGKPDLIWSDNATSFKLSQKTIEQLTTPKGVGQYHEEFLAHNKMKWKFIAQISPWAGGVYERLVQLCKNCFKRTLGRRILKYDELNTFVAEVEATLNHRPITVVSDGEDGIQPLRPIDLLQPDLQINWEITAEEAHPNDKQISSSERFAALFKATREAHESFWHKWHNDYLLLLREREKWDHKGPHLQDKGEPKKGMIADRLSCAPARLGPGGFWI

SEQ ID NO: 132069 - protein, 60 aa, Heterodera glycines
  misc_feature (18)..(18): Xaa can be any naturally occurring amino acid
  misc_feature (35)..(35): Xaa can be any naturally occurring amino acid
  Coding regions on vcDNA: vcDNA=SeqID_58492; Strand=+; Position=1-643
  Homolog annotation: Hit_ID=AAO51593.1; Match level="QueryCoverage =93%, HitCoverage=3%, E-value=4e-10, Identity=55%"; Hit description =similar to Plasmodium falciparum (isolate 3D7). Hypothetical protein [Dictyostelium discoideum]
GTRREKRRERERKEIDRXEMKQREREKKKDKRGEXEERERERRERVERDERKRIERKKRG

SEQ ID NO: 132070 - protein, 158 aa, Heterodera glycines
  Coding regions on vcDNA: vcDNA=SeqID_58493; Strand=-; Position=1 -87,130-370,414-562
MFRKNVFYAKIENKKMASYRIVAYDLEYTTNTIFDEKSLRKETIHKPNFISARFICSLCLGEIKDCEICGTGPRHLNWCSKDGIDPLNCFVKWIINLEKYDTYAYAHFGGRYDSHFVLRELANLGYKQPEFLTKFFKIVQANRAHLGLSNDTKNVGFG

SEQ ID NO: 132071 - protein, 70 aa, Heterodera glycines
  Coding regions on vcDNA: vcDNA=SeqID_58494; Strand=-; Position=1 -54,115-243,666-695
MDGKNYGLKHLQIVQDFWDSKFPGKFELLLFQGMLDFVRFLRGMAPVNIMCAFFMKKIIGMIKNIAENVT

SEQ ID NO: 132072 - protein, 84 aa, Heterodera glycines
  Coding regions on vcDNA: vcDNA=SeqID_58495; Strand=-; Position=1 -103,168-277,1396-1437
MNVRLKSIAIHNFVGNGKFIFKEMLSAFHGKKVNVRCVPLLSVKKRRPTPHPFGLFTGENLYKISLIIIDEDNRKQKIKDNLGE

SEQ ID NO: 132073 - protein, 18 aa, Heterodera glycines
  Coding regions on vcDNA: vcDNA=SeqID_58496; Strand=+; Position=1 -6,620-670
MECIFVQILRFVCIPYML

SEQ ID NO: 132074 - protein, 84 aa, Heterodera glycines
  Coding regions on vcDNA: vcDNA=SeqID_58497; Strand=+; Position=1 -60,163-357
MAISTHLTRQVPMERLNFGDRFNTEPIFAESAKMLISIAFIPIADLTEAVNVLDVAFRNFPHMQPMLDFMLIEVINSQHLPRSG

SEQ ID NO: 132075 - protein, 112 aa, Heterodera glycines
  Coding regions on vcDNA: vcDNA=SeqID_58498; Strand=+; Position=1 -157,1488-1669
MKVGRCSLLQCTAWPWKFVGETKGEAESLDSFNHFHLILHLRIGTILREGGSYTEAVKDMADEFSALTSSTWDIVNQLRFVSENAVKFVRVAGPVGAIIATAIDIAFSVKNI

SEQ ID NO: 132076 - protein, 94 aa, Heterodera glycines
  Coding regions on vcDNA: vcDNA=SeqID_58499; Strand=+; Position=1 -56,814-907,1046-1180
MLKGCLYVILVLIAVSLIRCWIQKIADGNERKREPLVHFAKVVWLDLMRAPFFAKQLLFFAILISIFQKYGKMWVRRCRQALPGKFFENFNAIC

SEQ ID NO: 132077 - protein, 118 aa, Heterodera glycines
  Coding regions on vcDNA: vcDNA=SeqID_58500; Strand=+; Position=1 -137,526-745
EITWPTISRTRAKSAIGVSDIAESKEAYQSVAEKIKDEVDQLGAEKYDYAVIVFPNWTDPEAMAIISEANSYFELIDVKQINVIVVRIEDNETNFELACKANEWFTPRIETKMKYTIK

SEQ ID NO: 132078 - protein, 81 aa, Heterodera glycines
  Coding regions on vcDNA: vcDNA=SeqID_58501; Strand=+; Position=1 -136,191-300
MWWDHKRHLKLSDLADMLKEWLQFYRNLVLVHNWKFFSSAATITLGVTPTFVRSARAEKGFRHKIVPALFDAEIFHVHMLL

SEQ ID NO: 132079 - protein, 54 aa, Heterodera glycines
  Coding regions on vcDNA: vcDNA=SeqID_58502; Strand=+; Position=1 -159,384-389
MPSIISKSSILLLYPLLLTTMVFISTSTSFPLLVTYNFNQPIQLLKLLKIDPRL

SEQ ID NO: 132080 - protein, 204 aa, Heterodera glycines
  Coding regions on vcDNA: vcDNA=SeqID_58503; Strand=+; Position=1 -129,190-273,324-414,476-555,606-710,769-894
  Homolog annotation: Hit_ID=BAC06575.1; Match level="QueryCoverage =99%, HitCoverage=96%, E-value=2e-99, Identity=57%"; Hit description =As37 [Ascaris suum]
MPDGKAPHFPQQPVARQNDDGSLELECFLEANPVPEIKWFYENNELKPTERFSFRLDNRGSEAFSAILQIKDLADSDAGAYRCAIVNPFGKGNANFNLKLTGFSSPTFIEKPQISSRDDGRVMIMEFKAKSILKPTFVWQKGDEIVAESDRYKIILKETGNHEYYAALEIVEPKKEKDAGQFVCTAKNESGKLTATFSVKFEGH

SEQ ID NO: 132081 - protein, 107 aa, Heterodera glycines
  Coding regions on vcDNA: vcDNA=SeqID_58504; Strand=+; Position=1 -117,687-893
MISRESLMLLRSVGERPFMRLDMLNPQIYAHCQLLRKVRCPNCASVFHKECAKKAGLDDCIAGLSSEQQQQQNKCPKCLRRAKYASTTTGSNSNNALAQLQNNTNIK

SEQ ID NO: 132082 - protein, 74 aa, Heterodera glycines
  Coding regions on vcDNA: vcDNA=SeqID_58505; Strand=-; Position=1 -27,72-143,185-291,531-549
  Homolog annotation: Hit_ID=XP_311491.1; Match level="QueryCoverage =82%, HitCoverage=18%, E-value=1e-16, Identity=67%"; Hit description =ENSANGP00000013700 [Anopheles gambiae]
MIAHVTGLKGGEFVHTLGDAHIYLNHVESLKEQMGRTPKPFPRIVFKRPDGNPITSIDDFTPESVLLEGKILAK

SEQ ID NO: 132083 - protein, 151 aa, Heterodera glycines
  Coding regions on vcDNA: vcDNA=SeqID_58506; Strand=-; Position=1 -105,220-572
  Homolog annotation: Hit_ID=P54674; Match level="QueryCoverage=72%, HitCoverage=5%, E-value=4e-10, Identity=33%"; Hit description =Phosphatidylinositol 3-kinase 2 (PI3-kinase) (PtdIns-3-kinase) (PI3K) pir||T18273 1-phosphatidylinositol 3-kina
RLQQLSLDADSSIQESGEQERTNSLSSSSSDSFIEYLEQFGLTDPVEEQPAPNLNSPNENHEGSSNSNESGHNNNNNINNDGIQQNNANGINNNNGTQTNAATSDDPSSSSTGAQNNDDATSAENCPICLESLTNTAIEEMKQLSSCRVFY

SEQ ID NO: 132084 - protein, 355 aa, Heterodera glycines
  Coding regions on vcDNA: vcDNA=SeqID_58507; Strand=+; Position=1 -199,262-1130
  Homolog annotation: Hit_ID=NP_507780.1; Match level="QueryCoverage =83%, HitCoverage=19%, E-value=7e-15, Identity=24%"; Hit description =predicted CDS, DNA polymerase type B, organellar and viral family member (5T899) [Caenorhabditis elegans]
MRFYSLYKRGIISEKRWRWMNNNQTTVLRQKVLLLLRDAGIPTTEPEYDAEIYIHQVQGLWSTKYPGEYKIFIFNDYQTRPITRSDVNEYQFSIILYHHDKHFDGIKTLSKFFNKNYYCLSCESVYERKSQHSMNCSSLCHGCREVGVDYPCEPQQGYFKKCDQCNNNFYNKICYERHLHKDLCTKFQRCEDCGVIYNVKYHGKTGHQCGEKFCRLCKQFHVKEDDEDNPCSSCFIQPLKPHKLKPYRIIAYDFEATQDKKVGNKFEHEVNFAAATIICTDCINGNWKDSLKGSSCKICGPHRTITFAPFDFSNTIVDQKVTTMHPLRDFVQWLLFDHNKKFQQLPLHILRAATT

SEQ ID NO: 132085 - protein, 32 aa, Heterodera glycines
  Coding regions on vcDNA: vcDNA=SeqID_58508; Strand=-; Position=1 -66,599-631
MPSFLVVALLLLLLMPKIMLLMLYANYCYCFN

SEQ ID NO: 132086 - protein, 76 aa, Heterodera glycines
  Coding regions on vcDNA: vcDNA=SeqID_58509; Strand=+; Position=1 -106,790-914
MVIWSFLAMVGPVNGFCEKDENYGNQNHDDQNEDAKSANNRSCDGEVLVCEDSRLAVAKRRPTKAKGWQPTQFIDQ

SEQ ID NO: 132087 - protein, 18 aa, Heterodera glycines
  Coding regions on vcDNA: vcDNA=SeqID_58510; Strand=-; Position=1-54
YYLPNSASEMFLYPMEIQ

SEQ ID NO: 132088 - protein, 899 aa, Heterodera glycines
  Coding regions on vcDNA: vcDNA=SeqID_58511; Strand=-; Position=1 -130,182-344,397-487,647-839,984-1030,1077-1151,1199-1240,1304 -1462,1518-1665,1716-1991,2089-2177,2384-2497,2562-2642,2705 -2888,2945-3023,3073-3121,3226-3350,3395-3658
  Homolog annotation: Hit_ID=CAE64423.1; Match level="QueryCoverage =99%, HitCoverage=99%, E-value=0.0, Identity=45%"; Hit description =Hypothetical protein CBG09117 [Caenorhabditis briggsae] emb|CAE64405.1| Hypothetical protein CBG09097 [Caeno
MNVGEIAFFLLSVLVHWQLTDAIRVISNGLAPPEIVHSPMDVKPRCLIRRCLIRAAPLDLVFILDSSGSLRNQFQDEIDVIRRIVRHVTIGDTATRVMLIQFSGVQHLEFDFNKFTHGVQHLEFDFNKFTHRDELLSALDVLRHVSGITRVGGAFEFAISALENASHGIRPSAVPKIVFLLSDGRTHDFPTDSEMAEKLRKKVSNSDIWAYGTGEYVALAELMKITKNESKIITNNESKIITNKNLDKIEPMFAPWHGVEVCEQRPVVCEQRPVCVKGSDKPLDLALLVDSSEPLDLALLVDSSESINQVFQEQVQFIINRIISNVHVHAEAVRLALITFSGQAFVHFGFNDPKVGNNSEVIRYLNTVHFGFNDPKVGNNSEVIRYLNTLRPIKGTTSAHLALASALRLFNDPIQNSSKRPNATKLVVLFSDKRPNATKLVVLFSDGRISEPVENVAEMLRSIGVETMAVSLNHPTNSNERELLAIAGRKEHVFTQKNLQEFEKSFLKFVGFGCDGFELGVNATPRIRGATDITCGPDSVTLTVRTTKPMQGMIYAQRFHDDPQCVLRSNGANRENSLTFRVGQCGVQKTPNSAESGYVFNVTVNSAESGYVFNVTVILQFHPIIVTRADQGLDVSGLDVSCVHHQPVSERELELTSQRSLVTSRCSYRLHRFGPDNCIALDAKVGESLFHKWECETGDEHRDEHRFLVHDCYATSERNNVQILDENGCEIDPHFIETPDYSQMNGCEIDPHFIETPDYSQMNSLPNDKGMAAFKFPDDDKLVFRCLISLCDLSSSDECAQMIPPKCDSKRPMAPPKCDSKRPMASAGERRILWAETFRCSDLMRRTLRGRKRQRRRRDVGTRKGFARTVAVETRTLNVIESEGIRPPTAEALRYCDVR

SEQ ID NO: 132089 - protein, 181 aa, Heterodera glycines
  Coding regions on vcDNA: vcDNA=SeqID_58512; Strand=-; Position=1 -184,285-646
MLGVKITEKTVPSSAVPSTRNGPTPPLAKQRPFGREANRLMSEWTMPNGVRAFASGRYEPPAQRPPMLPRMPSHQPDDDSFGVSAHKKQSSPQLSFRSPTGQYAPLWSPAGAAFAVPSPAHLGGIAYYAPNSGDGMHGTTAAEAAVHPIADGGQATKPPVLLIGAFPPSAKVRPVSGEGME

SEQ ID NO: 132090 - protein, 20 aa, Heterodera glycines
  Coding regions on vcDNA: vcDNA=SeqID_58513; Strand=-; Position=1-60
MASSSNWKPTKPALTSPLER

SEQ ID NO: 132091 - protein, 33 aa, Heterodera glycines
  Coding regions on vcDNA: vcDNA=SeqID_58514; Strand=+; Position=1 -19,760-842
MISCSKAQPKNKPLPINKKCQIIIKSDMGHPYF

SEQ ID NO: 132092 - protein, 92 aa, Heterodera glycines; identical to SEQ ID NO: 125147
  Coding regions on vcDNA: vcDNA=SeqID_58515; Strand=+; Position=1-304

SEQ ID NO: 132093 - protein, 151 aa, Heterodera glycines
  Coding regions on vcDNA: vcDNA=SeqID_58516; Strand=+; Position=1 -135,212-532
MSQNRDENSQPPVLDGPYPLAQERNEFVEDEAPVLLEMLDRLSQGGICQAMGLFSFALADCLATFHTFAILFDCETPVPFDEQHKRYVFEHRDKPRLIYVSEDGSAIQVDGVVKQGEFVMSIETMYLDKRNGVDHFCTFLRTFGICFLMCH

SEQ ID NO: 132094 - protein, 52 aa, Heterodera glycines
  Coding regions on vcDNA: vcDNA=SeqID_58517; Strand=-; Position=1-156
HANVPPLLNDTVHFRPPANPIGCPQLAVSPNVVAPIHPFTTQPTKLNPSRTP

SEQ ID NO: 132095 - protein, 18 aa, Heterodera glycines
  Coding regions on vcDNA: vcDNA=SeqID_58518; Strand=+; Position=1-56
YREAIPEGFGLPINLGAS

SEQ ID NO: 132096 - protein, 95 aa, Heterodera glycines; identical to SEQ ID NO: 124528
  Coding regions on vcDNA: vcDNA=SeqID_58519; Strand=+; Position=1-660

SEQ ID NO: 132097 - protein, 89 aa, Heterodera glycines
  Coding regions on vcDNA: vcDNA=SeqID_58520; Strand=-; Position=1 -106,426-589
MPLFGLLPPFLALILVSGSKDDRMNSGHSSISTTTIRPQLLATDEDEERLGIDMFRGYNPLIRPSPCRNSSVVHVDFGMAMASAKLGKF

SEQ ID NO: 132098 - protein, 358 aa, Heterodera glycines
  Coding regions on vcDNA: vcDNA=SeqID_58521; Strand=+; Position=1 -87,123-1112
  Homolog annotation: Hit_ID=NP_507780.1; Match level="QueryCoverage =82%, HitCoverage=21%, E-value=1e-17, Identity=27%"; Hit description =predicted CDS, DNA polymerase type B, organellar and viral family member (5T899) [Caenorhabditis elegans]
MRGSSQQRRSTTRKFIYIKCKGYGTSNIPIRPITKSDVTDYQFPILLYHNNNHFDGIKTLSKFFNKKNYCLSCESPYYKKIEHSLKCSSLCHGCREVGVDYPCDPQQGYSKKCDHCNNTFYNNSCYERHLHKDLCTKFQRCEDCGVIYNIKVHGSVGHKCGEQFCKLCKQFHIKEDDDDGMNPCTKCFIQPLKQQRIKSYRIIAYDFEATQDKKVENRFEHEVNFAAATIICTDCIINGDWNKSLQGKKCQICGPHRSITFSPFDYTETTVDQKVVTQQPLCEFVQWLLFDHNKKFPTVAFAHFGGRYDMTMIIKEVLAQGIHNPDIIKQGNRLYELKSGKRAWPPHHLSRQLQPNAH

SEQ ID NO: 132099 - protein, 40 aa, Heterodera glycines
  Coding regions on vcDNA: vcDNA=SeqID_58522; Strand=-; Position=1-121
MDKFPNILFIWKLTEGIEGQIQFKWDNVITQSWINQKELL

SEQ ID NO: 132100 - protein, 130 aa, Heterodera glycines
  Coding regions on vcDNA: vcDNA=SeqID_58523; Strand=-; Position=1 -196,453-649
MDGLRAEKFDVGMAEAYCLTEYSLALFHFLQIAVTIATQSQPMSPFQLHLMGHLSKMKKSEGTPTEFIGISTLNMFGAERMKLLNMGTKEQMAEELKWRRDEVWRNCVEQTLAKIKEHINMVENNHNIKY

SEQ ID NO: 132101 - protein, 90 aa, Heterodera glycines
  Coding regions on vcDNA: vcDNA=SeqID_58524; Strand=+; Position=1 -197,420-495
MTVFGEHFYGVPIVCVPFIGDQFYNAELMAFRHIGLAVDRENDQQTVQNDLIGALSEALGRQQRKKIILFSARLSYASQSELSFFDSKIN

SEQ ID NO: 132102 - protein, 133 aa, Heterodera glycines
  Coding regions on vcDNA: vcDNA=SeqID_58525; Strand=+; Position=1 -44,90-339,782-889
MNGAIVGGYSIRIQRFDLSSSAGVTKSADANNEKASDEQMHHISGTECRFNMQHLRPAQLYRLAVTAQSDAGPSPKSDILEYRSPPGVPEKPRNVHIEQKTLVEPPEPPQIFLAQATANSLKLKWSDGGGTDI

SEQ ID NO: 132103 - protein, 102 aa, Heterodera glycines
  Coding regions on vcDNA: vcDNA=SeqID_58526; Strand=-; Position=1-307
MPDLVHSGAEVISIQSTSEVCERQSNGSVCRVSGTTELTILPAGQKVSLALKDDKGKIMGSLELILQFLRLHCNQQTLKWLRSYKINVISKRRYPTMGSCTK

SEQ ID NO: 132104 - protein, 61 aa, Heterodera glycines
  Coding regions on vcDNA: vcDNA=SeqID_58527; Strand=+; Position=1 -92,437-530
MIALDFQPFSVVEDEGFTRLLNFLAPGYKQKILWNSLALSSTKSTYLCAMLKVQCRQPRVV

SEQ ID NO: 132105 - protein, 430 aa, Heterodera glycines
  misc_feature (359)..(359): Xaa can be any naturally occurring amino acid
  misc_feature (404)..(404): Xaa can be any naturally occurring amino acid
  Coding regions on vcDNA: vcDNA=SeqID_58528; Strand=-; Position=1 -1153,2091-2229
  Homolog annotation: Hit_ID=NP_508324.1; Match level="QueryCoverage =88%, HitCoverage=14%, E-value=6e-70, Identity=38%"; Hit description =predicted CDS, peptidase family A16 and RNA-directed DNA polymerase and Integrase, catalytic domain and Z
ESEKIWDLETIGIKDNPMEKDDEVALKMFKDTIYRKDGRYVVSWPWKGPKEELPTNFTLAYRRMISIIEKLKKSEEHLKQYNEIFKEQLKEGIVEESEIKGYDEHFLPHHCVLVAGKKPRVVYDASSKIRGKKCLNDLLFRGPIYMPELPGLLMRSRLSKIALWGDIQRAFWTLELQENDRDTVKYLWLKDVNKPITKANLCAFRFKRVPFGVISSPFLLGATVRHHLENEKSELANEVKQNTFVDNIFVGCNNSAEAIRNYKNLKILFENAQMNIREFISNSEEVNNQIPEKDRLLKENPKVLGINWCIKRDTYIINFPKMHENEKLSRRLVLKELNSIFDPCGWLAPCLLPAKIIFXSLWEEERKWDDNLNIDKINAWKAGMGARKFKSLVKPSSSTTENGXKSSAIISEIFCSNNASFSLPDSHFSK

SEQ ID NO: 132106 - protein, 27 aa, Heterodera glycines
  Coding regions on vcDNA: vcDNA=SeqID_58529; Strand=-; Position=1 -51,229-261
MYFSFPVAITTPAPTAPVFKYVFEAFF

SEQ ID NO: 132107 - protein, 123 aa, Heterodera glycines
  Coding regions on vcDNA: vcDNA=SeqID_58530; Strand=-; Position=1-370
MSGPIRMRINPSLRKLTERLVEIRPVIDAQQRDPEGIDLLRNSLVKIKRSVTFIDERIEQWRTYMTEIEVDERAAEEALFVNMNANQRHVTEWLEDAREAIDEIEIILVNEADDGSDTLSFEL

SEQ ID NO: 132108 - protein, 182 aa, Heterodera glycines
  Coding regions on vcDNA: vcDNA=SeqID_58531; Strand=+; Position=1 -237,694-1005
MIRRGFRDFSIDYTILIIIVIALLFLLVVTCVVYQKFKDRNNRVVNVDMNQRLVQQQQQQQQKESDRGVGGGRNLMGGKPNENIQWQKEPTDSRQWHAPNEEQPTEANKRQSPRIRLSPNQPQEGEEEEQEGKRDNGDEEGEERRNLGYEPKLGRGGGGDGSGPGAGAGREAADGEEEHGGH

SEQ ID NO: 132109 - protein, 200 aa, Heterodera glycines
  Coding regions on vcDNA: vcDNA=SeqID_58532; Strand=-; Position=1-600
MDYPRINESELAFPIPSGIIVSGPSSSGKTQLVLRLLRHANVMFDPPPKAIGMCKGGFCAVGCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLANQMFPREQGFLMDAYRQACALPYGYLL

SEQ ID NO: 132110 - protein, 86 aa, Heterodera glycines; identical to SEQ ID NO: 130750
  Coding regions on vcDNA: vcDNA=SeqID_58533; Strand=-; Position=1 -300,465-952

SEQ ID NO: 132111 - protein, 90 aa, Heterodera glycines
  Coding regions on vcDNA: vcDNA=SeqID_58534; Strand=-; Position=1 -132,741-878
  Homolog annotation: Hit_ID=CAE62837.1; Match level="QueryCoverage =95%, HitCoverage=45%, E-value=1e-16, Identity=46%"; Hit description =Hypothetical protein CBG07016 [Caenorhabditis briggsae]
DKPEIELTCKTHLHVDQMFKDVLDKKYDAVVMPGGSPGSNKLAEDPRVGDVLRKHQEANAVVGAICGSPLALVAHNVARGATLTSHPSIK

SEQ ID NO: 132112 - protein, 269 aa, Heterodera glycines
  Coding regions on vcDNA: vcDNA=SeqID_58535; Strand=-; Position=1 -120,181-246,693-905,1583-1990
  Homolog annotation: Hit_ID=CAE56807.1; Match level="QueryCoverage =50%, HitCoverage=16%, E-value=7e-11, Identity=29%"; Hit description =Hypothetical protein CBG24620 [Caenorhabditis briggsae]
MEEDNAGDIIKWLYKDSTKLDCSSEKVKVTSEHLHSKLCQVKLRGNLLGFKPLDFASEPFLISHNFPSRQIKCQEVMYESKLSMVVPREILRLSHKWATELRDELLDKLWGVKNAAILETLHNAIRHLNSNIEMHEQIIDFVNAFPNIFNLVDSLCEGGLAQLQHKGADSVPKDSLRNQMDNLNAQFESLSSKMVAVERIATANDRSQNLAECEQSARAAVHSTLDALHNLTCSLSSGQFLALVQSLRKASDCQTFFHLQLRSDALLSL

SEQ ID NO: 132113 - protein, 192 aa, Heterodera glycines
  Coding regions on vcDNA: vcDNA=SeqID_58536; Strand=-; Position=1-576
  Homolog annotation: Hit_ID=NP_608540.1; Match level="QueryCoverage =98%, HitCoverage=62%, E-value=6e-24, Identity=36%"; Hit description =CG2839-PA [Drosophila melanogaster] gb|AAF51469.2| CG2839-PA [Drosophila melanogaster]
MGGEERKGREEEEQEEEGREEVKIKEEGEKKKRKEIKSEENGWRGGGKKREVTGREGMGGEERKGREEEEQEEEGREEVKIKEEGEKKKRKEIKSEENGWRGGGKKREVTGREGMGGEERKGREEEEQEEEGREEVKIKEEGEKKKRKEIKSEENGWRGGGKKREVTGREGMGGEERKGREEEEQEEEGREE

SEQ ID NO: 132114 - protein, 60 aa, Heterodera glycines
  Coding regions on vcDNA: vcDNA=SeqID_58537; Strand=+; Position=1-182
MISLNEASGLRGRLKVCDGNLSLLREKLATDPDSYAEEFNEQFEHFKRLLKLLELQPVLH

SEQ ID NO: 132115 - protein, 74 aa, Heterodera glycines
  Coding regions on vcDNA: vcDNA=SeqID_58538; Strand=+; Position=1 -106,571-689
ELEDLDPENSGWKYWEKWEERRQQQMLRHDELKYLVPHYSRDDAGRLFEAYASTASQTAGVEVVGRVGANDEGK

SEQ ID NO: 132116 - protein, 70 aa, Heterodera glycines
  Coding regions on vcDNA: vcDNA=SeqID_58539; Strand=-; Position=1 -12,251-451
MWLNAGRKCLLLSDSSMVLASSDPSGSQSVANMAATSAPVVHLSNAEPELFAELLSRGFVQKSVKIRNQN

SEQ ID NO: 132117 - protein, 94 aa, Heterodera glycines
  Coding regions on vcDNA: vcDNA=SeqID_58540; Strand=-; Position=1 -43,361-602
MGNFWEKDRTIFSFYVSAKHSEFPVPSARSLLDGRFSPRRSHVVTTPAEDSASYDQQFFDNPLHLKWADRTQQNNDYADDDNNQMTSVRKMTLS

SEQ ID NO: 132118 - protein, 152 aa, Heterodera glycines
  Coding regions on vcDNA: vcDNA=SeqID_58541; Strand=+; Position=1 -22,179-615
  Homolog annotation: Hit_ID=EAL45620.1; Match level="QueryCoverage =82%, HitCoverage=12%, E-value=2e-10, Identity=30%"; Hit description =calponin homology domain protein, putative [Entamoeba histolytica HM- 1:IMSS]
MSINVIRNGIAVKRGGRISEEVEEKARTSTLRVQQSLTESEKWKSGTSDDDPVGPQEWEENEEETMKKGEEMKKKEEEEKKGREGKEKETEKKKEEMKQKDETETKRSLSVGTTKDDEISIVDSEERERDAFENPPKPTNERMAFLGVDFEQ

SEQ ID NO: 132119 - protein, 85 aa, Heterodera glycines
  Coding regions on vcDNA: vcDNA=SeqID_58542; Strand=+; Position=1-258
MRLIGRTQTFQVDEEAEEGEDEAKESVEMSYRLNGFTNSTKFEVRVECEPGKVNEEMVGKRSDRNFQWHGPKGSAKTKKDAIGMD

SEQ ID NO: 132120 - protein, 514 aa, Heterodera glycines
  misc_feature (444)..(444): Xaa can be any naturally occurring amino acid
  Coding regions on vcDNA: vcDNA=SeqID_58543; Strand=+; Position=1 -106,309-388,437-568,612-689,784-948,993-1128,1174-1217,1262 -1328,1381-1557,1599-1634,1682-1760,1861-2057
  Homolog annotation: Hit_ID=CAE60636.1; Match level="QueryCoverage =93%, HitCoverage=84%, E-value=1e-110, Identity=44%"; Hit description= Hypothetical protein CBG04280 [Caenorhabditis briggsae]
KEIVSQLCTKLTSASADEIEALPGLGTAPNFKHYSGYLKSADKHFLHYWFVTSQNDPCRDPLVFWFVFWFNGGPGCSSLGGLLEELGPYLVNSDGRTLRLNPHSWNKNASVVFIESVVFIESPVGVGFSYSADEERVMSGDETAQGNYEAVTAQGNYEAVKQFFLKFPLFRTNRVFITGESYAGIYVPTLVAKIVDGQADFPINLEGMAIGNGFMNEAIDTDTLAGMAIGNGFMNEAIDTDTLARFAYFHGFVGETEWNAIEKHCCGGCADNCNLGEQFGECRAMNCNLGEQFGECRAMVRDIILFCWVRDIILFCWTGGINVYDIYRDCFPQHSKMAAIPQHSKMAAIRRGILRAKISFKRHESLGGNFLTSLIRLLKQPLEEIIRGGAPCLDDHAITNYLNTPRVHAITNYLNTPRVRETLHIPRETLHIPPNVPNWESCKXKMSGHKPKILADMSPFVRKAINANLRVLLYSGDTDMACNFLSGQHFSAQLGLAVAWFFLAFNHFLLTDNR

SEQ ID NO: 132121 - protein, 247 aa, Heterodera glycines
  Coding regions on vcDNA: vcDNA=SeqID_58544; Strand=+; Position=1 -165,209-548,614-814,886-921
  Homolog annotation: Hit_ID=NP_494846.1; Match level="QueryCoverage =100%, HitCoverage=44%, E-value=8e-46, Identity=42%"; Hit description= protective protein for beta-galactosidase precursor (53.6 kD) (2F29) [Caenorhabditis elegans] gb|AAC4681
TAQGNYEAVKQFFLKFPLFRTNRVFITGESYAGIYVPTLVAKIVDGQADFPINLEGMAIGNGHMHTSMNFDTMARFAYSHGLLAESSWKELENECCRGCVGGKSVSYKWITKKGRLQILAIWVYCTENATERYGNHLLKWQPNALKVLNIMRFVWRGGLNVYDIYRDCDHQPNSKRMKAIRNGIFKSANKTDRWNIIGEELDAKAGKVGSLSKSDNLKENEIARESLREIKPCANDEESAQYLNTPK

SEQ ID NO: 132122 - protein, 515 aa, Heterodera glycines
  Coding regions on vcDNA: vcDNA=SeqID_58545; Strand=+; Position=1 -6,1008-2549
  Homolog annotation: Hit_ID=NP_494149.1; Match level="QueryCoverage =80%, HitCoverage=27%, E-value=2e-52, Identity=33%"; Hit description =predicted CDS, putative protein of ancient origin (2C297) [Caenorhabditis elegans] gb|AAF39854.1| Hypothe
MKIINSYIIPAKIMVRKKQIFSKERVESSREKSRYDGFQAPEKSGNNGFQAPDKSGTDIQTQTMKIFEKKDYDIGIEETIEIINIDDDELSDYSDIQSSSQINNTTLRKMKQRKKMNIDQKESEKQKNRERMALNRKFFLEESQAEKQKNRERMALKRKIFLEESQAEKQKNRERMASKRKKGLNEKIESYICADSLSVRKHKLGPMNNECVHCHSLNFSEEIVAGKKSEFKNCCHYGKVLISDFPEKNFPVGLKNLFIRNDVKCRMFFENIRYLNSTLSMASINPLRYKFKHNRGPYCFRISGQIFHKMNIALLPDEKEEPTNGQLFIVDTGDAVNLMKQSNSKIDNDLLNYLYNLIKSENPFAKAFVMMKEEEDAEKERAKQEGREPIEMKLLFGLAPNMDKNRYKLPRANEVAVVFVPGADGEIPESKIVVRERGKELKILDSLDKNVTPLCYPLFFPRGTPGWHPEMKQTNGYKSLTRLQYAGCCMAVRCEFNPMLFGGRLFQQWGADEYV

SEQ ID NO: 132123 - protein, 136 aa, Heterodera glycines
  misc_feature (131)..(131): Xaa can be any naturally occurring amino acid
  Coding regions on vcDNA: vcDNA=SeqID_58546; Strand=+; Position=1 -187,392-464,539-651,1363-1387
  Homolog annotation: Hit_ID=AAG23825.1; Match level="QueryCoverage =99%, HitCoverage=11%, E-value=3e-66, Identity=94%"; Hit description =guanylyl cyclase [Heterodera glycines]
KLGQSVEPEQFECVTVFFSDIVQFAALSNQMRPLHVVNLMNELYTTFDAIVDEHDVYKVESIGDGYLCVSGLPNRNGNLHAKQCADMALKFALKFLNSLQSFRISEHSDQRIRLRIGLHSGPCVAGVVGLXKSRFA

SEQ ID NO: 132124 - protein, 35 aa, Heterodera glycines
  Coding regions on vcDNA: vcDNA=SeqID_58547; Strand=-; Position=1-106
NKDEFLSKLPFAKVPVFVHDNLVLSESMAIIEYLD

SEQ ID NO: 132125 - protein, 334 aa, Heterodera glycines
  Coding regions on vcDNA: vcDNA=SeqID_58548; Strand=-; Position=1 -675,1203-1529
PWLSSTRPPTPPPGPSSSSTYARARHNTQQQQQQPRSSPPPIRACSITAQRSMAAIVRQMNTNDAAVARDERRSRERRRLRQLNAQPRQGRRLSTPRSSRGRNTLSPRPPHNVITIDESDAEEEALGVAQQQPLADEDQHFYDDEMLTIEDQIAQGLVEGAANEVVMMGNHPLAAADRVWMIGTAFEMSTLPSSVKGIVEHDEAGRRNLMCCICHEWIIGGGQRVCNAWRQIGRGRPSFTDQSDHDSSSTNGSDHQQHVSGAPPMRDSRDPAVSNLGSSSSSGSAAESANVAPSDDEADAGEADGQRLNRFCKVIGAWERTECRSRNTRCEAVE

SEQ ID NO: 132126 - protein, 241 aa, Heterodera glycines
  Coding regions on vcDNA: vcDNA=SeqID_58549; Strand=+; Position=1 -102,201-430,1293-1516,1856-2025
MAFSKQFAVFIFLLLQHSIRSQQQQQQQQNVIEQQSPSATAAEQTLPLSELHNTLNQFLYQLKQTGEKVVAQTPQIASPLLFNAAAAAAAMGQQQQRHSAGDGGAATAGGGQTPEQQNTVSDDPPTTVSELENTVHDDGHATVAATDVNANTRQQQQQVVAAAVVPPLAVPIEIETTNDTSPNVTALTAVDLEAFLRSANVARILSTWVSDQSLTDPLTVQKFGHQFLADRSDLAIFSNGF

SEQ ID NO: 132127 - protein, 68 aa, Heterodera glycines
  Coding regions on vcDNA: vcDNA=SeqID_58550; Strand=+; Position=1-204
MTSSQDTKLFLALVERVLEQEVARRLAEQQPNNNNNNGDSNNSEYGDNSTQRMSPPQHNHAAAVNTAV

SEQ ID NO: 132128 - protein, 73 aa, Heterodera glycines
  Coding regions on vcDNA: vcDNA=SeqID_58551; Strand=+; Position=1 -73,253-401
MAASDVFEAMFRFDSANATTSTSKPPSDLASSSNPVVVSDVDADVFRAMLGFIYADDLSGMNGDNLFDVLYAG

SEQ ID NO: 132129 - protein, 36 aa, Heterodera glycines
  Coding regions on vcDNA: vcDNA=SeqID_58552; Strand=-; Position=1-110
MWILIEKSKILFENHLLRHSFSMSLLPHLIFVGLSH

SEQ ID NO: 132130 - protein, 18 aa, Heterodera glycines
  Coding regions on vcDNA: vcDNA=SeqID_58553; Strand=+; Position=1-58
PVNSCIGCKCRRCCTPNS

SEQ ID NO: 132131 - protein, 52 aa, Heterodera glycines; identical to SEQ ID NO: 128760
  Coding regions on vcDNA: vcDNA=SeqID_58554; Strand=-; Position=1-267

SEQ ID NO: 132132 - protein, 164 aa, Heterodera glycines
  Coding regions on vcDNA: vcDNA=SeqID_58555; Strand=+; Position=1 -73,129-151,317-526,590-778
MASVDENEQLVQEIVGNVLSESAKDHQQEEGTEHQLMDEVVKMDSTDAEAEDHGGIGHEVAISVSDVKQEGYAVESPVGEEEEKETEGQNDGAMRQIADKVGGLSLDEDKTANTDAVVEPPMATEEKAADVGNDKPSGENLNEENNESKVGTNGVHLTLKPFFV

SEQ ID NO: 132133 - protein, 150 aa, Heterodera glycines
  Coding regions on vcDNA: vcDNA=SeqID_58556; Strand=-; Position=1 -26,1032-1128,1271-1405,1755-1949
  Homolog annotation: Hit_ID=NP_871815.1; Match level="QueryCoverage =76%, HitCoverage=33%, E-value=2e-16, Identity=39%"; Hit description =DeHydrogenase, Short chain (dhs-2) [Caenorhabditis elegans] gb|AAO38639.1| Dehydrogenases, short chain pr
MLRIRSANSYFSQEINCFPFIKMILFLPLLVFIYYALRYLWELIPLQNASKRAVFVTGCDSGFGYLLALKLAQYGMLTYAGCLTKQGRDELIEEAKKRGIAAKLKTVPLDITQDQSVNDAADFVRKDLNSVGNIGELLFCPGLILIFFLI

SEQ ID NO: 132134 - protein, 52 aa, Heterodera glycines
  Coding regions on vcDNA: vcDNA=SeqID_58557; Strand=+; Position=1-157
MSQIRRRRSSLMGWAAAATGAMLLMSFTSITLLIERVQAKPSTPVGGPYSEH

SEQ ID NO: 132135 - protein, 176 aa, Heterodera glycines
  Coding regions on vcDNA: vcDNA=SeqID_58558; Strand=+; Position=1 -166,615-734,830-949,1060-1184
  Homolog annotation: Hit_ID=CAE75327.1; Match level="QueryCoverage =61%, HitCoverage=62%, E-value=1e-24, Identity=39%"; Hit description =Hypothetical protein CBG23305 [Caenorhabditis briggsae]
MLFLPRLGTNCRLCPLALGKIVIVLLHFVCFIKVVDGEDEHQQQQLQIDHGGAEQSSCQPFIYKGCAGNLNRFISATECRKTCSKLSKKTQEWVLAERCNASHLIPDGHYIECVAGKCPEGHKCHPADGICCPRKEYVCSLQDNSGTFADGVPDKPRFAWSADIKVLLAFLVLSTA

SEQ ID NO: 132136 - protein, 21 aa, Heterodera glycines
  misc_feature (4)..(4): Xaa can be any naturally occurring amino acid
  misc_feature (8)..(8): Xaa can be any naturally occurring amino acid
  Coding regions on vcDNA: vcDNA=SeqID_58559; Strand=+; Position=1-98
IFFXLFIXLNYVKILNRLFQE

SEQ ID NO: 132137 - protein, 343 aa, Heterodera glycines
  Coding regions on vcDNA: vcDNA=SeqID_58560; Strand=+; Position=1-1032
MLNRNKAKSVQTGPNPEFPERSKAKFVQMETNPQLTDGSEGNSISQKSTNLRRLKSESNTDKRRFLESKKENLRMADSSRDYGPRHRQFPGHEISPNRSQRYHDHYHTHSTRYAPEISSSRSQRYYDHYHTHSTRPSYRRNSSPDRQSSAIQQGSQHSENYSTTDADRNGRDSSQQHHQHYSHPSSSKSQRSYSSPDQKRASSSESRRTNYSSSLDQYIDPQSAQAQIIQNPTQDDQTSEHSSKETNQQKQPVYEQNLENQLYDPLQPSSLTTNAQAYNQPKLLQTSHASHGQPMFLPMNYHQPLLQAQAVNVSTQPAGFPLHAYPLQNPTQTNFIYQSGMLT

SEQ ID NO: 132138 - protein, 305 aa, Heterodera glycines
  Coding regions on vcDNA: vcDNA=SeqID_58561; Strand=+; Position=1 -267,314-646,690-767,920-993,1043-1207
  Homolog annotation: Hit_ID=NP_501620.2; Match level="QueryCoverage =63%, HitCoverage=13%, E-value=3e-36, Identity=42%"; Hit description =myosin head  and M protein repeat (4K47) [Caenorhabditis elegans] emb|CAA21588.2| Hypothetical protein Y1
MPCLLVPVCVGSARLLPRGEGMGARVGHGVRSHRRGAIWRTARHGHFLCGGNGRCIHCQMRKYLSPKSRERFTEVEAVAELLGIRANALTFTILDSLITSVQPSIRVGDALIRRSQPLRKTLCAAQSLAKCVYERLFSWVLSKCNSAIRRGRTGSGQSDETDGGREANGMVGVLDMAGFEIMPCNSFEQLWFGCASSNPKQFFNEFMFIREQEEYLREGISWEFVKPLGILSLLQEECIVPNGSDQSLLDKPNNPIGNQQLFFPMCTEQISPHQTECQPPITSQSPIMPAPSVIPWTDGWRRTET

SEQ ID NO: 132139 - protein, 394 aa, Heterodera glycines
  Coding regions on vcDNA: vcDNA=SeqID_58562; Strand=+; Position=1 -145,195-358,398-520,567-613,666-796,858-934,983-1204
  Homolog annotation: Hit_ID=AAL06641.1; Match level="QueryCoverage =85%, HitCoverage=35%, E-value=5e-68, Identity=45%"; Hit description =serine-threonine protein kinase [Ancylostoma caninum]
LIFSFFEYCNGGEMFDYIVKKERLTEPEARHFFRQLVQAIAYIHSMGFAHRDLKPENLLLTFAHRDLKPENLLLTNEQQLKVIDFGLCARPLKGLDAVLETCCGSPAYAAPELLQNSYYFGNEADIWSMGVLLYTLLCGCLPNSYYFGNEADIWSMGVLLYTLLCGCLPFDDASYPRLYQKIRRGVYLEPDYLRGVYLEPDYLTSETKEFLRCMLTVDPKQRANIRFLRCMLTVDPKQRANIRQILTHPWLNKSYRQQIKWQSIYNVLFLDADVCQELAYFYGDADVCQELAYFYGSEKEEVIAQVKQWKYDSKTANYLIWKYDSKTANYLILLQKSKLSNRFSDLFVYFSRGAETEHCVALPQKSSVSFNLLVLIVLFLKSFQLVKRPSSLTI

SEQ ID NO: 132140 - protein, 56 aa, Heterodera glycines
  Coding regions on vcDNA: vcDNA=SeqID_58563; Strand=-; Position=1 -39,452-583
MAFALFWLSGMCTGKTMRKNVAKITIRRNERRKINLITRTMIDERSRMILFCCCCC

SEQ ID NO: 132141 - protein, 25 aa, Heterodera glycines
  Coding regions on vcDNA: vcDNA=SeqID_58564; Strand=+; Position=1 -73,547-551
MTQMANRQPKRLIVIKSNINTTPAK

SEQ ID NO: 132142 - protein, 78 aa, Heterodera glycines
  Coding regions on vcDNA: vcDNA=SeqID_58565; Strand=+; Position=1 -31,132-250,288-373
MSPLLTVHFQCEVCGQILSIHFLYNALLHLSLTIFYVAPLFQRLLFGIYSFRRIANIFTTFRLIMEKIMHIKGIKKCY

SEQ ID NO: 132143 - protein, 131 aa, Heterodera glycines
  Coding regions on vcDNA: vcDNA=SeqID_58566; Strand=+; Position=1 -127,277-292,820-1072
MSLLKSVDSKLGDEILATIVETTDIRLDDIEGNAMAKLALEESKSRGEKIAAMTDNYSYSDLKALCRAAALFPVQSARMENRDLRRCTAEQLRPVNVADLENAIRSVRPSINAESRKKLIGFAENHANQQT

SEQ ID NO: 132144 - protein, 175 aa, Heterodera glycines
  Coding regions on vcDNA: vcDNA=SeqID_58567; Strand=+; Position=1 -286,445-512,563-736
  Homolog annotation: Hit_ID=NP_732735.1; Match level="QueryCoverage =62%, HitCoverage=53%, E-value=9e-34, Identity=53%"; Hit description =CG31170-PA, isoform A [Drosophila melanogaster] gb|AAF55991.2| CG31170-PA, isoform A [Drosophila melanoga
MARRYMIMFDSLKEQQEGEVRSTEAMSELVGFGASELKMEHNLLKLQGIASFTKSVQQTLNSYEVRKLGDKVQGYVMNFTETEQKVREATNEDPWEVMGMLWKRMFQENKLAWRRVYKSLVLLNYLIKNGSERVIRTARDHVFEMRSLENYKCVDERGKDEGMNGLSEFGWPFVG

SEQ ID NO: 132145 - protein, 215 aa, Heterodera glycines
  Coding regions on vcDNA: vcDNA=SeqID_58568; Strand=-; Position=1 -193,246-427,495-767
  Homolog annotation: Hit_ID=NP_499652.1; Match level="QueryCoverage =88%, HitCoverage=57%, E-value=1e-42, Identity=46%"; Hit description =endoplasmic reticulum UDP-Glc UDP-Gal transporter (38.4 kD) (3N803) [Caenorhabditis elegans] emb|CAC35849
MLFGVLFAHKRYGLRKYFYVLLIVTGMAIFLYKPQKGSVGFQLGSGELFLCLSLAMDGFTGAVQDRIRHYHTTDKWTMMFSMNAFSSAFLTLILLASGELFQFFRFVAAYPFILQQMLLFSLSGACFIFKTVTDFGPLTCSIITTLRKLFSLVFSIIIFSHPYTNRHVLGIIFVFAALILDAIDSRKSHGKAKGDEKPPAKDGLLQEATAQEKEN

SEQ ID NO: 132146 - protein, 108 aa, Heterodera glycines
  Coding regions on vcDNA: vcDNA=SeqID_58569; Strand=+; Position=1-327
MDPSKGFYNREEEKLTLAIDVTVKDEKMDKFILEQSNSNGTIWMDIEKVSEFAQEVTWSERKSEAVHINGFSLRILAQISPKNGSTGNEKLLGIYLLCASPTEGVIKG

SEQ ID NO: 132147 - protein, 86 aa, Heterodera glycines
  Coding regions on vcDNA: vcDNA=SeqID_58570; Strand=+; Position=1 -95,163-328
MEIFDEFTISDENSISFFTDSKFLMESSFAAIEALLDSFWLKFKDVGNVLEQNVPLAQIILWAWDDNGAQVIKEVITDQNAVSQNS

SEQ ID NO: 132148 - protein, 46 aa, Heterodera glycines
  Coding regions on vcDNA: vcDNA=SeqID_58571; Strand=+; Position=1-140
ISKNIMVNKFLPLIIFVFLLIDTAICRHHHRHSHHHHQQNEQPEMI

SEQ ID NO: 132149 - protein, 324 aa, Heterodera glycines
  Coding regions on vcDNA: vcDNA=SeqID_58572; Strand=+; Position=1 -396,443-726,772-1065
  Homolog annotation: Hit_ID=NP_507780.1; Match level="QueryCoverage =97%, HitCoverage=21%, E-value=5e-23, Identity=27%"; Hit description =predicted CDS, DNA polymerase type B, organellar and viral family member (5T899) [Caenorhabditis elegans]
MQHEPADPHFPKRKKHQVNFVTAKVACPDCISTGKWKESLIGKFCKICGYHPTITFSQMPFRETTVDRQTIDRHPLVAFVKWLLYKLPNQYETIAYSHFGGRFDMVLVFRELFMEGLNPSMIRKGNRLFEMRVKSRKNLNPNVTFRDSWNLIPGLLASMVPMFGLDVQDKPFFPHMANKPDNYGCKILPAKADYLADGMIPEKRKQFDQWYQQNKNIPFLLDEALASYCKNDVDILMAGLIAFRGEFLEMTKRPAGLDGKADRAAYKTAHNGIDPVRHCVTIASACMRHFRTNHLKPGHLALVPEKGYDSCGDNQSELALNFMQ

SEQ ID NO: 132150 - protein, 646 aa, Heterodera glycines
  Coding regions on vcDNA: vcDNA=SeqID_58573; Strand=+; Position=1 -577,1227-1919,2014-2150,2197-2286,2531-2743,2997-3227
  Homolog annotation: Hit_ID=NP_701342.1; Match level="QueryCoverage =77%, HitCoverage=37%, E-value=4e-22, Identity=22%"; Hit description =MAEBL, putative [Plasmodium falciparum 3D7] gb|AAL10509.1| erythrocyte binding protein 1 [Plasmodium falc
MNEDNAKDRLEEFIGAEKTEKAQLLLRLNGEEYKGFVKEMKEKEKLEKSEEEKERNKKKREEADEIMRKLIEEERKKEELKKRMEEMQREKKERRLKQRELQRMKEKETEMDNGDGREQQNEDREASEGSQSEENSSSLAESFVITPKSVPKERKNGIFENKEQNGEKEKKENELLFGREEWQNELDKTKLIDFTSDQFLHEKIDAFLQNPSETKKHMLDIGVFVNELRHRMEMIRQLSKFEGNLEMEQAEIAVKIERMAKIDEKWTQLKRELMRDNLIRDRTQFEGVISKMYRLLKQMISIGEAKELQEEKEERKMVANQLATVGRESNAEWEEDTVEDREKAAIKSVKIQLHKNKLAKAIFSKEKRANENAEKNTFWEMDREQKSEILMELFEYERRKTKMISRFEEHLEGWQKLEEQQEIDRNLRGQKNAQQIYFDFARPHLEVNFPEISQQIRNDQLENIQQKNMFTDFIKEIPKSDANSVGAAFDTLKSIIEKWSNGAARLIVSGSHFLGTRTADSDIDAICVVPQKESLRGEREKFLGFFNCVLTIQREQRICSDNSLHCQFCKHANVEYLTKFPSVHIQLIKLKLLGVEFDLSLVSVPDMELLPDEPLEAVDVELMMEMIANQRVPSEVMLKTMAGKRI

SEQ ID NO: 132151 - protein, 87 aa, Heterodera glycines
  Coding regions on vcDNA: vcDNA=SeqID_58574; Strand=+; Position=1 -181,233-315
MPVKLTQQIGTTFDAFAWNTSADGQKGALMPIITPGKLAQNCAINVNESTIKILQDEMREAHLYLTKRTAANFGQLFSQRNFVEKVG

SEQ ID NO: 132152 - protein, 90 aa, Heterodera glycines
  Coding regions on vcDNA: vcDNA=SeqID_58575; Strand=+; Position=1 -131,465-606
MAPTTRLMQHKVVCMCHGSVPNWRPKVAKGCCTSDANRSALCRSVSNGRFLIGTVRQDNCWQLEVTEEEKRTIWTRFVDLQPNFRVIEKS

SEQ ID NO: 132153 - protein, 41 aa, Heterodera glycines
  Coding regions on vcDNA: vcDNA=SeqID_58576; Strand=+; Position=1-127
YDPTGITHVRLSPMEKLQDQMLEAAKERGTRDSKGYWVGKQ

SEQ ID NO: 132154 - protein, 244 aa, Heterodera glycines
  Coding regions on vcDNA: vcDNA=SeqID_58577; Strand=-; Position=1 -93,139-284,366-531,999-1147,1198-1378
MAGPDSRFILEFFNREAKEIGVTQELLDNSQPSDQLIQAYYFLCDLIFENVGTTKENEYEMATELTRARPQMIIRTQQHCNLVYNKLFDGSNEFLYSDLFQPDPCRTKMQIAQLIRLYTTKCDIAKELSAVDNHIDECKKLFAQEEENRKRLDNNIVNSPERIIEELSNMEVEVEDIRRKNDQAVQNDRKLEREYGEQLVTSKCVESLINSMQQLEMMQEQMVEMRAKEEERRKVVPFGDLIPV

SEQ ID NO: 132155 - protein, 73 aa, Heterodera glycines
  Coding regions on vcDNA: vcDNA=SeqID_58578; Strand=+; Position=1 -141,516-596
MGQIKKLMCLCTSTNSWLSNDPGLFGSGPGKCPKKGGQATSTLVAISELVQVANELDNEEDTLTLEADIQITN

SEQ ID NO: 132156 - protein, 56 aa, Heterodera glycines
  Coding regions on vcDNA: vcDNA=SeqID_58579; Strand=-; Position=1 -159,333-344
MGQSEKLMCLCTSTNSWLSNDPGLLGPGPGKCPNKGGQATSTVVAISPKKKENFFH

SEQ ID NO: 132157 - protein, 78 aa, Heterodera glycines
  Coding regions on vcDNA: vcDNA=SeqID_58580; Strand=-; Position=1-573
KFTEFSQFALDKKRWPLANNTFTKICSRFLISFSFLSRHMDIHSSPSCFVLFSAKSAGQKECHHNAKPMNGNWLILKT

SEQ ID NO: 132158 - protein, 371 aa, Heterodera glycines
  misc_feature (347)..(347): Xaa can be any naturally occurring amino acid
  Coding regions on vcDNA: vcDNA=SeqID_58581; Strand=+; Position=1 -105,644-754,1555-1903,1939-2068,3216-3357,3761-3988
  Homolog annotation: Hit_ID=CAE66996.1; Match level="QueryCoverage =87%, HitCoverage=90%, E-value=4e-62, Identity=34%"; Hit description =Hypothetical protein CBG12394 [Caenorhabditis briggsae]
KETEEQFDQMPWHLLAHHAALGWSQWSEWSACTRKCGGEGMQFQLRRCLDMYCSGPSSRHRICAEKVCLLHKRLIPYTNCGGLYCISVVEGYYRIAIVEAYTVHQLWGIILCSSGGKVFFLSGRCRSVGCDGIVGSSAREDQCGVCAGDGSSCADELFQWRDTGHFSPCDKSCDRTVRQKGGGEGGQSIRVSVSVCVNIHTERVVPEIRVSVSVCVNIHTERVVPERMCADRVRPRPQIRRCEHIVCPAKWFAGEWADCSVTCGTGQQRREVFCVERVDANVDRRVNVQHCLPSQKPVDVRKCSSEACPEWWAGEWGACSANCGRGVRRRTVGRAGGGKMPNKNLNXCKSNANKAIRMPKILIFGGVYGGN

SEQ ID NO: 132159 - protein, 114 aa, Heterodera glycines
  Coding regions on vcDNA: vcDNA=SeqID_58582; Strand=-; Position=1 -336,1217-1225
MPENLKFSTQNLHRFHSSVSSSLLSSLYGAAATTESDSTKTEDSKRNNEANCKLQYGDDGNIMPKRAENQGENGQERTEQNGVGPRTLVLATAWLNPIDRELPKMPELKGTKVI

SEQ ID NO: 132160 - protein, 53 aa, Heterodera glycines
  Coding regions on vcDNA: vcDNA=SeqID_58583; Strand=+; Position=1 -110,347-398
MPRHCTITGSAARAAVRFMRAMFISGRNNRILSSMPRLYAFSKFQISNFHFNI

SEQ ID NO: 132161 - protein, 113 aa, Heterodera glycines
  Coding regions on vcDNA: vcDNA=SeqID_58584; Strand=+; Position=1-342
MDTENWGGNGTKITKTPSKTPTQPQRTRNKSSSNETSDSEVQTTAARPSTATPGKAELKRRTTEDTSDSEAETPAKSKVLARATPKKQQKEAETAKKPAPKPTEGTSSEDSSG

SEQ ID NO: 132162 - protein, 55 aa, Heterodera glycines
  Coding regions on vcDNA: vcDNA=SeqID_58585; Strand=-; Position=1 -81,122-209
SVEALKTNWPKSKWSYDSTRGGSDCLRTNWRMPTWPMLMEYENGWPYKRNDPPKG

SEQ ID NO: 132163 - protein, 152 aa, Heterodera glycines
  Coding regions on vcDNA: vcDNA=SeqID_58586; Strand=-; Position=1 -149,213-431,805-893
  Homolog annotation: Hit_ID=NP_741269.1; Match level="QueryCoverage =76%, HitCoverage=19%, E-value=9e-49, Identity=76%"; Hit description =coronin (67.1 kD) (cor-1) [Caenorhabditis elegans] emb|CAA83461.1| Hypothetical protein R01H10.3a [Caenor
MSANCAGVKPQRAIFTKDGRVFSTGFTKRSERLYALRHPDNLSQPIMQDELDTSNGVLFPLYDEDSGLCYLMGKGDCAIRYYEINEDPPYVHYINTHTTSEPQRGFAFMPKRGMNSLENEINRKRDSIKPTRTSARTADAKAGAPSAAASRA

SEQ ID NO: 132164 - protein, 25 aa, Heterodera glycines
  Coding regions on vcDNA: vcDNA=SeqID_58587; Strand=-; Position=1-75
TCTCGVVVKLSTFHNFSPGFNSPLG

SEQ ID NO: 132165 - protein, 264 aa, Heterodera glycines
  Coding regions on vcDNA: vcDNA=SeqID_58588; Strand=-; Position=1-792
  Homolog annotation: Hit_ID=XP_320889.1; Match level="QueryCoverage =93%, HitCoverage=30%, E-value=9e-16, Identity=28%"; Hit description =ENSANGP00000012033 [Anopheles gambiae] ref|XP_313651.1| ENSANGP00000013044 [Anopheles gambiae] ref|XP_314
MATAKTNARTRTQNAESECGNVGHWAVICKTKQGSNWPRRQGKPVNQVNTECQKAHDIGTLAKSEEVKSISVPPAMIKLQLSKKATDFELDCGADVTLITKNDWMSIGRPKLGQTSGLMAYGKKPIKVLGSFKTDVVYNGKEVNAEIYVVDGEGKNLCGRDLIGELQIDLNKAFGIRSVNEVNSKAVNRELGAVLLKYGEVFNDGLGRCTRQISLKFKPEVQSKKCKPRPVPFALRPEVEKVIDKWVKDGVLEQVTTSERATPL

SEQ ID NO: 132166 - protein, 241 aa, Heterodera glycines
  Coding regions on vcDNA: vcDNA=SeqID_58589; Strand=+; Position=1 -96,155-192,253-331,390-451,523-595,644-757,805-869
  Homolog annotation: Hit_ID=XP_393286.1; Match level="QueryCoverage =91%, HitCoverage=13%, E-value=2e-46, Identity=47%"; Hit description =similar to chloride/bicarbonate anion exchanger [Apis mellifera]
IASMPALFYTILVMMDQQITAVIINRKDNKLKKGCGYHLDLLKGCGYHLDLLIISLLVLICSFLGLPFYVAALLVLICSFLGLPFYVAATVLSVMHVESLKENGDCTVPGSLKENGDCTVPGERQKLLGVKEQRLSAIEQRLSAILSHIFIGCSVFLTPLVKVVPLPVLVVPLPVLTGIFLYMGVVSLIGQQFVQRIALLFMPVKYQPDYVWLRNVPTKRPDYVWLRNVPTKRIHTFTMVL

SEQ ID NO: 132167 - protein, 45 aa, Heterodera glycines; identical to SEQ ID NO: 124814
  Coding regions on vcDNA: vcDNA=SeqID_58590; Strand=+; Position=1-331

SEQ ID NO: 132168 - protein, 190 aa, Heterodera glycines
  Coding regions on vcDNA: vcDNA=SeqID_58591; Strand=-; Position=1 -21,73-157,494-687,747-859,1030-1189
  Homolog annotation: Hit_ID=AAH71128.1; Match level="QueryCoverage =97%, HitCoverage=63%, E-value=4e-29, Identity=41%"; Hit description =MGC81473 protein [Xenopus laevis]
MAGKIFVVTGANKGIGYGIARGLAQQVNGATIYMTARTPSLGEKALDDLEKELGTKRISKLAFHQLDITDEKSCADFAAFLKKTHGGLDVLINNAGFAYKQNATESAAIQADVTIGVNYYGTKLISDQLGPLIRDGGRIVNVCSQAGVMGSQIGVMGNLYKQSLIDQFKRADLTSDDINTFVEEYKKWEH

SEQ ID NO: 132169 - protein, 76 aa, Heterodera glycines
  Coding regions on vcDNA: vcDNA=SeqID_58592; Strand=+; Position=1 -109,183-304
MGMGDTLLCKAIEPFRRLKLSTEEFVLIRAIIYSNMVSPGLSDQAQKLLLSEAEKYSSQLMSIVQVAFFLFCNWFS

SEQ ID NO: 132170 - protein, 68 aa, Heterodera glycines
  Coding regions on vcDNA: vcDNA=SeqID_58593; Strand=-; Position=1 -94,185-297
MHAFCARAIYHRACQSKAKQQRCCFERIKGIESVHRLLEKYICNLSTILRSELEMINFTIQTNFRCSN

SEQ ID NO: 132171 - protein, 77 aa, Heterodera glycines
  Coding regions on vcDNA: vcDNA=SeqID_58594; Strand=-; Position=1 -94,185-324
MHTFCARAIYHRACQSKAKQQRCCFERIKGIESVHRLLEKYICNLSTILRSELEMINFTIQPIFVALINRDKNIRIN

SEQ ID NO: 132172 - protein, 64 aa, Heterodera glycines
  Coding regions on vcDNA: vcDNA=SeqID_58595; Strand=+; Position=1 -134,194-254
MSRNELVGFLLRQIKFHPIFANNFFSSSDSGLIHWDASALAQGANLNPPTNGREMTGHESAAGW

SEQ ID NO: 132173 - protein, 42 aa, Heterodera glycines
  Coding regions on vcDNA: vcDNA=SeqID_58596; Strand=+; Position=1 -18,537-647
MTTENEIFHRQKLGCNAFWKTQLTLHKRQGSVVTGTYILLFL

SEQ ID NO: 132174 - protein, 95 aa, Heterodera glycines
  Coding regions on vcDNA: vcDNA=SeqID_58597; Strand=-; Position=1 -87,131-233,751-848
MAVRRRVAHHEAGHIMANHLNKHGTECLASDVVPEGINDGYTWIYFREKYTLAQVMATLQYFLELLGTLNDRNVHSTDRDGARLKKVNIIILTKH

SEQ ID NO: 132175 - protein, 154 aa, Heterodera glycines
  Coding regions on vcDNA: vcDNA=SeqID_58598; Strand=-; Position=1 -91,136-506
  Homolog annotation: Hit_ID=AAD24649.1; Match level="QueryCoverage =86%, HitCoverage=78%, E-value=2e-34, Identity=53%"; Hit description =unknown protein [Arabidopsis thaliana] pir||C84470 hypothetical protein At2g05580 [imported] - Arabidopsis
MRKLIILALLSLFFILVASEGKEGGDGAEGEEGPGQGGGGKEGEGGGEGGGEGGKGGHGTGGKGGRGGGGPGGGHGVGGGARGEEEGGKGGQGGGHGGGGEEDGGGGRGAGHGRGRGGARGGGHGGGGEEHGEGGGGGRAGGNGRGGRGGGIRE

SEQ ID NO: 132176 - protein, 64 aa, Heterodera glycines
  Coding regions on vcDNA: vcDNA=SeqID_58599; Strand=+; Position=1 -55,377-516
MPRFSGYFCLILSRFRRFELINQITQMNYTLICFSILLQFTLFWASICAADNGPPLTIKQLIYI

SEQ ID NO: 132177 - protein, 291 aa, Heterodera glycines
  Coding regions on vcDNA: vcDNA=SeqID_58600; Strand=+; Position=1 -133,262-1004
MKWLENAVMDESNGLNMKGIYEKILEEFDNRRHNQYSAERSFGMACSAEFFKLHSLNYLSQFVLRQIVQSALTSQANFMYKIFQTEMKHLYEELHIFLREHFGTVVGQIGISSREKGNDEIEDGETDGDGEDTTGESDEDSDGDEQQKQQQNQAVPAQAPRHRDQHERNDDGHGHGGRGKAEESAVAEEQPREQCQDELKHPKQIGEAALSEQQVEAVTEPTEAAAADKGGNGGWWVAEKLANLCNMATINKKGETREELRTLPTRTKCTMTWTKTNFEEEEKEGGGGNCG

SEQ ID NO: 132178 - protein, 129 aa, Heterodera glycines
  Coding regions on vcDNA: vcDNA=SeqID_58601; Strand=+; Position=1 -265,482-606
  Homolog annotation: Hit_ID=AAP30836.1; Match level="QueryCoverage =68%, HitCoverage=53%, E-value=4e-42, Identity=98%"; Hit description =putative gland protein G30C02; Hg-G30C02 [Heterodera glycines]
MAEVALFQMAMACMANRMDFQMADLAAPVSIQIAAGRIAFQMVDLAAPVAFHRWDITRADFTALGPAHLLEATDTEAVLVEENEKMTERFIFVPIDRLFISPLLLKMPTEPCQAYAKAIEQNKRGDTSA

SEQ ID NO: 132179 - protein, 32 aa, Heterodera glycines
  Coding regions on vcDNA: vcDNA=SeqID_58602; Strand=+; Position=1-96
MQIGDQLVEIDGESCIGMSHERAIGMIKERQC

SEQ ID NO: 132180 - protein, 25 aa, Heterodera glycines
  Coding regions on vcDNA: vcDNA=SeqID_58603; Strand=-; Position=1-79
KCHGTRKVLLGRVKCDGTRKMSWDA

SEQ ID NO: 132181 - protein, 120 aa, Heterodera glycines
  Coding regions on vcDNA: vcDNA=SeqID_58604; Strand=+; Position=1 -88,1479-1555,2144-2341
MRKFRQQILSLFHFVVLHILIAINSRIINALLKLQQQIAGNGQNNNAGEQIPFGELVRQGVTLGFALAGQNTTGWDEKTMRLVSPRFLSVVAEEEMASDNETVEKMENNRMKKVGTMPTE

SEQ ID NO: 132182 - protein, 62 aa, Heterodera glycines
  Coding regions on vcDNA: vcDNA=SeqID_58605; Strand=+; Position=1 -64,121-245
EAAGINEEAKKIADETEKEEKEVKTVPTIGTAADNGTRLNLTEIWKKSRGMYEKEVPKLAFN

SEQ ID NO: 132183 - protein, 68 aa, Heterodera glycines
  Coding regions on vcDNA: vcDNA=SeqID_58606; Strand=-; Position=1 -113,1346-1439
MAGLPMAPMQMHQMMAQRPPPPPQMGQMFAPPPPPMSRPSTAASVRLTDDDKFGACCWLMFCERMRTI

SEQ ID NO: 132184 - protein, 42 aa, Heterodera glycines
  Coding regions on vcDNA: vcDNA=SeqID_58607; Strand=+; Position=1 -34,104-198
MKLRKNYFCSNKNSLKTPGILKKSIPYIVQFILNKFSIKFLV

SEQ ID NO: 132185 - protein, 93 aa, Heterodera glycines
  Coding regions on vcDNA: vcDNA=SeqID_58608; Strand=+; Position=1 -97,165-349
MASCKSPISLLCMLLIMLLIDPCFNISLFNPASDDCVVAIRNRTQIPPGVSHSLLKINTILAFCLRFTNKNAIKTENTPLIIDSKIFKKYTPL

SEQ ID NO: 132186 - protein, 112 aa, Heterodera glycines
  Coding regions on vcDNA: vcDNA=SeqID_58609; Strand=-; Position=1 -179,1164-1222,1296-1396
MSGGTSFFPQPNHFLVVQRNGATWPPAAFGNGRPLGLVGRRPIRIFAGEIRKNTSKTIKSNLMFMVLLKFSKQNKIFESSLGNKKKEFVAAFRQKNDISPVLNSASGFNLQS

SEQ ID NO: 132187 - protein, 191 aa, Heterodera glycines
  Coding regions on vcDNA: vcDNA=SeqID_58610; Strand=+; Position=1 -126,303-471,526-594,641-709,874-1016
  Homolog annotation: Hit_ID=XP_395964.1; Match level="QueryCoverage =87%, HitCoverage=8%, E-value=8e-14, Identity=29%"; Hit description =similar to ENSANGP00000012828 [Apis mellifera]
MQRELALYEQRSNELTAKADQLQETLLDRERELDTLRDQFKKSLSDQTSRLNELEAELRARERLANVYKANSEAANAEIAELNDTEVRLQAQLKEAEQIVHSYTAEMERAAEEQKKTITEKDAEIKRLNDEVVKSTELLNAGFRLNRADEDLIQLSPAAAVASSLLKSGMSLTSIYAEHWSRGGRIGQEKR

SEQ ID NO: 132188 - protein, 241 aa, Heterodera glycines
  Coding regions on vcDNA: vcDNA=SeqID_58611; Strand=-; Position=1 -405,696-1016
MPPSNIHHHIGLTDPIVLPIRPPEQNTADTLMGELEKLGQSDGDEDVHGGGMSKRSLLLSEPVQIVITCIAPPVGAAPRFHHYQHWGYNERQLIRIRNVGDHFCLFHALIAARSYTDHDLTKMIAPQQQQCHQGDDRLYPGMYRIVLFEDRPEELPRPIWKGPMGRCFVVALFMSGGHFDAIKKVNCFFKLGRKYCIDCECVYTTDAKHTISCKSRCAQCTRGYFVGRVRKILFIVVVVVQ

SEQ ID NO: 132189 - protein, 82 aa, Heterodera glycines
  Coding regions on vcDNA: vcDNA=SeqID_58612; Strand=+; Position=1-520
ICQLVSKTIGLFQWWGFPISHRYEENKTTTPFYLPDELQSYCQNDTEILLKAIVQFRKILMRDITGGYDVLPISSTICQVKH

SEQ ID NO: 132190 - protein, 161 aa, Heterodera glycines
  Coding regions on vcDNA: vcDNA=SeqID_58613; Strand=-; Position=1 -279,331-537
MPCKKKLTEALYCESCDHHAVSPLNNLYLRIDLRDCEDIETSKQITAFSSTAVKYLGLKIDEFSRLAEQRPKKLASLLQSKIEETIALKLIVKAKGETLDWVISSIRVPEQVTAVDDSVDAQKGGSKDGNGNDGDDDDDIYTIDDAECTRMPPPKRPRKTE

SEQ ID NO: 132191 - protein, 361 aa, Heterodera glycines
  misc_feature (354)..(354): Xaa can be any naturally occurring amino acid
  Coding regions on vcDNA: vcDNA=SeqID_58614; Strand=+; Position=1 -335,372-1120
  Homolog annotation: Hit_ID=XP_497341.1; Match level="QueryCoverage =99%, HitCoverage=57%, E-value=2e-38, Identity=30%"; Hit description =PREDICTED: similar to submaxillary apomucin [Homo sapiens]
HWGLNYPSFQFPRFNPTSIPVTGTLFSCIPITGTQLSDIPVTGTQFSSIPITGTQLTIIPIAGTTSPDSSVSQPPRLNSPVTGTQFSCISITGTQLTSIPITGTQFSMSSITGTLFSSITGTLFSCVSITGTQPSSISITGTQPSSISITGTQPSSIPVTGTQHTSISITGTQFSRISITGTLFSCVSITRTQFLCIPITGTHSPASITGTQPSSISITGTQFSCISITGTQPSSISITGIAFQSLGPNLTWSFGIPITGTQFSCISITGTQPSSISITGTQFSCISITGTQHTSISITGTQFSRTSITGTQFLCISITGTQFSCISITGTQPSSISITGTQFSCISITGTQPXSISISGT

SEQ ID NO: 132192 - protein, 22 aa, Heterodera glycines
  Coding regions on vcDNA: vcDNA=SeqID_58615; Strand=-; Position=1 -40,1282-1310
MIGKIETAIPAILGNPINIFPL

SEQ ID NO: 132193 - protein, 277 aa, Heterodera glycines
  Coding regions on vcDNA: vcDNA=SeqID_58616; Strand=+; Position=1 -3,275-408,454-1148
  Homolog annotation: Hit_ID=AAO50734.1; Match level="QueryCoverage =36%, HitCoverage=15%, E-value=4e-09, Identity=39%"; Hit description =similar to Suppressor of mutant AC40 subunit of RNA polymerase I and III (high serine); Srp40p [Saccharomy
MKEETKLSPEEELQKQQDLNSKKAVINAYAEKLKGLIQTDKDSTAKLNNALTDMNIASKNRNYRQISLRQRSASTSSTSSTSSTVSSTSTTSSDSSSTTSSSSSSSSTSTDSQEKNDNTQRTTGRSSPKGVEPPKQPIMLKRMIGANRTVKNGQHVPTVQVENRVPQKVTKILPLESAQAKKGRFVAAFKIAPTAAHLPIANYGTKSAAVAKAFVNSDGGEDGEEETLPKNAHNKMEENPNQKLQKQLTDDKIEEHSFPTTMAHPSKVEEMKMPSED

SEQ ID NO: 132194 - protein, 122 aa, Heterodera glycines
  Coding regions on vcDNA: vcDNA=SeqID_58617; Strand=-; Position=1 -99,360-476,526-678
  Homolog annotation: Hit_ID=CAE69839.1; Match level="QueryCoverage =85%, HitCoverage=8%, E-value=2e-28, Identity=60%"; Hit description =Hypothetical protein CBG16163 [Caenorhabditis briggsae]
MYFFLFCLPIGLCASSAQITTSLMMMVFVVVPEWLADSQNDAKRFNQTRHIKVIPPKMLAHADELNTVLDFGGYLQYSYLFYGFYSSETVLKGVVIPYNVPVAYFCVNLFLLVFSIFIILKK

SEQ ID NO: 132195 - protein, 38 aa, Heterodera glycines
  Coding regions on vcDNA: vcDNA=SeqID_58618; Strand=-; Position=1-132
LKITILAFCHYFFTISRFFGKFLNKNAIKSKNTPLRID

SEQ ID NO: 132196 - protein, 189 aa, Heterodera glycines
  Coding regions on vcDNA: vcDNA=SeqID_58619; Strand=+; Position=1 -102,592-708,754-959,1009-1153
  Homolog annotation: Hit_ID=NP_506361.1; Match level="QueryCoverage =82%, HitCoverage=45%, E-value=2e-49, Identity=57%"; Hit description =complex i intermediate-associated protein 30 mitochondrial (5O46) [Caenorhabditis elegans] emb|CAB01129.1
MWQRIKDRVLIYDRMGRGTVHGETSIKYEFKTDEDGKTQRAGWCSMRSLNDKKAFDRKNFFSDWSHYTHLLIKCRGDGRTYKVMLHIPQFMDITWGNSYTYLLHTHGGPHWQFEMIPFSRFVFTVEGRAIDVQYPLDPRAASSIGITLMDRIEGPFRLEIDFIGATHDISHLEKHAYEKYNIPLGNPML

SEQ ID NO: 132197 - protein, 44 aa, Heterodera glycines
  Coding regions on vcDNA: vcDNA=SeqID_58620; Strand=-; Position=1 -42,99-267
SVINFQFKCFVYSVPLIRLPSDFGRRVVSDRQQLCQYMRFVLMG

SEQ ID NO: 132198 - protein, 86 aa, Heterodera glycines
  Coding regions on vcDNA: vcDNA=SeqID_58621; Strand=+; Position=1 -149,1218-1329
MPRKLLHQLPISSNKRRISSNCRPPYPPLPTPSANTAPPNNRRDSSNPDRIAQVSKIVLWAIIRISENEGQGENTCLWTKDFSYIF

SEQ ID NO: 132199 - protein, 35 aa, Heterodera glycines
  Coding regions on vcDNA: vcDNA=SeqID_58622; Strand=-; Position=1 -79,884-912
MEKNEPYENSVVEDDEFHVLQPHNFVVKIYRSQAP

SEQ ID NO: 132200 - protein, 76 aa, Heterodera glycines
  Coding regions on vcDNA: vcDNA=SeqID_58623; Strand=+; Position=1 -98,664-793
MVQFQSSALKPRSGPIWYQLVTFRLQSTKFYSISVSFICPNSAASSRVRCAARTDQRNCVAAAHEIHRLRRHCSHK

SEQ ID NO: 132201 - protein, 68 aa, Heterodera glycines
  Coding regions on vcDNA: vcDNA=SeqID_58624; Strand=-; Position=1 -54,390-482,531-590
MPVVFDSESSDEEGIDPFAWLTKVPGNKTAAKIRRNGMAQMAPTKRLRLKIIQSTCPCGKILHYWSKS

SEQ ID NO: 132202 - protein, 42 aa, Heterodera glycines
  Coding regions on vcDNA: vcDNA=SeqID_58625; Strand=-; Position=1 -46,159-241
MGLNSEQRGKAKAKKGLLEDYGIIFLFGEFGLNSEERGNAKI

SEQ ID NO: 132203 - protein, 132 aa, Heterodera glycines
  Coding regions on vcDNA: vcDNA=SeqID_58626; Strand=+; Position=1 -235,787-926,1043-1066
MMLLPPMIFLALSLAFLLNNNGTFGGSCTSKDGVMVSNGQMKQEQLKKKRQGTTPKARDLSRRNSSTSTSIGSEIDINDTINFIKETTRDGYTSPMQSSRFSDSQMPFPPLSPNVTHFAVDKSSREFFQVRV

SEQ ID NO: 132204 - protein, 201 aa, Heterodera glycines
  Coding regions on vcDNA: vcDNA=SeqID_58627; Strand=-; Position=1 -139,190-656
MADEIWRDLTHLRKKSSNGWQMHDRERRELQMSHGESRGFLDRLERKSYKGRQRMKQREGEPTKEKHSKQQKGQGKRKEKPPNWELYIKRIPLEEGMAKSKKVPKPNPTEAWTKRNGTALTERGEIEGPTERKAMAKAQGVPTYGEKAAQRSQTDNEQRVEPIECPKGPPGFAGKAGHDGIPGVPGVHGKKVKGKRNECND

SEQ ID NO: 132205 - protein, 255 aa, Heterodera glycines
  Coding regions on vcDNA: vcDNA=SeqID_58628; Strand=-; Position=1 -11,404-872,931-1217
MNRRYIDHSVIAFIRANQQMFDKGTNLEFFYVSWNETFFVQPIWNALIRHILPIFVPNIRQLKFPSADHLYCLLRFTSPKVLSDLNIHSIDADRLFPNAIDSGDQLLDEICGDSDQPLAYSAGQILSEWLHIPAKDGQLKKLICWSDSSEIADLVNNFKKKFIRATTSSASYQIQFTVHVPTEIVPFQLVNERTNEKLTLEKAENNDESMDEEDDDEWDERWIMKRCQIGETTAALNQNSGNLNNVSFTFYVNCI

SEQ ID NO: 132206 - protein, 216 aa, Heterodera glycines
  Coding regions on vcDNA: vcDNA=SeqID_58629; Strand=+; Position=1 -123,190-283,323-621,682-816
MDAILATDWLHNAFPERKTTTTTTTTTISSVEEELDDAVKAEEQISWLKIIEEEEERGNELQTGEMEVERAKEIEPPKRQHLQSKCSCNEKQKSVPLIDFLCQHYKCSVKELHVLLQTLNKRREISEMLRSQLQLRTNHLRPAWKNFRVHCNELTIHPAQTAYAMRGYLGITVRIYYYVKHGVKLVYPQLPCVLQFGGGDHCSLFPLECLSVIKDA

SEQ ID NO: 132207 - protein, 128 aa, Heterodera glycines
  Coding regions on vcDNA: vcDNA=SeqID_58630; Strand=-; Position=1-385
MNDVAILRESVLQFRKIIAENTNGLDPFKVASTAAGLALATLRRCFLPMNKLVNAPEGGYLRGRRASAESARYIRYYEMTHPGVHVQSAQWSIGEANVEDTGYRLDGLVTRDPPERDLAIEYMGCFYH

SEQ ID NO: 132208 - protein, 743 aa, Heterodera glycines
  Coding regions on vcDNA: vcDNA=SeqID_58631; Strand=-; Position=1 -412,460-2279
  Homolog annotation: Hit_ID=NP_507780.1; Match level="QueryCoverage =19%, HitCoverage=9%, E-value=1e-10, Identity=33%"; Hit description =predicted CDS, DNA polymerase type B, organellar and viral family member (5T899) [Caenorhabditis elegans]
MNRFDQNDFTITSVHQMRNRPRNTIGEIAEVSFAPLEEVERPDRVLERLVRRLFDRVLDGRSAPMLIGLQLHPPTFENPFTIPLRPPEQNNPAAIADLIQRLNDQSAAGIDLTAGTTVTKVLAVWPMQADQSDAGRSGACSLEDEHRLVNTVRSLIRIKNPNDRLCLARAVLLGLHDWRARTPGGGGIPAFKSYANRQHTHGPEARNLLRRAGIPRNKHMYTIDDVQKLQAWIDQRYGHGEIRIAVFEKEREYRIVFKAASGEAAKFNLCLLLENQHFNYVGRIEQLFRVQGYCIDCERRVTRWYHPQECKVVCRLCLRFGVGYPCKQHSRADGTASNRLCSECLFVFPNDDCYAYHLSNRAPSAMHSQEGGGRGGRTFRPICEWRRACRQCGAITYANYPHKCPALISQTGWMRCPRCSGPHPIGYPCFIQPLKDKPTSGRRRRERRMRQPNHHNGNNNNDDDSGNDRGHDDDGNEVEEEEEEDDDDANSPKKAVRLCFFDAETSQDLPLQLRTKVVQKHVPLLIIAEIICEACINEGISVHSGVGQYANGCVCSPPVGPRGRRWCSPPFLNVPGDDSALPACVNYNPRRLFFHSFDNANNDPVDDFINFLTGTGPHGVKTICLSHNGGKYDIHLILETLHRRNLPQKRICTIGLKIFSMTLKGNHQRDVVFKDSLNFFFCELDALPRTFGLNTEVATTKPFFPYLFIRRENLHQRLRGLPPKEFYQPDHMKAQKRDAFFHW

SEQ ID NO: 132209 - protein, 73 aa, Heterodera glycines
  Coding regions on vcDNA: vcDNA=SeqID_58632; Strand=+; Position=1 -87,758-892
MASAERQPFFYRFGIFYPQGMEKREAEFSICENPEDHNCRSLPLAVDANDHLNYFGVNSEEYLKAGCPRDMLL

SEQ ID NO: 132210 - protein, 276 aa, Heterodera glycines
  Coding regions on vcDNA: vcDNA=SeqID_58633; Strand=-; Position=1-831
  Homolog annotation: Hit_ID=AAA59875.1; Match level="QueryCoverage =97%, HitCoverage=68%, E-value=2e-37, Identity=35%"; Hit description =mucin
MKKHQKKLKTTPKVSTPPPVSSPAKPTTVKPSAPPPSVTTPAPPTIAKPPVTTPPTTTKPTTPVPPPAVQPTTPVPPPSVQTTTPVPPPAVQPTTTPQPTKTPVTVPTPTTTPVPPPPKTTTEVKSPSAKPTIPAPPAQLKSSALSPKAPISTVKPPPPVSLSAKSKSPPSPPEESPPHYDEEKDITVKPTSPVKPTITAPPAQLKSPAATQVIKPPQQPTKPLAPPPGAPPRFPAAAVSPPPPTSAAQIDPSRLIHTLDPPKIYFKTPPANVESV

SEQ ID NO: 132211 - protein, 42 aa, Heterodera glycines
  Coding regions on vcDNA: vcDNA=SeqID_58634; Strand=-; Position=1-145
GTGNFGQNRDRDLPGPEKPGPGPRFFFGTGTNREILKIQKNF

SEQ ID NO: 132212 - protein, 201 aa, Heterodera glycines
  misc_feature (196)..(196): Xaa can be any naturally occurring amino acid
  Coding regions on vcDNA: vcDNA=SeqID_58635; Strand=+; Position=1 -142,196-246,304-369,419-489,902-1070
  Homolog annotation: Hit_ID=CAE61910.1; Match level="QueryCoverage =99%, HitCoverage=98%, E-value=3e-27, Identity=38%"; Hit description =Hypothetical protein CBG05906 [Caenorhabditis briggsae]
MKDSSVPEQMLIEHAQIVQRNSHSPYSKFAVGAAILNNDGQIFRGANVENASYGANVENASYGATICAERSAICSAIAAIGPTKFICSAIAAIGPTKFCPKAICVVTDLTEPGAPCGICRQTDLTEPGAPCGICRQTLVEFGDMAVLLYSRPSKKLLKTRVQNLIPMAFTPNALNTFKSDASMAINRMNGRAFEQXLIKPI

SEQ ID NO: 132213 - protein, 122 aa, Heterodera glycines
  misc_feature (118)..(118): Xaa can be any naturally occurring amino acid
  Coding regions on vcDNA: vcDNA=SeqID_58636; Strand=+; Position=1 -109,573-830
  Homolog annotation: Hit_ID=CAE68228.1; Match level="QueryCoverage =78%, HitCoverage=19%, E-value=1e-22, Identity=54%"; Hit description =Hypothetical protein CBG13900 [Caenorhabditis briggsae]
FQEAFESFERVNIFKNLFKSMRTPAVLFASMIALYCCQEFFQLLGLDTMASIFSLFLTLIIVALGIWTYSRYSGQFRHAQVFIDERVHLLWHNILVPAFVNTAGGVALNMTVISQIFXFDGF

SEQ ID NO: 132214 - protein, 89 aa, Heterodera glycines
  Coding regions on vcDNA: vcDNA=SeqID_58637; Strand=-; Position=1 -60,441-647
  Homolog annotation: Hit_ID=EAA19671.1; Match level="QueryCoverage =77%, HitCoverage=24%, E-value=4e-10, Identity=50%"; Hit description =Ran-binding protein [Plasmodium yoelii yoelii]
MDPEQGAGGFVGYAYVINVDYCWKALDKKEELEKKEEQLEKKEEKLEKKEEQLEKKEEKLEKKEEQLEKKEKGNDAAAAKKEERKRKKG

SEQ ID NO: 132215 - protein, 170 aa, Heterodera glycines
  Coding regions on vcDNA: vcDNA=SeqID_58638; Strand=-; Position=1 -185,296-620
  Homolog annotation: Hit_ID=EAL31772.1; Match level="QueryCoverage =88%, HitCoverage=51%, E-value=4e-13, Identity=32%"; Hit description =GA11411-PA [Drosophila pseudoobscura]
MSSFAKLDAKKVLIVVTGASRGIGRELALQMAKFFATNECFFVLLARGKEALEAVGDQIRKENPSAVVELVFADLATQPFALGSINSRIKAWRGSHWTKVIPCAYSAFTNSETVPFDLCLLFHNAGTVGEMAKKSSELSDEAQWHEFLQANLVSAILLNNGVYAALNNAE

SEQ ID NO: 132216 - protein, 46 aa, Heterodera glycines
  Coding regions on vcDNA: vcDNA=SeqID_58639; Strand=-; Position=1-141
FFPPFILWQLCKTKQREHVLNERLKLIATGHKMTVYRESITGTDKA

SEQ ID NO: 132217 - protein, 2326 aa, Heterodera glycines
  Coding regions on vcDNA: vcDNA=SeqID_58640; Strand=+; Position=1-6981
  Homolog annotation: Hit_ID=NP_508324.1; Match level="QueryCoverage =56%, HitCoverage=48%, E-value=1e-143, Identity=29%"; Hit description= predicted CDS, peptidase family A16 and RNA-directed DNA polymerase and Integrase, catalytic domain and
MSGFLRTKIAIELKALEKAKTATELHVEPDQTLTTLENAILLESAAERIKSEVEAVNAKIEQIWTSASKWHDLIQKMDKDERKSEQTVYDQFQTTEKLNTKMETANTKLTELKDLAMKVEAGAKLQRSKADRDARVEQREHAKAMSKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEYVRRLHTELSNLKRCFSVEDTKHFCMELERLARELEAAEEDIEGPPIYLMLEKKLYKPFLREILEEKAKNPDFWDTSSLRKALGSALSKELAIKEVMREYGFEGKEANPEHGFKRQLRRNRFGGSVNVATTHFGKPNGERRKIPEQKMPNPRQGQRSFQQTPRNSAFRDRKGQGRSPKIQRNPTAVNTQGELLLCVFCGGKHRHDSCEKARTVQQRFAVLQEKGLCYKCLKSNHIGRNCPCPMKCFKCQQAHPTALCHQANPQRVTEWKNMANRVMNVREEEKPDKRDEFKEVSFTPSQCNSVQGNSRVLLRTAEVTIFNPSNPKRSMVASVFVDDGSERSFIRANVAKQLGLPVIETEECHLTGFGEKEAKRYVSNVVRVGFLGVNGDPYICALNEMEFIVKAMPIVTLNSMDEAELNKKKLSLPSRPRQPDILLGMDVRHDLKIRDETEKLPSGFTLSTSRVGRMISGYGQVQGPMDMSVQVTYTGALISALQCASSRRDADEEIEEQIKTFFGLNIIGMSDNPEENDKEEVMRTFRKSLTFKEGRYECGLPWNERVKDLPTNFQQARARLCGTVKKLRELNLVDEYQKIFNEWERNGIIERVPDPTQTTGPVHYLPHRPVIKMDKATTKIRIVMDASAKPANRKGAPSLNECLHTGPLLLNELTGILLRWRRMKDLILADIEKAFLQLSVREEDRDATRFLWLEDPQKTEISSPTYVKTVVFRFCRVSFGLTTSPFLLNATIREHLSFYDTVLPQTIMENLYVDNILINVKKNEDMAQICHESIELFRQGGMKLQEFFCSKPIAIRSLPVELLAKNQKEIKVLGIPWTNEDDEICFRFKKFAGKHTKRNILAHIAKIYDPLGLVAPAVLPAKHFLQKRFEAKNGWDEGLEEELIHEWNQIMETWQTKEGTEVQIRFARRVDNEDEVDKEMHCFADASGKGLGVAIYIRESTEKMSANLVFAKSLVKPSNISDVAATIPKMELQSITLGVKLLKYVLQHLKLKPTQTTIWTDSLCSVERIKEHKKCDRFVSNRLAKIRGQFEVKHLVSADNPADVASRGTTPRELSRNLLWKHGPKWLSEEKALWPKPAKVYHPDEEKLRASAEDEEVKTAAVMNEVPFQPTIDVNRYSSWKKAKTVGAYVLRWIHSVAKNGYNGNLLPILSKMGPKKHGNQDKGVLSVPELCASEHLLIWEAQQQFPTEEKTKENLRLFKDKEIWRCRGRIGEATVKEETKFPIFLPPEAWTTKLIVLEAHWKMKHPTHSTLLGYMREKYWIPKGRRFIRNTILSDRHGCLNCRKERLKPYAYPQMPNLPSERVAMIRPFEKTGVDYFGPLTIKGGVKVYIALYTCLVIRAVHLEVADDCTATEFLRTFRRFSSRRGLPSLMWSDNGTNFIAGAECIKEEWRREILVETSHSGVSWKFNVPRAPWQGGAWERLVGITRSALQRTVGKSLMERQEFDTLVCEIEAVVNTRPLTFQSEEEFTQPLRPVDFLLPYKRVETSLPLSDEDPRDPDYAYQPRKKGELHQLMRVAIKRIDRFWKQWKTEYLLSLRERDRTNRAEGSLPREGDIVLIEEEEDPRSIWTMGKVEKLLKGRDGLVRTARVHTKGKTLVRAINLLYPLEINTSAEDEVSQIQVTAIMDSPSAVMEGGDPQTVTTESSLPPGTVMQDSQIVTTESSPVRGRNERQAVKERIRKRQPTEEVRGKGKLKKNGPYDPLRPGNYRIPRRNPFFPSQVAYNEQTRTYRRRRGRTIDLSGLRKLFAGLGGTEFVRRELQEKANPALREERLRKDKVKFMEDDARRVAERERKAAEEKLEKSMKDSQRQTNVESSSGGTTRNPFESMEVLPGDPEPEVPLEELARQEKFDREMALEQRKMYEKRRAERNAEKDRMRWGLPRGVVRRKGHYAPHRGINKRRKWHRGRHLNEIQTGRKYRRPRGHDISPLRQPNGATTELLAPSLEMERQIRNDKRARDESQSKEPVRSQRRLKGRDPLDEQLKRGQKGQQAEENPDRIKLAPASPGYRRTINYSLFTRCEPGVKGHEGCLRNCTMGSLSHGRLTKIPQAESKRSAWPKPSHSIG

SEQ ID NO: 132218 - protein, 136 aa, Heterodera glycines
  Coding regions on vcDNA: vcDNA=SeqID_58641; Strand=-; Position=1-413
  Homolog annotation: Hit_ID=CAG83749.1; Match level="QueryCoverage =99%, HitCoverage=30%, E-value=4e-16, Identity=45%"; Hit description =unnamed protein product [Yarrowia lipolytica CLIB99] ref|XP _499823.1| hypothetical protein [Yarrowia lipol
VPLLITVLPLLITIVPLLITDVPLLITVLPLLITIVPLLITVVPLLITVLPLLITIVPLLIRDVPLLITVLPLLITIVPLLITVVPLLITVLPLLITIVPLLITVVPLLITVVPLLTLLYLFSSLLYLFSSLLYLF

SEQ ID NO: 132219 - protein, 65 aa, Heterodera glycines
  Coding regions on vcDNA: vcDNA=SeqID_58642; Strand=+; Position=1 -164,264-297
MAKEKPKEIEQNKTRNIEKSIKERPLVRGKPMEGTENGEEGTKEHMEERKTEERIPITKKLCRVE

SEQ ID NO: 132220 - protein, 205 aa, Heterodera glycines
  Coding regions on vcDNA: vcDNA=SeqID_58643; Strand=-; Position=1 -126,177-337,386-492,563-709
  Homolog annotation: Hit_ID=XP_308183.1; Match level="QueryCoverage =96%, HitCoverage=17%, E-value=1e-31, Identity=40%"; Hit description =ENSANGP00000020746 [Anopheles gambiae]
ENVIIDQTFGCKLIDLVSAAFFGEGIVSYFYGTMEYCSPEVLSGNKYLGLSGNKYLGPEVEMWSVGILLYTLVFFENPFRSSHEIVDAEIELPWEISEGLYQVLSWLLQPGPKLRATISEIVLSWLLQPGPKLRATISEIKRHWWLTQRVDPRNYNFLHLLLCSTSDLNLEGSSVSNLCSNLAAISLSSAINSDRETDANGQKKE

SEQ ID NO: 132221 - protein, 74 aa, Heterodera glycines
  Coding regions on vcDNA: vcDNA=SeqID_58644; Strand=+; Position=1 -77,219-366
MNPSLRHSFSIENILTKGVNFGAFSEPLLPHHFLGRCFDKVPTFVLEPPPKAFPTEFSSAFFERNNGERKGVRS

SEQ ID NO: 132222 - protein, 150 aa, Heterodera glycines
  Coding regions on vcDNA: vcDNA=SeqID_58645; Strand=+; Position=1 -57,102-171,229-256,307-409,459-530
  Homolog annotation: Hit_ID=AAP22042.1; Match level="QueryCoverage =79%, HitCoverage=50%, E-value=1e-26, Identity=52%"; Hit description =glutamate carboxypeptidase-like protein 1 [Oreochromis mossambicus]
SEVWKGRGSPNKMKWSICHGTLAWLGDFKQPHGTLAWLGDFKQPHFQAGVKAIKKVYGVEPDFTRYGVEPDFTREGGSEGGSIPVTLTFQNLTGKSVMLLPMGASDDMAHSQNEKLNVTNYVNGMKNEKLNVTNYVNGMKMFAAYIFECA

SEQ ID NO: 132223 - protein, 260 aa, Heterodera glycines
  Coding regions on vcDNA: vcDNA=SeqID_58646; Strand=+; Position=1 -54,179-709,878-949,990-1115
  Homolog annotation: Hit_ID=NP_495900.1; Match level="QueryCoverage =99%, HitCoverage=64%, E-value=6e-92, Identity=58%"; Hit description =enolase (46.6 kD) (2J223) [Caenorhabditis elegans] emb|CAA92692.1| Hypothetical protein T21B10.2a [Caenor
MINGGSHAGNKLAMQEFMVIKERYGLDATSVGDEGGFAPNIQNNREGLDLLKEAFAASGHQDKVNTLFEVYNLSFKVIIGMDVAASEFYKEGKYDLDFKKWNCFFFCVVKFILSPNTDKAQWLTGEQLADMYKSFINDYPVVSIEDAFDQDDWENWSKLQAAIDIQLVGDDLTVTNPKRIQKAVQKKACNCLLLKVSHRSGETEDTFIADLVVGLATGQIKTGAPCRSERLAKYNRIMRIEEELGTDAVYTGKRFRKPQN

SEQ ID NO: 132224 - protein, 19 aa, Heterodera glycines
  Coding regions on vcDNA: vcDNA=SeqID_58647; Strand=+; Position=1-58
FRPLRGLERALRARFLNFV

SEQ ID NO: 132225 - protein, 74 aa, Heterodera glycines
  Coding regions on vcDNA: vcDNA=SeqID_58648; Strand=+; Position=1 -53,115-286
MLGQALTPAHFARDAPIRPNKKFLKLFYRVSLTFTTITMLMKARKKTDAWRKFIIVCAVVDFGTTNIADQNHDV

SEQ ID NO: 132226 - protein, 176 aa, Heterodera glycines
  misc_feature (6)..(6): Xaa can be any naturally occurring amino acid
  Coding regions on vcDNA: vcDNA=SeqID_58649; Strand=+; Position=1 -145,192-304,352-528,1046-1075
  Homolog annotation: Hit_ID=CAF96120.1; Match level="QueryCoverage =92%, HitCoverage=39%, E-value=6e-33, Identity=47%"; Hit description =unnamed protein product [Tetraodon nigroviridis]
QKTWLXFFLILKIRIRPQSGKEKEEPICLSVTPGEPQLTISRDKTFTYDFVFDQMTLQKTVYDKCVFVFDQMTLQKTVYDKCVRELVDGAFEGYNATVFAYGQTGSGKTGSGKTFTMGTSLEDPAKRGIIPNAAQQIFDEIEERREQARRSGKVIPSFEVSAQFIELPGGKIENIF

SEQ ID NO: 132227 - protein, 150 aa, Heterodera glycines
  Coding regions on vcDNA: vcDNA=SeqID_58650; Strand=+; Position=1 -153,402-701
  Homolog annotation: Hit_ID=NP_502142.1; Match level="QueryCoverage =92%, HitCoverage=7%, E-value=5e-28, Identity=50%"; Hit description =kinesin-like protein (klp-12) [Caenorhabditis elegans] emb|CAB05214.1| Hypothetical protein T01G1.1 [Caeno
MGTSLEGDPAKRGIIPNAAQQIFDEIEERREQARRSGKVIPSFEVSAQFIELYNEELIDLLSPDRDSSSIKIKEDPKNHEILLMGASSRNVTSQEAILSALAIGAQNRTTAATNMNKQSSRSHAIFTLNIKQTRVVPVDVLDFFGRGRHW

SEQ ID NO: 132228 - protein, 187 aa, Heterodera glycines
  Coding regions on vcDNA: vcDNA=SeqID_58651; Strand=+; Position=1 -135,734-826,879-1214
  Homolog annotation: Hit_ID=NP_064346.2; Match level="QueryCoverage =98%, HitCoverage=10%, E-value=2e-13, Identity=32%"; Hit description =kinesin family member 21B [Mus musculus]
MGTGAEVETLHAKFHFIDLAGSERLSRTGATGDRAKESISINSGLVVANQNKSSTLITDLRIKIQLLEAELHEWKTGKRRRSGHIAVTEPEDKNSTEQVFGCLARLDEEEEAEDADNEEEPGEMEHERICTDLDKLQENISSKERLMANYEKELEKIKQEINRLEETKKENKQEINRLEETKKENSG

SEQ ID NO: 132229 - protein, 89 aa, Heterodera glycines
  Coding regions on vcDNA: vcDNA=SeqID_58652; Strand=+; Position=1 -30,371-610
MEEMQKLKKKERRKTMFETNNPRKPLTPINEQLTPESKHLERLNTTYIVDTPSEEQKKGRLLGELPEEKDSNYQIPPLLSGCCPKGPSV

SEQ ID NO: 132230 - protein, 200 aa, Heterodera glycines
  Coding regions on vcDNA: vcDNA=SeqID_58653; Strand=+; Position=1 -75,139-237,340-505,602-864
MQSVQSSATGAVTAASTVPLSIQNEILWIKQDALQVRNAVILLEQEKDSLRKAIRKLKLENGRLKTKVKTLNEKVAKISNEEMDDEEGKLAPESELDYDELNRGDFYLIGGVHDPISLRFEAAIRDQNAVEHKSAERYYWYKMAEFFGDEEAMKSILHAQNVQQAEEAMKNIKGFDVAEWDKVSWNEKHWWKGKGFSGQT

SEQ ID NO: 132231 - protein, 49 aa, Heterodera glycines
  Coding regions on vcDNA: vcDNA=SeqID_58654; Strand=-; Position=1-374
VGVNSVWPTPSQQCSKSYNFFLCWPNFTIMVSFESPRCLEDIYKLFLSD

SEQ ID NO: 132232 - protein, 87 aa, Heterodera glycines
  Coding regions on vcDNA: vcDNA=SeqID_58655; Strand=-; Position=1-263
FEYPKRTLEKIDFFVFGAVPPSRCAQIYGETESFRNSFPIACTLILRWIFAPHNCLSTPNGHLKNRFFCFRGSPPERCARFMGRRIL

SEQ ID NO: 132233 - protein, 68 aa, Heterodera glycines
  Coding regions on vcDNA: vcDNA=SeqID_58656; Strand=+; Position=1 -69,119-255
  Homolog annotation: Hit_ID=NP_492064.2; Match level="QueryCoverage =89%, HitCoverage=29%, E-value=2e-12, Identity=60%"; Hit description =inositol monophosphatase (23.3 kD) (1H878) [Caenorhabditis elegans] emb|CAA95791.2| Hypothetical protein
MATPTQIELYFNVALSLVKKAGNLAKNAYAQPLGVVKTKSSPTDFVTETDQAVEKLLISGLSERFPDH

SEQ ID NO: 132234 - protein, 105 aa, Heterodera glycines
  Coding regions on vcDNA: vcDNA=SeqID_58657; Strand=+; Position=1 -79,169-280,691-817
MVPNTAKKDVLLRLFQLELQTAKKRDPVNGKIRNTMVFVNTKRDADVVSTYLNQFDFNTTTINGVFKKRLSRCQTGSTNWLLESPSLVLAKSLTRSCLAFCETTL

SEQ ID NO: 132235 - protein, 89 aa, Heterodera glycines
  Coding regions on vcDNA: vcDNA=SeqID_58658; Strand=+; Position=1 -75,145-339
MGIPWHGWWEMFHPGQTLYDSSGNENHKEPAKSASERHKWGSNVDFLAAAKLFQINVIVCSPNPQRKEDFGIQYVWNIYTPDMLDTVSI

SEQ ID NO: 132236 - protein, 57 aa, Heterodera glycines
  Coding regions on vcDNA: vcDNA=SeqID_58659; Strand=-; Position=1 -40,182-315
MHFLGRPYLSARFVPFIIVGATSFRDKCKKGTSRQCKNWALREKCKNWALRDSAKMV

SEQ ID NO: 132237 - protein, 36 aa, Heterodera glycines
  Coding regions on vcDNA: vcDNA=SeqID_58660; Strand=-; Position=1 -31,656-735
MDFCKILLVESFICSICCLQPLTKAMDPTATVSFDN

SEQ ID NO: 132238 - protein, 57 aa, Heterodera glycines
  Coding regions on vcDNA: vcDNA=SeqID_58661; Strand=+; Position=1-172
  Homolog annotation: Hit_ID=CAE62342.1; Match level="QueryCoverage =98%, HitCoverage=11%, E-value=5e-10, Identity=50%"; Hit description =Hypothetical protein CBG06417 [Caenorhabditis briggsae]
MFGGIMVGTVADRLGRRKSLLYNNILAIIAAALITLAKYVNIYYLIIIGQFIIGSNV

SEQ ID NO: 132239 - protein, 108 aa, Heterodera glycines
  Coding regions on vcDNA: vcDNA=SeqID_58662; Strand=-; Position=1-327
MSHQPFANFEIVRLEAMIIGLEIDKDQLQRDVYHLKNRKTQIHNKKIELLQQKEQLIREISVLRETKATLVNEMKDLREEILELRDMDGSNDDDPLCAVCYTRKVVSV

SEQ ID NO: 132240 - protein, 148 aa, Heterodera glycines
  Coding regions on vcDNA: vcDNA=SeqID_58663; Strand=+; Position=1 -200,418-553,626-711
  Homolog annotation: Hit_ID=CAA65018.1; Match level="QueryCoverage =96%, HitCoverage=35%, E-value=5e-31, Identity=51%"; Hit description =S-adenosylmethionine decarboxylase [Onchocerca volvulus] emb|CAA65017.1| S-adenosylmethionine decarboxylas
LFNASEHFFEGAEKLFEIWFDNDQQKRENGHKSTLRTIPENELRQLLNTAGCHILQATKKQRMAIKIISESSMFISDRRLILKTCGQTRPLLVIEKLLELARKHCQMDTVTNVYYSRKNFVYYSRKNFFRPHLQPQLHATFDEEVDYL

SEQ ID NO: 132241 - protein, 46 aa, Heterodera glycines
  Coding regions on vcDNA: vcDNA=SeqID_58664; Strand=-; Position=1-140
MDNADGECAEDGCVSDVEAGSGAEDGDELLDDDGVNQQQHLRSDES

SEQ ID NO: 132242 - protein, 77 aa, Heterodera glycines
  Coding regions on vcDNA: vcDNA=SeqID_58665; Strand=+; Position=1 -8,210-435
MQYCSCVFFGFSLKRESFITGPLTRIAYGYSSNGKLWANSANLETARSYGENDVVGCGVNLATRQIFFTKNGKRMGW

SEQ ID NO: 132243 - protein, 76 aa, Heterodera glycines
  Coding regions on vcDNA: vcDNA=SeqID_58666; Strand=+; Position=1 -94,390-526
MLISNILTFCLNLSPGLRIQKVSHKILLLYYNAGGLYILANASSLSDYFPFVMLFNNEDMIYANFEQEFIFNLATL

SEQ ID NO: 132244 - protein, 182 aa, Heterodera glycines
  Coding regions on vcDNA: vcDNA=SeqID_58667; Strand=+; Position=1 -76,242-421,494-567,624-761,876-955
GAEKVLSVSGQIHSPSIEPDRMEVHDLGNVTAGSSSTGRSLHTLCTFASVGAANDYVPAGVVTAPLALSGSKINCIGRSLVVFQEGRSALGSGVIGYAKDTRIFSDEFDEIFRNLITQYRNVNVSDCWLVLRDGTSSNPDCRAFFDMLDEILATEEVQEYTGPRKAICSLVNVENQAVNGSI

SEQ ID NO: 132245 - protein, 57 aa, Heterodera glycines
  Coding regions on vcDNA: vcDNA=SeqID_58668; Strand=+; Position=1 -69,459-563
MVIVYGHSTIIQFKMLKTNQKSKSLDPNSVPDSAETVIMSDFAFAISAIFGTKFINF

SEQ ID NO: 132246 - protein, 87 aa, Heterodera glycines
  Coding regions on vcDNA: vcDNA=SeqID_58669; Strand=+; Position=1 -145,576-694
MTAKTKGILSTTNKTPKMMDATIILKKNAPSSTSNSEKQKRGICLWSEEFGHLSKNSATWHLDGTIMPKFTMLLRILVCRSKDTQKN

SEQ ID NO: 132247 - protein, 249 aa, Heterodera glycines
  Coding regions on vcDNA: vcDNA=SeqID_58670; Strand=+; Position=1 -120,198-301,359-500,620-865,919-1056
  Homolog annotation: Hit_ID=CAE66247.1; Match level="QueryCoverage =83%, HitCoverage=56%, E-value=7e-55, Identity=49%"; Hit description =Hypothetical protein CBG11491 [Caenorhabditis briggsae]
MAKEEETGGGGRKALENAGEHSFVREEARRPLRDGLDGAERGALSAISAFITEHYVEMIHEFVLVNAPSFISTIWTIAKPLLPERTRNKVQILGKSTWRSEILQMACAEALPSFWNTEGEEKHFLANLKRSPPIDVSNYHKNGQLPPGFYTSLTIGAGKCGTIEVEATKGQTLRWQIESDGHFSFAVHFKSDETSPRLVYPRLNQIPGPTFVPVDDHLQCDATGVYQIWISNEHAWIHSLKMRYRISKE

SEQ ID NO: 132248 - protein, 97 aa, Heterodera glycines
  Coding regions on vcDNA: vcDNA=SeqID_58671; Strand=-; Position=1-294
MAGAGFQHFDAYTQLTDRSEVEELDTLFRQWRKTRSNLQFFKFFFEENGYECEQVKKAAEFYSQNAIKSEQLFQSCYYGKREIPCCDLFKPNCKCGD

SEQ ID NO: 132249 - protein, 84 aa, Heterodera glycines
  Coding regions on vcDNA: vcDNA=SeqID_58672; Strand=+; Position=1-255
MARPQRNGTEPIAYKESAKDELRPAMGLSGSAIREQQQKKKKTNIEGREKMEEIGGEGKEGKKEEGGGGGGGATGREGSGCTLM

SEQ ID NO: 132250 - protein, 103 aa, Heterodera glycines
  Coding regions on vcDNA: vcDNA=SeqID_58673; Strand=-; Position=1 -267,780-822
  Homolog annotation: Hit_ID=NP_493614.1; Match level="QueryCoverage =100%, HitCoverage=6%, E-value=9e-28, Identity=58%"; Hit description =alpha-2-macroglobulin, N-terminal and alpha-2-macroglobulin family member (1P593) [Caenorhabditis elegans
ITAYSRDVKLEVDKQSDTFKPGLPYSVVVALKQMDDTPAKSSLPRRVQLTTFYRGAQAQQQQPLQQQQEDKEVKVLELDAHGTAMLQLLPPLNSTSARVEASY

SEQ ID NO: 132251 - protein, 47 aa, Heterodera glycines
  Coding regions on vcDNA: vcDNA=SeqID_58674; Strand=+; Position=1 -83,185-245
MFPRCFSLMGLALVHLWHWAHTTNITTIQALTVCCVNSGTSVFAGIT

SEQ ID NO: 132252 - protein, 54 aa, Heterodera glycines
  Coding regions on vcDNA: vcDNA=SeqID_58675; Strand=+; Position=1-164
QSQADSDNDDAAPKGRRGPGGGPGKRQRVTKSPANPKLYAKLNACLNTLLNYKT

SEQ ID NO: 132253 - protein, 61 aa, Heterodera glycines
  Coding regions on vcDNA: vcDNA=SeqID_58676; Strand=+; Position=1-183
MADWNDFFGSLRKYLNYFRAHHSQGLSYNALTASSNTQTISDAELAGLLSWTRFASAVAKK

SEQ ID NO: 132254 - protein, 164 aa, Heterodera glycines
  misc_feature (12)..(12): Xaa can be any naturally occurring amino acid
  Coding regions on vcDNA: vcDNA=SeqID_58677; Strand=+; Position=1 -28,163-249,487-679,844-1030
  Homolog annotation: Hit_ID=CAE66724.1; Match level="QueryCoverage =100%, HitCoverage=51%, E-value=1e-32, Identity=30%"; Hit description= Hypothetical protein CBG12070 [Caenorhabditis briggsae]
FLLNLIDKTHAXGDNVKFSAKIEAFPAPEVQWTFNGEPYFEFSNIRISNEGNLHMLEINNVQLEQAGELACTVKNSAGSKRQNAHLTVKESGGAPAFERSIEDRLVEENETLIMEAQLAPGAKPAAEVQWLKDGQQLQKTDEHFKQSEEANRVHKLTIIRVAQA

SEQ ID NO: 132255 - protein, 92 aa, Heterodera glycines; identical to SEQ ID NO: 125147
  Coding regions on vcDNA: vcDNA=SeqID_58678; Strand=+; Position=1-304

SEQ ID NO: 132256 - protein, 33 aa, Heterodera glycines; identical to SEQ ID NO: 127153
  Coding regions on vcDNA: vcDNA=SeqID_58679; Strand=+; Position=1-101

SEQ ID NO: 132257 - protein, 174 aa, Heterodera glycines
  Coding regions on vcDNA: vcDNA=SeqID_58680; Strand=-; Position=1 -173,238-589
MLLAICVSARQLAVIHLQQILRAFKVAQQPTVSCTNIANIEQCHIAVVSNSEHHRDKRFVYIATIDEIVVLQYVAKLGFFSPVAQIKTEEPCTCICSASFGFVFGADNFHFARFDDNFAMPSPLVVENCPFDFPVAAVEISDNEFLLAFHSNSKLIDNEFARLINAHFRLWTVR

SEQ ID NO: 132258 - protein, 1714 aa, Heterodera glycines
  Coding regions on vcDNA: vcDNA=SeqID_58681; Strand=-; Position=1 -127,171-240,288-378,438-482,531-681,724-797,841-911,959-1061,2443 -2501,2550-2739,2786-2845,2890-3104,3146-3297,3344-3560,3601 -3709,3764-3856,3903-4058,...
  Coding regions on vcDNA: Position=...4188-4279,4333-4502,4546 -4663,4705-4746,4790-4932,4976-5045,5093-5183,5800-5964,6037 -6141,6192-6274,6320-6464,6521-6682,6880-7032,7088-7264,7310 -7471,7514-7678,7846-7947,8004-8156,...
  Coding regions on vcDNA: Position=...8204-8535,8682-9137,9187-9261
  Homolog annotation: Hit_ID=NP_494921.1; Match level="QueryCoverage =48%, HitCoverage=58%, E-value=3e-45, Identity=23%"; Hit description =citron (2F293) [Caenorhabditis elegans] gb|AAK31526.1| Hypothetical protein F59A6.5 [Caenorhabditis elega
MDGGDVLVIGVDTSRPPKATPFEKFMLRKKGVEGLTSEDPLIVGICANYLKNPYKFCGDYYFQPCTQDVLEPTMLSYKMSWILDKVKKNRSKPPSTIFIIRDGVSEGMVPNNIHDEFPSYVKACKKYDPTWEPKFVYCIVDKNHNKRFFVKGQQQVENTAPGAVIDSKVVRVDIHEFWMQSHVPLKGTSKMPQYIFPVNDPKANNNELQGFLLALCCSWQIVTLAPALPNSRAHQRAAVARDRRNIPPPAACNRYVEGFSSVYVFETRPSSHGGAFAFRYDVEMVQLSRNKSLTSGGGDDGKNGLLRTVCFDLIKFVHDSTQGFGQAAHFVYDNRKILFTNKRIEQFALEIDTEKIQGIVRDFLRGSSVKIEIKPCQTDKHELDLNDVFSSISRRPDEQSDRSLRTFLEMLTSQPFLNAGTHDIIGAGRLFKRQICKELEDGIVTREGIAKGVRVIDNNGEPKAALVADVKTCAFFASRNLEEIVMEMVQKRRFNINNASQMDRFWSDFNHLFRGVSGYLTYAPSRVIVIDAISQRKMAEISFDVDGRPMSMVDFFRTKKNIPINGQLPAVRQQQDRETLFPMSCVIILPGQRVPIDKMSEFISRELLSANTTNSSKRYADIEAEVRKIGTGTSSAFMSHFGVKLIGGKNDVKIGMHEMPQVNPGVRFLETSTLMKAWVVGFTRQVGEGDVRNFIQQVVVMGRKRGMHLPDPQYECIELENISERMQQLSDRRIQFLLYIDKKFVKSHAILKLNEKKYGLLTQHVTFEVASKARAMTLSNVLNKMNMKLFGFNYMPMFPQASKSKFNMDGGDVLVIGVDTSRPPKATPFEKFMLRKKGVEGLTSEDPLIVGICANYLKNPYKFCGDYYFQPCTQDVLEPTMLSYKMSWILDKVKKNRSKPPSTKKVEMELLQETMKGQTESFHREILELKAEKRVKEAEIAEMREKLRTNEANGQKREYLDQLNQKLGSLDTKNESLRDEVGTLKKGNKEMEQRYKQCEEEKAALQQEINSLLKQISASSGSSDIVSSRLMDEIERLKQQKAQLRCEHVQLKRKYTELETETAKFGGLAKEMKLLNSTVGELRSKIESAEAEKKAIENENELLKERQKKMETEMKEKAWHWPIIDKMQRLCRENEECENSRLKLLQSELDLQRRKCDGMKRSMGELDMQCEKLMTQLRLTDAEKRKAQNENELLKREIEKLSGQLTEKIKMENENASLKDRSKWLKDKIVFLESELKETSTDHRTVPMRISIHKISKMFKELANLADQLGATSAGTSKGKESENSGEVPKMEARLRQQEAELRSLQRKVEQYERENNSQREEMEKMREEATKTKQENIILRQNFDVCLKKAETFKSELDAFKEANDQLKSENEREKNSTSDQLYELRADLEQKEKLIAYLQSVVQPKQMQKLPRHRSSLLSDGSDLSEIEMEYKQCLQLEKERNQLKNNLENRRRGEIPFIDKQITKMINRALLISLINALALVLDEKQNEMTPTRPMLREETVRFHDALSPARNSQSKLKQAFAFDFLSFGFALQEQINAKSAWTVSPTFDSSSDAATVPLRCTRTVVATWSTRAVFRKNGGHFYLDTHSISFQPMTRWGKLWPFSSASAALPSPDQSTHWLNAWAVIDDNRLSFYDSDQLAVSEGALPFLSIDLDRDHWRIYNQTTDKPLDGIRGTEMSMLIELKLPDYILFMLAPTVQAKQRWVYSLQMAT

SEQ ID NO: 132259 - protein, 50 aa, Heterodera glycines
  Coding regions on vcDNA: vcDNA=SeqID_58682; Strand=-; Position=1 -108,150-191
LNEKKYGLLTQHLPFEVASKARAMTLSNVLNKMNMKLFGFNYMPMFPQAS

SEQ ID NO: 132260 - protein, 28 aa, Heterodera glycines
  Coding regions on vcDNA: vcDNA=SeqID_58683; Strand=+; Position=1-114
TRKFIQCFLDLARQELSDDTKFIKIRSF

SEQ ID NO: 132261 - protein, 138 aa, Heterodera glycines
  Coding regions on vcDNA: vcDNA=SeqID_58684; Strand=-; Position=1-477
AKKFCGTYCGTSLLDSCLIAPVIWFCNFQKSNKLRISNFIFENFAVDNCCYNHDVCYIKKYQKRYDCDIKFCNCLNEYPNCFLTKVCSPTHILNILFFRIYYAGQFIFLENVLKKDKNNYFILPSIDMHMYFKFFIVM

SEQ ID NO: 132262 - protein, 60 aa, Heterodera glycines
  Coding regions on vcDNA: vcDNA=SeqID_58685; Strand=-; Position=1 -166,590-606
MPTELYRTDLLQRVRQHNAVGLPAGGAVPWQSKSSFALQQLDGGGTGANAEECRHDLPNW

SEQ ID NO: 132263 - protein, 43 aa, Heterodera glycines
  Coding regions on vcDNA: vcDNA=SeqID_58686; Strand=+; Position=1 -90,196-237
MASQRFILYGKSYFYYNIDDYDKAAQMINQFMRVSCDAKNQFQ

SEQ ID NO: 132264 - protein, 51 aa, Heterodera glycines
  Coding regions on vcDNA: vcDNA=SeqID_58687; Strand=+; Position=1 -45,106-216
MELQKELVSICRSAWTCEARGPAWDFAGPSLQSRIFGTCKKEGLIQRSPGR

SEQ ID NO: 132265 - protein, 87 aa, Heterodera glycines
  Coding regions on vcDNA: vcDNA=SeqID_58688; Strand=+; Position=1 -100,196-356
  Homolog annotation: Hit_ID=AAM61642.1; Match level="QueryCoverage =100%, HitCoverage=36%, E-value=3e-11, Identity=38%"; Hit description= 14-3-3 protein GF14kappa (grf8) [Arabidopsis thaliana] gb|AAL85081.1| putative 14-3-3 protein GF14kappa [
MLPNCSTNDERIFYLSLKVDLLRYACKHETLESFKTQAEAAYNLAKTEAVAKLRPENPIRIGIALNFGIFYESILKSNALAYKIGKE

SEQ ID NO: 132266 - protein, 197 aa, Heterodera glycines
  Coding regions on vcDNA: vcDNA=SeqID_58689; Strand=+; Position=1 -40,202-755
  Homolog annotation: Hit_ID=AAD46501.1; Match level="QueryCoverage =95%, HitCoverage=54%, E-value=3e-28, Identity=31%"; Hit description =latent nuclear antigen [Human herpesvirus 8]
MFSTNFTPTVSINAKPIAQQQEEQDGHRQVEQQADEHQQLEQQEGQQQEQPRQVEHQVDEIQEGQQEHQEGQQELGQQLDQQRQVEQQEGHKGDWQEETEQEVEQQGDRQEEQNVQQEEEGHVEQRKEQNEQQGEQLQGERQQMEKEEIQTEKQEIEEGEEEEKHQMEQKSGDNEEEGEGGQQKKSSNDYEDNNNKE

SEQ ID NO: 132267 - protein, 111 aa, Heterodera glycines
  Coding regions on vcDNA: vcDNA=SeqID_58690; Strand=-; Position=1-3,63- 395
MPENEALIVFVRGKSNFDKFCMENKERLHEICDKLPKESTDAQRKEYLTQKYEAHLGVLYLMRENWHCAKIVDENAGQNRADCEIFRKYFEIFYEYLFTVNAEGFLAYYLK

SEQ ID NO: 132268 - protein, 90 aa, Heterodera glycines
  Coding regions on vcDNA: vcDNA=SeqID_58691; Strand=-; Position=1 -171,217-318
MPLKDCQRFIRKLVINGYLDERLVTTAHQTVIGYISVASKGRQFLIDYKRNPGAVERVNLYMGEPKKQDKRRSSTASNASNLTRQKSMEE

SEQ ID NO: 132269 - protein, 229 aa, Heterodera glycines
  Coding regions on vcDNA: vcDNA=SeqID_58692; Strand=-; Position=1 -114,160-231,320-507,561-695,1094-1274
  Homolog annotation: Hit_ID=NP_502390.2; Match level="QueryCoverage =73%, HitCoverage=16%, E-value=5e-46, Identity=54%"; Hit description =high Incidence of Males due to increased X chromosome loss HIM-6, human BLooM syndrome related, RecQ heli
ISCALLRGSMDSVEVESIYSDLSSVEPTIKLLYVTPEMISASRRLNDAFISLFRRNLLARFVVDEAHCVSQWGHDFRLDYTRLSTVLEPYRSGKDKVPVMALTATATQRIIDDVKQQLNIANCKMFTSSFVRPNLVYDVVDKSQANFKKVVDHIRKMYPNGSGIIYCLSNVWHGYRQAGRALHHPSHNPTDIGVLLPGDWPSWTRQPSCALYSHVQFQRPFADQKANRK

SEQ ID NO: 132270 - protein, 202 aa, Heterodera glycines
  Coding regions on vcDNA: vcDNA=SeqID_58693; Strand=-; Position=1 -238,290-352,477-587,910-1003,1048-1150
MMPGTLPQVTRYNFVPIDETIKFPVFHCCNGSHQESFHQSFGQKAPNEPLKKRDSSVELLNDNNSFFKIRDSSAEFHNDVKLLGVGGQSHQGPFHEFIDDDFLFEKAEQHPPIVVANPSAPNGPFKIRDSSAEFHNDGRVWLFLFPLQAKAGGGRRSFGARLFYCDANGVWEEFVLPTASCAPSRRYNRHFSASFPDAGSNY

SEQ ID NO: 132271 - protein, 159 aa, Heterodera glycines
  Coding regions on vcDNA: vcDNA=SeqID_58694; Strand=-; Position=1 -74,152-365,528-719
  Homolog annotation: Hit_ID=CAF95482.1; Match level="QueryCoverage =81%, HitCoverage=10%, E-value=4e-38, Identity=58%"; Hit description =unnamed protein product [Tetraodon nigroviridis]
MSENVRGRKAKNVVFQEKPPPNFFCCLREIVNNFAHTRITETALGPTIQAGLDALRSADRAGKLFIFHTSLPVLDGAPGQLKNREERKLLGTDKEKTMLTPSIDFYAKLGEECVKWGCAVDLFLFPNAFVDVANIAPAVTTTGGIIYKYQYFDVRFCNI

SEQ ID NO: 132272 - protein, 58 aa, Heterodera glycines
  Coding regions on vcDNA: vcDNA=SeqID_58695; Strand=+; Position=1-176
NYFLNLTGPDGAEKEEKPRWQLLYTAKTEYGMEQLNAEAWNAVAQRIEREPAMARKFN

SEQ ID NO: 132273 - protein, 414 aa, Heterodera glycines
  misc_feature (167)..(167): Xaa can be any naturally occurring amino acid
  Coding regions on vcDNA: vcDNA=SeqID_58696; Strand=-; Position=1 -95,144-205,288-327,378-419,462-584,677-769,825-889,942-1033,1082 -1125,1179-1220,1264-1442,1486-1545
  Homolog annotation: Hit_ID=NP_510020.1; Match level="QueryCoverage =99%, HitCoverage=78%, E-value=3e-96, Identity=46%"; Hit description =alpha-L-fucosidase precursor (XM720) [Caenorhabditis elegans] pir||T26127 hypothetical protein W03G11.3 -
WWYWKGQRDAKSRFVQKHYPNGTTYADFAKSFTAVDFDANNFAEFTAVDFDANNFAEIVKSSGARYFVLTYFVLTSKHHEGFTLWPSATSWNWNAVDLWPSATSWNWNAVDIGPHRDLIGPHRDLVKALSDSIRAQNIRFGLYFSLFDWFHPLFLNDVKFGTSFFFXTVSYPQLLEIVNGYHPEVIWSDGDWEQPDDWEQPDTYWRSKEFLAWLYNESPVKEKVVPVKEKVVVNDRWGSGIAGKHGGFLTYQDHYDPGHLLARKWENCLTDHYDPGHLLARKWENCLTLDKRSWGYLDKRSWGYRRYLKASDVLSLAELINQLVRTISCGSDVLSLAELINQLVRTISCGGNMLLNVGPDHTGRIVPIFEQRLREFGEWMNVNSEAIYGSKAWIHQKAWIHQSDGPTSCYWYFH

SEQ ID NO: 132274 - protein, 56 aa, Heterodera glycines
  Coding regions on vcDNA: vcDNA=SeqID_58697; Strand=-; Position=1 -114,548-604
MDLVTSLEMMDAIYEGGSVDRRMMDSAIEKALELQQERHCKVISEFANKRLIYSIM

SEQ ID NO: 132275 - protein, 50 aa, Heterodera glycines
  Coding regions on vcDNA: vcDNA=SeqID_58698; Strand=-; Position=1-150
CQFEFCFDIYGMSINQRNGGYLIQEIRYMPVEPGKKMKMPIFVLFPSANA

SEQ ID NO: 132276 - protein, 132 aa, Heterodera glycines
  Coding regions on vcDNA: vcDNA=SeqID_58699; Strand=+; Position=1 -136,1239-1501
MKPNLAVYNYAAGSATAVPSDQWTNNETGEELLGKGQMLATLPDLSPPSIVPPRQPTSVAPATATGEQSEEAEEEEEEENSQQLATMSSTSKREEDEQGKKRNGAGTGEQQKERECTEKQSEGEGGEKEEDE

SEQ ID NO: 132277 - protein, 123 aa, Heterodera glycines
  Coding regions on vcDNA: vcDNA=SeqID_58700; Strand=-; Position=1 -90,176-457
  Homolog annotation: Hit_ID=NP_076368.1; Match level="QueryCoverage =81%, HitCoverage=8%, E-value=4e-15, Identity=40%"; Hit description =retinitis pigmentosa GTPase regulator interacting protein 1 [Mus musculus] sp|Q9EPQ2|RPG1_MOUSE X-linked r
HKEKLVAAYSEAGQKIEALERKLRLQCLIEDHQQPTDESHVQEADIDRNEEAEEEEEEPRRRKGAEDDEGEEEEDGQDEDEDEQDEDEDEQEEEEQEDEEELDEDECKDSPAYIPKQGFDKFA

SEQ ID NO: 132278 - protein, 90 aa, Heterodera glycines
  Coding regions on vcDNA: vcDNA=SeqID_58701; Strand=+; Position=1-649
LFEYPKRTLEKIDFFVFGQSPNRCAQIYGETESFGNSFPIACTLILRWIFAPHNCLSTPNGHLKKSIFLFSGSPPEPMRPDLWGDRILRE

SEQ ID NO: 132279 - protein, 116 aa, Heterodera glycines
  Coding regions on vcDNA: vcDNA=SeqID_58702; Strand=-; Position=1-483
KNRFFCFRAVPPNRCAQIYGETESFGNSFPIACTLILRWIFAPHNCLSTPNGHLKKSIFLFSGSPPKPMRPDLWETESFGNSFPIACTLILRWIFAPHNCLSTPNGHLKKSIFLFS

SEQ ID NO: 132280 - protein, 52 aa, Heterodera glycines
  Coding regions on vcDNA: vcDNA=SeqID_58703; Strand=-; Position=1-158
HFKWYKMSIIDIDAEQNNHSFAVDSQSNNYFLVGRGGDKSILLNETSGNSYA

SEQ ID NO: 132281 - protein, 18 aa, Heterodera glycines
  Coding regions on vcDNA: vcDNA=SeqID_58704; Strand=-; Position=1-56
INYEFMWPKNRHNFTETV

SEQ ID NO: 132282 - protein, 100 aa, Heterodera glycines
  Coding regions on vcDNA: vcDNA=SeqID_58705; Strand=-; Position=1-303
MYLTVLFRFIFDDYPHVLLYKLINIRSEKAVYMFEQLEKEFDEDGLTEIIKHKLYGFISDGASVMRGTRGGLFAHLEKFINHDKKLTGIHCFAHRFSVMS

SEQ ID NO: 132283 - protein, 90 aa, Heterodera glycines
  Coding regions on vcDNA: vcDNA=SeqID_58706; Strand=-; Position=1 -60,423-635
MSYSDSSRHLKAPFILLLNKYAGSGARLARPVAAVGPWQTTNRVTGVEPQLAKQGGTKPGADAGTAAGSGLCTNPTMHYILHIYYIALRF

SEQ ID NO: 132284 - protein, 240 aa, Heterodera glycines
  Coding regions on vcDNA: vcDNA=SeqID_58707; Strand=-; Position=1 -320,360-444,661-834,877-1022
SKINTSTFFDVKENGRIVVKNSDKYCLFYSVVLSQLYQTIGTEISYSMFRRILSNAKRQRIYVDDLIRNAKIEPNKKNYGIDELRQIQEYLNQEFPGKFLIAAFTKEWGIKPIYKGDGPKKYIVCVFHENDHWDGLNFPCEKEGREPIECLKCNRLFFSDFCFQNHLKLACKLYRRCTLCDSEYNTRNKHICGIKFCNVCKVKHAKSESCYIKKINIPKNLPRYRIVSYDIECSVSIEKS

SEQ ID NO: 132285 - protein, 202 aa, Heterodera glycines
  misc_feature (11)..(11): Xaa can be any naturally occurring amino acid
  misc_feature (59)..(60): Xaa can be any naturally occurring amino acid
  misc_feature (92)..(92): Xaa can be any naturally occurring amino acid
  Coding regions on vcDNA: vcDNA=SeqID_58708; Strand=-; Position=1 -198,280-348,821-886,941-1037,1490-1626,1994-2018
  Homolog annotation: Hit_ID=AAL58982.1; Match level="QueryCoverage =90%, HitCoverage=17%, E-value=3e-44, Identity=52%"; Hit description =lysosomal alpha-mannosidase [Cavia porcellus] sp|Q8VHC8|M2B1_CAVPO Lysosomal alpha-mannosidase precursor (
FKNFFFKFYNXIHILLVQEVRQIVSPWISQVVRLVAGKPYIEFDFTVGPLPKNLRWTNXXINEFDIELNSELNSEGIFWTDSNGRQMMKRRXDRNDSSFFEGTEPVAANYYPVNSRIYVRIYVHDDKTRMVILTDRSQGGASLADGQIELMLHRRAFWDDGFGVEEALDEPGEDGNVRGRHWLLLGDASSAAHRHSLSLALS

SEQ ID NO: 132286 - protein, 136 aa, Heterodera glycines
  Coding regions on vcDNA: vcDNA=SeqID_58709; Strand=-; Position=1 -233,501-678
MSRLQQRFHSSPGKREGIEPLNLSECCNTKDYTNSSASASARSLPRAKSAVFTENGVVDEKQRDKDGQRQTSASTDENKDLHPLTDRRRRSSIILNKRMPMRKTESGELGDRTASKLTLDEELYDILHAFLYVFDL

SEQ ID NO: 132287 - protein, 371 aa, Heterodera glycines
  Coding regions on vcDNA: vcDNA=SeqID_58710; Strand=+; Position=1 -355,414-905,2245-2381,2853-2984
MPFPACLTLIFTVPSGILIAEEVVGIEQYRSQSKMCGTSEGLLYGPLQFPSHWRNLTFGKIILDIEKVSEFVGEKVGSRRFSETVQIRGLPWNILAKINGKTDEKCLGFYLKCAAAEEDENWCCECSATFRIVSQKFDVENSTGKFFGQIFDHTADQAGFHGFISFAVSGCLLIDPLWLIKELLDPNNEFYSNNEDKVTLTVDFILKDAKMGQFSAPKTADKTIFMEIEKASEFFCEIIGSERKSETVLIKGLPWKIVAKINRSADDEKCLGFYLLCAVPKETPNWSRKCSATFRIVSGVPREWFERRIVINETPIHGFDYFVTFSYLLWNLTHRLEIALSRIYNSLEAWHIICRDLLDLLPIFTMHRKIV

SEQ ID NO: 132288 - protein, 78 aa, Heterodera glycines
  Coding regions on vcDNA: vcDNA=SeqID_58711; Strand=-; Position=1 -65,434-605
MTHKSVSKVYRESAADADRSSDYLGVIKREFRDVLGELLPIRTLISRDRTLSIRDRTGSGSRGIKFGIPTSGSVPSDI

SEQ ID NO: 132289 - protein, 130 aa, Heterodera glycines
  Coding regions on vcDNA: vcDNA=SeqID_58712; Strand=-; Position=1 -240,466-618
  Homolog annotation: Hit_ID=CAE63564.1; Match level="QueryCoverage =100%, HitCoverage=57%, E-value=1e-19, Identity=36%"; Hit description= Hypothetical protein CBG08051 [Caenorhabditis briggsae]
YFVLLLILAMIEFVTVLALYTNRAELVDSVHNAFIASAKTADGRRNLKPIQTALHCCGATIETQKLYLDEQLCPQELAKAEDCFSVLKYKMDSNAVLASALMLLVAQFFAMVFSCILCRAIRERSPVYYA

SEQ ID NO: 132290 - protein, 95 aa, Heterodera glycines; identical to SEQ ID NO: 125597
  Coding regions on vcDNA: vcDNA=SeqID_58713; Strand=-; Position=1-662

SEQ ID NO: 132291 - protein, 129 aa, Heterodera glycines
  Coding regions on vcDNA: vcDNA=SeqID_58714; Strand=-; Position=1 -358,426-457
MNTYWHFEMYLCNFKLIKIKKLILLLNHEDGINWASADCADPKLAAKFMESIRKIPNWADRVHFDALSKLIPKFAYFQGIFCYGTPTADFFHIKAKLNVIVQTNVLHAIERTFPEILHFGFTKNFLKPY

SEQ ID NO: 132292 - protein, 54 aa, Heterodera glycines
  Coding regions on vcDNA: vcDNA=SeqID_58715; Strand=-; Position=1 -18,515-661
MRNKTKRVEEDFLDQMVAFSDQRRTAEAIALFLLLFSNKFGMGQQFEEGVTTFR

SEQ ID NO: 132293 - protein, 239 aa, Heterodera glycines
  Coding regions on vcDNA: vcDNA=SeqID_58716; Strand=-; Position=1-720
  Homolog annotation: Hit_ID=CAA82797.1; Match level="QueryCoverage =63%, HitCoverage=23%, E-value=1e-15, Identity=38%"; Hit description =gag protein [Ascaris lumbricoides]
MPAGGQQPAAAVTQAIAQVPAIPVAINAAAGANIQQPAAANHAYQPPPVPVANALNMPMPPAAAPHATARLPQLSLPIFSGEPMEWPSFWQSFESAVDRATLEPVDKLNYLHGCLRGEAARAVTAYRGGENYVHAIAALRRLFGDPRKIAEALQSELINLRSVDDSVGSLQHFLETLERVCRQLSNLNMPDDSPFMYQIIRSKLPSTGTRQNGTCGRHPMGYSSAQSWTRQSSRSQRRG

SEQ ID NO: 132294 - protein, 221 aa, Heterodera glycines
  Coding regions on vcDNA: vcDNA=SeqID_58717; Strand=+; Position=1-666
MTDIYYKIASFDHSYLNKINQSELFSMIDEIVEKFQLCNVEETRSLSRWVYCMLLVLLWIAIVMTGIFLYFNSLIRNMCKLMHICRDENDTTTINRILAGNTKTREHYLGCFPCDKLPNKINQYPSTLVANNDPSNKEGTHWIAMFIVDDRTVYYFDSFGRTPNRCISHFLRNYEKVISNKPTIQSVFSENCGYYCIYFVHFMCSFGGRNYESNFEKMTKK

SEQ ID NO: 132295 - protein, 179 aa, Heterodera glycines
  misc_feature (83)..(83): Xaa can be any naturally occurring amino acid
  Coding regions on vcDNA: vcDNA=SeqID_58718; Strand=-; Position=1-541
  Homolog annotation: Hit_ID=CAA82267.1; Match level="QueryCoverage =97%, HitCoverage=91%, E-value=8e-36, Identity=41%"; Hit description =TATA box binding protein [Acetabularia cliftonii] sp|P46272|TF2D _ACECL Transcription initiation factor TFI
FFPTIKNCVAVIDIKTRLNLEKIYIISPSTKYTPKRMNAVIMNVYNPNATAIIFGTGKFVCTGAANEKECRQAAEQVTERIRXCGYYDAQIQEFKVQNLVATADVGFHIRLGPLSDFLGEYCSFTPELFPGLVYRNQNPKISIIVFSSGKLNLTGSRSKEEIDFVFNQFYQIICNFKYS

SEQ ID NO: 132296 - protein, 200 aa, Heterodera glycines
  Coding regions on vcDNA: vcDNA=SeqID_58719; Strand=+; Position=1 -469,1181-1314
MDRLDTVIASLLNCPARNLCDCLNHLDEIQKVEKYLKGKTLQTTYKNQLGEYKGFEYGGITKECARKQMAYNGFKNVTVDQHFYVRHRICLRYANNPCVIEKHRNGHERFYPLELVKVKHGDKSDIYLGQNFPKSIPLLDENNSKIMTIIMILVVYANNLSQSGSQIAPAGAQVVAYLHSIEFELPLTNSWCFPLSPAGS

SEQ ID NO: 132297 - protein, 159 aa, Heterodera glycines
  Coding regions on vcDNA: vcDNA=SeqID_58720; Strand=+; Position=1 -345,390-524
MRLRQQAASQNPLPTRQAIANVRENMPFEAIIAGPSSSSLARNYRNYVVQERGERGDDQLDLADTAQIQIPENLRVNFVFDGFVDNLRMLVFATESGRNLLARFGQHAAIDGTFKCAPAHFTQIYTISVLVDKVAVPCIYGLLRSKSENTYSTVSQFVN

SEQ ID NO: 132298 - protein, 70 aa, Heterodera glycines
  Coding regions on vcDNA: vcDNA=SeqID_58721; Strand=-; Position=1 -165,212-259
MFVMQNADQQQLPDLAILRSSTSHVPLFVSSGWAIEFDLAANIALECIDQNPIRLSDLRSRTKLNELFER

SEQ ID NO: 132299 - protein, 72 aa, Heterodera glycines
  Coding regions on vcDNA: vcDNA=SeqID_58722; Strand=+; Position=1 -104,320-434
MPSLESVPERINFDEEEEKTLQKWRDENTFQTSLEDHQRHCHALGSSERLLCRTAFWLGHPRTSRGVRSGQN

SEQ ID NO: 132300 - protein, 76 aa, Heterodera glycines
  Coding regions on vcDNA: vcDNA=SeqID_58723; Strand=-; Position=1-230
MEREAMKPKETNTAEKVLLSQRLRETGVESGVAARRAKFGDKAAEPAGEKRGEKAVKTAPDREEKKAQHTTDETAE

SEQ ID NO: 132301 - protein, 194 aa, Heterodera glycines
  Coding regions on vcDNA: vcDNA=SeqID_58724; Strand=-; Position=1 -137,183-368,417-615
  Homolog annotation: Hit_ID=NP_494711.1; Match level="QueryCoverage =100%, HitCoverage=54%, E-value=1e-48, Identity=46%"; Hit description= prion-like Q/N-rich domain protein PQN-48, Prion-like Q/N-rich domain protein (36.9 kD) (pqn-48) [Caenor
YEALCPYCQRFIANNLGALLNRFGSRIKLDLVPWGNSILLRNGQISCNHGPKECDCNHGPKECDANRLMSCVLDEVSADQAVHFVICFERSLSVGSGVEQSLLQCSSFVRNSYKRIKLCYMGERGFLLLCYMGERGFLLQRQAAQRTMTAKENPIVEVPYILVNGYSPNTDANSVNIVALSHLIQKWLNLRERR

SEQ ID NO: 132302 - protein, 87 aa, Heterodera glycines
  Coding regions on vcDNA: vcDNA=SeqID_58725; Strand=+; Position=1 -141,188-310
MLPSMSKKQRKPEQNNRQLRIIEVQLFTPTARRYPHFDYEEMCKELGLEISKQKETAESNSFHDQDAEEIVRRLEAKYVCLRNCKIR

SEQ ID NO: 132303 - protein, 31 aa, Heterodera glycines
  Coding regions on vcDNA: vcDNA=SeqID_58726; Strand=-; Position=1 -88,442-449
MPNLALLRNAQSGTFYETTPKARYFSTNAQT

SEQ ID NO: 132304 - protein, 99 aa, Heterodera glycines
  Coding regions on vcDNA: vcDNA=SeqID_58727; Strand=-; Position=1-302
FFDKNRLIDHYVSVLLNANIVPDSVDRMRRDIKSDDLIVWAQWLQSLIEQQHKGPSRHSLHRDYVWMYLRIAYDMYELGTEKSEFEHTFTKMETLMKSN

SEQ ID NO: 132305 - protein, 304 aa, Heterodera glycines
  Coding regions on vcDNA: vcDNA=SeqID_58728; Strand=-; Position=1 -102,305-973,1020-1163
  Homolog annotation: Hit_ID=NP_703434.1; Match level="QueryCoverage =53%, HitCoverage=5%, E-value=5e-09, Identity=27%"; Hit description =hypothetical protein [Plasmodium falciparum 3D7] emb|CAD51454.1| hypothetical protein [Plasmodium falcipar
MATSDENNSGAYAKFADKVTILAKLTMHLRECLQLHEKPGIDTVNTLLKLLEGMVTKNGAEFGAMGARSYLLPSFSYDPRSFQYYDDDDLTLSRATFEEMGRPATNIDPPIASTPREDQNAHQENHAAIPNEHGDVEQLDESMGEPGHLRGDIIDSMLDTTQEENEDGGDSEEESPHDSEEEDMDTGEELTQQRPAVHEGAMEDDHISEAADANEQVLQSHLVADDDFEEMDDDDDGEEDEEDETEVEGGGELADFDDTLLDYVTDFNALAQQMHDIRRRINLNIDTNALTIRPQQVQKRNDEY

SEQ ID NO: 132306 - protein, 453 aa, Heterodera glycines
  Coding regions on vcDNA: vcDNA=SeqID_58729; Strand=-; Position=1 -198,247-699,746-1009,1064-1234,1284-1559
  Homolog annotation: Hit_ID=NP_500284.2; Match level="QueryCoverage =49%, HitCoverage=5%, E-value=7e-11, Identity=23%"; Hit description =ubiquitin-associated domain and HECT domain containing protein (4D798) [Caenorhabditis elegans] gb|AAG2337
MASPECSTYDRMFNLFEARINGNCCEKLTSKLLTPMLLFFNMYEQERSADIRQDLLQEALDGTQFQWFYWTADDHYTGAGEWREFTPLSVAQLNKAVREKKTSVRLTVAQRVYFIDLNEMTKRLLPDQQQQGFHPLHSSVPIYAKANLRGDFNMEKLVKLESELRKGTERHRLLVKGILKLVKSSSTQPLDNELAHNALTLLLRLVSLDGMAQEFLNEDGVKALLEMKRNPISAQMVPNGTSTPPTLNTLATLILRQCIDSDAALLQSVFEQMITATCNGQPISMQEITSRRHAMRTKRYQKDVKRVLRMLVPLAARSPPLYMDAAKKCMAIKQNEILVKEQRGDVTGNGSAAAASDQFIQALLSQIVTDLAQFDTLADADKNTRLMQPPNLLKLIAEVLRSYPKVAVRQVSASPIMSWATSNHFSSKVATWTMRWQLPMRATAVHMRNLRTK

SEQ ID NO: 132307 - protein, 67 aa, Heterodera glycines
  Coding regions on vcDNA: vcDNA=SeqID_58730; Strand=-; Position=1-204
MCKTVRGTTKRRHTWDSELKKGDEGDDKENIPPSDYHNLTTFNGHGNEEEEEEGEHNTFEYTNMPFI

SEQ ID NO: 132308 - protein, 23 aa, Heterodera glycines
  Coding regions on vcDNA: vcDNA=SeqID_58731; Strand=+; Position=1-72
ESVHPIYNVHIDAYSKAQRYFKA

SEQ ID NO: 132309 - protein, 126 aa, Heterodera glycines
  Coding regions on vcDNA: vcDNA=SeqID_58732; Strand=-; Position=1 -198,253-432
MELINQFWRDDSEKQFEDYQIPESPPYWSSGFLSIQYAIEKAFIELVRINIYIFENGLIVSLSFFTAKGDDALANVSLRLHRLPIPSYMNKQMATITVPLFLTMLLFVFAFSMLKDIAVERESGIM

SEQ ID NO: 132310 - protein, 110 aa, Heterodera glycines
  Coding regions on vcDNA: vcDNA=SeqID_58733; Strand=+; Position=1 -287,342-387
KFAKPSTSVSFIVVIWFPAFFAYSFEPFNENNELTREQLTFKKTNNSRCFLLVRCPIAREESKWIEWEEEAIGWEFLHQPNRINIQIDDEENIGDGLLDATPGPSDQQQK

SEQ ID NO: 132311 - protein, 129 aa, Heterodera glycines
  Coding regions on vcDNA: vcDNA=SeqID_58734; Strand=-; Position=1 -255,303-436
MPQKEVIQVESDYEIRRKPNISEALKLFKRHPTKIDTGKRKRKSQLNRPLLIVGAFALIPPTTAFNRICEAVKALFESLNNQLASTNLIVSFTNLVIRRTKNRLDELKRQRISITENVECCICRKRIMN

SEQ ID NO: 132312 - protein, 472 aa, Heterodera glycines
  Coding regions on vcDNA: vcDNA=SeqID_58735; Strand=-; Position=1-1417
  Homolog annotation: Hit_ID=CAA82797.1; Match level="QueryCoverage =52%, HitCoverage=39%, E-value=1e-14, Identity=28%"; Hit description =gag protein [Ascaris lumbricoides]
PNPTKGRLIRPSPPLIRLTHQRVGTFGHQSPTSSSCPTRGKTHSAITADPSLTQQRETQPATSSRIFESSIGPCAARTKAYIEAATVNLGKDTTDVSIQADLTAERRGLRRAIRLLEDCNDKWQSLLLKFNGADRQQEEQRYDDFKPSGKHFMEWADKARGEVDTIDGVIGPEDDDEITGSIISQPANPPQIQHVQPPPPRHEVYLPPISLPKFTGEPREWPMFWRLFRSSVDNLPIDDFKKHIYLLGCLPHNSPARRAVDLYPPSDENYPRVVDILKKRFGDSKTITESLQAELLHLSKPGESVLSLRNFAESVERICFQLMDFVESEENMFMASTIKSKLPFSILTHVVEKELSSGRTFSCLDIRKALQAIVEVKEEVQRCAHVLRGDERPRSSTFNSPPQQRGAWDQRGDNRHSNNRQSQPPRPFNRGVTHQPEYRAFSAINKNPERAKTTARKWGRPCSLCSGTDHLP

SEQ ID NO: 132313 - protein, 49 aa, Heterodera glycines; identical to SEQ ID NO: 130195
  Coding regions on vcDNA: vcDNA=SeqID_58736; Strand=+; Position=1 -110,199-238

SEQ ID NO: 132314 - protein, 302 aa, Heterodera glycines
  Coding regions on vcDNA: vcDNA=SeqID_58737; Strand=-; Position=1 -66,127-206,255-324,373-480,523-576,621-645,703-800,851-961
  Homolog annotation: Hit_ID=AAF37720.1; Match level="QueryCoverage =99%, HitCoverage=95%, E-value=2e-81, Identity=46%"; Hit description =galectin [Dirofilaria immitis]
GEWVKEERKSNPYKKGDDIDLRIRAHDSKFTVYADQKELKIRAHDSKFTVYADQKELKEFEHRVPLSHVTHFSIDGDVLITQHVTHFSIDGDVLITQIHWGGKYYPVPYESGITGDGFAPGPVPYESGITGDGFAPGKTLLIFGTPEKKGKRFHINLLKKNGDIALHLNPRFDEKLKKNGDIALHLNPRFDEKAIIRNSLIAAIIRNSLIANEWGNNEWGNEEREGKIPLEKGIGFDLKVINEEYAFQIFINDERYCTYAHRVEPIFINDERYCTYAHRVEPHDLHGLQIGGDVEITGIQIF

SEQ ID NO: 132315 - protein, 80 aa, Heterodera glycines
  Coding regions on vcDNA: vcDNA=SeqID_58738; Strand=-; Position=1 -109,153-284
FWRRIHRLGKLPIKSFVASSPNLSGSNSKSLSTDPSQFGGVCHGFRRGILSRQTARTAESKRTLSMHLTGTETKGIWIDL

SEQ ID NO: 132316 - protein, 388 aa, Heterodera glycines
  Coding regions on vcDNA: vcDNA=SeqID_58739; Strand=-; Position=1 -58,153-256,499-579,681-795,872-952,1151-1252,1884-1948,1995 -2106,2309-2587,3421-3590
MSSNFIGSPNCFFRPTADQAAAEEVDKYEVFSWHGDLSDQLAAQFLVSDQQLLKECREKLASAELRETKLLCKNGELNAENKALKAELEKQKLMSENSELKAKVEKMEQEKQQQLDKKYVSVDVFNSLVERIKQLENRQNKEEGRKAEEKQQKESVGQQNKNTEQKLDGKYAVVDKNNVLVALVTSSGDHSPPAVVSAKVAKEVPNSQQQNGWDAKVCHKDIEIIGEKQLTINCKGNRFVLLRLEVPLDGSIGQILNSYGYRSDGSFGCNGINRPCKMPMSLFGSSFSPVAMQSADVEMAYKSSEFSTGDVVGCGIFLDTRLIFLTKNGQRMEGTPIKVEAEGNECTAGEIEAENGKMKTNKKTNFADQFLRKISILRVVFFFLLHFC

SEQ ID NO: 132317 - protein, 121 aa, Heterodera glycines
  Coding regions on vcDNA: vcDNA=SeqID_58740; Strand=+; Position=1 -187,377-490,553-617
MRWKEFKFYKCNYLFLFYFPLEQKLNANAEFANSIQTKCTKFEEQQNKLKNCVDILNYRFGNALIEQILELQNEQKEILGRMSEMEKKQQNDEEKETEKYGKLNAILGRIIIVYESKLDIC

SEQ ID NO: 132318 - protein, 29 aa, Heterodera glycines
  Coding regions on vcDNA: vcDNA=SeqID_58741; Strand=+; Position=1 -15,75-149
MARNKRINNLLLYHFSSSLDVEEGLTRHN

SEQ ID NO: 132319 - protein, 102 aa, Heterodera glycines
  Coding regions on vcDNA: vcDNA=SeqID_58742; Strand=-; Position=1-927
FLNIFSERVLKRTKFYLHVSLGTLMLFLSKREMNKIFKNFYFFLNRPKSLGLLFFQKLIRSAPNFAGILKGREITYFKYYLVSSFKLFLSKKFFFWISGQSP

SEQ ID NO: 132320 - protein, 32 aa, Heterodera glycines
  Coding regions on vcDNA: vcDNA=SeqID_58743; Strand=-; Position=1-99
KVYNTFDSQDVSVPSTKKAQRCLTCQIGRDGV

SEQ ID NO: 132321 - protein, 30 aa, Heterodera glycines; identical to SEQ ID NO: 126994
  Coding regions on vcDNA: vcDNA=SeqID_58744; Strand=+; Position=1-200

SEQ ID NO: 132322 - protein, 169 aa, Heterodera glycines
  Coding regions on vcDNA: vcDNA=SeqID_58745; Strand=+; Position=1 -36,878-1351
MPKHNGNEKQMTEIAHFVVNVVFYRLPIFAPTCPWFGTSPSALYTIGTFLVYFFEYLIYVLHIAITLNRCSCVWAPIRHKEVKQTHKQFTPLHFLSFGAVLVSRQLRLLLLFLWHFLPTVWSLLPSWSNSTKRTRPRAQFRSLSPTNFILYVQIFANSFEIFVALRIAL

SEQ ID NO: 132323 - protein, 111 aa, Heterodera glycines
  Coding regions on vcDNA: vcDNA=SeqID_58746; Strand=-; Position=1 -107,206-302,345-476
MNNNLVVWLNVDLFPRLFFIGLLLPNLRTLALAKTIKSKDKMTADRIDNHNIITNDDVEIIYPIQNQHLKQQLLGLNHQNLCNFVAKKIMMDNPSEEGLNEKNIADMEMDD

SEQ ID NO: 132324 - protein, 83 aa, Heterodera glycines
  Coding regions on vcDNA: vcDNA=SeqID_58747; Strand=-; Position=1 -133,190-308
MSNFCYFAIFACISQIFGTANGMNTEMGFQPHFQQNTSTFLRKLEFANEPKLLIPIENVIAFLKMFSQLSSSLNSNDFSTVCF

SEQ ID NO: 132325 - protein, 180 aa, Heterodera glycines
  Coding regions on vcDNA: vcDNA=SeqID_58748; Strand=-; Position=1 -177,235-450,504-653
  Homolog annotation: Hit_ID=CAE62630.1; Match level="QueryCoverage =71%, HitCoverage=38%, E-value=4e-10, Identity=29%"; Hit description =Hypothetical protein CBG06760 [Caenorhabditis briggsae]
MLDQIYNLSLSHRQLFNYFGICIDIPSTIVYILEMITIIKHKQFSKSPFYKLFFIRGVFDILSLVPNSLGNLLPAFFGQQLLSIYSTVPNWAIVLLTFFTKTLVFQVSNIVTVFILLNRFTAIAFPLRHKMLWKKHFRHLMVFLLIVPMLITFPIMRMRTTIIFYDSNSFLLDDKDPVKT

SEQ ID NO: 132326 - protein, 90 aa, Heterodera glycines
  Coding regions on vcDNA: vcDNA=SeqID_58749; Strand=-; Position=1 -171,594-695
MAAAAATFAVAIRWAPSQARRLIKSSSRSSVQQCGWPMATFVQPVAVFSGPQQWKGGESQAIKAIGQEKNIEVTDVHIGNPSKGKKKLII

SEQ ID NO: 132327 - protein, 91 aa, Heterodera glycines
  Coding regions on vcDNA: vcDNA=SeqID_58750; Strand=-; Position=1-816
MFEYPKRTLEKIDFFVFGAVPPNRCAQIYGETESFGNSFPIACTLILRWIFAPHKCLSTPNGHLKKSIFLFSGQSPRTDAPRFMGRPNPSE

SEQ ID NO: 132328 - protein, 55 aa, Heterodera glycines
  Coding regions on vcDNA: vcDNA=SeqID_58751; Strand=-; Position=1 -78,347-378,1226-1281
MNSDNSLTYEEMNNTNRRAHSSSNIKIWAFELLEEKSRNLHDNGELEDDDDEHDG

SEQ ID NO: 132329 - protein, 327 aa, Heterodera glycines
  Coding regions on vcDNA: vcDNA=SeqID_58752; Strand=-; Position=1 -726,882-1137
  Homolog annotation: Hit_ID=AAL77223.1; Match level="QueryCoverage =62%, HitCoverage=10%, E-value=5e-15, Identity=33%"; Hit description =Bck1-like MAP kinase kinase kinase [Podospora anserina]
MPPYGPAHNQQQQMMPPSAMGSVQPGAAAMNNWMDWNSAAAMPPRGNYPVAPTNAMKAGTPTGAYIPPQSGGMMPPPAGQVPYYAVGMPTSTAAAHGQPMEPAAYHQQQQQHYQAVQQQYTNYHQQQPNMTYNTQQQQQMLFHQQQQQQLQQQMMMQQRQQQQHRQMVAAATAPPAAGTTQHKAELGGVQAGQPAVQLGSYASSAAGGGGMAPAAGGPSAVNSAAQQQHQWPGSVTPVEDLYSSMDDLLPVPSEQRETAGHFGGAVTSSANTAVMSSGGGIGKVTVNILHLPEMVRGELNSVEQRFQFDPTVELNTDANAFIVKCIL

SEQ ID NO: 132330 - protein, 314 aa, Heterodera glycines
  Coding regions on vcDNA: vcDNA=SeqID_58753; Strand=-; Position=1 -18,62-124,1061-1361,1550-1755,2187-2543
  Homolog annotation: Hit_ID=EAK81553.1; Match level="QueryCoverage =73%, HitCoverage=24%, E-value=8e-10, Identity=28%"; Hit description =hypothetical protein UM00168.1 [Ustilago maydis 521] ref|XP _397783.1| hypothetical protein UM00168.1 [Usti
MPDRSAVEDYVFQKCSSKDEYMRTIAKVPPDPQPTHQQQQQQQRMAAAVQHQQQQIGAADAFHQPMGQPPPAMSSAPSMAMAASGTTAAAVMVGATSHAGTVVDTRDVAGVISSSNFQPAHQQQQYPYSTAPSVGQPITMATSSASAAAYPVATPQLMMGTAGAGGGGKMPNAVLTAQQMQQQRHWQRQQQQEQMQHHHPPANMPTTTLHQQQFSAGGPFMGPPHQQQQHAIVPGAAAAMAQQYGGSAAGFDYPPTLAPEIVQQLKALGEEERPYYEKVCQLQQFVAFLHNSLNKYAADPAMVGHCDQNFKWSC

SEQ ID NO: 132331 - protein, 105 aa, Heterodera glycines
  Coding regions on vcDNA: vcDNA=SeqID_58754; Strand=-; Position=1 -98,405-624
MGPIEEKEAIELNFKDPWNTIQIAINEEEIGDGFYLEPGAGPDPAQDFAGSQSAILHFLEKTGFAGFAGLIRPDPVLQTFLNSNPATGSANLNVCAGLCGILLIF

SEQ ID NO: 132332 - protein, 143 aa, Heterodera glycines
  Coding regions on vcDNA: vcDNA=SeqID_58755; Strand=-; Position=1 -58,284-657
MCAQKALHSATVGRATFSDSGRFGGAARAQNQAQIGRRLGRVIHFLGDNSRPADGLGFISLAFWIFLGPGSRFFKKKCLEIDTETEILSNFHCYYGIIQGLKVIQKANLIFHQVPVHIAFYYCSPVFVLLLLFVITRYCFATL

SEQ ID NO: 132333 - protein, 101 aa, Heterodera glycines
  Coding regions on vcDNA: vcDNA=SeqID_58756; Strand=+; Position=1 -172,237-370
MIIFHNFEKRNQKIRVRSSLSLAILGRLFDAKNVGIDQVRKKYKVMAKKLKIVIIKVEFILKFKSSNQFLIKMLSRFSYDPFYRRSLLPMTTVGNGRHQGC

SEQ ID NO: 132334 - protein, 19 aa, Heterodera glycines
  Coding regions on vcDNA: vcDNA=SeqID_58757; Strand=-; Position=1-59
TFAFSSLALPNTHTIFEML

SEQ ID NO: 132335 - protein, 19 aa, Heterodera glycines
  Coding regions on vcDNA: vcDNA=SeqID_58758; Strand=-; Position=1-59
TFSFSSLALPNTHTIFEML

SEQ ID NO: 132336 - protein, 19 aa, Heterodera glycines
  Coding regions on vcDNA: vcDNA=SeqID_58759; Strand=-; Position=1-59
TFSFSSLALPNTHTIFEML

SEQ ID NO: 132337 - protein, 19 aa, Heterodera glycines
  Coding regions on vcDNA: vcDNA=SeqID_58760; Strand=-; Position=1-59
TFAFSSLALPNTHTIFEML

SEQ ID NO: 132338 - protein, 111 aa, Heterodera glycines
  Coding regions on vcDNA: vcDNA=SeqID_58761; Strand=+; Position=1 -165,299-469
MQYNAFKPRREAGQLQNFVPHFTVESPSTLLDNYVSMSTVAFGQLWNGKMGISDGLLIMQYNAFKPRREAGQFQNFVPHFTVQSPSTLIGQLRVNEHSRLWPVVETKKWEY

SEQ ID NO: 132339 - protein, 74 aa, Heterodera glycines
  Coding regions on vcDNA: vcDNA=SeqID_58762; Strand=-; Position=1-392
FSYIFHNLFQKAKKNYSILKRNSAQKGGMVRRKEEFLEKSAPHLIFPFFRSTTGQRRLCSLTRSCPIRYLDFPQ

SEQ ID NO: 132340 - protein, 473 aa, Heterodera glycines
  Coding regions on vcDNA: vcDNA=SeqID_58763; Strand=+; Position=1 -153,298-423,596-843,887-1040,1348-1727,2379-2526,2580-2684,2757-2864
MSSSSAKLDEFQNALPFGVFLNDFDGAALGIVAFEIHCAIGTNDVNTCKTMATEEKSRKLTTRGIRTSTTTRATPPKTKLKIVTPFKTETPRVPNLFTPRDSTVKHFGTNCVQIDFPAEIAQFSLNISASLFGIACKQYLRKYKIGQLPKNYDEKMEMKDKMEACGKVPTETNCKKSYELIGCSESKSQQKIANEEIAEVCRKHLANAKFSDGFRIRNCASRKPGTKNETIGHFLGSIAEQSIDEGWAKSIHFIPPSDRFLDVFFQISNPPFSRLISNETNLMPYENDPNKVRVGKENRKRLNITRRFRRDAICWEMIVRRHAKFCGKLGKFWSAAPPLMLLVHVFVNFRSPTWDKTCVTFTTDLSHGPDEGIEIYDKKDGYCGLSWVGHIKEWQRVSINCTNSDTVAHEFLHALALKHEQDRDDANKYIKWNPTPRNQKEPSKTENYGFPYDFHSILHYAAVKTSGSVILKV

SEQ ID NO: 132341 - protein, 83 aa, Heterodera glycines
  Coding regions on vcDNA: vcDNA=SeqID_58764; Strand=+; Position=1 -75,175-351
MIKLNGQYREIRGVNESKVFFFECFRREGETKSFWGYWKDKSKDPIRIDEMQCLSYEQAGIVKPPNKTVIDYPLRFKSANTNE

SEQ ID NO: 132342 - protein, 125 aa, Heterodera glycines
  Coding regions on vcDNA: vcDNA=SeqID_58765; Strand=+; Position=1-378
MEISKSVNNTNQTFANASSSPAQFIIVLYFRISHFDLFVPPLPFNLINNLTRERLTLALIDQGTFLLVRCPLVRDEPKWANWEREAKEWPIDGQMNRIVIGEHEQEQEEESEDDGLYLVNLLNTG

SEQ ID NO: 132343 - protein, 157 aa, Heterodera glycines
  Coding regions on vcDNA: vcDNA=SeqID_58766; Strand=+; Position=1 -106,154-266,318-497
  Homolog annotation: Hit_ID=CAG01175.1; Match level="QueryCoverage =100%, HitCoverage=9%, E-value=5e-32, Identity=46%"; Hit description =unnamed protein product [Tetraodon nigroviridis]
RIRPQSGKEKEEPICLSVIPGEPQLTIGRDKSFTYDFVFDQLTPQKFVFDQLTPQKTVYDKCVRELVDGAFEGYNATVFAYGQTGSGKTFMGTSLEGDTGSGKTFMGTSLEGDPARGIIPNAAQQIYDEIEERREQARRSGKVIPSFEVSAQFIEVH

SEQ ID NO: 132344 - protein, 37 aa, Heterodera glycines
  Coding regions on vcDNA: vcDNA=SeqID_58767; Strand=+; Position=1-112
MHSAAAFNQLMCCPAAAAMSFLPAALQSSATIASGNA

SEQ ID NO: 132345 - protein, 59 aa, Heterodera glycines
  Coding regions on vcDNA: vcDNA=SeqID_58768; Strand=-; Position=1 -105,245-319
MVCDNVFNERQRLKNRVTAHAKMLATLLSPLDCNDLELVALADRFTACRYIPREEYGKV

SEQ ID NO: 132346 - protein, 65 aa, Heterodera glycines
  Coding regions on vcDNA: vcDNA=SeqID_58769; Strand=-; Position=1 -85,430-542
MQFSVVIIILFTLAMFFHSFPLSEADGIQNAIDVYGSANSFADSDGPQILAIPRKIKSAFHEMVI

SEQ ID NO: 132347 - protein, 79 aa, Heterodera glycines
  Coding regions on vcDNA: vcDNA=SeqID_58770; Strand=-; Position=1 -69,450-620
MSSTTTAAAAATANQNVLELRRLIKKFFAARSLYLSEQALTYLVDQLNSFGRAQCQTVMARVVQLVERKGGRSPFLLLN

SEQ ID NO: 132348 - protein, 181 aa, Heterodera glycines
  Coding regions on vcDNA: vcDNA=SeqID_58771; Strand=+; Position=1 -165,469-588,719-740,1772-2010
  Homolog annotation: Hit_ID=CAE67634.1; Match level="QueryCoverage =55%, HitCoverage=10%, E-value=1e-17, Identity=49%"; Hit description =Hypothetical protein CBG13191 [Caenorhabditis briggsae]
MADAGQLVALTGDGGVDKTALLNTLLDHNLKTLSVEGQVLINAHSLGRFITYVIGYVQQDDLFMGTPTVKEHLMAPAQLWMVGHTQRTMRRRVNELEEAISDGPSFEVTRTDAKGCPAPDDRQPTAHHRQPTAHHRQPTAHHRQPTTYYNKPTTAEHNQPPAAKHPTTPKLIGFVQNLLEI

SEQ ID NO: 132349 - protein, 181 aa, Heterodera glycines
  Coding regions on vcDNA: vcDNA=SeqID_58772; Strand=-; Position=1 -169,342-400,556-624,678-764,849-1010
  Homolog annotation: Hit_ID=NP_741153.1; Match level="QueryCoverage =66%, HitCoverage=25%, E-value=5e-39, Identity=63%"; Hit description =chaperonin Containing TCP-1 (58.9 kD) (cct-6) [Caenorhabditis elegans] gb|AAC46642.1| Chaperonin containi
MVTVPLQGEDKYTFVEECKSPKSVTLLLKGPNKHSITQLKDAIYDGQRAVANALKDGAVLPGAGAFEIAGYCALKKAFAEALLVIPKTLAVNAGFDAQEAIVKLVETFSAAGELVGLDLESGEPCVPQRLGQCVREAGESERLSEHRLQSAGGGRGDACRHARLEGGTVKMNGTEMKEQHQ

SEQ ID NO: 132350 - protein, 54 aa, Heterodera glycines
  Coding regions on vcDNA: vcDNA=SeqID_58773; Strand=-; Position=1 -110,177-231
MTLKCSSAEHLSTITPCLAQIGQKGANMSKEEFDFREFNDKMSVLRMFRPCLTV

SEQ ID NO: 132351 - protein, 169 aa, Heterodera glycines
  Coding regions on vcDNA: vcDNA=SeqID_58774; Strand=-; Position=1 -108,377-610,1241-1408
LTCKAGYANHLSGENATNEICESKAHHCFSVMCMEQNYTSTALITWGCSGDADKKGCEQFFVNAANSALHSTKQRCECQFGDEGKDMANEQAKLPEKEKPGPIPTLSPEALEKISEMFTFWGCSLDNDCEEVSKFLAFGQKCQCQFGAKGENMGNLNFDSPFYLPMKGK

SEQ ID NO: 132352 - protein, 167 aa, Heterodera glycines
  Coding regions on vcDNA: vcDNA=SeqID_58775; Strand=+; Position=1-503
MDTKRTTTGTAPTPTHLREMPMPSSEQQMTPSASGTSSVTDEIVSQQAQMPWHHQMSEAEFGQMPTDDYPFYQNWEQSFVLPNVEQEFEGLDHFYQNDFQMPVENEWHQSEREQPIDNNEPSWDGWQRQDREENEEVNQSDQKAQPLQMTKNVGKFDAAKLDNQLSP

SEQ ID NO: 132353 - protein, 453 aa, Heterodera glycines
  Coding regions on vcDNA: vcDNA=SeqID_58776; Strand=+; Position=1 -274,633-933,1170-1314,2146-2265,2679-2932,3221-3488
MVINCTELPQNLSSHFSAGKVLARKKAAKFEPGQSSTQSAGQQQQKTVVVGVGHGEHMQQKGQGHQGIQGQEHQVIQRQGIYNKGAIAGFLLYCVRHIVLMSLRSLQIASPDSFLDGTIQQIRNGHPLEMALGPPKMALAQKLSQMNAMEVAKGIKMHLLNDGEIKNYKIFAEIMDQTMENCVAVLGQTALTNGDNVNVNANSNDGDDISPSVVLFFFSRLFRKLAGFLNAPFMEEMAFSAELKGTSRVAMFILIREIRTLFVSQFDASFKFIVHKGQKIQQAMELNKLDAFETAIEHFSLAHLAICSTISAFTDKKICQMDLKIFFILLAKFLHRNFACLLLSKENISNFVQMFTHYMTIEFGSQFLPKNAKDSLADNQFMAHGWDEMGHFLSTAGKQLTELVQHLDNWRAAESAKLGENDYKNEAEQSAKKDFWHKNCTNFASSSGTKQQN

SEQ ID NO: 132354 - protein, 100 aa, Heterodera glycines
  Coding regions on vcDNA: vcDNA=SeqID_58777; Strand=+; Position=1 -181,427-548
MTQTVQRILLISDSNKKNSGANVAQRIVPLDPQEDIAEKAFCRHSHFVHVLLNFHPFGQFGVRMWLLFFASALQNSKDADRHALVWDIRTGQCSAELRGA

SEQ ID NO: 132355 - protein, 47 aa, Heterodera glycines
  Coding regions on vcDNA: vcDNA=SeqID_58778; Strand=-; Position=1-141
MATKCLPLELLYEIVPLIPAENATPNALSSCRLLHKLLLSRVIKWKE

SEQ ID NO: 132356 - protein, 81 aa, Heterodera glycines
  Coding regions on vcDNA: vcDNA=SeqID_58779; Strand=+; Position=1 -57,332-520
MSTVPFVQLWNGKMEISDGLLIMQYNAFKPRREAGQFQNFVPHFTVESPSTLLDNYVSMSTVAFGQLWNGKMGISDGGALF

SEQ ID NO: 132357 - protein, 62 aa, Heterodera glycines; identical to SEQ ID NO: 131736
  Coding regions on vcDNA: vcDNA=SeqID_58780; Strand=-; Position=1-386

SEQ ID NO: 132358 - protein, 43 aa, Heterodera glycines
  Coding regions on vcDNA: vcDNA=SeqID_58781; Strand=+; Position=1-133
RLIEPVKSFRMISRLFDSVNNFKSYIDSKLAQTELARRNWPVP

SEQ ID NO: 132359 - protein, 107 aa, Heterodera glycines
  Coding regions on vcDNA: vcDNA=SeqID_58782; Strand=+; Position=1 -81,131-373
MLYSFFIIYFLLIIHRFLIHISNAIQFGDDKMLIAFVSNGQKTQISEYSKQKYETHLGIVYYMRKNWHCDKTRRDLMNMNEKNVKNIVNCWTLFTNICSENTSEFQQ

SEQ ID NO: 132360 - protein, 108 aa, Heterodera glycines
  Coding regions on vcDNA: vcDNA=SeqID_58783; Strand=+; Position=1 -47,103-382
MSDNPKEAEREMEKAIFIAADCWLEVFGLLPRSQLGLGIALISHRFDYYVDEHFKICKWTFDKLKIRSKIGENGAKEMEIVNSDGKELSIPQNSLPNKFIRFGCILIK

SEQ ID NO: 132361 - protein, 91 aa, Heterodera glycines
  Coding regions on vcDNA: vcDNA=SeqID_58784; Strand=+; Position=1 -129,818-961
GENATLEEIDNFIEQRRDAASTGQRSQRRPCVLETPEAPPKPLNFPCTNTNCDRSFPSKKALSNHKRACSAPARVTPPPAAQMTPRRRVLN

SEQ ID NO: 132362 - protein, 165 aa, Heterodera glycines
  Coding regions on vcDNA: vcDNA=SeqID_58785; Strand=+; Position=1 -76,766-920,1819-2082
  Homolog annotation: Hit_ID=CAE62158.1; Match level="QueryCoverage =53%, HitCoverage=1%, E-value=3e-12, Identity=41%"; Hit description =Hypothetical protein CBG06205 [Caenorhabditis briggsae]
FDESDAEDPAEEVPPCTVEIGLRSLDTPKAQRTRSATVQRKSRRLAAVNNAASAGQSADKAHAQSRDGIFRGNIIGEVRCADEPLLAKAPFNVPGRPYPPEPLYTTDKSIMLKWERPSLDRGTPITDYELEIRERGTKLWEKATTTNASLWEKEAFGNVPDTRIK

SEQ ID NO: 132363 - protein, 418 aa, Heterodera glycines
  Coding regions on vcDNA: vcDNA=SeqID_58786; Strand=+; Position=1 -160,622-770,955-1128,1355-1552,2106-2221,2782-2959,3318-3465,3778 -3911
  Homolog annotation: Hit_ID=CAE62158.1; Match level="QueryCoverage =87%, HitCoverage=64%, E-value=6e-28, Identity=34%"; Hit description =Hypothetical protein CBG06205 [Caenorhabditis briggsae]
MGPLACDMTVLVGEQAKLLVPYAANSSRPKFVWSKNGKPMDPRDDPRVKEEKSDILIQLCYPKCEQSDTGTYSIRIVNDLGSDSVDLRLKVVDRPAPPEGSLKERTASSSGRRRVGSTAADRSAQAAAAACAADEEAKDEVYNNEEERQDMAVVTKRMAILDLETSGTPARIVEIPENVTVVEGELAIIKCVVEGNPAPTIVWKKGGRKMPLTDDRVRCQTDGDTGHSNLDFRAKQKKRGTGISNSEQEKQRQRSDAEPKSKAERRKRQVYVVEEPRDTFVVPLNSQHANEKENATFECEVNDKEIDVKWFHDGAEIGMDGRHFKERAGCRRRLLIINVLIEDHGEYKCTAKDDETMAQLIVHPKFVKKSGAQAEKRNLIAGKMGSGGTFLRRDLVKNEKELSRQRDCGNANVKMPMI

SEQ ID NO: 132364 - protein, 97 aa, Heterodera glycines
  Coding regions on vcDNA: vcDNA=SeqID_58787; Strand=+; Position=1 -72,123-162,418-599
MCPLCRAEITDDFKNLLSGKDQAKAGPSNSKREQTDMDEQFARALMYVDYDDDDDTITHGNNPTANDAAMAQRMQKQLQEQQEEADAELARRLADQL

SEQ ID NO: 132365 - protein, 129 aa, Heterodera glycines
  Coding regions on vcDNA: vcDNA=SeqID_58788; Strand=+; Position=1 -97,140-432
MALNNLFAFASTHGEKAPADQMGGRLDTCKYNGQFSFLFSDLIAPGVRRPSFAQVYTLAPEDALNVREEALDTAVSPHVRRTILERLEALMRQNPFGQTFQTVGTKIAAARAATGEMPHFRVYHTNNHI

SEQ ID NO: 132366 - protein, 238 aa, Heterodera glycines
  Coding regions on vcDNA: vcDNA=SeqID_58789; Strand=+; Position=1 -220,620-1116
MIGKAERAFDAAMKHRPKNFNKICRGMEGILSEWDCTEMRAFNELWEGVKRRPEETLDEFAERIYGIVDRAHPEAEKKLNDLRLSNQPPAQQTNVEAGPKRKASNRQRNSSSSSCSVKAAKIKENSPEIPKWFLNAMIAALALLASTFSNEKSKIGRIWKGKSPTNGSDDEKRRKADGKLRTIFSPKAGEEMANDIADNLENLSIANTELNTPLSTPNALPMSPKRRGHRFVEGEDVI

SEQ ID NO: 132367 - protein, 87 aa, Heterodera glycines
  Coding regions on vcDNA: vcDNA=SeqID_58790; Strand=+; Position=1-263
MALSTKLLPGLFLRSSAFFAPISCSRMAKSDVPALSTTNQPYPYKEQTPKGIFEKMGLQKTPDGASIGEFAVMRMDDMMNLIGRGSL

SEQ ID NO: 132368 - protein, 140 aa, Heterodera glycines
  Coding regions on vcDNA: vcDNA=SeqID_58791; Strand=+; Position=1 -170,242-494
MGRKWPGATAAAGVRVVLLVLLPHRPLRPTAVVLLSRTPCPRRRRPSTPTAVPLQQRSSDEEDDYGKKYKYDDDEDDGEEEEEPVMMTCDDDEEDEEDGDNSWVPWAVTTSRHQNRHPKAAPKEHKARSNNHKRHKKSSR

SEQ ID NO: 132369 - protein, 37 aa, Heterodera glycines
  Coding regions on vcDNA: vcDNA=SeqID_58792; Strand=-; Position=1-116
  Homolog annotation: Hit_ID=AAH51840.1; Match level="QueryCoverage =97%, HitCoverage=52%, E-value=7e-12, Identity=94%"; Hit description =Sec61 gamma [Homo sapiens] ref|NP_035473.1| SEC61, gamma subunit [Mus musculus] ref|NP_055117.1| Sec61 gam
YQKIAFATAIGFAIMGFIGFFVKLIHIPINNIIVGGG

SEQ ID NO: 132370 - protein, 78 aa, Heterodera glycines
  Coding regions on vcDNA: vcDNA=SeqID_58793; Strand=-; Position=1 -141,583-678
MDLLLFQRDKYALAYNCTNFDANLVPIGQRIHTVHGIILIIMFFVFELPPKLRHKNDPFHLSHGHEYFFSISCCTFPA

SEQ ID NO: 132371 - protein, 252 aa, Heterodera glycines
  Coding regions on vcDNA: vcDNA=SeqID_58794; Strand=+; Position=1-759
  Homolog annotation: Hit_ID=NP_702063.1; Match level="QueryCoverage =96%, HitCoverage=5%, E-value=2e-16, Identity=21%"; Hit description =hypothetical protein PF14_0175 [Plasmodium falciparum 3D7] gb|AAN36787.1| hypothetical protein [Plasmodium
DSIHRIQSLGLNPPTFQSLGLNPPTFQSTGLNPPAFQSLGLNPPTFQSLGLNPPTFQSVGLNPPTFQSTGLNPPAFNHWDSTHQHSNQQDSTLQHSITGTQPTNIPINRTQPSSISISGTQSTNIPINGTQSTNIPSNGTQPTNISISGTQFFCISITGTLFSCVSIKRTQSTAFNHWDSTHQHSNHWDSTHQHSNQQDSTLQHFNHWDSIHQNFNHWDSILPNSNHWTQSHQSFSNTITGTQFSDISITGT

SEQ ID NO: 132372 - protein, 63 aa, Heterodera glycines
  Coding regions on vcDNA: vcDNA=SeqID_58795; Strand=-; Position=1 -99,423-515
MDETQIGDSAKENEAIRLKIQKDQQQSKESQSTQQKLSQRRSSTFGSSARQHRIYYQSKKQFV

SEQ ID NO: 132373 - protein, 141 aa, Heterodera glycines
  Coding regions on vcDNA: vcDNA=SeqID_58796; Strand=+; Position=1 -125,169-286,333-515
  Homolog annotation: Hit_ID=NP_497969.1; Match level="QueryCoverage =81%, HitCoverage=7%, E-value=9e-14, Identity=36%"; Hit description =EMB-5, abnormal EMBryogenesis EMB-5 (175.8 kD) (emb-5) [Caenorhabditis elegans] emb|CAA84801.1| Hypothetic
MTSYIEQEADLSEGHDSDSEVSEPVAKKAKKNKEKKRRHQISSDEEEEEDEGDEEEMRDFIVNEGDEEGGDEGVEAEADGESEKGSDVSDDLLDDDLDLLNENYQNTRGRVEISDDEEDVRERIKDRIFGPSNSPFFIFLC

SEQ ID NO: 132374 - protein, 134 aa, Heterodera glycines
  Coding regions on vcDNA: vcDNA=SeqID_58797; Strand=+; Position=1-405
MGLWSTTTCPLWDCGQQRPAPYGIVVNNDLPLMGLWSTTTCPLWDCGQQRPAPYGIVVNNDLPLMGLWSTTTCPLWDCGQQRPAPYGIVVNNDLPLMGLWSTTTCPLWDCGQQRPAPYGIVVNNDLPLMGLWST

SEQ ID NO: 132375 - protein, 76 aa, Heterodera glycines
  Coding regions on vcDNA: vcDNA=SeqID_58798; Strand=+; Position=1-232
FSLIVPPSFSNNSNNNNDSGTTKASTTNDDDDDANNLLILHQNCATNVGEKECFFEPTVSPLSFLLYMDLSEIYGE

SEQ ID NO: 132376 - protein, 108 aa, Heterodera glycines
  Coding regions on vcDNA: vcDNA=SeqID_58799; Strand=+; Position=1-327
MPKYVLHPIQLFTSLNNTENVENAQNSPRFARARFHVQFNATARAFAPPLVLLAHVVYASPPTAQRDNDSDVEFGLAQDAAGAAELVEMAPATGIIVPRVKEKNNFET

SEQ ID NO: 132377 - protein, 335 aa, Heterodera glycines
  Coding regions on vcDNA: vcDNA=SeqID_58800; Strand=+; Position=1 -87,150-359,424-541,839-1002,1057-1181,1727-1815,1951-2165
  Homolog annotation: Hit_ID=AAR85527.1; Match level="QueryCoverage =68%, HitCoverage=92%, E-value=4e-57, Identity=46%"; Hit description =14-3-3b protein [Meloidogyne incognita]
MTDREKHLHFVRLAEEAARYDEMVQGMKQVIELDAKLNENERKLLGVAYRKSVTGQRFAWRVIASVLARGKGTKRQLEMVKQLLNKLEREVEERCREILDLLDRVLIKEAADDEAKVFYLKLKADHFRYLAETRAVKNGVAEKAKQAYQEAFDLAKNKLRPMHPIRLTVALNFAILQFEVQKSPADACQTAQRAYDDATSDAQTTGESICAESVTIMGLLQDNISYWSGNTSKTDSICFGIINGQIAHFDNGINAVVHLLLNISVYIEVQAVQQILMGKEMKMDNSKNGETRQEEENSIRLGGETEEKERKRKNSAEGRGENEAEKRKEQQQIGT

SEQ ID NO: 132378 - protein, 300 aa, Heterodera glycines
  Coding regions on vcDNA: vcDNA=SeqID_58801; Strand=-; Position=1 -189,332-761,1664-1948
WICNDVWMDIFPSFDRAQLGLKLALLSPRFDALVDKHFDGKSELTIWRTIEIRRKDKGPEPKLYIDHSVIAFLRSNHQIFDKRGTNLHLWIPLSYTMDVFVREIWPIFSANIRHLGFPHGDHLDNLLRRISPTILTDLNQLTSIHSGALLPAAFGDDFDGPNSTISSGQALSKWLHSPRKDGQPKRLHCANYNKQTNFDWVNSFKEHFLRANAISSVSYEIHFYVRATSMQIVPFELVNECTKEKLTLAKEDENEFEDNSWIMKRCKIGETAAVYWKDGNWDNNYNTVLIWLYDGTNCIG

SEQ ID NO: 132379 - protein, 98 aa, Heterodera glycines
  Coding regions on vcDNA: vcDNA=SeqID_58802; Strand=-; Position=1 -11,78-363
MNRRWICNDVWMDILPSFDHPQLGLKLAILSPRFNALVDKHFDAKSELTIWRMIVIRRKDKGPEPKLFVQMDDKFVPFPLPDDRPLPIKIRFKHLQIE

SEQ ID NO: 132380 - protein, 49 aa, Heterodera glycines
  Coding regions on vcDNA: vcDNA=SeqID_58803; Strand=-; Position=1-149
LQIYWLKLHMRYISKFFDSVRRFDKDGFRFAISRSTFGNWSRIFSAITC

SEQ ID NO: 132381 - protein, 39 aa, Heterodera glycines
  Coding regions on vcDNA: vcDNA=SeqID_58804; Strand=+; Position=1 -67,260-312
MSPAVIRRGATVMRRGTTVIRREYLLKLKGINFSKIQIK

SEQ ID NO: 132382 - protein, 95 aa, Heterodera glycines; identical to SEQ ID NO: 124528
  Coding regions on vcDNA: vcDNA=SeqID_58805; Strand=+; Position=1 -787,954-986

SEQ ID NO: 132383 - protein, 97 aa, Heterodera glycines
  Coding regions on vcDNA: vcDNA=SeqID_58806; Strand=+; Position=1 -11,85-367
MNRRWICNDVWMDIFPSFDRPQLGLKLALLSPRFNALVDKHFNGKSELTIWRTIKIHRKDKGPETKLSVRMDDKFVEFPLPDRPLPSKIRFKHLRIM

SEQ ID NO: 132384 - protein, 27 aa, Heterodera glycines
  Coding regions on vcDNA: vcDNA=SeqID_58807; Strand=-; Position=1 -23,338-398
MRNNGGMIITKVVIRQECISFLNQIKA

SEQ ID NO: 132385 - protein, 148 aa, Heterodera glycines
  Coding regions on vcDNA: vcDNA=SeqID_58808; Strand=-; Position=1 -335,390-499
  Homolog annotation: Hit_ID=AAH87800.1; Match level="QueryCoverage =84%, HitCoverage=76%, E-value=6e-19, Identity=42%"; Hit description =Unknown (protein for IMAGE:7016565) [Xenopus tropicalis]
EQTSNVLISETTTIPQMAAAPSIRIIATSKAPAATGYRWSKQWMTIEKAQLYLLFCSQAVLVNNQTLYVSGQTGMMPGKTDVVSGGARAEAKQAMTNIGELLTYAGSSFKHVINCNIMVANMSDFQDVNETFKNFFTADTYPARSFFQ

SEQ ID NO: 132386 - protein, 66 aa, Heterodera glycines
  Coding regions on vcDNA: vcDNA=SeqID_58809; Strand=-; Position=1 -195,313-318
MTDQICQYLNISLFTKYETANLASKSAALYLDKNMTTVGEWIFSPIIHQFVVAKCTFQHQYKLIEK

SEQ ID NO: 132387 - protein, 82 aa, Heterodera glycines
  Coding regions on vcDNA: vcDNA=SeqID_58810; Strand=-; Position=1-248
MKRTNATNITPPRAKRSMAPALDPITAALAEQERQRTLVFIGLPESNAVRPSERVQEDREATTKILDHLEVEAEPTAVFRLG

SEQ ID NO: 132388 - protein, 149 aa, Heterodera glycines
  Coding regions on vcDNA: vcDNA=SeqID_58811; Strand=-; Position=1 -126,206-529
MDEFDEDAAAMAQRPMPKWEKAGLRIERNCAENQIFLNIVQEIVDKFGWDNSAHDYDMWKKAFGPNFSMFFVLDQNRVPMGCISMALYPQVAHWSMFYVRDPYHGHQLGRALARRALEFAGDRPVFGYAGQKTYGSFANAFLPIDCSVE

SEQ ID NO: 132389 - protein, 157 aa, Heterodera glycines
  Coding regions on vcDNA: vcDNA=SeqID_58812; Strand=-; Position=1 -323,728-875
MVEKKNVRKITGRNSTANKESGSGGKGEGNSVGNAQQKGKRQNEFEGGSGANGNNSSNIGNGNNEINTNSNNSGGGGWGIVGEDEGEPPPPQTPQQLEIISNNSSGVRAQNDALAIASQLEKSASAGATGGATAQQLLQQFGFGGAGAQNALQMNQL

SEQ ID NO: 132390 - protein, 100 aa, Heterodera glycines
  Coding regions on vcDNA: vcDNA=SeqID_58813; Strand=-; Position=1 -168,616-750
MAKATHARWAKNFQAMVSALLTPFVRKRMLVERGTLFGNDCLMSECDGTLGQNNSRVGRYSHLGTQEKIVEKLVKHTTMLNALHDRGVENNKENDKYPDF

SEQ ID NO: 132391 - protein, 29 aa, Heterodera glycines
  Coding regions on vcDNA: vcDNA=SeqID_58814; Strand=+; Position=1-87
MPPSLSLLLALSMAFCLITLVLKCPDEEC

SEQ ID NO: 132392 - protein, 16 aa, Heterodera glycines
  Coding regions on vcDNA: vcDNA=SeqID_58815; Strand=-; Position=1-49
EAIPEGFGLPINLGAS

SEQ ID NO: 132393 - protein, 77 aa, Heterodera glycines
  Coding regions on vcDNA: vcDNA=SeqID_58816; Strand=-; Position=1-234
MPLNQQMKNYNSNHLTKYLEKNGKKKKKKNKMKRKSSKKEENIQEKNGRKIMPKFVRKFELAIMTQLRNGRNNLALT

SEQ ID NO: 132394 - protein, 135 aa, Heterodera glycines
  misc_feature (9)..(9): Xaa can be any naturally occurring amino acid
  Coding regions on vcDNA: vcDNA=SeqID_58817; Strand=-; Position=1-703
FRGQSPRTXCAQIYGETESFGNSFPIACTLILRWIFAPHNCLSTPNGHLKKSIFLFSGQSPRTDDAQIYGETESFGNSFPIACTLILRWIFAPHNCLSTPNGHLKKSIFLFSGQSPRTDAPRFMGRPNPSGIASL

SEQ ID NO: 132395 - protein, 152 aa, Heterodera glycines
  misc_feature (148)..(148): Xaa can be any naturally occurring amino acid
  Coding regions on vcDNA: vcDNA=SeqID_58818; Strand=-; Position=1 -194,246-283,342-413,494-575
  Homolog annotation: Hit_ID=NP_500987.2; Match level="QueryCoverage =61%, HitCoverage=12%, E-value=3e-22, Identity=54%"; Hit description =tyrosinase family member (4H251) [Caenorhabditis elegans]
MRRKRQLERGGAKGEKTRKSPQGKKFVRKEYRMMNDSERAHLHNALNMLKEKRVDNISIWDLHILLHYPNSAPAAHWGLHYPNSAPAAHWGPPAFLPWHREFLRQFEAAMHSEVPVGVIPYWDSTLGVIPYWDSTLDPGGVLMSTVFXYDFF

SEQ ID NO: 132396 - protein, 51 aa, Heterodera glycines
  Coding regions on vcDNA: vcDNA=SeqID_58819; Strand=-; Position=1 -35,201-307,352-430
MLMPQRQLRLVSKSLLLVHGAGAKQFLQGLTTKDMDSLNNVPLVYSFLIQC

SEQ ID NO: 132397 - protein, 82 aa, Heterodera glycines
  Coding regions on vcDNA: vcDNA=SeqID_58820; Strand=+; Position=1 -142,313-419
MTRNFEAAERFLYFFLKIISVNATMRDAFRELLILETFLHIMQQHSSEATVQPHVRRVVQLSLDLLINATKGNVLNAQFITG

SEQ ID NO: 132398 - protein, 714 aa, Heterodera glycines
  misc_feature (428)..(428): Xaa can be any naturally occurring amino acid
  Coding regions on vcDNA: vcDNA=SeqID_58821; Strand=+; Position=1 -358,437-532,605-733,824-870,918-1078,1136-1258,1414-1564,1836 -2166,2222-2500,2571-2897
  Homolog annotation: Hit_ID=NP_502420.1; Match level="QueryCoverage =100%, HitCoverage=49%, E-value=1e-113, Identity=35%"; Hit description=beached 1 (4N439) [Caenorhabditis elegans] emb|CAB16307.1| Hypothetical protein C26H9A.2 [Caenorhabditi
GINDDQTEIRDGGEGMIALIKEAQRCKVKVYDRSMVKLFTRLIFAPSNSFSKIQLFDKVRPAIINSVLLNFGCFGKCTKVDSEAPVWATVTLANCGPKLAAIHQCFRMGTDLYRADNKSEVPKGTEVPKGTFNALFLMRLLFDLAFDNFDKYLFNSQWLQNAENFETWLQNAENFETAVLTWSNSMLTHPSALLSIVDLLPAICFPSNEWCALAQLYIALVLKAVLRSEAVLRSERNQQTMCQFDLPAKLLAVGENLFKTERHPLLSSFHYLFERLAYQSLRPKQLRRFLRLDMPLKQLRRFLRLDMPLCCTNLDDNEKGRSDAAMKPGGPIPTHRIKAFVSMLTPRNHSLLLAPSFVEFDLAIEGFAALVIPSIVPVFNNSRSCRIVRVFDGSPSTTMLPDENTSNSSRDSRPVSRVLWPSTGGKHXEPPELSACCFSEWTAAVGLVVSGAEHSVADELRKDFSRGAEQCLQVPLSEQYSPKQWAHLAIGWSSLLLKSSNVYNCEVFVNGHSLSSLLLKSSNVYNCEVFVNGHSLASQKLQLWWHSADSGGQQGLNAYIGTLPFFRRGSKLRWRLASLCLVEEALGADVLRKMVALGVAYTGNYQASSRSALISEERVLLSLNASASAETTALSLRSMFPCRTDAEMIAALVGISPNDQSTPLCILCITSCPTPCRALPLGAVLIGYLGIRTFCPCPVSSLLDSVGGIAPLLG

SEQ ID NO: 132399 - protein, 132 aa, Heterodera glycines
  Coding regions on vcDNA: vcDNA=SeqID_58822; Strand=-; Position=1 -96,135-252,468-652
MPKQNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTVIPNPRF

SEQ ID NO: 132400 - protein, 446 aa, Heterodera glycines
  Coding regions on vcDNA: vcDNA=SeqID_58823; Strand=-; Position=1-1341
  Homolog annotation: Hit_ID=NP_001004509.1; Match level="QueryCoverage= 96%, HitCoverage=29%, E-value=9e-51, Identity=32%"; Hit description =si:busm1-180o5.3 [Danio rerio] emb|CAD60788.1| novel protein similar to DNA polymerases [Danio rerio]
MPNGKTLGQLREREVRKHDILSRYVDLEVVWEHEINEQLKNDTAMREFFDNWKDRSPIKIRDAFHGGRTGQMKLLHTAKPGQKISYKDFTSLYPFTNFTTDYPLGHPKIISFPVNEQTVNWRSPSDNPYKGLLKVLLLPPNNNIKVTVMPIKFDQRLLFPLCEKCAKHITAKYPNGLKVNDYSCPHFNPIYRAFVSTCTHLELNASLEAGYTARKLFHVLQYDQWSNNVFKSYVSEMMALKIHATGFPSWCESEEQKSEYIEECWKKFAIKLDKEKMNSEPGKRYIAKLCLNSLWGRFSMRNLLSKSIIDNDESLIHQYAEDKKIDLIDLEMMDEDNDVFMLTYKPKEEFVDENKYSNVVISLFTTSMARLYLYEALKKVADTPGCEILYFYTDSIIYVHPVDNDPLPTGKGHLGELTDEKPDHYILGFISAGCKTTGLNFHGRQW

SEQ ID NO: 132401 - protein, 122 aa, Heterodera glycines
  Coding regions on vcDNA: vcDNA=SeqID_58824; Strand=-; Position=1-369
  Homolog annotation: Hit_ID=NP_491240.1; Match level="QueryCoverage =97%, HitCoverage=9%, E-value=9e-23, Identity=42%"; Hit description =zn-finger, CCHC type and RNA-directed DNA polymerase  and Integrase, catalytic domain containing protein f
MPYGVASAPAIFQQVMEEILCGIDGVAVYLDDIVVTAANDAEHLKRLDAVLQRLQKAGLRVKKEKCSFMQESIVYLGHIIDRQGIRTSPEKVEAIQKMPAPENLKELQVFSSELSTQSQTNS

SEQ ID NO: 132402 - protein, 43 aa, Heterodera glycines
  Coding regions on vcDNA: vcDNA=SeqID_58825; Strand=-; Position=1-129
MANVWRKNGPSLPDKDIPNRCFSGHLQCQFGAPSVKEQFHGLI

SEQ ID NO: 132403 - protein, 175 aa, Heterodera glycines
  Coding regions on vcDNA: vcDNA=SeqID_58826; Strand=+; Position=1 -248,1387-1666
MDQFELVNETTQEKLTLQKEVGCGKNKCKECEKMNGWLLKKRCLSSNVVVFGEAVQHQQQRNHNILNNSQNVRIELRGPICIGWICNDVWMDIFPSFDHAQLGLKLALLSPRFDALVDKHFNGKSELTIWRPIEIRRKDKGPEPKLSVQMDDEFVPFPLPDRPLPSKIRFKNLRT

SEQ ID NO: 132404 - protein, 74 aa, Heterodera glycines
  Coding regions on vcDNA: vcDNA=SeqID_58827; Strand=+; Position=1 -182,925-967
MTKGKADIAKTKGWDNRWIMKRCKIIGETATVQQQKKNENLDNSCNNVSIWLYNSANNCIGNSLTKATIFFIDA

SEQ ID NO: 132405 - protein, 114 aa, Heterodera glycines
  Coding regions on vcDNA: vcDNA=SeqID_58828; Strand=-; Position=1 -184,211-329
  Homolog annotation: Hit_ID=EAK91016.1; Match level="QueryCoverage =98%, HitCoverage=90%, E-value=3e-24, Identity=60%"; Hit description =hypothetical protein CaO19.6835 [Candida albicans SC5314]
MVRLVFRPYTQVRRSICTSESLRTSTRVSSGFILLRNSSPSFGSQRIRSVSAPSHAIETGLWITHQLRKKPSLSLITHQLRKKPSLSLRLWVLNTPMTCAYAKLLGPCFKTGRT

SEQ ID NO: 132406 - protein, 91 aa, Heterodera glycines
  Coding regions on vcDNA: vcDNA=SeqID_58829; Strand=-; Position=1-333
IHPIMNAKIIRVPKIACDLSLAKNGVSKNRNYAQKASQTILTLPIPSTIAFIHPIMSAKIIRVPKIACDLSLAKNGVSKNRNYAQKAPQKF

SEQ ID NO: 132407 - protein, 32 aa, Heterodera glycines
  Coding regions on vcDNA: vcDNA=SeqID_58830; Strand=-; Position=1-155
KPKLFGLFKKELKIFKNLFISLLIEKASESLI

SEQ ID NO: 132408 - protein, 110 aa, Heterodera glycines
  Coding regions on vcDNA: vcDNA=SeqID_58831; Strand=+; Position=1 -104,281-509
  Homolog annotation: Hit_ID=NP_490685.1; Match level="QueryCoverage =67%, HitCoverage=77%, E-value=1e-10, Identity=38%"; Hit description =transposase (1A616) [Caenorhabditis elegans] gb|AAB54166.1| Hypothetical protein F53G12.11 [Caenorhabditi
MGPTIKKSIKDSRRIIDFSRNRFEPFWSLFRDDFLADPSLYWEVNSQKWPMIGAVVRKFLSPPATSSESERLFSTAGLISDDLRKSLQAENLAKLLFLHHNLLLTGFSIE

SEQ ID NO: 132409 - protein, 238 aa, Heterodera glycines
  Coding regions on vcDNA: vcDNA=SeqID_58832; Strand=+; Position=1 -111,170-280,345-455,508-618,671-781,840-950,1008-1056
  Homolog annotation: Hit_ID=CAE66851.1; Match level="QueryCoverage =100%, HitCoverage=86%, E-value=1e-34, Identity=38%"; Hit description= Hypothetical protein CBG12223 [Caenorhabditis briggsae]
TIPVTKAKPPTVSESSSSGDDDEVPAKKPAQKAQPAKTIPVTKAKPPTVSESSSSGDDDEVPAKKPAQKAQPAKTIPVTKAKPPVESESSSSGDDDEVPAKKPAQKAQPAKTIPVTKGKPPTVSESSSSGDDDEVPAKKPAQKAQPAKTIPVTKGKPPTVSESSSSGDDDEVPAKKPAQKAQPAKTIPVTKAKPPVESESSSSGDDDEVPAKKPAPKAQPAKTIPVTKAKPPTESESS

SEQ ID NO: 132410 - protein, 47 aa, Heterodera glycines
  Coding regions on vcDNA: vcDNA=SeqID_58833; Strand=-; Position=1-141
FFYLCFSLDHSCDQGQTSDGVRVEQFGRRRRSAGQKTGPEGTAGQSA

SEQ ID NO: 132411 - protein, 49 aa, Heterodera glycines
  Coding regions on vcDNA: vcDNA=SeqID_58834; Strand=-; Position=1-148
SEALWPAVPSGPVFWPALRRRLPNCSTRTPSEVCPWSQEWSKEKHKLKK

SEQ ID NO: 132412 - protein, 29 aa, Heterodera glycines
  Coding regions on vcDNA: vcDNA=SeqID_58835; Strand=-; Position=1-86
FFYLCFSLDHSCDQGQTSDGVRVEQFGRR

SEQ ID NO: 132413 - protein, 271 aa, Heterodera glycines
  Coding regions on vcDNA: vcDNA=SeqID_58836; Strand=+; Position=1 -111,164-274,333-443,504-614,667-789,840-938,996-1145
  Homolog annotation: Hit_ID=CAE66851.1; Match level="QueryCoverage =99%, HitCoverage=94%, E-value=2e-37, Identity=36%"; Hit description =Hypothetical protein CBG12223 [Caenorhabditis briggsae]
TIPVTKAKPPVESESSSSGDDDEVPAKKPAQKAQPAKTIPVTKAKPPAESESSSSGDDDEVPAKKPAQKAQPAKTIPVTKAKPPVESESSSSGDDDEVPAKKPAQKAQPAKTIPVTKAKPPVESESSSSGDDDEVPAKKPAQKAQPAKTIPVTKAIPPTESESSCSGDDDEVPAKKPAQKAQPAKASANPVSIQNGKANPVNGNETESNSSDGAPPAKAPRMDLDSWGKKAAADFNGVKGKRFRHEKTKKKRGSYNGGKINTSANSMKFDH

SEQ ID NO: 132414 - protein, 47 aa, Heterodera glycines
  Coding regions on vcDNA: vcDNA=SeqID_58837; Strand=-; Position=1-141
FFNLCFSLDHSCDQGQTTGGVRVEQFGRRRRSAGQKTGPEGTAGQSA

SEQ ID NO: 132415 - protein, 54 aa, Heterodera glycines
  Coding regions on vcDNA: vcDNA=SeqID_58838; Strand=-; Position=1-260
LTIACPYISGRFGRLCLLGRFFGRHFIVVSRTARLGLRRRYGLGHRNGLKKNTN

SEQ ID NO: 132416 - protein, 68 aa, Heterodera glycines
  Coding regions on vcDNA: vcDNA=SeqID_58839; Strand=-; Position=1 -72,1131-1262
MRSEVGKIALDTVFKEREQLNVAIAGGSDAASLLVAEKYVKAFGELAKENNTVLLPTDMGSVGSFVSQ

SEQ ID NO: 132417 - protein, 44 aa, Heterodera glycines
  Coding regions on vcDNA: vcDNA=SeqID_58840; Strand=-; Position=1 -93,531-572
MADLAFLFGLYGFAYQTYQSLKKEFANDQAWQKGESAGFIAIIR

SEQ ID NO: 132418 - protein, 25 aa, Heterodera glycines
  Coding regions on vcDNA: vcDNA=SeqID_58841; Strand=-; Position=1 -12,413-478
MGLEFIALSVPNLLSPKNSESFILK

SEQ ID NO: 132419 - protein, 138 aa, Heterodera glycines
  Coding regions on vcDNA: vcDNA=SeqID_58842; Strand=-; Position=1-415
MNYFGLFPAGIFAVQTMLMLSILLSFTNGMEIKVISDMHRHAKLLTIEVQKTDTVATLKANITEKLKEIFKNKDGIPQEELSLRYSEELKEILKNQTDPKKQTDHKQQKTPKKQTDISSPEEQSLAYYKKGNGHILED

SEQ ID NO: 132420 - protein, 244 aa, Heterodera glycines
  misc_feature (13)..(13): Xaa can be any naturally occurring amino acid
  Coding regions on vcDNA: vcDNA=SeqID_58843; Strand=-; Position=1 -151,342-485,690-763,853-978,1040-1153,1206-1247,1605-1631
  Homolog annotation: Hit_ID=CAE58761.1; Match level="QueryCoverage =84%, HitCoverage=56%, E-value=3e-62, Identity=60%"; Hit description =Hypothetical protein CBG01953 [Caenorhabditis briggsae]
FFAERINTHTTRXICMASRDGIGSDGCALIGNTPMVYLNKVSKGCAAKIAVKLEWLNPSGSVKDRIGVAMIDAAEKEGRIKPGISTIIEQTAGNTGIALASVAAIRGYRFIAVISSSQTIERRTVLRARTVLRALGAELVLLDPKLGFNGAVERTKQLARAIPNSFNPMQFCNEFCNEANPEIHYRTTGPEIWHQTQGKVDICVFGIGTGGTMTGVGRYLRMTGVGRYLREKNPNKQIINLLSK

SEQ ID NO: 132421 - protein, 87 aa, Heterodera glycines
  Coding regions on vcDNA: vcDNA=SeqID_58844; Strand=-; Position=1 -181,507-589
MVGVSVGLARSGSAGGMMYFEVAEADPLNSHSERGTCFFTGGGGSLDTYALCSQQNAYGAGSKIRTFCKIASNIFTFYSIKNVFYYY

SEQ ID NO: 132422 - protein, 73 aa, Heterodera glycines
  Coding regions on vcDNA: vcDNA=SeqID_58845; Strand=-; Position=1 -47,102-207,923-991
MSHNPKEAESEMEKAIFISADCWLGVFDLLEPLQLGLGIALISHRFDYYVNGGREYNLLPLLPTLACLYVSFS

SEQ ID NO: 132423 - protein, 95 aa, Heterodera glycines
  Coding regions on vcDNA: vcDNA=SeqID_58846; Strand=+; Position=1 -90,691-888
MLPMVFGVADHESCIQFDQFRQLYVSSIIYARGLLDSGHLDSGHYDSGHLDSGHLDSEVIWTEVDIWTVDITTVNANFLLITNFCKHMLIPITDH

SEQ ID NO: 132424 - protein, 40 aa, Heterodera glycines
  Coding regions on vcDNA: vcDNA=SeqID_58847; Strand=-; Position=1 -58,238-302
MCKISTSADFQFVSVYSNRANNREIFGLSSYINKIKFGSF

SEQ ID NO: 132425 - protein, 147 aa, Heterodera glycines
  Coding regions on vcDNA: vcDNA=SeqID_58848; Strand=-; Position=1 -190,360-613
  Homolog annotation: Hit_ID=CAE56264.1; Match level="QueryCoverage =70%, HitCoverage=75%, E-value=3e-14, Identity=42%"; Hit description =Hypothetical protein CBG23909 [Caenorhabditis briggsae]
MAATDAQKAGGCYGNGPCEGTKKTFNAFFFVIRHAFQLFYVFCAFVICWLVMGPGNQFLCNLIDDDTQWLIYWCSFALFILFDFVVNTLLISNMIPLYLLLKTAALLYLALPQTYGAHNVYVSYVDPLVDWIDENGTKLYRAETTAQ

SEQ ID NO: 132426 - protein, 123 aa, Heterodera glycines
  Coding regions on vcDNA: vcDNA=SeqID_58849; Strand=+; Position=1 -279,510-602
MALIITPLFLVLVEYDLILENTITLNKMRSHQFNLRQLRKPFRNVASTNSEGLRHRNSIVGPPVVPWTSLALLATAPPIVAPEDDILNSLFAQTTQSCSTAKTATLSSAVLLRMTRRPRNSTF

SEQ ID NO: 132427 - protein, 43 aa, Heterodera glycines
  Coding regions on vcDNA: vcDNA=SeqID_58850; Strand=+; Position=1-134
PGLDPGPEEPGFFLDLDFCPGNQGPGPTWNLGPGPGFFQNVDL

SEQ ID NO: 132428 - protein, 51 aa, Heterodera glycines
  Coding regions on vcDNA: vcDNA=SeqID_58851; Strand=-; Position=1 -59,361-457
MTRRRGTDGPTGEDAKCQKCPTVVTNARWNFRNCGISNGITVHILTSKHSR

SEQ ID NO: 132429 - protein, 1025 aa, Heterodera glycines
  Coding regions on vcDNA: vcDNA=SeqID_58852; Strand=-; Position=1 -162,220-344,952-1061,1110-1262,1303-1458,1511-1767,1816-1953,1994 -2145,2197-2371,2414-2591,2638-2893,3260-3499,3574-3741,3792 -3992,4032-4226,4698-4884,4946-5095,5144-5220
  Homolog annotation: Hit_ID=NP_491970.2; Match level="QueryCoverage =29%, HitCoverage=11%, E-value=1e-24, Identity=30%"; Hit description =suppressor with Morphological effect on Genitalia SMG-1, Male ABnormal MAB-1, nonsense-mediated mRNA deca
DETKQQQKVETDAEEGREIQSPSPAKPKYYRPLDATDLDQLQNVYPKIVSEICELISQLKHSKIEWSKFKSEEKRIMVMLCSVKQLIKVKNSIFLLREMFALRSSLLLVPFFSLYSIKSFEMRKSLVKCLYRIHVFNVLLSDEPSCKILSHQFIAKLRECAEHLEVEQFRTLWNRIPITYLIRISEISTIKCLSFLEIAKRTQKLLGKMCMEPNEFRFVTDFLFGRKRISMLQDNCSPQNWLFISGQYLFESLSCTANDKSQKASTTFNENAKQNNRIGDSASLLQKWLFIVGQFAHYCAVNRMKTPIGKTPLETFTKFEAQLRALASSSTSQLIASRSKNLASNEKGIISYSNSNDDDHLSMNQSSGNCGKEQRNLYPEEEWFRVRMLLHCIDMVEKMMCYAVRGSMLKIYDELPLNARQFFSVNFKTCMDWLFRTALPLMSTAYANGHYAQIVRFGGFLFAELERKHPSNASNDTKIRLDPSIQFAITWVIRALVRLGAPQAIRGVQRFSETMFGPAVDFSWCHYAELLASARVEEALDGCLNFLNCAKQSKENVPKVRDHVLNAIDELALMAAGILRLPQAETKLIVLRILLYCLIKEFAKQSSTEKKLKTTKAERADELSDLAQFLLCGGHENSDGLAHSKLAILHAICTGIQHLNVPNQQYHVQPAQIQQHFPPKGQQSAKQMMRSPPKYSVSTPILLEVDFADLLHNCNSNALHSLEIGQMYCGWMHRLYGAQKEHSFVLKRMHGQIAQLAQKLGNPNLANTHFRLSVQNGGTQNSWPIDDLYGNQMHRQLDILPEYQLPMGISNLYIQQQTQPQFQSIPPGFESLLGNQPFQTEDAHNHFTVNNISFTAPATPQATKSLLSEDFDGDSLRLLPNELAIMQQSSEKSYVQTAEVILRFLKMLSRQPEWFQRIVTFPDDKTATSAGNNSGKKLAWMDRIPVNVWTGMIPQLFACLNHSNSIVVDAIHMLLEQIGQNLPHVVCYPAIVIAGAADEKANTMPLLSEFSKENSERLIVISIHP

SEQ ID NO: 132430 - protein, 91 aa, Heterodera glycines
  Coding regions on vcDNA: vcDNA=SeqID_58853; Strand=+; Position=1 -135,295-434
VSHDSSIAVIDKSNSQPQERPIQHKTAFLPFTSVRWVNETHIVTADVPPESKNGSNVSSAFAMFRSIDKKALSADSPLGSTALKTLHQNSI

SEQ ID NO: 132431 - protein, 100 aa, Heterodera glycines
  Coding regions on vcDNA: vcDNA=SeqID_58854; Strand=+; Position=1 -192,510-620
MDKNVAWWCCNCWDSGKSVDEDVVGVQQQHLQLPQQQMLLSGAKLGQKRSLQIQIEFKKLILIRSQIYSKGTTEFTRFKTMPYLMTKTNNSCITAECKNF

SEQ ID NO: 132432 - protein, 25 aa, Heterodera glycines
  Coding regions on vcDNA: vcDNA=SeqID_58855; Strand=+; Position=1-111
DHSQRNVPGTDSVISMPGLTGSHKQ

SEQ ID NO: 132433 - protein, 15 aa, Heterodera glycines
  Coding regions on vcDNA: vcDNA=SeqID_58856; Strand=-; Position=1-45
MTVYEYKLCPDKEIN

SEQ ID NO: 132434 - protein, 37 aa, Heterodera glycines
  Coding regions on vcDNA: vcDNA=SeqID_58857; Strand=+; Position=1-112
KFAGPVAGLEFKIFYRTGSGRINPANPVNPVFSKICR

SEQ ID NO: 132435 - protein, 69 aa, Heterodera glycines
  Coding regions on vcDNA: vcDNA=SeqID_58858; Strand=+; Position=1-207
MNKAFVKAALCSKSTNVCLFKRLVRPVVQIGSRPITGAGFGHPMTRQKMQMYSPEMRAVNYQQKRTHMH

SEQ ID NO: 132436 - protein, 120 aa, Heterodera glycines
  Coding regions on vcDNA: vcDNA=SeqID_58859; Strand=+; Position=1-512
  Homolog annotation: Hit_ID=NP_502175.1; Match level="QueryCoverage =70%, HitCoverage=20%, E-value=3e-22, Identity=56%"; Hit description =COLlagen structural gene (45.3 kD) (col-128) [Caenorhabditis elegans] emb|CAA97787.1| Hypothetical protei
RAEFAGLPGVKGPPGQTGKQGERGKRNFVIGMPGPDGRVGKQGLDGLEGKPGQRGEKGPPGEDGADAKFCPCPSELNSVGGEAKANKRPLRQSLTSDQQKNAFLSQSLPFFCPIPKSTSS

SEQ ID NO: 132437 - protein, 254 aa, Heterodera glycines
  misc_feature (8)..(8): Xaa can be any naturally occurring amino acid
  misc_feature (15)..(15): Xaa can be any naturally occurring amino acid
  misc_feature (18)..(18): Xaa can be any naturally occurring amino acid
  Coding regions on vcDNA: vcDNA=SeqID_58860; Strand=-; Position=1 -323,536-984
  Homolog annotation: Hit_ID=NP_502175.1; Match level="QueryCoverage =93%, HitCoverage=57%, E-value=1e-32, Identity=38%"; Hit description =COLlagen structural gene (45.3 kD) (col-128) [Caenorhabditis elegans] emb|CAA97787.1| Hypothetical protei
AGPPVQRXPSEKNAXIKXRAEFAGLPGVKGPPGQGKQGERGKRNFVIGMPGPDGRVGKQGLDGLEGKPGQRGEKGPPGEDGADAKFCPCPSELNSVGGEAKANKRPSQKGAKTTTVYETTAKRTTNYALGEGTTNGTTSEDIVTTKTTTTPTIQNTKPNEGNGQQNSNLKIGHLKAGERPNGRENRREKGQSEQNSKKGKDKAHQLRRGGHLPKLRKSERRKGKERREEAGEYDEETTNGEEEEREREGERERE

SEQ ID NO: 132438 - protein, 338 aa, Heterodera glycines
  Coding regions on vcDNA: vcDNA=SeqID_58861; Strand=+; Position=1-1017
  Homolog annotation: Hit_ID=AAV44035.1; Match level="QueryCoverage =96%, HitCoverage=20%, E-value=9e-42, Identity=36%"; Hit description =putative helicase [Oryza sativa (japonica cultivar-group)]
MAIPQYKDLPFGGKTVIFSGDFKQSLPVVPHEGITAQVTACFQTSPLFRQFTTMKLTINQRLGQGQQAYLQMCRQIGLGETGEHFWIPPQFIVKSREELINFVYPNFQQLLGNEKELLNRLILAPHIDTCDEVNEMMMANVPGQVREYLSTDKPLDDRPLDIDEIESEVAALNGRTDSGMPPHCLRLKVGSVVVLLINKSDREGLINGTRIVLEELGDDRLVGRVINSNAIGGQVRFFLERSRNVFEDKTPGGLKYERLQFPIKPAFAMTIQKGQGQTIRTVGIDLEREVFTHGQLYTAFSRATDGNNVRVHAPKREIDAQGQAKVLNIVAKNMLKLQ

SEQ ID NO: 132439 - protein, 206 aa, Heterodera glycines
  Coding regions on vcDNA: vcDNA=SeqID_58862; Strand=-; Position=1-621
MEPTDDEQDHGNDGNERIGGSPTTQIGAGQKSAKRGKDKQKGVEASTTQSCSGTQPGGTRNLRSNGIAIRAIRDQLERASGPLADRIAEARDLLDPDLNGDRPQTAVCLSAMERGLRELVDIFKGHFDRGLATIGDEAPELHDYLYDAFTRPLPAATRCLGLRSHPPPAELLQIAMEHLGDLRTVRRTLEDGKSYPSCHPGPDREP

SEQ ID NO: 132440 - protein, 808 aa, Heterodera glycines
  Coding regions on vcDNA: vcDNA=SeqID_58863; Strand=-; Position=1-2427
  Homolog annotation: Hit_ID=CAA82797.1; Match level="QueryCoverage =40%, HitCoverage=42%, E-value=4e-18, Identity=25%"; Hit description =gag protein [Ascaris lumbricoides]
MRSVAKVAQYPVLNAGGNGANTWVNQASDRRERTPSPHIRQAGNQPRPLIPELPIAGNPNPCGHFRIPEQVRGRDPSVLRTTRRDEETTVFETVRLQPPTFSGQPEDWTTFWSYFKRAVDDKPIPGFEKQLLLLRCLKEGSPARRAVEVYPPSDGNYPVVIQLLKERFGDTDDLQRAIRAQLLHLPPATDNAQSLTTVVDEFERGVCQLEQLGANVEDASFMPLLESKLPVRILTELRIRESTSGTKWSVREFRRAVGAQVRCMRAAESALAAMREPERRTESRPEQSRHAEGTQNRDQFPRVFMVRSNPSSQRPITPGASALRTGTHAPHRKVADRNRNRLAQSRGPAPTDNGCSLCQNWGHRPSNCPTYPTFQERRQRFFEQRRCIRCLSSDHIASCCPRPKACRWCLRNDHHSLVCWVGPGKPIAIREPAGPETREHIGSKPVESVVEPRTHSGLLKPTDATVQPQIVIGIRKFWDLVIGFKISAEGAFLVDTVFGTVLCGEHFGAPLGQSVPRDTILMAISGEENRWNRMPASSGVEAADKSKPSIYENDRLGIGPLNPTPKNPRDRKDPPHVQPEKRCRVEQQRTKCELPESDQDGTTEPCERGLSQCLLGASLLWKVMTWVTRHPIRVFNRLTGGDIPEPTADQVKSQERVQLARRARAAARAWRNAERGRASRPGAAMALLPLLCFVALFSSSEPMSVMLRSEDCASTPSGFKCSGSAAMIIGPEVGELRDSVNGITPKGIGPLCLFLQWDGGISTVARPWPASPPPPMSRKRREKKDGLWMAGIVPGGLKEAGGPMPNSD

SEQ ID NO: 132441 - protein, 206 aa, Heterodera glycines
  Coding regions on vcDNA: vcDNA=SeqID_58864; Strand=-; Position=1 -84,278-405,449-589,701-812,1092-1247
MIRNKLECLQKSRKKLYLLDISNPTEDADLFHTSLRKSLESRRQKIKESVGLEHLYGEKTEYVEAVRNIFRAVLSLPLLPSAISEELSQLSWPSSPLGMPVFFLYFSRTYIGLTQRPFCTLDNNFDHNSEHSYAATLIQFGIGSPAPSTLTWPTTDAVIMRILADASYNSNGEISDLMSALGLQVEGYAGKLRDFEIYDHSIVHVP

SEQ ID NO: 132442 - protein, 753 aa, Heterodera glycines
  misc_feature (535)..(535): Xaa can be any naturally occurring amino acid
  misc_feature (545)..(545): Xaa can be any naturally occurring amino acid
  misc_feature (557)..(557): Xaa can be any naturally occurring amino acid
  misc_feature (734)..(734): Xaa can be any naturally occurring amino acid
  Coding regions on vcDNA: vcDNA=SeqID_58865; Strand=-; Position=1 -30,3438-5006,5044-5233,5270-5715
  Homolog annotation: Hit_ID=NP_508324.1; Match level="QueryCoverage =100%, HitCoverage=30%, E-value=1e-114, Identity=32%"; Hit description=predicted CDS, peptidase family A16 and RNA-directed DNA polymerase and Integrase, catalytic domain and
PFVDHADWELTAKNFWDLQLIGIKDNPKENDDDTAMEIFEKKAKRLADGRYSSGWPWKEFPSDLPSNYNMAYRRLVNLLEKLRKTPELLDKYHESISREFNLGFFELGERREGFPEHFLPHHGVVTHKLRIVFDASAHPRGEKSLNECMFRGPVMIPDLVGILLRFRLPIIALWADLEKAFNAISLDNEDREFVKFLWEKLSTDNLQIFRWARIPFGVISSPFILAAVVQKHLKEKASPLALEFAGNAFVDNLMTSCKDAGEVLKKYREGKALFAEAQMNLREFICNSMKAMEQIPEEDRLNKPGTKVPGIPWDIQKDELSIGFPPTNEAGKISKRIVLKTLASIFDPLGMVAPCLLQAKLFLQRLWDRTLGWDEILPADETAEWFAVIRLCSGTFIRSQKGEETNVQLLYAKSRLKPRKAEVTIPRMELLAMLIGARMLKFAENQLRIPINEKFIWGDSKPVLSWIESKDSQPRFVENRLREIRRISENARFLHIRTHENPADVASRGCTPEELRSHHLWWNGPTWLSPQQEPXMMDSPQQEPXMMDKKVQNWTMXLQCQQQRVKTIHIDPCRFSSWTKLRRTVVWFLRAINKMRKTRIYYQYAEILLVKMAQKCYQYAEILLVKMAQKCWPMCKKQPQELVKTSRKDGLVRLSTRLAMSKIPFLPENSITRLIAQSVHESLAHSGVESTLTEFMGKYWTPRARLTIKKVIRACGRCRRNAPYKLPTMPPLFXDRVRRTAPFESIGIDYLGP

SEQ ID NO: 132443 - protein, 31 aa, Heterodera glycines
  Coding regions on vcDNA: vcDNA=SeqID_58866; Strand=+; Position=1-97
ASATDWASGCSQVSLMRSTSKLLRVRTNERI

SEQ ID NO: 132444 - protein, 101 aa, Heterodera glycines
  Coding regions on vcDNA: vcDNA=SeqID_58867; Strand=+; Position=1 -63,566-806
MAELITKLCTTKLAILKWLQMEIGFNALAAFVCLAFAVLLTIDSVRMFGDDFSHHRFLVGNLEKWQQNDLPKIKGFNKKRNALATSEHWQGRVAQSDFGGG

SEQ ID NO: 132445 - protein, 51 aa, Heterodera glycines
  Coding regions on vcDNA: vcDNA=SeqID_58868; Strand=+; Position=1 -20,425-559
MSADNGCRFHPKSSTVPTTTTKSPPPPKKEKETGVFKLLPMWATIVIAVLI

SEQ ID NO: 132446 - protein, 95 aa, Heterodera glycines; identical to SEQ ID NO: 124528
  Coding regions on vcDNA: vcDNA=SeqID_58869; Strand=+; Position=1 -497,826-1122

SEQ ID NO: 132447 - protein, 76 aa, Heterodera glycines
  Coding regions on vcDNA: vcDNA=SeqID_58870; Strand=-; Position=1-290
YHTSIIFLKLFFSFITQRSRLIRSSPNFAGKLLRTLQMLINFLRIFCLEEHSSSHLPHQHYFFLIIFFILSPNVLD

SEQ ID NO: 132448 - protein, 91 aa, Heterodera glycines
  Coding regions on vcDNA: vcDNA=SeqID_58871; Strand=+; Position=1-658
LFEYPKRTLEKIDFFVFGAVPPNRCAQIYGETESFGNSFPIACTLILRWIFAPHNCLSTPNGHLKKSIFCFRGSPPEPMRPDLWGDRILRE

SEQ ID NO: 132449 - protein, 81 aa, Heterodera glycines
  Coding regions on vcDNA: vcDNA=SeqID_58872; Strand=+; Position=1 -72,544-717
MAKNPLPEGCTARPLDQRNMTSWTKSLICFSVFTVVLSIIVLLNDPNPDNSPVNAQAASLYRTDRAEFNRRAREMTLAYAR

SEQ ID NO: 132450 - protein, 96 aa, Heterodera glycines
  Coding regions on vcDNA: vcDNA=SeqID_58873; Strand=+; Position=1 -103,151-242,574-669
ANIICDGDKLGCTNVPPRRIFSKKELFARLLGLSGAGVFEQFFLRKPAVLNVTDKIVARKVAFKLGGGDSSSNSSEGEEEEANEEEEKGQSREGDE

SEQ ID NO: 132451 - protein, 143 aa, Heterodera glycines
  Coding regions on vcDNA: vcDNA=SeqID_58874; Strand=+; Position=1 -146,474-756
MPNLLQVLFGPVVYRPYQPNLLESGGNKLFSIGAGAYNTCVVLSPILVPECPTVALFSSLSLFSVYAAPADFKASPGRTAKWHPPRERLPDLNPPLNFLRQAIAWTAANTFGRRMLFPGSMALFNSMLNSQLVDGRRKLLTEM

SEQ ID NO: 132452 - protein, 396 aa, Heterodera glycines
  misc_feature (12)..(12): Xaa can be any naturally occurring amino acid
  Coding regions on vcDNA: vcDNA=SeqID_58875; Strand=+; Position=1 -135,183-228,531-579,629-760,823-992,1045-1285,1346-1490,1561-1617
  Homolog annotation: Hit_ID=BAA91553.1; Match level="QueryCoverage =93%, HitCoverage=87%, E-value=5e-56, Identity=39%"; Hit description =unnamed protein product [Homo sapiens] emb|CAI18400.1| HLA-B associated transcript 5 [Homo sapiens] emb|CA
LLSSSLLFLYFXGWKRKVIETEDGGKVDSVFIDKRGKGKHGNILIICCEGNAGYYEMGIMLIICCEGNAGYYEMGIMSTPVNLGYSALGWNLPGFAESTGTPLPHTILFAESTGTPLPHTILNSMEAVMQFAVKNLGFQPQQIVLFGWSIGGFAATWAAANFAATWAAANYPQIKALILDASFDDVVPLASARMPAVLEGLVRFAVRTHLDLPVAKQLQRYEGPVLLIRRWNDLQRYEGPVLLIRRWNDEIIATDTLAKTMPPDASNRINHLLVSLLRSRHPGLLKTKGTKSVCSNGKSYAHERFNSIFSYWLEPQTLNDSEMKSEQLEPQTLNDSEMKSEQSRHRELKWAIGYEMGGRFRRLEHWATHQHKFHFGAGATHNVALDPQHFKIPTAL

SEQ ID NO: 132453 - protein, 28 aa, Heterodera glycines
  Coding regions on vcDNA: vcDNA=SeqID_58876; Strand=+; Position=1-85
NPWVLYAPTKFHSETPRTPPDLPLLVSS

SEQ ID NO: 132454 - protein, 55 aa, Heterodera glycines
  Coding regions on vcDNA: vcDNA=SeqID_58877; Strand=+; Position=1 -54,782-892
MANRGPVAAAFTPAQMMQGAHFGSPFYHSSAAAQNSSANNTPPQSQRVPTIAVQQ

SEQ ID NO: 132455 - protein, 212 aa, Heterodera glycines
  Coding regions on vcDNA: vcDNA=SeqID_58878; Strand=-; Position=1 -135,175-436,490-731
  Homolog annotation: Hit_ID=CAB88203.1; Match level="QueryCoverage =100%, HitCoverage=94%, E-value=1e-106, Identity=69%"; Hit description=putative cuticular collagen [Globodera pallida]
MQETHIVLGIGTVCSLLAIIATVVTLPSLYSEMNEMSTKVHAGVEAFRVNTDSAWTDLMDVQVAVSPPSKPRANPFSSIFRAKRQLPGHCQCGPLQQPSCPPGPPGPAGAPGQPGQPGGAGQPGQPGAPGQPAAPCAPQHIPCPRCPAGPPGRPGGQGPPGQQGAPGQPGSPAPGGGQGPPGAPGPQGPSGQPGRSGAPGQPGQPGANGVVS

SEQ ID NO: 132456 - protein, 33 aa, Heterodera glycines
  Coding regions on vcDNA: vcDNA=SeqID_58879; Strand=-; Position=1 -74,302-329
MKDWYMNPVGFKFLDQGRSADMKGRNMVKKKEG

SEQ ID NO: 132457 - protein, 117 aa, Heterodera glycines
  Coding regions on vcDNA: vcDNA=SeqID_58880; Strand=+; Position=1 -87,495-761
MKTENRKHKVNENTTEPGPFYKPESCELSPSSPSSNCSIFVLTNLFNTSHATITDLLSSSLSFSSVAWFTPNLKNSAKFLKNNLYILASESNLSSSGWRCATTKLINALIRGTIGNL

SEQ ID NO: 132458 - protein, 173 aa, Heterodera glycines
  Coding regions on vcDNA: vcDNA=SeqID_58881; Strand=+; Position=1 -356,477-642
MAFTVILACLFPLPVKGGTETNAYPTNQCNECKLLCFNKGVKAKIPKEINKVELCCAENCYIHENVKQLTYELPKEILLNDFQCEGHFWMDSKHMFKKDILCPAVDECELIECYFCIEQILYGHLADNSIYQANNLLSWPKSASEREEAKGNSFSKLDITPCLQNNGVCCPYG

SEQ ID NO: 132459 - protein, 217 aa, Heterodera glycines
  Coding regions on vcDNA: vcDNA=SeqID_58882; Strand=+; Position=60-713
MPIPIREGPYFSARRVVIPENSEVFNDRLYGLGDPRSEEEERVPRWQEPPIPRQIESLSSWIERSYGPHWYETARERRAVEARLRGELREGANLLGEHFGRIAEIHFDGFTCYGPEGLFISPGITLFDHFVRLGLQVDPVKPCIQEYIGFSPREQGMLLVDIYPIELVNIRTRIGVAWRAPAVLEEPRPPPRDQAQLPDGRLENRPPRVARRLPNRR

SEQ ID NO: 132460 - protein, 120 aa, Heterodera glycines
  Coding regions on vcDNA: vcDNA=SeqID_58883; Strand=-; Position=1-566
MALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 132461 - protein, 115 aa, Heterodera glycines
  Coding regions on vcDNA: vcDNA=SeqID_58884; Strand=+; Position=1-348
LLGRPIAYFVCESNGNAENFQISLLKHFLLQIEPPLPKEEENVYFVEVQCHGFKPHTFKTITRAKTDVVLHQLSCKTYDISVRKVPLEWIRRLKYHGVSRRPLGKRRGAIRERNF

SEQ ID NO: 132462 - protein, 153 aa, Heterodera glycines
  Coding regions on vcDNA: vcDNA=SeqID_58885; Strand=-; Position=1 -295,364-527
MHLRPKRVALQIGFASTFKQWSDSLTVHKQIARDEFVVLRCDFTSVFANDGNGHEAKVEKSAIPFGTESERERRGWVITTDRLGMRRRTWPGGVGAAEVLMLTESGTFDRKLITSVGSGLTPKSAQICYLCAVFRAPSGFGIEYQCQIALSKR

SEQ ID NO: 132463 - protein, 143 aa, Heterodera glycines
  Coding regions on vcDNA: vcDNA=SeqID_58886; Strand=-; Position=1 -405,961-987
MSFDVIARVALGQRESRQFETEMAHLAIESMQKYNNTPFDYVGFAFPWFGIHFLEPFISWSGILRKDPLIILRKQLMDELKARKKLRESGEQQQQQRAKVDFIDLFLETEQNEQQQLTEQCQNEGEAMLSKTALQMEIHEKKT

SEQ ID NO: 132464 - protein, 52 aa, Heterodera glycines
  Coding regions on vcDNA: vcDNA=SeqID_58887; Strand=+; Position=1 -116,810-852
MLELRVVISVISNVQILVFVVHLAHGVTLPMLVVAWGELQLHEKQDTYKRDE

SEQ ID NO: 132465 - protein, 102 aa, Heterodera glycines
  Coding regions on vcDNA: vcDNA=SeqID_58888; Strand=-; Position=1 -240,504-572
MYLFPIGPTVFCSMYNNYFNYFFPFFLEFLSVLENEEDMPELTTTFIENELKNAITKFLKQMIGIEQLETMEKEIPKAFRIRREDTSLIKKPENMASSAENV

SEQ ID NO: 132466 - protein, 93 aa, Heterodera glycines
  Coding regions on vcDNA: vcDNA=SeqID_58889; Strand=+; Position=1-280
MTKDNYCAFADLLLLHQSESTFRRWIGQSSPASHRNLSLRIELKWENWGRIKRRLEKAAEGMRHIRRRKERGEGHGKVSKNGTKYLRQKWVGG

SEQ ID NO: 132467 - protein, 17 aa, Heterodera glycines
  Coding regions on vcDNA: vcDNA=SeqID_58890; Strand=+; Position=1-66
HKHLFDLFYHIHNLIKI

SEQ ID NO: 132468 - protein, 562 aa, Heterodera glycines
  misc_feature (380)..(380): Xaa can be any naturally occurring amino acid
  misc_feature (382)..(382): Xaa can be any naturally occurring amino acid
  Coding regions on vcDNA: vcDNA=SeqID_58891; Strand=+; Position=1 -1606,4309-4403
  Homolog annotation: Hit_ID=NP_498959.1; Match level="QueryCoverage =94%, HitCoverage=24%, E-value=1e-86, Identity=35%"; Hit description =zn-finger, CCHC type and RNA-directed DNA polymerase  and Integrase, catalytic domain containing protein
RLLGLKNIFAVDDSEDSASPIVIVPKKDGSLRFCVDYRGLNAITRKDCFPLPNIERTLLMLGGRKFFSTLDFLSGYWQIKMANDSIEKTAFATEFGLHEFTVMPFGLCNAVATFQRFMSHLLGDKLNNFVFVYVDDVLVASESFDQHLEHLKFVFQQINEAGLKLKISKCHFCAEQLPFLGHILTREGIKMDEEKVKPILEMPIPVSKKELHSFLGFMTYYRKFIYSFGSIAAPLFQLLKKDIPFRMGKTEIAAISKLKEKVLSEVILYFPDFKAAMENPSRKFLIMTDACKTGISAVLFQPDLKNRIRPIYFASRQCNRYESRYCPTELEALAVRFGVKKFAQYITMIPTRVLTDHKALISMFRSKNETGNARVDKWIXNXIQFILEIEYNPGKTNVIADVLSRSGALKQNQSAENAILIGEILPGTQCEIEPQAEMNEWILSTKESEFRQTYEFLEKRKLPQNIRESQRILDTIQKFTLLNGLLYFCDSTFENLRLFVPRAKIIEERHQGKCAGHLSGKKIFEQISEKFYGHWRPVCTRCILRCFIVSVLATLLSSWSEA

SEQ ID NO: 132469 - protein, 234 aa, Heterodera glycines
  Coding regions on vcDNA: vcDNA=SeqID_58892; Strand=-; Position=1-705
MSSDSEMLEFFKKFWAKCENEEESKAETSTIGKIVAIIVEIFGQTTPSMLDSGAQVSLIKAEFLREILKRLGLKGKSINICPKSRNVVDVNGKLVECYGTVSLPVLRKGCEEMEIDFHITYAPIGLPILFGTNALGPLGFKLFGAPNGELIEFECSNNKSDSVRVVYNTVVEPFSTKFVELSVPPIFNDTNVLIIANDEDNSVRVEPALSTGRNAKIMAAITNFSEKAVILKEN

SEQ ID NO: 132470 - protein, 207 aa, Heterodera glycines
  Coding regions on vcDNA: vcDNA=SeqID_58893; Strand=-; Position=1 -154,307-494,887-1168
MTKIFARNILQIKIKDQNLKNYSRLIKAHFKSYELTKLCRHLNKQCLWHKKSFQNDRTTNQSDQICRRVVNIKTEFVQCIVLTRAEKREKLIMELRKADFNGVKIWSKMDTKPKEEQEKNSAKRADGRLKLTVKANANQNRVLAIKGVVKFSAFIAIFLLCQNLVCGMEEQKKMLNESILDESDDDVCVKSTKRRKSEQRQKAKNRL

SEQ ID NO: 132471 - protein, 220 aa, Heterodera glycines
  Coding regions on vcDNA: vcDNA=SeqID_58894; Strand=+; Position=1 -88,367-941
MQDPMLRECKKFKEYLLVLYEFLFRKYLEVNCPSFQFATTVQPIFVLGNSKTNATIIDVLDSLGIIWAFFFDYAYGQKYENYLEKLFKEKAAAEPKWLNEETIGHKIVNNLQQITKYGADFKQIFGREKPDKIDDELKQSLLIDDATNQHSSKANSDKAIQSFREAFDGIIKSMAETAKTMEESEEGFGKTKKICVIYSFEIISRIISFSMLSNREWKTC

SEQ ID NO: 132472 - protein, 379 aa, Heterodera glycines
  Coding regions on vcDNA: vcDNA=SeqID_58895; Strand=-; Position=1 -176,222-344,387-636,683-822,864-1314
  Homolog annotation: Hit_ID=CAC37684.1; Match level="QueryCoverage =62%, HitCoverage=59%, E-value=7e-09, Identity=24%"; Hit description =putative recombinase [Chironomus tentans]
VIKRVRHDEDVPPAAPLSLEALELPPAYRMYNRTEIDEENFLLADTGVFQIQGQAGPQRILIFARASTSEWAGIMKNVYADGTFSLAPPLFSQIYVLLAKRDKWGFPIAYCLLTSKCEVIYTRMLQLIVQRWPNFAPDTISLDFEQAMVATVRTVFPLCRVQFCFFHLVRSMKKRIASEGLTQTYNNDAVFAEKSKMITSMAFLPVHHLPAVLNALEAQLPQQLIGVFDWFTDNYTGRPRFNGGLTAPRFAPDEWSVHQRTLDGGDRTNNYAEAYHRKLQRAFDCTHPTVFRFINTIRCEQKSIDADIARCIAGELPPQKAPKYRAADARILRLLQSYNAINNNQAHQNDHNYHALINVNPYNIINFLLGISRNYEMRP

SEQ ID NO: 132473 - protein, 175 aa, Heterodera glycines
  Coding regions on vcDNA: vcDNA=SeqID_58896; Strand=+; Position=1 -306,374-515,717-796
MARHIWPLLKNGLIILVNMKRTHLARMHKYVSPIVLFDCPELVQISSTVLPESPTTYSTSPDFSTRCLYNWLYTPRPDGRPLVFKLTKWEAGWENFVNDLFASFSRAIVPVKYMVLASFDVNYTRSEQMVNTLTEEKLTLSSDVHPTPDDRCLRTEEPIGLRTEKDNCGSTTDEP

SEQ ID NO: 132474 - protein, 88 aa, Heterodera glycines
  Coding regions on vcDNA: vcDNA=SeqID_58897; Strand=+; Position=1 -13,283-328,920-1127
MLVQDCLIADTFFKCQRITSSLYFGIKNYFQLNSAVRSLQRCWIGANRNCHQWHYCCHLFFRHHSQHVACLCHRQIKVKCPQIFDAIT

SEQ ID NO: 132475 - protein, 133 aa, Heterodera glycines
  Coding regions on vcDNA: vcDNA=SeqID_58898; Strand=+; Position=1 -130,184-455
MPMEVDDVEEENFVRLRETNQIKMDTLNKEIAETVSQENITKLEKVIWQIFALTFQIVGIELNPTDQITRILQQTLNFDQLALALCNSNSELVLNSIKTHLVNNEHLKKKAIFANIFSRINSQAKDIFGQPLG

SEQ ID NO: 132476 - protein, 144 aa, Heterodera glycines
  Coding regions on vcDNA: vcDNA=SeqID_58899; Strand=-; Position=1 -138,493-641,875-1022
MSKKMKIAPYKNIRCEQTGNGANEELENFMDTISDIVVGENITIDSANTNGEHQESEMDHAWRPNQNIVLHDEFQNALALNMDVENNNLEEENSESMGDHHSFANSVQNGQQGAFRLPPIEIFVDGSLPEKTVKMRENISSLVA

SEQ ID NO: 132477 - protein, 87 aa, Heterodera glycines
  Coding regions on vcDNA: vcDNA=SeqID_58900; Strand=-; Position=1 -579,744-1068
IIFIQKIFFWVFGAVPLNRCAQIYGETESFRNSFPIACTLILRWIFAPHNCLSTPNGHLKKSIYFCFRGSPPEPMRPDLWGDRILRE

SEQ ID NO: 132478 - protein, 95 aa, Heterodera glycines
  Coding regions on vcDNA: vcDNA=SeqID_58901; Strand=+; Position=1-288
MKENTRQMKENAKKLKLEEKGERLEENAKKLEEDGERLVENANKIEENGERLVENANKIEEDGKRLIEIKITEKFKETAERLIENNKKLLEIREK

SEQ ID NO: 132479 - protein, 19 aa, Heterodera glycines
  Coding regions on vcDNA: vcDNA=SeqID_58902; Strand=+; Position=1-62
SHSAPAPYLGNVRATDVAD

SEQ ID NO: 132480 - protein, 144 aa, Heterodera glycines
  Coding regions on vcDNA: vcDNA=SeqID_58903; Strand=-; Position=1 -107,764-1091
MRERTERNEKNTEEMQQKQSGRNEKKRKWKKQRMNCRKRPKRSARMREGGNDGMILRRDLYLDKWEKERMAFTRRDTGENKGTVRGKTIHTDETNDGKEKMKRRWGRDRQKQKGREEKRSVGWMSKSRGREGREKRTKVKRMGA

SEQ ID NO: 132481 - protein, 25 aa, Heterodera glycines
  Coding regions on vcDNA: vcDNA=SeqID_58904; Strand=+; Position=1-77
MVTAGQLQDLCSRIPRLADKHQNHK

SEQ ID NO: 132482 - protein, 105 aa, Heterodera glycines
  Coding regions on vcDNA: vcDNA=SeqID_58905; Strand=+; Position=1-318
MPKAMPKACQGNAKSNAKGTAKSNAKSNAKGNACRLCILAGAVHFAFVPSSRVRSLSLRSCRRRLGTFRASLRHCRLHGLQICSFVAAPAASQCAGPGRGAYATT

SEQ ID NO: 132483 - protein, 110 aa, Heterodera glycines
  Coding regions on vcDNA: vcDNA=SeqID_58906; Strand=-; Position=1 -132,186-386
  Homolog annotation: Hit_ID=AAP30770.1; Match level="QueryCoverage =81%, HitCoverage=34%, E-value=4e-21, Identity=59%"; Hit description =putative gland protein G17G01 [Heterodera glycines]
MALYSVFCWCCSAWASSYLLLYWTPYWSCMNFRADDTNVPLVTFVFDIVMVCSFVFEMFFNNSLVKKRPENASVAAANRKLRNDVATECANVAIHRQQQQKNGSAIIMQT

SEQ ID NO: 132484 - protein, 331 aa, Heterodera glycines
  Coding regions on vcDNA: vcDNA=SeqID_58907; Strand=+; Position=1 -70,162-660,794-1033,1288-1474
MDLFGEPIWNYARMIGIDSNKCIAVKEFGEALRKIIHAKLNSVEMNKRQQKRIESPIQMNEFQILKKILEKIKDNENYGKMENYGQKFNSILLDKQGIAALKELLAILNQIIGHYSGTDESCPMEKRRSIYLESFREKIKFSKILFETLSKYSENVNYDEKRQLLTFPLSTGEHIIARLSALIELIGQQRRTVRNDHISSQIDVVKTIQNIASMEPIQFYERKFTLYWREWVHFDLFFSMAIRLSAQIERNDHLNALLLSASPNYHSYCIFFDYKIQIKNGNLVEINTPTWHAPYYVYWGNDKDQMVTQSQHRRSKEALVQREAMGKKTIN

SEQ ID NO: 132485 - protein, 164 aa, Heterodera glycines
  Coding regions on vcDNA: vcDNA=SeqID_58908; Strand=+; Position=1 -22,466-929,1389-1397
MPSQNGAENSAVVDAPQLEEELLLTGSSPSVEEEQQQQLQQEEEEKEVEMLHIHGMEQPPHQQQIVAGTASTFAAHAAGAASVDDMGPAAASNRQNRPASGSTLPRSRAQSQDADAGPPYASTPTLCPTDENPTFLRHLWLPEEPEGTERTANFVRKMDSLEGI

SEQ ID NO: 132486 - protein, 77 aa, Heterodera glycines
  Coding regions on vcDNA: vcDNA=SeqID_58909; Strand=+; Position=1 -103,393-521
MELRMDEAEDGPIVGGVGGMEQQQQSEPGLQYGTDESCVSLIFRPFSGDDNEQRNGTGAVPGATSMCRLFPFGKMDN

SEQ ID NO: 132487 - protein, 140 aa, Heterodera glycines
  Coding regions on vcDNA: vcDNA=SeqID_58910; Strand=+; Position=1 -109,1126-1439
MTTTQAKEKQQQQVDTAAGEKGKTEQGQMDTVVANDRIRQQMFCKNVAQFAVGAGPHAEVGAASATPPQRDGRVALRAVVRRRGRCAAIVGHQRVVVVVHMSSIRVQRPVARMSALVHTNQRRSSGSRRVGAVQPGGPGL

SEQ ID NO: 132488 - protein, 229 aa, Heterodera glycines
  Coding regions on vcDNA: vcDNA=SeqID_58911; Strand=+; Position=1 -427,496-759
YIDHSVLAFLRANNQIWDKGTNLYLYVCTHGNAIHIWNVFVGEIWPIFATNICRLAFMDGDQLDNLIRFISPTILFDLNIDSVHSGELLPDGIADFDGPNATPTAGQALSKWLHTPRKDGQPKRLSCDLMSGTIEWVNNFKEAFLRATTSSASYKIRLELFEPTEIVPFELVNERTSEILKLEKGEVDGWVFPWIMKRCQIGGPAVQWEDENLDNLNDVHFMLQADCIG

SEQ ID NO: 132489 - protein, 233 aa, Heterodera glycines
  Coding regions on vcDNA: vcDNA=SeqID_58912; Strand=-; Position=1 -95,150-321,453-678,725-837,881-976
  Homolog annotation: Hit_ID=CAE69691.1; Match level="QueryCoverage =90%, HitCoverage=51%, E-value=4e-81, Identity=69%"; Hit description =Hypothetical protein CBG15946 [Caenorhabditis briggsae]
MLSKKLIAFCSDTFSGKGLSSRRLISFDLSDQHKAIRDGALKFAKEVVAPKAAEYDKTMAFPWDIIKQAHQLGLMNPTIPEKYGECVEATALIVEALSYGCSAIQLAIMGPSLALAPLLLAGNETQKQKYAGMLAAEPLIAAYCVTEPGAGSDVSGVKTTAVLKGDKWVLNGSKAWITGGGYAKWFFVLARSDSDPKTPAGKAFTAFVVDGDTPGITRGKKVMGSNWINWDSP

SEQ ID NO: 132490 - protein, 103 aa, Heterodera glycines
  Coding regions on vcDNA: vcDNA=SeqID_58913; Strand=-; Position=1 -147,189-270,321-369,414-447
  Homolog annotation: Hit_ID=NP_510789.1; Match level="QueryCoverage =95%, HitCoverage=23%, E-value=2e-39, Identity=82%"; Hit description =acetyl-Coenzyme A Dehydrogenase family member (XR830) [Caenorhabditis elegans] gb|AAC69025.1| Hypothetica
MAINVELARLMTFKSAQEVDSGRPGAYWASIAKCFAADTANQTASNAVQIFGGNGFNTEFPAEKLMRDAKIFQIYEGTSQIQRLVISRQLLQRVAQTGTSYVT

SEQ ID NO: 132491 - protein, 125 aa, Heterodera glycines
  Coding regions on vcDNA: vcDNA=SeqID_58914; Strand=+; Position=1-376
MLDWAMDKMACGYKQAILIPNQNRPILKYGFFAGSQQSDPSSFLLQQTTVEEGVSNGDICHNAQRHQLQFSTMNGQNGGMCFPSNLPSAMSMLANAPQRRTFLFNSDMANTAAKSMQQHLTEDMA

SEQ ID NO: 132492 - protein, 142 aa, Heterodera glycines
  Coding regions on vcDNA: vcDNA=SeqID_58915; Strand=+; Position=1 -52,105-217,299-562
MNALTAAIFFLRFICAFGLKCFLEFEGNGKLAKNQLDDFECPLEGQLCLFAQCVDVALCQLLSAVVNGRMTTARNFLRNANRCKPMDAATLAAQIGATVAGLVATCTVQIPYWKGGIFVTIFFQIPGVQSLPPPRVLRRQVR

SEQ ID NO: 132493 - protein, 29 aa, Heterodera glycines
  Coding regions on vcDNA: vcDNA=SeqID_58916; Strand=-; Position=1 -60,184-213
MSTDAEKSREFPITINYWKLSLPYQNDLL

SEQ ID NO: 132494 - protein, 77 aa, Heterodera glycines
  Coding regions on vcDNA: vcDNA=SeqID_58917; Strand=+; Position=1-642
LICIQKMSIIFCHFYKNSDLSNFVFHFHSKNFHYRKLEELVFEIFHMNVYSNLNRHLMPNPKDIFEYEVFLNWPFNI

SEQ ID NO: 132495 - protein, 95 aa, Heterodera glycines
  Coding regions on vcDNA: vcDNA=SeqID_58918; Strand=+; Position=1 -27,178-438
MSTGPSDVNDTEVRWNSMFQMLNRFLQCKAAVQVFMTSDEAKRNNKGKGIPIISNIEWNQIEQIVDVLKIINDASNELQSRTATIGMIMPYYFGI

SEQ ID NO: 132496 - protein, 195 aa, Heterodera glycines
  Coding regions on vcDNA: vcDNA=SeqID_58919; Strand=+; Position=1 -110,141-273,383-727
  Homolog annotation: Hit_ID=EAA45732.2; Match level="QueryCoverage =74%, HitCoverage=32%, E-value=8e-14, Identity=28%"; Hit description =ENSANGP00000025171 [Anopheles gambiae str. PEST]
MVFIFNLDTFDIRIAIIGKLDQIMDKEKTENNKLLKKSLIIATVLDPRFKLKLFEQMKEQIREWMRADLQKMFSGFLNTTLSSSGSSNLSITDDQSKSQNEFYDALHQMDKYLREPRVKYNVDPFQWWKKNEAEFPSLGRLMRKYHSAPPGSVESERLFSCAGFILNDLRKSLSHENLERLIFLHHNIILYNFDY

SEQ ID NO: 132497 - protein, 59 aa, Heterodera glycines
  Coding regions on vcDNA: vcDNA=SeqID_58920; Strand=-; Position=1 -175,379-383
MPTVREILESLQKPIKRPRIPTNEDSVLNAERTDAEQQMEDTSTRNDLDVAASDDEENS

SEQ ID NO: 132498 - protein, 179 aa, Heterodera glycines
  Coding regions on vcDNA: vcDNA=SeqID_58921; Strand=+; Position=1-540
MLLRDLVVRPPMLLHLQIIVRPPVLLLRELMVVGPPLTPMLLLDEMALVVGLPKPWVLCQLPVVGLPKPWVLCQLPVVGLPKPWVLCQLPVVGLPKLLLELVMRPPVLLQLLLLLLAVVTAVQANASFATTNNFAPFFKVLQRTERRARKWHRRRMPTTTIRPDMGMRPAAPQAATVTE

SEQ ID NO: 132499 - protein, 64 aa, Heterodera glycines
  Coding regions on vcDNA: vcDNA=SeqID_58922; Strand=+; Position=1 -64,259-389
MYVKVNKLFNKSWSTPFHQKKGKARFCEKWLPIKSPDINHITSNRRNLAISEKKRTKPRNRFIL

SEQ ID NO: 132500 - protein, 83 aa, Heterodera glycines
  Coding regions on vcDNA: vcDNA=SeqID_58923; Strand=-; Position=1-249
RTVCGLVNGTRMRQKIKGGRETKKGCQNKRKKSKEKTNKQKMGVVKLSSLHRDPSAQGSAKVTHSTRQKSGRFAARRFVRVSP

SEQ ID NO: 132501 - protein, 170 aa, Heterodera glycines
  Coding regions on vcDNA: vcDNA=SeqID_58924; Strand=+; Position=1 -214,631-930
INDEKVKRLIIQLNVDIAMADLFVEVNDPAKKRANLCLMDSLLTHLVANGTLYTEVQEWQTHMLYEHFINHNEIPRSSDADLRWAKPECHKAEVAQAAVSKLLSQMHLVVQSHSFVLCQVAQDCAEFVSFVNQYAIRNFEKLYCCNQCAIGRRIVIVPVCKIFKQNSSHF

SEQ ID NO: 132502 - protein, 92 aa, Heterodera glycines; identical to SEQ ID NO: 125147
  Coding regions on vcDNA: vcDNA=SeqID_58925; Strand=-; Position=1-304

SEQ ID NO: 132503 - protein, 474 aa, Heterodera glycines
  Coding regions on vcDNA: vcDNA=SeqID_58926; Strand=+; Position=1 -663,968-1729
  Homolog annotation: Hit_ID=AAA93301.1; Match level="QueryCoverage =46%, HitCoverage=58%, E-value=6e-35, Identity=40%"; Hit description =HASI
MIIAFDRIFKRSKYIPWKVLTDQGKEFTARAVQQFFRTKDVEHFCMLTSPQFHAGMAERANRSIKERLYRYFTERNTYKWIDVVQDIVCAINHSTNSCIGMRPVDVNFKNAEALRQKLHDAAENVVRRKPKYRVGDRVRIEKYKHVFQKGHLPRFTNELFTVAEVHSERSPVVYRLRDDNNEIISGWFYANDLCKTLEDKQQKMFDIENILKKKRQNGVEYIEWQTGNTVRIEVPPSNVTNPHELSKNLYRLLGEGSDPLAKKVRSTQNSFMLTINKARRWAREEYIKRKTKEKRGVRDEELLLQAMLADTGTLVDLNNVAQGLLSREKSAATSNLQLRTSADDNDSYQKKLDDYFSKLSDKNLTVLDELGMTKLTAEIKNLTEEERTILEATKEMGTEAWIQAYREIRLVCQFNYDVHRNRFVLNTDPRYVKKVEVSPQLAYILGFNNTEFMQPAKEARFSPDIIPRLHAGSY

SEQ ID NO: 132504 - protein, 89 aa, Heterodera glycines
  Coding regions on vcDNA: vcDNA=SeqID_58927; Strand=+; Position=1 -156,204-317
MSPNECSDRPFQQPDNVQQPHQQPDEDAELRAQIEDAEEDLLLNWWREDPTIIRFLFGHGRAPAIEAALLQRAEREAEILREYAENQQQ

SEQ ID NO: 132505 - protein, 156 aa, Heterodera glycines
  misc_feature (31)..(31): Xaa can be any naturally occurring amino acid
  misc_feature (64)..(64): Xaa can be any naturally occurring amino acid
  Coding regions on vcDNA: vcDNA=SeqID_58928; Strand=-; Position=1-478
  Homolog annotation: Hit_ID=NP_671477.1; Match level="QueryCoverage =91%, HitCoverage=49%, E-value=6e-29, Identity=55%"; Hit description =rRNA promoter binding protein [Rattus norvegicus] gb|AAK21974.1| rRNA promoter binding protein [Rattus no
ARSHGQKPPFHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 132506 - protein, 136 aa, Heterodera glycines
  Coding regions on vcDNA: vcDNA=SeqID_58929; Strand=-; Position=1 -97,141-206,573-831
PRFGRPPAILRFAPPSLRLPNSQKSFSAIWALSFSIFSINSFFAFRIFPSNSFLACSLRFCCLVLNEFRSSSNFLSIFAFSSSGSFLLPRPVFVREHSPDSWRLFSSFSFSSPGKGRQSLNIKKEMKNIRKYFIIQ

SEQ ID NO: 132507 - protein, 103 aa, Heterodera glycines
  Coding regions on vcDNA: vcDNA=SeqID_58930; Strand=+; Position=1 -46,249-379,476-610
MEPMPPYTVICPGVYCITEQQIRRHFLKKKKLPLGTQRRRRRVKSAKRVTVKNFAKCRHINLKQTVLLTCIGCSHFADEQFISQTFEEFNKINDVEYIGELLN

SEQ ID NO: 132508 - protein, 83 aa, Heterodera glycines
  Coding regions on vcDNA: vcDNA=SeqID_58931; Strand=+; Position=1-250
  Homolog annotation: Hit_ID=NP_499021.1; Match level="QueryCoverage =98%, HitCoverage=5%, E-value=2e-17, Identity=47%"; Hit description =CEll Death abnormality CED-11, TRP homologous cation channel protein (ced-11) [Caenorhabditis elegans] emb
MFVYVPISHVFGPMLVRIRLMITRDLVNFLLLILLVLVGNALAIKAVLFPDLSANRETVATSVHWTFQQLFTTDLSVLAQSDE

SEQ ID NO: 132509 - protein, 73 aa, Heterodera glycines
  Coding regions on vcDNA: vcDNA=SeqID_58932; Strand=+; Position=1 -79,132-274
MTIMPLPSLSLPLKCCTNASTHLTQNKTPGQMAVIPALAFSSYRLTRVFVLPKCCCPALWPFRRLLEPLGNST

SEQ ID NO: 132510 - protein, 24 aa, Heterodera glycines
  Coding regions on vcDNA: vcDNA=SeqID_58933; Strand=-; Position=1-75
TPSEKTRCVPINRECQRKTLSFFS

SEQ ID NO: 132511 - protein, 29 aa, Heterodera glycines
  Coding regions on vcDNA: vcDNA=SeqID_58934; Strand=-; Position=1-87
MQLASVMARALLVSAFFAMDTSHRSTMTK

SEQ ID NO: 132512 - protein, 220 aa, Heterodera glycines
  Coding regions on vcDNA: vcDNA=SeqID_58935; Strand=-; Position=1-663
MKLCLIFFSIVLFLIAQIEIGAEKKKLQQKTFKEIFGEKWEEKENEQKKREIVEKFNKIKAKIKQKGRKYSTKEWNKINDKIAKTLGTNRKYIYKWIKELGIYKWHNKSKTDEQKIEIVQKFNAMKNEYKQKGRKYSTKEWDKNYAEICKKIGVGQGVIGQWKKQFGMGERMTEKEKMEKMKMYWQMKGENPKMSDEKISKILKISQWTIFNWKKQFEKN

SEQ ID NO: 132513 - protein, 75 aa, Heterodera glycines
  Coding regions on vcDNA: vcDNA=SeqID_58936; Strand=+; Position=1 -165,438-500
MAEQGDSLSPFRCRPFIASRFIAVVVSLPRWVSLPICLTTAYFSLFLIIFINFVIARAEKHQSSNTYDIAEEACA

SEQ ID NO: 132514 - protein, 214 aa, Heterodera glycines
  Coding regions on vcDNA: vcDNA=SeqID_58937; Strand=+; Position=1 -82,129-181,421-584,686-1031
MTDVFVDGTFIIAPPLFYQVYAVLARWSVEIDESFLLHMHYLRTKRYQIDPIFASQSSWITSMAFMSIGDLTHALSHWKCICYLSFDQFFVIDLSKQIYRTINGEDRTNNFAEAAHRRLQRDFNCSHPSIWRFIETLQKQQKLRDSEMSKCVAGFDPPQKAKRYREADRRILTLTRNYHPVNIGDPAHVNVDNFNPQTIIDFLAGVSYNCSMDP

SEQ ID NO: 132515 - protein, 30 aa, Heterodera glycines
  Coding regions on vcDNA: vcDNA=SeqID_58938; Strand=-; Position=1-90
MAEQAIHCRRFIARIFIASRLIAGVVSLPK

SEQ ID NO: 132516 - protein, 410 aa, Heterodera glycines
  Coding regions on vcDNA: vcDNA=SeqID_58939; Strand=-; Position=1 -1008,1064-1287
MVNVRFQIGADRRVAEPPRPPRIRAYLALEEAPNDQEGPNRGPPSRRLFEAIGFRRDNPNIGDRAENNARQAPIQRGERAIDNGRPNSPDGSFENRPRRAVPNRPMRRWQNGLFIVALALCLGSLAEGKEFPSTRTCHQPLEAADMARENQWGFSRILFPWPFSHDQKANLIRGLRPFNGSGTYIRAGIRHIPPSLALPKMPKPIKMPSSSSSAYSSSSSSSPDRQSPPPPRKKAVELFNIAAATPERDAKSGRKFSVRDFIDAEAKEEPSSKRLPTCSACQLSGHRRGAKACPLYVAPQRERSAAASRPGTSNARRDSPEEGEITADKADRNRPPDDAGIVAKAQPPPRQPWTSWLFTENSPLAVGGWKAQGEERAPTPPRRNSMIAAGGSSVANSDRFYRSPAVFSHA

SEQ ID NO: 132517 - protein, 79 aa, Heterodera glycines
  Coding regions on vcDNA: vcDNA=SeqID_58940; Strand=-; Position=1 -26,369-582
MASLQNLERCKLCNFAVEMEVDKTVNKVFDCLNCGAKFCRLCERRWDEDHFGISCDELGTKTKKDKKERELWAFDKQTE

SEQ ID NO: 132518 - protein, 37 aa, Heterodera glycines
  Coding regions on vcDNA: vcDNA=SeqID_58941; Strand=+; Position=1 -35,270-348
MPITKPYIKTLDFLEGIDITKGKDEENDMFQVIKFKL

SEQ ID NO: 132519 - protein, 73 aa, Heterodera glycines
  Coding regions on vcDNA: vcDNA=SeqID_58942; Strand=-; Position=1 -165,311-367
MKTEPIENYDEKTSGRGAAKAENFVLKQEPYEVKIGEIIEERCQINGSASFSRGEANSATEGLSNDAKNVGFG

SEQ ID NO: 132520 - protein, 76 aa, Heterodera glycines
  Coding regions on vcDNA: vcDNA=SeqID_58943; Strand=-; Position=1-230
MPPSNAEVVVEPNATTSTTTVKVAARQKAKTSSTTTAASRRQPKCRLLYIIHRIDNGHAQCTTTCSGGGSGSGTCN

SEQ ID NO: 132521 - protein, 243 aa, Heterodera glycines
  Coding regions on vcDNA: vcDNA=SeqID_58944; Strand=-; Position=1 -184,267-454,499-644,1006-1219
  Homolog annotation: Hit_ID=NP_492043.1; Match level="QueryCoverage =60%, HitCoverage=14%, E-value=3e-21, Identity=37%"; Hit description =protein kinase family member (1H806) [Caenorhabditis elegans] emb|CAB10931.1| Hypothetical protein C01H6.
MPFAIKQEQCSKLVNGVDLKTAKFIFNELFITKQLTELSEDTGSDFVTPSFTQLRMRKIVKVLKHNSSFRLGCFPPKLLKAWDAFKKAKPELSENERPDIYADEDLHFVIIGLSYGGKDLEAFKIKNGPECYSIFHQVALSLAIAEAVLEFEHRDLHAGNILVERCPDNEKIRENWSSFWPQTNVYWMGYAAKKLFNKNRFIRAKRKETIDNLFSNFEKKFGSISDFIDHPDFLSVFAEFTSG

SEQ ID NO: 132522 - protein, 197 aa, Heterodera glycines
  Coding regions on vcDNA: vcDNA=SeqID_58945; Strand=-; Position=1 -212,953-1092,1343-1427,1472-1511,1675-1788
MPIQVHAQSIGRDGTPKIIFLIFYKNSGPNCVTLTWQPPAEDGGCKLEGYLVQKREWGHEQWEMATPDMVRKEVSVQKPSVVPLKSQRANEKEKDATQIRTPKTAQPSSVHGIGPSLDSSDQPLSSTARRRQPRRSARKDATDIQCCSKNLTPPRSKNTCTAKDDKTMAQLFELVVKGKPKTPKRLLDTMNATSDSC

SEQ ID NO: 132523 - protein, 805 aa, Heterodera glycines
  Coding regions on vcDNA: vcDNA=SeqID_58946; Strand=-; Position=1 -111,363-479,1161-1255,1307-1357,1749-1827,2766-2872,3348-3513,4076 -4204,4571-4955,5325-5914,6363-6536,6849-7223,7321-7359
  Homolog annotation: Hit_ID=CAA33463.1; Match level="QueryCoverage =81%, HitCoverage=78%, E-value=1e-111, Identity=27%"; Hit description= twitchin [Caenorhabditis elegans]
MGTSVLMLIISTIKCDIFRRNTVLFVDTEIEVPIPHRLLEQRGHKRGTSDSSAQRYLRRQQLKEEKQAELDKPAELPYKCKECPDAFARPLYLASHSRNHGYNGRYKCQHCNYGCDLKDTFDKHRACHVNVTPIRIDFDDEVFAGSPDPDEFRVCAENAFGRSDPLNTDVDRPGPPEGPITYPATTNKCQVSVVEEPRDFVETLKSQSANENENATSECEVDDNDIDVEDDEQLRDEIAANVALLRANAEQFELEASDVEEDEWVDSSEEEQENKQLRDEIAANVHQQCRPFVSPPGAPEKPRVGNVTKHTVDLSWIRPLHDGGARIDGYVVEQRKMGDNHWSRANIGIPRAKTVRDTHCTVECLPEKEQFEFRVRAVNKAGEGEPSKSSDLVFTTDQPGRPVFDLSNLKDITVRADETITFTLPYSSGGLKPNVDVLNNGKTIFDERTTIEVEDDKIVFTMRDTKHSDAGPYKVVAQNRHGKDSAKLNVNVLDVPGKPGGPIRFSELAADACTLHWSQPKDDGGSPLTNYVVERKSARGGDWERVGAPAGMSLRVRRLTSGERYKFRVRAENQFGVGEPLDVDEPLLAKAPNAPWEKTPFGNVPDTRFKVLPEPVVKYSVPSQPDKPVVRNFGRTWAELEWELPASNGGAKIRGYELQHKDQHSNEWVTCKKSATWSTNFKVQNLSDRGEYVFRVAAKNAAGWSKPSPQSDRIKLRQRYGPPGMPIQVHAQSIGRGGTPKIIFLIFYKNSGPNCVTLTWQPPAEDGGCKLEGYLVQKREWGHEQWEMATPDMGPNSESLMPKSP

SEQ ID NO: 132524 - protein, 69 aa, Heterodera glycines
  Coding regions on vcDNA: vcDNA=SeqID_58947; Strand=+; Position=1 -140,226-292
MAFILEKCASILCCAVLLAVIICFSNKNLYNICINAMILPYKHSNFSTKAQFGDVPNKIGVERSPYYRM

SEQ ID NO: 132525 - protein, 49 aa, Heterodera glycines
  Coding regions on vcDNA: vcDNA=SeqID_58948; Strand=+; Position=1 -94,522-577
MDPDAAIPDVGSRVPDVANDPDVERDNGHAAESYSVDRKAMSIQKENSK

SEQ ID NO: 132526 - protein, 85 aa, Heterodera glycines
  Coding regions on vcDNA: vcDNA=SeqID_58949; Strand=-; Position=1 -121,1272-1408
MFAVRKSQKHIETAFTAEMIAYHPTDGTDSEYVEKGQIMFEINWLKRKETAPKEEKGEEAKRREPKKATESAENGHRKQQQSQEA

SEQ ID NO: 132527 - protein, 120 aa, Heterodera glycines
  misc_feature (99)..(99): Xaa can be any naturally occurring amino acid
  Coding regions on vcDNA: vcDNA=SeqID_58950; Strand=+; Position=1 -145,1237-1415,1461-1500
  Homolog annotation: Hit_ID=CAE57892.1; Match level="QueryCoverage =79%, HitCoverage=18%, E-value=4e-09, Identity=41%"; Hit description =Hypothetical protein CBG00938 [Caenorhabditis briggsae]
MLLGFAAAFDDHFQHFPWLFSALFAWLLLLFLLLELFPSFSANLSLQLVSPRRALIALFRAPNPTEHYLAFLDIFRIGAICWVISNHLGSEGGLDVLLXLPHGEHFKQSVHSLPIFGPIF

SEQ ID NO: 132528 - protein, 202 aa, Heterodera glycines
  Coding regions on vcDNA: vcDNA=SeqID_58951; Strand=-; Position=1 -291,342-593,2149-2214
DIQFWTDTKNTGEGKRPMEDLEDPSEGNDQGQFPLTISHKFPTSSSPTAEVVVKAAKVLNKLDRNKEKASYLVLWPDEAGVRSNESPNRSWDQRISLGNVEAILEFEEAVRKRKAWAENAVMYEVEKVMGRRKNSGKEAPQYLIKWKGYDEISWATMESLQIGFKHLLVAYALERPRTLEKRRQLSIISPMPQANSVRKDAV

SEQ ID NO: 132529 - protein, 55 aa, Heterodera glycines
  Coding regions on vcDNA: vcDNA=SeqID_58952; Strand=-; Position=1-165
MNAIFGPKTPRHAVKILKKIDYEDRASCYLVQWNCGSAEEKGPSTTWEWANKLSP

SEQ ID NO: 132530 - protein, 241 aa, Heterodera glycines
  Coding regions on vcDNA: vcDNA=SeqID_58953; Strand=+; Position=1 -35,102-285,325-437,487-642,688-739
  Homolog annotation: Hit_ID=CAE63593.1; Match level="QueryCoverage =92%, HitCoverage=53%, E-value=2e-62, Identity=54%"; Hit description =Hypothetical protein CBG08084 [Caenorhabditis briggsae]
MINSIFIVNSSHDVILEKHYKDVILEKHYKVIHRSICDYFFDVQKQSPNAENIPPVIAAPHHYLYIVHHNSLYFIAICVTETPPLMVIEVLHRIIAIPPLMVIEVLHRIIAIFTEYFDECSDSAIKENIVIVFELLDEILDYGYPLCTELNVLQDFELLDEILDYGYPLCTELNVLQDMIKPPNFLRSLKNQVTGRTNISEILPTGQLSNVPWRRAAVKYANNNVPWRRAAVKYANNEGEF

SEQ ID NO: 132531 - protein, 257 aa, Heterodera glycines
  Coding regions on vcDNA: vcDNA=SeqID_58954; Strand=+; Position=1-771
MSFDEFVALASRAEATQMAAKRQSSEHRPNQERKYMHPNNREVETSSKNQLRPYQVVCYNCNEPGHVSRNCNKTMSRQNRNEFPSSFPQQNQQQTPNTVATGANRVFLNSKNGIPSAGRSQNFLKQNCIRMEEEVKTDATVAGVKLEREVVEFLRNELDKAKTKSDKTGESPVIGKMVTVELKVFETPATAMLDGGAQISLMGGKFFYELITNGKLELHKNGFNRVSARISDVNGKELECFGVISLPVDRDGCKTTN

SEQ ID NO: 132532 - protein, 116 aa, Heterodera glycines
  Coding regions on vcDNA: vcDNA=SeqID_58955; Strand=-; Position=1 -129,187-405
MSQSPSSMSSSSSSAESSHSAGNKGGQPNVCALVAKTGFQKTGHVESHGDHVGKMLGNVSDDSEEGEEEEAAQQQHAEVAVAAMDDASSDSPATSSDEEMPMEQRQQKQRDAEGTE

SEQ ID NO: 132533 - protein, 54 aa, Heterodera glycines
  misc_feature (10)..(10): Xaa can be any naturally occurring amino acid
  Coding regions on vcDNA: vcDNA=SeqID_58956; Strand=+; Position=1-161
PFLLNSYLCXLVVRDRKQGSCLFSTDSGSEINFFRYSRPTKKVYRLIFIKQSLS

SEQ ID NO: 132534 - protein, 111 aa, Heterodera glycines
  Coding regions on vcDNA: vcDNA=SeqID_58957; Strand=+; Position=1 -277,568-627
YSGRLVAAVLQRLLHARAAHIYGLGWFALRHGELLLANGLHLEVRELRVHSLFNWWWTTTAPTVDSAANDGGGQRMALNVRVSVGTIRVGKQLADEEGSRNATSSICDGQK

SEQ ID NO: 132535 - protein, 283 aa, Heterodera glycines
  Coding regions on vcDNA: vcDNA=SeqID_58958; Strand=+; Position=1-849
  Homolog annotation: Hit_ID=NP_920205.1; Match level="QueryCoverage =95%, HitCoverage=18%, E-value=3e-33, Identity=35%"; Hit description =putative DNA helicase homolog [Oryza sativa (japonica cultivar -group)] gb|AAP52492.1| putative DNA helica
MEEEEIRQRIANCSELMAYFELNKTNVLAKTLFYHQIPEKFCFKKGKWTERKTYFNTIGRMVKVSPAEPERYHLRLLLLNVKGACSYDDLKTVIDINGNAKLCETFSAACLERGLIRNDEEWKRALEEAESFEMPCKLREFFALILVHCNPAKPEELWNMFKDSLSEDFCRSFRKELAYAKAYKEIALSIMKAGKTLPIFQPWNINVDDEVEQLFDLAEELDLGQRNYALMYDEQRNVCDAILHRICNPVNEPAFYFLSGPGGTGKTHVNKTIVHMLRGQKKK

SEQ ID NO: 132536 - protein, 104 aa, Heterodera glycines
  Coding regions on vcDNA: vcDNA=SeqID_58959; Strand=+; Position=1 -85,147-376
MILEIRLYEEWTQNFFYKEENQNKSKKTGNVSEEKHFVKDNLRLKFFHNLGDYWIFYASNFWKREKIVRKVTHQMAKDSKNKVAKMKEMITELKEGKDFFLFVS

SEQ ID NO: 132537 - protein, 17 aa, Heterodera glycines
  Coding regions on vcDNA: vcDNA=SeqID_58960; Strand=-; Position=1-55
NGQGLGPEIHVFRDSRS

SEQ ID NO: 132538 - protein, 81 aa, Heterodera glycines
  misc_feature (14)..(14): Xaa can be any naturally occurring amino acid
  Coding regions on vcDNA: vcDNA=SeqID_58961; Strand=+; Position=1-484
FFAYQIFAINAHLXKKYSILLKCSVFCYILRIAVHLKASVIEQISQISRKVPAVAVKIVYIKTMAIRISALGPFSKLMCFY

SEQ ID NO: 132539 - protein, 81 aa, Heterodera glycines
  Coding regions on vcDNA: vcDNA=SeqID_58962; Strand=+; Position=1-484
FFAYQIFAINAHLFKKYSILLKCSVFCYILRIALHLKASVIEQISQISRKVQAVAVKIVYIKTMAIRISALGPFSKLMCFY

SEQ ID NO: 132540 - protein, 81 aa, Heterodera glycines
  Coding regions on vcDNA: vcDNA=SeqID_58963; Strand=+; Position=1-485
FFTYQIFAINAHLFKKYSILLKCSVFCYILRIAVHLKASVIEQISQISRKVQAVAVKIVYIKTMAIRISALGPFSKLMCFY

SEQ ID NO: 132541 - protein, 81 aa, Heterodera glycines; identical to SEQ ID NO: 128717
  Coding regions on vcDNA: vcDNA=SeqID_58964; Strand=+; Position=1-484

SEQ ID NO: 132542 - protein, 45 aa, Heterodera glycines
  Coding regions on vcDNA: vcDNA=SeqID_58965; Strand=+; Position=1-483
KYSILLKCSVFCYILRIAVHLKASVIEQISQISRKVQAVAVKIVI

SEQ ID NO: 132543 - protein, 19 aa, Heterodera glycines
  Coding regions on vcDNA: vcDNA=SeqID_58966; Strand=+; Position=1-60
EPVNSCIGCKCRRCCTPNS

SEQ ID NO: 132544 - protein, 357 aa, Heterodera glycines
  Coding regions on vcDNA: vcDNA=SeqID_58967; Strand=+; Position=1 -697,736-1077
  Homolog annotation: Hit_ID=NP_502797.1; Match level="QueryCoverage =95%, HitCoverage=95%, E-value=1e-54, Identity=35%"; Hit description =HASI (4P602) [Caenorhabditis elegans] emb|CAB16520.1| Hypothetical protein Y57G11C.19 [Caenorhabditis ele
VEKILSKIYYNLKSPASFAGIQKILIEAKKIDPKITTDDVNKFLEKQRTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKIKNILRKNFIKNVMYSPDLHAGVVERANRTIKERLYRYFTKKDTLRWVDVIDKIITNINNSVNRTLGAKPSSINLKMPVRSGKKKFKIGDIVRITKEKKFKIGDIVRITKEKGKFSKGYLPNFTEELFKIVVANSTTPDSYRIEDLEGNLIKGIFYNQEVKTWMIFTLYYLRTHRGRRTLRQNSQYTPRDFGIGHKLVSSSLINYLPLL

SEQ ID NO: 132545 - protein, 64 aa, Heterodera glycines
  Coding regions on vcDNA: vcDNA=SeqID_58968; Strand=-; Position=1 -129,288-353
MAQFKANTLPMLKHLDDQGKLRVVRLERAAHIGAVSEMAPMGKKYFMIRHTAVPESAVGRFLGF

SEQ ID NO: 132546 - protein, 66 aa, Heterodera glycines
  Coding regions on vcDNA: vcDNA=SeqID_58969; Strand=+; Position=1 -13,79-266
MQTDSNEKFFILDCAEENNEYDGKQKIIEHIHQIQSDVHWTCDIKFGDRDQPVPFPLPEGAILPKK

SEQ ID NO: 132547 - protein, 75 aa, Heterodera glycines
  Coding regions on vcDNA: vcDNA=SeqID_58970; Strand=-; Position=1 -6,352-573
MVLLRAPRPLLRPRPQPLPPQPPRQPLPRHCRHISASEKLFPRTKMKNLLTPVLRGKMRAICLTVLRVGSIIELP

SEQ ID NO: 132548 - protein, 27 aa, Heterodera glycines
  Coding regions on vcDNA: vcDNA=SeqID_58971; Strand=+; Position=1-81
MHRIIAAVKKLVVGSVLAVRCTLCVLL

SEQ ID NO: 132549 - protein, 371 aa, Heterodera glycines
  Coding regions on vcDNA: vcDNA=SeqID_58972; Strand=-; Position=1 -937,1007-1185
  Homolog annotation: Hit_ID=NP_701480.1; Match level="QueryCoverage =78%, HitCoverage=10%, E-value=5e-09, Identity=25%"; Hit description =hypothetical protein PFL0575w [Plasmodium falciparum 3D7] gb|AAN36204.1| hypothetical protein PFL0575w [P
MKILLIFLLLCALIFKKAINQIEAGKIIQEKSFAEIFGQRWDDGAEENICQNDQIIHGEIADQNNQFGQNVRQFDQIFDENVEVKEEESEEMSTDYDELGDQLPMPTNNEQIYDQIRILNDKQKRGIVEKFHKIKEKIKQMGKKYPRKEWVKIERKIAKKLGVSQEKIYKWKREFGMMKNKNYSVEEKRIMLKQFDQIYGKLKTKFNEKLEGKRTKCQKIIAKHLGTNIRSMNRWKKEIKNGKTMKNQRIFEQKIEIVEKYFKLKKEFMQNGKHSRKEWKEFRAKIKQKFGVIFQTIEKWDKKIGLNQILSKGQKHYTFAEKTEKIKQYYQLKNQNPKLNDRQIAEILNITKRSLERYKSEFKRKSEGVTD

SEQ ID NO: 132550 - protein, 63 aa, Heterodera glycines
  Coding regions on vcDNA: vcDNA=SeqID_58973; Strand=+; Position=1-189
KSCQFKTAKKAEFSTFFIFIFFYSSKFSVIFSRLIEPVKNFRMISRLFDSVNNFKSYIDSKLA

SEQ ID NO: 132551 - protein, 83 aa, Heterodera glycines
  Coding regions on vcDNA: vcDNA=SeqID_58974; Strand=+; Position=1-249
MANVDLALDEIISKSRPPPPPPAPQQRNFGGKRPFRMNATNRPGFGRRNSLGGGQRFMRSGSDNAVWINIVNLHDTVLTQDLQ

SEQ ID NO: 132552 - protein, 372 aa, Heterodera glycines
  Coding regions on vcDNA: vcDNA=SeqID_58975; Strand=-; Position=1 -940,1010-1188
  Homolog annotation: Hit_ID=EAA15516.1; Match level="QueryCoverage =95%, HitCoverage=59%, E-value=3e-10, Identity=24%"; Hit description =hypothetical protein [Plasmodium yoelii yoelii]
MKILLIFLLLCALIFKKAINQIEAGKIIQEKSFAEIFGQTWDDGAEEENICQNDQIIHGEIADQNNQFGQNVRQFDQIFDENVEVKEEESEEMSTDYDELGDQLPMPTNNGQSCDRFSNETNKNKRETVEKFHKIKEKVKQMGKKYSTKEWVKIETKIAKKLGVNQRKIYKWKREFGMMKNKNYSVEEKRIMLKQFDQIYGKLKMKLNGKLHKKSTKCQKIIAKHLGINIRSMNRWKKEIKNGKTMKNQRIFEQKIEIVEKYFKLKKEFMQNGKHSRKEWKEFRAKIKQKFGVIFQTIEKWDKKIGLNQILSKGQKHYTFAEKTEKIKQYYQLKNQNPKLNDRQIAEILNITKRSLERYKSEFKRKSEGVTD

SEQ ID NO: 132553 - protein, 73 aa, Heterodera glycines
  Coding regions on vcDNA: vcDNA=SeqID_58976; Strand=-; Position=1-222
MKSSFLILSLLFLIIFENVIEQINSGKINQEQNFDEIFGQGWDERTELRIDQLIHGQNADQNSQFGQNDRTFG

SEQ ID NO: 132554 - protein, 271 aa, Heterodera glycines
  Coding regions on vcDNA: vcDNA=SeqID_58977; Strand=+; Position=1-816
  Homolog annotation: Hit_ID=XP_345024.1; Match level="QueryCoverage =92%, HitCoverage=91%, E-value=6e-31, Identity=28%"; Hit description =similar to SPAC23A1.17 [Rattus norvegicus]
HFNHWDSTHQHFNHCGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLKPPAFQSLGLNPPAFQSLGLNPPAFQSLGLNPPAFQSLGLNPPAFQSLGLNPPAFQSLGLNPTAFQSLGLNPTAFQSLGLNPPAFQSLGLNPPAFQSLALNPPTFQSLGLNPPAFQSLGLNPPAFQSLGLNPPAFQSLGLNPWDSTHKHFNHSRIQSHQFFETQ

SEQ ID NO: 132555 - protein, 30 aa, Heterodera glycines
  Coding regions on vcDNA: vcDNA=SeqID_58978; Strand=+; Position=1-92
MAYKGASAFVKNCHPYAFVKTASAFVKTAN

SEQ ID NO: 132556 - protein, 77 aa, Heterodera glycines
  Coding regions on vcDNA: vcDNA=SeqID_58979; Strand=-; Position=1 -52,198-379
MFFRKLDPGKEFLKNWKTINGIHSNKTIMIYHFEVLFFYLDLNLTSIADRSLKSVVVMADKIWWSLRFQCDNMGTIS

SEQ ID NO: 132557 - protein, 51 aa, Heterodera glycines
  Coding regions on vcDNA: vcDNA=SeqID_58980; Strand=+; Position=1 -69,378-464
MKRRLSPRSNSTQPVGPISRTAIQQQQQWGGEKQQQVDRKEEEAVLINNST

SEQ ID NO: 132558 - protein, 437 aa, Heterodera glycines
  misc_feature (23)..(23): Xaa can be any naturally occurring amino acid
  Coding regions on vcDNA: vcDNA=SeqID_58981; Strand=-; Position=1 -321,379-561,600-812,871-1161,1214-1282
  Homolog annotation: Hit_ID=AAK54395.1; Match level="QueryCoverage =98%, HitCoverage=92%, E-value=1e-94, Identity=33%"; Hit description =myosin heavy chain [Trichinella spiralis]
KAKLTDIRTSRSPSLESDQIQIXLFRLRCSKDEANEQAEALRRENKTLMQELKEVTEQLNDGGRGTHELGKAKRKLEQEKEELQLALEDAESALEAEESKVLRAQVEISQIRSEIEKRIAEKEVEISQIRSEIEKRIAEKEEEFENTRKMHQRALESLQVTLESESRAKTELAKTRKKLESDIGELELALDQANKANVEAQKHLKRCQEDIGELELALDQANKANVEAQKHLKRCQEQIRELQHQVDEEQQLREQVQEQWQVTEKRVQVGQQEKEEALMEAEQAERARRHAESEAQEAERARRHAESEAQEMRETMGGLENANAAMNTLRRRLENELGQTKMELAETTAELRGMEETARRAATDAARLAEELRHEQEHAQGVERQRNALEQQVKETQLRMDEMDTLTLKSGKKAETQLRMDEMDTLTLKSGKKAMAK

SEQ ID NO: 132559 - protein, 119 aa, Heterodera glycines
  Coding regions on vcDNA: vcDNA=SeqID_58982; Strand=+; Position=1-360
  Homolog annotation: Hit_ID=XP_522969.1; Match level="QueryCoverage =100%, HitCoverage=84%, E-value=6e-15, Identity=36%"; Hit description= PREDICTED: similar to putative protein family member (XC187) [Pan troglodytes]
MIRRGTTVIKRGTTVIRRGTTVIRRGTTVIKRGTTVIRRGTTVIKSGTTVIRRGTTVIRRGTKVIRRGTTVIRRGTTVIRRGTTVIRRGTKVIRRGTTVIRRGTTVIRRGTKVIRRGTK

SEQ ID NO: 132560 - protein, 150 aa, Heterodera glycines
  Coding regions on vcDNA: vcDNA=SeqID_58983; Strand=-; Position=1-453
  Homolog annotation: Hit_ID=ZP_00351648.1; Match level="QueryCoverage =57%, HitCoverage=77%, E-value=9e-12, Identity=48%"; Hit description =hypothetical protein Avar03001934 [Anabaena variabilis ATCC 29413]
MIVPFLTIVVQFQQFLYLSNNYCTFSTVVVPLLITVAPLLITVVPLLITVVPLLITVVPLLITVVPLLITVAPLLITVVPLLITVVPLLITVVPLQITVVPFPSVVAPLLITVVPLLITFVSLFYCCTSSNHWCTSSNHFCITFSMSYLF

SEQ ID NO: 132561 - protein, 51 aa, Heterodera glycines
  Coding regions on vcDNA: vcDNA=SeqID_58984; Strand=+; Position=1 -120,432-643
AQTGDSRPFFKSCFALTGASRPFFKFVELRRAIRARFLNLLRSDGRFAPVF

SEQ ID NO: 132562 - protein, 123 aa, Heterodera glycines
  Coding regions on vcDNA: vcDNA=SeqID_58985; Strand=-; Position=1 -145,230-295,967-1127
  Homolog annotation: Hit_ID=NP_740900.1; Match level="QueryCoverage =57%, HitCoverage=2%, E-value=2e-16, Identity=55%"; Hit description =chorein A (359.3 kD) (1J482) [Caenorhabditis elegans] emb|CAB02304.1| Hypothetical protein T08G11.1a [Caen
MGKGVAALTLDEDYQRRRMQARQQPTSIGEGMFRGVRGVGTSVVEGVTGVVSKPVEGVKQGGLLGGIKGIGIELRLKKEKKGFSFFSSKDANVKGKIVQFGAEHVAQRVFEHILRAWEYGVAD

SEQ ID NO: 132563 - protein, 409 aa, Heterodera glycines
  misc_feature (16)..(16): Xaa can be any naturally occurring amino acid
  Coding regions on vcDNA: vcDNA=SeqID_58986; Strand=-; Position=1 -269,309-647,692-966,1009-1189
  Homolog annotation: Hit_ID=NP_501949.1; Match level="QueryCoverage =97%, HitCoverage=64%, E-value=2e-45, Identity=32%"; Hit description =tc5 transposase and CENP-B protein and Tc5 transposase, C-terminal family member (4L315) [Caenorhabditis
RNYGGIRVSLKLRTHXRFEKTYQDRKSALKRINESLFEMFLEKGESTLQKDMDLRRWAHNRIKIPNFKASRRWLKNFKSAKRIVVRRITKFVNKKYAVEKITKFVNKKYAVEKEKLLETSNNFVQGVINMVEELSPDLVLNSDQSGFELELHSQHTLEISWTKRVESRAQNISATTHSYTICPIVSVHGVLYSPLLIIIAEKNGQFPQKGIFKAPNITAIAGRSHIMTKEMAKFFVENAPNITAIAGRSHIMTKEMAKFFVENFLLKVIGDKKAIVLLDSWPQWKTAIGGTFGQECSSSNKECGRDNICIQTIQPGCTGFVQPCDLYLFRTWKELVRKISDRIVLDELPTWKELVRKISDRIVLDELPVNIYQDEIIKLQSLIHYQLCAPKFKQFLRYAWYKGGYLRKH

SEQ ID NO: 132564 - protein, 74 aa, Heterodera glycines
  Coding regions on vcDNA: vcDNA=SeqID_58987; Strand=+; Position=1 -11,72-282
MNRRWICGDVWMDILPSFDHAQLGLKMALLSDRFDVLVDKHFDAKSELTIWRRNRIRKDKGPKAKLSVLIDDKW

SEQ ID NO: 132565 - protein, 135 aa, Heterodera glycines
  Coding regions on vcDNA: vcDNA=SeqID_58988; Strand=+; Position=1-408
MLFKFSILFCTIFLCFCVDDGPKNDGKKQILTNWEENNQLTEFELDDEYSHYLYDLMGNENDEDKWAKIETKIDKAIGGGQWPKEGHKSGNGENGDENGQNECRNGQNGGKNAQNKCRNGQNGDKNGQNGDKKVK

SEQ ID NO: 132566 - protein, 55 aa, Heterodera glycines
  Coding regions on vcDNA: vcDNA=SeqID_58989; Strand=-; Position=1-208
NDGQINQSIRSLLTELCLCHVQSAIGRQKILPISRIIVCLHAGHHNVAVVTILLH

SEQ ID NO: 132567 - protein, 103 aa, Heterodera glycines
  Coding regions on vcDNA: vcDNA=SeqID_58990; Strand=+; Position=1 -211,407-507
MLLSPTNLLFFSILSQMCSVIWATTCWPIGHVTNWRSLTCACGCPVVMKLAQHVRRLALTVPMMGMSKAEGVSALFIYMQMGIINWKICTTKKINSTINCCFK

SEQ ID NO: 132568 - protein, 168 aa, Heterodera glycines
  Coding regions on vcDNA: vcDNA=SeqID_58991; Strand=-; Position=1 -188,261-579
  Homolog annotation: Hit_ID=CAE61764.1; Match level="QueryCoverage =91%, HitCoverage=29%, E-value=8e-16, Identity=32%"; Hit description =Hypothetical protein CBG05724 [Caenorhabditis briggsae]
MVQFIRLKLNLTELVRRMNLIGYGRDETMLVTLHSADQLNAPGGYTQTCFNQKKAGPTKYLTRETLWAPDTSCPSGHFRHGICNFGVEDLARLAKFPHFFFNKFWPAFDFGALLCVYERLFNMTHLYTGAEQLAKMTPVVNKSFVQQLPNVRWFGVGKKIKSEKLAKY

SEQ ID NO: 132569 - protein, 224 aa, Heterodera glycines
  Coding regions on vcDNA: vcDNA=SeqID_58992; Strand=-; Position=1 -252,591-845,1083-1250
  Homolog annotation: Hit_ID=NP_495166.2; Match level="QueryCoverage =66%, HitCoverage=30%, E-value=2e-20, Identity=35%"; Hit description =glycosyl transferase, family 14 (58.4 kD) (2G139) [Caenorhabditis elegans] gb|AAC26306.2| Hypothetical pr
MIKRRIRREEDPAENDLDMSCTAIQSRNRFWHGAKDDEQGEKDEKEHANYPMAQIRTVYKARNGEIGINIGCEYSNSLKPIRPLDYVVVELEFAATFSPLNWYCFVVDAASPALFKRRVRALAKCFPNVIMGDERPMKSDGEGMMEAVLDCFERLDTPKRKWEYVTLLQNHDTAIKTRVQMAQIFAWMDGANDVQVLVPPPGRVDKITGMDWSFEALNLFKNGT

SEQ ID NO: 132570 - protein, 122 aa, Heterodera glycines
  Coding regions on vcDNA: vcDNA=SeqID_58993; Strand=+; Position=1 -80,128-286,342-471
MHFSTINLIYFIIALNVSHGNLSPCLPIRLTNGTDGGVRVIKLCTSAEKCPENNGTDGATKKAYGIEFRLSQNSGNCDDGLLICYPALLQRGNHLDIAANFKVKRTFTIGDQKANYSKNMNA

SEQ ID NO: 132571 - protein, 222 aa, Heterodera glycines
  Coding regions on vcDNA: vcDNA=SeqID_58994; Strand=-; Position=1 -166,450-658,848-1036,1106-1207
  Homolog annotation: Hit_ID=NP_499799.1; Match level="QueryCoverage =94%, HitCoverage=30%, E-value=1e-83, Identity=69%"; Hit description =fatty acid Coenzyme A ligase (75.8 kD) (3O630) [Caenorhabditis elegans] emb|CAA21744.1| Hypothetical prot
SLVARSSPFKQWLFRLAYAQKLALLRKGIVTNRSIWDRLVFSKIQQQLGGKVRLIVTGSAPIAPEVLQDLRIAFGTTIIEGYGQTECTAMVTVTWPGDVDGGHCGAPAACSLVKLADVPELNYFTSDRKGEVLVKGPSVTKGYYRDAEKTAELFDENGFLHTGDIGQLLPDGRLKIIDRKKHIFKLAQGEYVAPEKIESVYVQCPLVQQVYVDGDSLERNLV

SEQ ID NO: 132572 - protein, 254 aa, Heterodera glycines
  misc_feature (72)..(72): Xaa can be any naturally occurring amino acid
  Coding regions on vcDNA: vcDNA=SeqID_58995; Strand=-; Position=1 -388,444-619,668-839
  Homolog annotation: Hit_ID=NP_507812.2; Match level="QueryCoverage =97%, HitCoverage=18%, E-value=6e-38, Identity=38%"; Hit description =multidrug Resistance Protein (125.4 kD) (mrp-7) [Caenorhabditis elegans] emb|CAA21622.3| Hypothetical pro
FKMRKRQKMPMSPKLNASFFSRLFYSWFGPILQIGRKRPLTEHDLFELDTDNKCHFLTAQWEKLWLPAAESXINNAKRFISSHQQNTAAPSQILHLADQQTWFDAETQLRQRSAVPMPSIVFTLFKLFKYLFKYDLLVAAFVKLFYDILLFANPLLLNLLVNFISDPNAHLWQGICYSLAIFLCSEIRSICVNYHYNVICVNYHYNVMFQMGAKVQSLLTMAIYKKAFKLSNGTRRDRTVGEVNLMAIDVERFQ

SEQ ID NO: 132573 - protein, 77 aa, Heterodera glycines
  Coding regions on vcDNA: vcDNA=SeqID_58996; Strand=-; Position=1-231
WIKTLKVSELRGKKKLYFPKNRQSYEITVFHNEQFIVRKLAIYERSKLKNYLEIEPEQWEQKQSGDVFTFQRSDDGQ

SEQ ID NO: 132574 - protein, 139 aa, Heterodera glycines
  Coding regions on vcDNA: vcDNA=SeqID_58997; Strand=+; Position=1 -249,571-741
MHQIFLKNCFTLRIHPSLSSNNTTNDDGHIYFVAVKCNGIEGGQLYRTITEEIAQIVLHEQNECEAYDIKVYKISNEISKKDMPLNGDQFKDGRQILGVQIPNGHTYQFSFVTFEAQQPSTPSSSWNTKAVTIERAFGI

SEQ ID NO: 132575 - protein, 88 aa, Heterodera glycines
  Coding regions on vcDNA: vcDNA=SeqID_58998; Strand=-; Position=1 -100,145-351
NDPPLLITTHSHFCHFDSPLAFLMDPPDLSETQPTIPKRGHHHRRRVEISASRLPRAVLVRIFGHLSVAELGAVSLVCCSWKFIVDSN

SEQ ID NO: 132576 - protein, 44 aa, Heterodera glycines
  Coding regions on vcDNA: vcDNA=SeqID_58999; Strand=-; Position=1-133
MFHAHQFVLVVILALSINEVNCMPKRKEKTTVIVNEGESPIKHV

SEQ ID NO: 132577 - protein, 169 aa, Heterodera glycines
  Coding regions on vcDNA: vcDNA=SeqID_59000; Strand=-; Position=1-508
MEPFYRIGWISDPPDLALTFGEDLTFITSCLRRLVVSQQGFAIEEREFVKFNRQLDRTRRNVNFDEPLDGEVRTEWISQNILEIWPCSPVYEYGFAQTKDKCYKKIPVKVTLVRKDKPILAYLDPKTLIISAEARKVDCQTDRYKHIVLEGRLYEIDQVLGIKSPVKEI

SEQ ID NO: 132578 - protein, 17 aa, Heterodera glycines
  Coding regions on vcDNA: vcDNA=SeqID_59001; Strand=-; Position=1 -5,306-336,491-508
MLFYTASETFKSILHAN

SEQ ID NO: 132579 - protein, 190 aa, Heterodera glycines
  Coding regions on vcDNA: vcDNA=SeqID_59002; Strand=+; Position=1-573
  Homolog annotation: Hit_ID=NP_508324.1; Match level="QueryCoverage =93%, HitCoverage=7%, E-value=2e-34, Identity=41%"; Hit description =predicted CDS, peptidase family A16 and RNA-directed DNA polymerase and Integrase, catalytic domain and Zn
ESLGIKEDPNEVDDQTAMQLFDKSIRRENDGRYSVKWPWKEDIPNLPSNYRMAFSRLMSTLNKLRHSPELLQQYNSTIHDQLSKGIIEEAREAHGTLEHYIPHQGVLAKGKKLRVVYDASAHTRGTNSLNDCLYRGPVLLPDLIGMLLRFRCPAFPLLADIQAAFLQISLEPEDREVTKFLWLKTPKRRH

SEQ ID NO: 132580 - protein, 56 aa, Heterodera glycines
  Coding regions on vcDNA: vcDNA=SeqID_59003; Strand=-; Position=1-170
MLRPAHANNEQQQSLCAQLPTNVWCTPSAIGRMATILRQMHAVVSEEMGRELMGRQ

SEQ ID NO: 132581 - protein, 101 aa, Heterodera glycines
  Coding regions on vcDNA: vcDNA=SeqID_59004; Strand=+; Position=1 -37,679-750,945-1079,1135-1196
MANFEEYEAPTFESEPNYGTLAGLDKEIFAKEQQAKATDPNYWTLNNLDADIFTKNAPAKPAAAPKAGPAPHGGGGQALTPTTDPNYGTLQNLDAEIFVKK

SEQ ID NO: 132582 - protein, 105 aa, Heterodera glycines
  Coding regions on vcDNA: vcDNA=SeqID_59005; Strand=+; Position=1 -57,855-956,1051-1206
  Homolog annotation: Hit_ID=NP_741115.1; Match level="QueryCoverage =54%, HitCoverage=7%, E-value=2e-24, Identity=91%"; Hit description =ankyrin-related ADP-ribose polymerase like (3E838) [Caenorhabditis elegans]
NTIDSIHKAVKDGQLELVKNKRTAMHYAAAARDGGHYLKILGKAGADPMAVDNEGRAPDYYRRNTVFDLKLLKERDVEEGQPVLIIFYSLRHSRPEPGPGFCEIP

SEQ ID NO: 132583 - protein, 18 aa, Heterodera glycines
  Coding regions on vcDNA: vcDNA=SeqID_59006; Strand=+; Position=1-56
YREAIPEGFGLPINLGAS

SEQ ID NO: 132584 - protein, 35 aa, Heterodera glycines
  Coding regions on vcDNA: vcDNA=SeqID_59007; Strand=-; Position=1-106
MDGGKAKFNGGGKAKFNGGGKAKFNGGGKAKFNGG

SEQ ID NO: 132585 - protein, 87 aa, Heterodera glycines; identical to SEQ ID NO: 129152
  Coding regions on vcDNA: vcDNA=SeqID_59008; Strand=-; Position=1-822

SEQ ID NO: 132586 - protein, 212 aa, Heterodera glycines
  Coding regions on vcDNA: vcDNA=SeqID_59009; Strand=-; Position=1 -158,337-817
  Homolog annotation: Hit_ID=AAO51011.1; Match level="QueryCoverage =49%, HitCoverage=10%, E-value=1e-08, Identity=30%"; Hit description =similar to Homo sapiens (Human). Hypothetical protein FLJ12238 [Dictyostelium discoideum]
MCASGNPSVKQSVGYGQSVSGQSVNKFFFFNSLTKCPLTERQSTDELFFTDELRNQNIQLAPLLVVDYQCRRQTIGRKHQINNNSKKETTNWEEKEEKMGGKERKREEKKEQQRKQRKRKIAAEHHQKQQQQKQEVQAVQQQQQKQILVGMEMKMDNSKNGETREEVETEGNSTGEGGETEEKERKRKKSRVKIPKINVTIFKQREIHTLDR

SEQ ID NO: 132587 - protein, 72 aa, Heterodera glycines
  Coding regions on vcDNA: vcDNA=SeqID_59010; Strand=+; Position=1-386
ILCLPCTPFVVSPARAFIFRSPFWRTPEERMGVRSFFAFCFGFPIFSFHFSFSPNSFVIFVIFMVILEHLIN

SEQ ID NO: 132588 - protein, 42 aa, Heterodera glycines
  Coding regions on vcDNA: vcDNA=SeqID_59011; Strand=+; Position=1-129
NCTKLTSFLKKKLKKFPTFHQKFRKSEFRPQKCRKSEVFPCH

SEQ ID NO: 132589 - protein, 58 aa, Heterodera glycines
  Coding regions on vcDNA: vcDNA=SeqID_59012; Strand=+; Position=1 -67,811-920
MQKQRIPLRNLQKMRFLRLYGRDTFVHRDNTNDHHNVKSFETYPLGMARNFNSDFRSY

SEQ ID NO: 132590 - protein, 32 aa, Heterodera glycines
  Coding regions on vcDNA: vcDNA=SeqID_59013; Strand=+; Position=1 -65,568-601
MVLMMLGFLLVLWSSFSYSRPLLAEERLCKRV

SEQ ID NO: 132591 - protein, 129 aa, Heterodera glycines
  Coding regions on vcDNA: vcDNA=SeqID_59014; Strand=-; Position=1 -177,534-744
  Homolog annotation: Hit_ID=NP_490730.2; Match level="QueryCoverage =78%, HitCoverage=15%, E-value=2e-31, Identity=62%"; Hit description =zinc finger Cezanne (72.7 kD) (1A885) [Caenorhabditis elegans] gb|AAF60741.2| Hypothetical protein Y50C1A
LYQLFFDFPPFLPLFTSESLNFPFAGHLNWWCQHDSNQRLWPLVTTGDGNCLLHAASLGIWGVHDRQLNWRNTLHDVLKFGSRKHAIYRRWRWHESKNNLASGLVLSEEEWRREWNAVLELASPTPRPN

SEQ ID NO: 132592 - protein, 34 aa, Heterodera glycines
  Coding regions on vcDNA: vcDNA=SeqID_59015; Strand=+; Position=1 -93,307-318
MASTPLLGYLVVHEQYLPGCILFVLIAFTDIPFT

SEQ ID NO: 132593 - protein, 186 aa, Heterodera glycines
  Coding regions on vcDNA: vcDNA=SeqID_59016; Strand=-; Position=1-561
MTKLTAEIKNLTEEERTIFEATKEMEREAWIQAYREIRLVCQFNYDVHRNRFVLNTDPRYVKKVEVSPQLAYILGFNNTEFMQPAKEARFSPDMSGGVSSFHVYTPDLIEPMMIGDVTAPVLRIVTIRGNPDQVVEEQFFAIQYHKLLSKEVSEILIEIRTNSGILMPFQYGTCTLTLHFRKMSYF

SEQ ID NO: 132594 - protein, 697 aa, Heterodera glycines
  misc_feature (54)..(54): Xaa can be any naturally occurring amino acid
  misc_feature (530)..(530): Xaa can be any naturally occurring amino acid
  misc_feature (538)..(538): Xaa can be any naturally occurring amino acid
  misc_feature (664)..(664): Xaa can be any naturally occurring amino acid
  Coding regions on vcDNA: vcDNA=SeqID_59017; Strand=-; Position=1 -25,342-516,1129-1219,1567-1659,1739-1864,2269-2358,2415-2483,2662 -2720,2808-2871,2947-2982,3191-3295,3639-3707,3761-3811,4036 -4133,4183-4268,4515-4573,...
  Coding regions on vcDNA: Position=...4623-4843,5232-5259,5329 -5402,5445-5552,5835-5904,6010-6033
  Homolog annotation: Hit_ID=NP_492055.1; Match level="QueryCoverage =99%, HitCoverage=83%, E-value=1e-174, Identity=43%"; Hit description= tyrosinase family member (1H852) [Caenorhabditis elegans] emb|CAA95805.1| Hypothetical protein F21C3.2 [
ANGIIRMIKLLFVLILALFSLTNAQKNCASAPTSAFRILCEQLHRWDTNARVKXKRNAKFCAKFKMGPTLAAEIAPVAATPYQCMDLQCLSSYLGGKNNVRSCFTGRQLNKAIRKEYRMLSDMERSRFHAAMKTIKQNGEYDKIARIHADPTIGGGAHGGPAFLPWHREYVDPSVALPYWDSTIEDRLPTPKDSHMFTTDFMGETDAAGNLVFMGETDAAGNLVKGDFAGWRTTTGKANVLRKLGADGHGFRDTEINWFLQQTSPEMIFGYSAPQQGCTVTTNYNLIEGCTVTTNYNLIEYTHGNIHLFIGGDMAEQSTAANDPIFFLLHSFVDFIWEMKRQQQAPFEREQMYPMDNTQCASASHFGSASMRPFQQCASASHFGSASMRPFQPWTNRDGLSNRYLDLYEYAPRPNCMMGPNCGSKYLFCDRSHGAPHCAAQVKPGYLFCDRSHGAPHCAAQVKPGGNCTGFRSGEDVCLNGECRAGKCVQTEKPTPKPPKSTTGSPIPTPKPPKSTTGSPITPVHVKIIXLTKIKLIXFWVSCYNEHECCGTWATKGECRRNPTYMNLWCKASCAQCQPNYNLAAECQDRHKNCGQWSRQGECNKNQFFMTENCRKSCSKCGVSRAQVCGTENCRKSCSKCGVSRAQVCGGGAGSKANHSKKLXMPVTQAPPKQAKCTSPMCFNENLCCPRHFQRLQ

SEQ ID NO: 132595 - protein, 21 aa, Heterodera glycines
  Coding regions on vcDNA: vcDNA=SeqID_59018; Strand=+; Position=1 -49,283-299
MDWRYRGASRRFWWFWLYGTD

SEQ ID NO: 132596 - protein, 120 aa, Heterodera glycines
  Coding regions on vcDNA: vcDNA=SeqID_59019; Strand=+; Position=1 -88,157-245,637-822
  Homolog annotation: Hit_ID=CAE59463.1; Match level="QueryCoverage =91%, HitCoverage=33%, E-value=3e-19, Identity=48%"; Hit description =Hypothetical protein CBG02845 [Caenorhabditis briggsae]
MENTEQAKVAALRILEMGPRVAIVTLGPRGAIVARREHNNGHVKIGEVSAPKVTAVDTTGAGDCFCGALAHFLVAQPSAELLEDHVRRAVQIAALSVQKKGTQASYPTRDELITMGILQD

SEQ ID NO: 132597 - protein, 31 aa, Heterodera glycines
  Coding regions on vcDNA: vcDNA=SeqID_59020; Strand=+; Position=1-95
DYFSKHLVDCGIIGDCGINRDWAIIRAYTVI

SEQ ID NO: 132598 - protein, 18 aa, Heterodera glycines
  Coding regions on vcDNA: vcDNA=SeqID_59021; Strand=+; Position=1-56
YREAIPEGFGLPINLGAS

SEQ ID NO: 132599 - protein, 49 aa, Heterodera glycines
  Coding regions on vcDNA: vcDNA=SeqID_59022; Strand=+; Position=1-163
LFEYPKRTLEKIDFFVFGAVPPNRCAQIYGETESFRNSFPIACTLILRW

SEQ ID NO: 132600 - protein, 351 aa, Heterodera glycines
  Coding regions on vcDNA: vcDNA=SeqID_59023; Strand=-; Position=1-1057
  Homolog annotation: Hit_ID=CAI04701.1; Match level="QueryCoverage =99%, HitCoverage=83%, E-value=7e-45, Identity=41%"; Hit description =conserved hypothetical protein [Plasmodium berghei]
ESVRGTESGRGKESGRGTERGRETERGRESVRGTESVSGTESGRGTESGREEEEQKVEEEQKVEEKVKRNRKRKRRRGTESGRETESGRETESGRETESGRGTESGRESGRGTESGRESGRGTERGRETERGRESVRGTESVRGTESGRESGRGTESGRETERGRESVRGTESVRGTESGRESGRGTESVRGTESGRESGRGTERGRETERGRETVRGTESVRGTESGRESGRETERGRGTESGRESGRGTESGRESGRGTERGRETERGRESVRGTESVRGTESGRESGRGTESEEKVEEEQNVEEEQKAEEKVEEEQNVEEEQKAEEKVEEEQKAEEKVEEEQKVEEKV

SEQ ID NO: 132601 - protein, 84 aa, Heterodera glycines
  Coding regions on vcDNA: vcDNA=SeqID_59024; Strand=-; Position=1 -87,189-356
MADGTPSAKRPYIRLTVPPSNATRPIGGEMVKELCAGGKESADSNSAQGNVIEIGNGRVGRARPRLLPMHRYQRGWQCQRHCGA

SEQ ID NO: 132602 - protein, 95 aa, Heterodera glycines
  Coding regions on vcDNA: vcDNA=SeqID_59025; Strand=+; Position=1-286
MEWPAFWQSFESAVDRAALEPVDKLNYLHGCLRGKSARAVTAYRGGENYAHAVAALRRLFGDPRKIAEALQSELINLRSVDDNVGSLQHFLETLE

SEQ ID NO: 132603 - protein, 78 aa, Heterodera glycines
  Coding regions on vcDNA: vcDNA=SeqID_59026; Strand=+; Position=1-237
  Homolog annotation: Hit_ID=ZP_00295172.1; Match level="QueryCoverage =98%, HitCoverage=85%, E-value=4e-13, Identity=43%"; Hit description =hypothetical protein Meth02003882 [Methanosarcina barkeri str. fusaro]
MEEEQKEEKKQEEKEEETEKQKEQQRQRGRERKWEMEEKDKEEQKEEEKVKVEEEEKKQQRERGRNKKRREQEKARVM

SEQ ID NO: 132604 - protein, 115 aa, Heterodera glycines
  Coding regions on vcDNA: vcDNA=SeqID_59027; Strand=+; Position=1 -199,807-955
MSFDSFVALAVRAEEVQKATKSAESGNKHRPKFQQKSTFQPQKIFAPKTNRIVCYNCNKTGHISRHCLTLQRDSMPNRSTADTLAAPFNAECTTDEPKALSTSLLRGRGCDIIVI

SEQ ID NO: 132605 - protein, 31 aa, Heterodera glycines
  Coding regions on vcDNA: vcDNA=SeqID_59028; Strand=-; Position=1-203
LCHTKVIEQTLMFYQRHDTHNCVTLNSNNKH

SEQ ID NO: 132606 - protein, 54 aa, Heterodera glycines
  Coding regions on vcDNA: vcDNA=SeqID_59029; Strand=+; Position=1 -22,97-143,370-465
MKGNPSKVRSANVGSAVDELLAKKFTRKAFIFLIVLVAARESILFKSRTNSKKN

SEQ ID NO: 132607 - protein, 62 aa, Heterodera glycines
  Coding regions on vcDNA: vcDNA=SeqID_59030; Strand=-; Position=1 -78,300-407
MIPTMLDLVGKKVIESYSGKTYWGRTNMLEESNLKEGQRTANHQAGYAAGCAMNPHCTRITF

SEQ ID NO: 132608 - protein, 350 aa, Heterodera glycines
  Coding regions on vcDNA: vcDNA=SeqID_59031; Strand=-; Position=1 -31,1794-1957,2083-2319,2382-2437,2529-2707,2753-2890,2956-2982,3031 -3110
  Homolog annotation: Hit_ID=NP_505215.1; Match level="QueryCoverage =92%, HitCoverage=64%, E-value=1e-94, Identity=52%"; Hit description =cysteine proteinase PWCP1 precursor (5J77) [Caenorhabditis elegans] pir||T31871 hypothetical protein F41E
GKWLATKHSVDRYGPKYSTKREIAKRFRIFKKNLAIARRIQSAEKGTAEFGETKYSDLSVTEFQKIYLPYKWPLNSHGKMIDGGKIAEGILPESFDWRQKGAVTTVKNQGTCGSCWAFSVTGNIEGQWKLKKGELVELSEQELLDCDKLDMACQGGLPDCDKLDMACQGGLPLQAYKEIEREIERIGGLERENDYPYDAHKEKCHLKSDRISAYINDSLQLPKDEAKMAQWLVQNGPISIGLNAMPMQFYLNAMPMQFYRRGISHPPKWLCNPSWLNHGVLIVGFGEEARKPFWIIKNKNSWGTNWGEKGYYRMYRGGNTCGVREKGYYRMYRGGNTCGVREMATSAIIE

SEQ ID NO: 132609 - protein, 503 aa, Heterodera glycines
  Coding regions on vcDNA: vcDNA=SeqID_59032; Strand=+; Position=1-1512
  Homolog annotation: Hit_ID=NP_608540.1; Match level="QueryCoverage =89%, HitCoverage=66%, E-value=2e-63, Identity=34%"; Hit description =CG2839-PA [Drosophila melanogaster] gb|AAF51469.2| CG2839-PA [Drosophila melanogaster]
MNGTAITTTINSSTSKRTKTTLAFFKEKGTKRDTVQPNGHTVTPRGTVEPVMERQRNETQQKGRETTAEKAGELVMPLKEDGNGEKETEEYGKGKAKGKEEAMGGERRRGSEREEKQDKGTIANGSENGAEKETEKRKEEEKETDGKDGKEERKREEQREKTEKRKEEEKETDGKDGKEERKREEQRVTEKQNREKKEPENEGEERNEGQREEQNTVKKVGKEEKKEEKGKEEKKVGKEEKKEEKGKEEKKVGKEEKKEEKGKEEKKVEKEEKKEEKGKEEKKVGKEEKKEEKGKEEKKVEKEEIEEEEGKEEKKVGKEEKKEEKGKEEKKVEKEEIEEEEEQEEEEDEEDEEDEEEEGKEETNLTSVEKFFATSAKAEETTERNDGGEKTTTILVTERDGEGSGTEEEGKEEEEERKEEGEEAEVEGKEEEEERKEEGEEAEVEGKEEEEERKEEGEEAEVEGKEEGTDEIGIPTTSKSVVTLPTIALPTESVERKCADTHD

SEQ ID NO: 132610 - protein, 269 aa, Heterodera glycines
  Coding regions on vcDNA: vcDNA=SeqID_59033; Strand=+; Position=1 -81,540-1266
  Homolog annotation: Hit_ID=NP_495838.1; Match level="QueryCoverage =100%, HitCoverage=10%, E-value=7e-36, Identity=35%"; Hit description= carbamoylphosphate synthetase 2/aspartate transcarbamylase/dihydroorotase; rudimentary homolog, PYRimidi
MQQLVEKLHDNPRRIFGLPEQPDTYIEVEMNEVWTIPESGGWSKAGWTPFAGLQARGRVCTVVIRGQRVYDEGQFLVGPGFGHNVRLLPGAMAATASNLPSPSPAAELTAAAKKTDGAGGGGKKRGVAAVTAGTGGGTTKRHDTLRQHQQQRISPELSPDRTSVVGPSRLYGQNILCVEQFDKETVEQVLKLAKHFEEVAVKMAGADGVERLHPSAFGFPLRDFSVSLLFFEPSTRTMCSFDDAMRLLGGTVSVFNAEHSSVKKGETLE

SEQ ID NO: 132611 - protein, 20 aa, Heterodera glycines
  Coding regions on vcDNA: vcDNA=SeqID_59034; Strand=+; Position=1 -16,123-169
MPDPVVKGNHLSAGRRTFRQ

SEQ ID NO: 132612 - protein, 17 aa, Heterodera glycines
  Coding regions on vcDNA: vcDNA=SeqID_59035; Strand=-; Position=1-53
IIRLRTHGCHISEAFVL

SEQ ID NO: 132613 - protein, 72 aa, Heterodera glycines
  Coding regions on vcDNA: vcDNA=SeqID_59036; Strand=-; Position=1-216
MDMKLRSARQNVERTVAGVELAWEQKRDADAELAAADAAFKLAQQRLNAAKNAAANANTALDAADAERIRVI

SEQ ID NO: 132614 - protein, 49 aa, Heterodera glycines
  Coding regions on vcDNA: vcDNA=SeqID_59037; Strand=+; Position=1 -15,686-772,816-863
MRTFRAGDRDRDLDKFLKVREDKEQWKTPWPAPKPEDESLRELDRLRQV

SEQ ID NO: 132615 - protein, 49 aa, Heterodera glycines
  Coding regions on vcDNA: vcDNA=SeqID_59038; Strand=+; Position=1-147
MCPFGPKIPQASMRRSKSLNELRPVKASATKPEQFTLPPLLPSRHKILE

SEQ ID NO: 132616 - protein, 133 aa, Heterodera glycines
  Coding regions on vcDNA: vcDNA=SeqID_59039; Strand=-; Position=1 -220,449-630
MHAENIVWLEKYPRYFRINWNGWFDNPRIARYEAFVKQLSGVDDWARIGSLPVVSFKILSFKGVEPAMGRIELDRHFEKSLDLDLDLDSMLDLDFLDKNPGKSRSRKNPGSSRPGSRPGPGFFEIYFKNQKNV

SEQ ID NO: 132617 - protein, 55 aa, Heterodera glycines
  Coding regions on vcDNA: vcDNA=SeqID_59040; Strand=-; Position=1-166
NRKTSNSCPIVHPGQLLNKCLITGNSWIVKPSVPVYAKVTRVFFEPNDIFSVHFY

SEQ ID NO: 132618 - protein, 105 aa, Heterodera glycines
  Coding regions on vcDNA: vcDNA=SeqID_59041; Strand=-; Position=1-318
  Homolog annotation: Hit_ID=CAE66971.1; Match level="QueryCoverage =69%, HitCoverage=11%, E-value=4e-20, Identity=61%"; Hit description =Hypothetical protein CBG12366 [Caenorhabditis briggsae]
MSKSCSLSLFSLSLFSLSPLFLSPIRLILHFAKIRRLPAVLYADSRKSDSRQLEVLLRDGYGLPLVTFYADKIGRLAAVEANLAKLTAHREMPFLFICGTFIGSQ

SEQ ID NO: 132619 - protein, 65 aa, Heterodera glycines
  Coding regions on vcDNA: vcDNA=SeqID_59042; Strand=-; Position=1-287
SCHFKTRGSKSLCSSQQDESAFGVAFSAGMRGTISNKSSSGRHLGAIVGRSIVLLFGVISEQLAD

SEQ ID NO: 132620 - protein, 159 aa, Heterodera glycines
  Coding regions on vcDNA: vcDNA=SeqID_59043; Strand=-; Position=1 -277,343-547
LIHLNDPCPSIAFHLSFNGAVSGYDGGPFSVGGGTSAAADGGRPWRQHQKPTPPLMVAQQNAVVQQQGNADHWQMPTTNGGEEKRRRTVTGGKILLIVQKSFNFGKKPVQKDGQQQPAAAVAGAVAASRAISHSATNDGGDTHQQNANTANANDDDGNN

SEQ ID NO: 132621 - protein, 186 aa, Heterodera glycines
  Coding regions on vcDNA: vcDNA=SeqID_59044; Strand=-; Position=1 -135,380-525,711-864,933-1057
MKPELKQLFCPPVNLFKEFSMQLKKVVDFQQNNRMRLKERQTMEKMQSAARYIQILKVELRKSSDNERIALKERNQMKAEMERYKEQAQNLKTKLADREKQLHLHACKLQLQPRNPNRAFASLNGNTPLLGLSFDCVKSTPNLNDTTMFQANRKDVGNNVLETPVFNESEIAGPLRMPDTPAMLRN

SEQ ID NO: 132622 - protein, 27 aa, Heterodera glycines
  Coding regions on vcDNA: vcDNA=SeqID_59045; Strand=+; Position=1-118
TQTQGGIELETPFLVTNSQTTKTKKPT

SEQ ID NO: 132623 - protein, 110 aa, Heterodera glycines
  Coding regions on vcDNA: vcDNA=SeqID_59046; Strand=-; Position=1 -120,163-375
MSTIGSLARSVTGTQSGSGSEPRERTLYEREAEKALKLRNVEVGRAVMAEKPSAGHEGDLEVHTNVYAISMGPLDIYRYDVSIVGERGGERSGVLFTKNIRDESGVFIVH

SEQ ID NO: 132624 - protein, 92 aa, Heterodera glycines; identical to SEQ ID NO: 127421
  Coding regions on vcDNA: vcDNA=SeqID_59047; Strand=+; Position=1-304

SEQ ID NO: 132625 - protein, 58 aa, Heterodera glycines
  Coding regions on vcDNA: vcDNA=SeqID_59048; Strand=+; Position=1-175
MAFPALAEHSRRRRKNSVGPLRFGAEVRLARGRLFAEAETAGETDQSGSAVNRCTIAA

SEQ ID NO: 132626 - protein, 39 aa, Heterodera glycines
  Coding regions on vcDNA: vcDNA=SeqID_59049; Strand=-; Position=1-118
MSESENSWDKKACHADLALIGPDNLVVKTKETKNRSSSN

SEQ ID NO: 132627 - protein, 87 aa, Heterodera glycines
  Coding regions on vcDNA: vcDNA=SeqID_59050; Strand=-; Position=1 -105,162-261,326-384
MRFQQNHIAAKVQIGQLENEVHDLKHRIDQLEMLNILKLSQRSNEVAESSTSTKTNPKKKKELMKSKSAGDLLVNNLGKGHGKGTQL

SEQ ID NO: 132628 - protein, 108 aa, Heterodera glycines
  Coding regions on vcDNA: vcDNA=SeqID_59051; Strand=+; Position=1 -101,310-535
MITALAFVPIQHLTAAITALNYIVGEELDPILGCCRYPSIWRFIDVLRKDQRSRDADYVRCVNGEEPAMKKKKFRKADKRILNIIENFDAQNIIEFLRGISSNCVMDP

SEQ ID NO: 132629 - protein, 326 aa, Heterodera glycines
  Coding regions on vcDNA: vcDNA=SeqID_59052; Strand=+; Position=1-981
  Homolog annotation: Hit_ID=CAE72551.1; Match level="QueryCoverage =76%, HitCoverage=32%, E-value=1e-16, Identity=27%"; Hit description =Hypothetical protein CBG19735 [Caenorhabditis briggsae]
MCGRLLEDIREKLYPNGYRKPKRANKPKNEKDLDQILKKIENDRKICVFKTENILRQCTRIKEVVKENWDMNVFIQGSIYNGLGRKESDLDLVMINSKGIPNDWTKDDSCQFFDKLRKRLRESGMALTRTLIIPSRNVSILEITINSDDQEINAQISCNNLIGLINSKWLACCVQLDVRFKTLYFAILEWADFFEIHQSANGGGTLNSYGWTSLLIFYLMKIPNPVLPNLIKILPEIFEIRNVTYTKKQIFEVLKQKLIWETTNSQSISSLLIGFFEFYTKINLEESRLNMKEGKIDFWEKSAQEMKMHLFILEPFGAFNVARSVT

SEQ ID NO: 132630 - protein, 50 aa, Heterodera glycines
  Coding regions on vcDNA: vcDNA=SeqID_59053; Strand=+; Position=1 -31,301-422
MAYAEELPKMANANDPSEISHLDDDDDDDGSDSGRLDDPNREHLRDYILL

SEQ ID NO: 132631 - protein, 68 aa, Heterodera glycines
  Coding regions on vcDNA: vcDNA=SeqID_59054; Strand=-; Position=1-207
MNIDSYLDGIQFGNQNAKLSATRPNIVEKFKGKCQINERTQNCHQKIVHGVKPMLVLKLFINSFFLFG

SEQ ID NO: 132632 - protein, 87 aa, Heterodera glycines
  Coding regions on vcDNA: vcDNA=SeqID_59055; Strand=-; Position=1-261
MILCRCIVLLQLFLVLLALLPPSSNCSCYCGCCDCCGCCGGGCFCCGGSRNRNNGAAATAAAIGSGIIANTAQQAAAVAPPINVADE

SEQ ID NO: 132633 - protein, 144 aa, Heterodera glycines
  Coding regions on vcDNA: vcDNA=SeqID_59056; Strand=+; Position=1 -89,481-826
MVVEAKKENVTASVPTWRRRRKSTTPTDWGSEKLLTPQQLEGKFQQIRLLQQRPLAPLQPELPPIQPPDFPPLSASAGDSPSFAYANEETAGKFRPQVTSGIGQFIHVKPTVNGIGDAMGQRADAAAEFEDPTLKHPFEEPFWI

SEQ ID NO: 132634 - protein, 64 aa, Heterodera glycines
  Coding regions on vcDNA: vcDNA=SeqID_59057; Strand=+; Position=1 -162,272-304
MQTQLLQQQQKLKSHQILAAAAAKLPPAATMANQQRALINNGARQQHQQQQQQMKPQTNQTKNR

SEQ ID NO: 132635 - protein, 158 aa, Heterodera glycines
  Coding regions on vcDNA: vcDNA=SeqID_59058; Strand=-; Position=1 -33,85-526
  Homolog annotation: Hit_ID=AAS00714.1; Match level="QueryCoverage =91%, HitCoverage=24%, E-value=2e-10, Identity=25%"; Hit description =serine-aspartate repeat family protein [Staphylococcus capitis]
MRDTDKKKKKEEIIAAGTNNVVSEQQQDGVPGDEHSDSDNSTEERAQNGVPGDEHSDNATEERAQNGVPGDEHSDNATEERAQNGVPGDEHSDSDNSTEERAQNGVPGDEHSDNATEERAQNGVPGDEHADSDNSTEERAQNGVPGDEHSDSDNSTEE

SEQ ID NO: 132636 - protein, 73 aa, Heterodera glycines
  Coding regions on vcDNA: vcDNA=SeqID_59059; Strand=-; Position=1-219
MSNYYGRIGHLVGFNPPSNRNEAEEMIIEEDARLLLEQSLDENGLLVDQYFEEMGLNEVQDENSPDVNSEDGE

SEQ ID NO: 132637 - protein, 44 aa, Heterodera glycines
  Coding regions on vcDNA: vcDNA=SeqID_59060; Strand=-; Position=1 -106,149-176
PNYLARSLQLTRHLITHSPWKTLQQGALSEVLDYCNNTWINNRI

SEQ ID NO: 132638 - protein, 189 aa, Heterodera glycines
  Coding regions on vcDNA: vcDNA=SeqID_59061; Strand=-; Position=1 -155,1525-1803,1856-1989
MDVRIGFSGGLDFPGPVFSWIFVQEIQVQVEHGIQVQAFFKIPSSNNDIAPGWICNDVWMDIFPTFDHAQLGLKLALLSPRFDALVDKHFDGKSELTIWRPIEISKRIGTKPKLSVRMDDKYVPFPLPDDRPLPSKIRFKSLQINYFDHSVIAFLRSNHQIFDKRGTNLQLRIQSSHTTEGQRIWDIFG

SEQ ID NO: 132639 - protein, 245 aa, Heterodera glycines
  Coding regions on vcDNA: vcDNA=SeqID_59062; Strand=+; Position=1 -88,200-288,368-529,762-826,921-998,1055-1091,1141-1275
  Homolog annotation: Hit_ID=CAE61637.1; Match level="QueryCoverage =97%, HitCoverage=97%, E-value=1e-51, Identity=43%"; Hit description =Hypothetical protein CBG05570 [Caenorhabditis briggsae]
LGAAAILAFASADFVFVGGNQMEFDPTAVIPDSQFIDLISRDIESFSGPMAFGHKFMSGGAGEGDQQGAGEGDQQLGPDGPFEHRQQVKSDSVLPAYCEPPNPCPVGYSEKDGCMEQFDNTAEFSRSYQGQQQCLCDQEHMFNCPSCPSKENAEEYAQGLEQLLADNGLHKSMIAKKFHLTRAEMIAKKFHLTRAERKEPRRRKRSRKEPRRRKRSVALTHSRYNPYLEGIPLKSVAKKDGRNLK

SEQ ID NO: 132640 - protein, 103 aa, Heterodera glycines
  Coding regions on vcDNA: vcDNA=SeqID_59063; Strand=-; Position=1-309
  Homolog annotation: Hit_ID=CAD38524.1; Match level="QueryCoverage =84%, HitCoverage=48%, E-value=2e-31, Identity=79%"; Hit description =putative glutathione peroxidase [Globodera rostochiensis]
RFVLPLKFLSPLNIKFMGAMSSSSSAAPSDPQQKSIYEFSAKDIDGNETSFGKYRGKVLLVVNVASNCGFTDSNYSQLKQLLDKYKSKGLEIAAFPCNQFNNQ

SEQ ID NO: 132641 - protein, 122 aa, Heterodera glycines
  Coding regions on vcDNA: vcDNA=SeqID_59064; Strand=+; Position=1-369
  Homolog annotation: Hit_ID=NP_001003179.1; Match level="QueryCoverage= 66%, HitCoverage=14%, E-value=1e-11, Identity=47%"; Hit description =ribosome receptor [Canis familiaris] sp|Q28298|RRB1_CANFA Ribosome -binding protein 1 (180 kDa ribosome
MPNGKGKAKGMPNGKGKAKGMPNGKGKAKGMPNGKGKAKGMPNGKGKAKGMPNGKGKAKGMPNGKGKAKGMPNGKGKAKGKPLIRIIGSTAAVQMERLSALFWLCPRRCEGPKAVERVQNGH

SEQ ID NO: 132642 - protein, 63 aa, Heterodera glycines
  Coding regions on vcDNA: vcDNA=SeqID_59065; Strand=+; Position=1 -121,176-243
MSRILAGGGAANGDETLLRKRIGPGTAVAVDKSRIAAQTEAMKNGAGITTGVAADDDELLDGV

SEQ ID NO: 132643 - protein, 115 aa, Heterodera glycines
  Coding regions on vcDNA: vcDNA=SeqID_59066; Strand=-; Position=1 -195,443-595
MTNSNTEYTPMAQLNDDRFEHRIIFQSKSSKWLGLFMKCILMMLIAAFVYALIRTVDSSKNISKKLECPKVNDTNFLAALAKQQRGLVDVRLKDGSIDVNGTWTQIQPHFNVRDN

SEQ ID NO: 132644 - protein, 105 aa, Heterodera glycines
  Coding regions on vcDNA: vcDNA=SeqID_59067; Strand=+; Position=1-330
PGLKCPAEVKNFFYFWKKIENFPKKLPIDRARKTMFWKWSPFFWENSLKNHKIKKPENRFLGLTRKILKIFEILKSGKIELIELYNKSAGHPALRSNPNELFGWY

SEQ ID NO: 132645 - protein, 601 aa, Heterodera glycines
  Coding regions on vcDNA: vcDNA=SeqID_59068; Strand=-; Position=1-1806
  Homolog annotation: Hit_ID=NP_920205.1; Match level="QueryCoverage =77%, HitCoverage=31%, E-value=8e-48, Identity=30%"; Hit description =putative DNA helicase homolog [Oryza sativa (japonica cultivar -group)] gb|AAP52492.1| putative DNA helica
MDLRISTPKNLLQYLVNQYNRQQARQNPNAQQKTVDDIGSVVRLSEHNVNSLQYWKKMYEDCNTVFARCHDAKKARLFITFTNNREWPEFKENIYKNGQVFTDRFDMWMRVWTSNIAEFREELYEKKFFGTILGYGESMEFQGRGGPHAHIVAQTDLDAVPHVIQEYIWAHIPSLPDKDDDTPIAKMHREIRETMHMQLHRCSDSWCGPSDPIYGRCKKGFPAPYSKCTVLRPDRPAMYFRPSPSDGGAQLEVNGLIYDNSHVVPYNPYVLLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETHCSAYWKQWQNEWKNDPKFKDILFEKVPEQFRWAKDKWVLYKRQQIKRPPIGRIVPVPPSDPERFALYSLMRHFPGDPDHLKMVNGLLCTSFTDAAIMHGLLEDGKIWDKTLAEAALSRWPDQMRWLFVSIMVYGQPSNAIELWNKYKDQMYNPQGIITPAQHKAAELEALADLDWRLHSCFNLSCVHFGLPDPPNCICKILTAQLKSFSLAMMI

SEQ ID NO: 132646 - protein, 58 aa, Heterodera glycines
  Coding regions on vcDNA: vcDNA=SeqID_59069; Strand=-; Position=1 -75,561-662
MVPFWVGVILGGAVLGGDVMEGTIWDLKKWLYLIELIWHSKKQCGSCWIPNKKAQTFV

SEQ ID NO: 132647 - protein, 86 aa, Heterodera glycines
  Coding regions on vcDNA: vcDNA=SeqID_59070; Strand=+; Position=1 -137,393-516
MKRLNKSIMDLQELISQLTLANTEFAACRRKMSHYELQAYILVHIDRQMKRLNKSIMDLQELISQLTLANTEFAACRRKMSHYELQ

SEQ ID NO: 132648 - protein, 255 aa, Heterodera glycines
  Coding regions on vcDNA: vcDNA=SeqID_59071; Strand=-; Position=1 -241,303-651,707-884
MSQPQEVQIMEAFDEVNTQQWHDLDNLKCKAYEHCGADKAAAADPVPIQLRGRSDRTRAVPPGRGGVVEKCQKSGVEDHPVEPEAKQCTGLASKRRFACRTVSTGGDGPEQIVQNPRGDCHFSRGLLISPPTFAQITLEGACQTMYTINKAQRIGQQQQHQFNVTKTINFKKCQKIADVANGFQADQPQAQCAQCQQYWAQQQSDQQNSPTDQQKTNAWQMGESDQHPCAKCDPKEVKENEVINRSDSVGSDADG

SEQ ID NO: 132649 - protein, 123 aa, Heterodera glycines
  Coding regions on vcDNA: vcDNA=SeqID_59072; Strand=+; Position=1-372
MAETDQSVSDWLIGELLVKKTIQIIGRSNYRPNYLIDQSLNGYSQLVSFCLLSILLQFVRFFVVRHLSVGADARFDGLGIGTGRNGKEQKRREEKAGQTERADERGRGGKDNGRRREWQRARE

SEQ ID NO: 132650 - protein, 143 aa, Heterodera glycines
  Coding regions on vcDNA: vcDNA=SeqID_59073; Strand=+; Position=1 -117,589-903
MFILYQFVRLLYCNETMRRDNKKWTAQFTNAPFINFLVEEFEKGICDDHQQLGHWDIPKFNKKEAMQIYESLMAQRERAKTINLYCIGMLIERFIKMRIFFCKMNADRLLQSKKKLITLIGETGLVQLELMYPEVMKFCGFNG

SEQ ID NO: 132651 - protein, 92 aa, Heterodera glycines
  Coding regions on vcDNA: vcDNA=SeqID_59074; Strand=-; Position=1 -232,384-430
MYRGISMVRMMPWSPPVVNAYLMWLEVVYRKASLPASQAPLFTRVDSCTVPSTWRKKIERRDQRVQRHLQSLGDEGNVILNTQFCVTTPLLP

SEQ ID NO: 132652 - protein, 85 aa, Heterodera glycines
  Coding regions on vcDNA: vcDNA=SeqID_59075; Strand=-; Position=1 -106,718-869
MAGWNCRLRNGPPFGFVRSAGGAGERQKDGAHTVDAKSVSEKSEDRQQIVSLLEQFVPLIIEALKQKYDKVKHEQCFDLFFNLFR

SEQ ID NO: 132653 - protein, 573 aa, Heterodera glycines
  Coding regions on vcDNA: vcDNA=SeqID_59076; Strand=-; Position=1 -90,134-202,243-572,630-869,914-1435,1481-1951
  Homolog annotation: Hit_ID=CAE59343.1; Match level="QueryCoverage =99%, HitCoverage=31%, E-value=1e-45, Identity=26%"; Hit description =Hypothetical protein CBG02688 [Caenorhabditis briggsae]
GRQLRWALTQMALSVGKNRHFPLAARNLIDLLEALESWDTRRIEEPDADRRCEALVRLHDWYEHRDRHILLDDGAARTLPLLAHSHVHSMLQVRKINLLQRNGIPLRQKSDISLRGTAANTFRQLIHFVSTTANDSNLDAVQMLRAHFIPLILRGLRTSVDDESARHEFIQCFAFLVHCFPNEPQFAALRHLTDTTPTSTTASASVDFEIDPDVDFFECATHIQLHRRQRAFHKLAERLNNKELSIGHSSLVRFIVPIVEPYLMDTASNRSALSDQALHLFSSILRRTPWPKYCQMLEYFLRLLDTAGEESTKGAIRVIGAVLNAFHFDLRHLKIKGTHSNEKGNCDEKKEGKTEEDEGNEFGEGSETPVDAQKETEDMARDKKEEEKRRILEVVRGRLLPRLRECLHRWNGVNKPGNHWDEEEQKLLRAPLTLSIVKLLEWLPPEMSGHHLHGLVLFLDHLLMSRCSPSVYLILNKFCGDRSPNTRQNARKLLEQMVRLLGPAKLPFVVREVKQSLNKGYQMHVMAVTVHALIGAMEGHLTNGDIEPILKEVVDVCRWETFGGHAKANSAKA

SEQ ID NO: 132654 - protein, 24 aa, Heterodera glycines
  Coding regions on vcDNA: vcDNA=SeqID_59077; Strand=-; Position=1-76
FSIHRDKEIVRQNERCFFLCTLLF

SEQ ID NO: 132655 - protein, 41 aa, Heterodera glycines; identical to SEQ ID NO: 129572
  Coding regions on vcDNA: vcDNA=SeqID_59078; Strand=+; Position=1-162

SEQ ID NO: 132656 - protein, 69 aa, Heterodera glycines
  Coding regions on vcDNA: vcDNA=SeqID_59079; Strand=-; Position=1 -90,1119-1238
RWGEKAGICSGLAKIEDKFAHLGSNFQKTMLYLAYRSVGPSADLIVPAVAIYLVALVGIVLNGTVLVVL

SEQ ID NO: 132657 - protein, 58 aa, Heterodera glycines
  Coding regions on vcDNA: vcDNA=SeqID_59080; Strand=-; Position=1-174
MCPFMEEGAFGWHKSAENGRPIAKAEGEGRLLSGQSAEEQPKRPQNEIPNGTANNANC

SEQ ID NO: 132658 - protein, 207 aa, Heterodera glycines
  Coding regions on vcDNA: vcDNA=SeqID_59081; Strand=+; Position=1 -24,403-789,836-1048
  Homolog annotation: Hit_ID=CAE65876.1; Match level="QueryCoverage =83%, HitCoverage=13%, E-value=1e-22, Identity=34%"; Hit description =Hypothetical protein CBG11026 [Caenorhabditis briggsae]
MHIFKNLKAYQRLQDVDKRVMCFDQKFNGLRQRMDLARQITETPSIYMTAVPEVIRREALKREFSSWINLHIGKTMEFITEENKIRQQFFGKLEKHFLRQLFPGMDEMMPQFSPQIAPKIDQLLPKVPFSHLHELRSRFPEMKELLFVGTPRLFSRLAISDPTSPIASAPIRSIRRDESFYERDKTSNIDVMNRNLPSTNWLRHYFD

SEQ ID NO: 132659 - protein, 140 aa, Heterodera glycines
  Coding regions on vcDNA: vcDNA=SeqID_59082; Strand=-; Position=1 -164,667-925
MNGIISRESRGLNHGLPLDTVPFHNGMVNLKNKTHSTANGRKCANGFRPSATFCRNSWVEINSFFHKFYPLSIMNARVEQRRRNRNADGVRRHSSAECLCRVGDDAKSAKQKGQQMLGRDGQSGDNSKNGNEMYYLQLGF

SEQ ID NO: 132660 - protein, 82 aa, Heterodera glycines
  Coding regions on vcDNA: vcDNA=SeqID_59083; Strand=+; Position=1 -172,596-670
  Homolog annotation: Hit_ID=NP_872058.1; Match level="QueryCoverage =98%, HitCoverage=23%, E-value=5e-23, Identity=64%"; Hit description =RhoGAP domain containing protein (37.9 kD) (2P555) [Caenorhabditis elegans] emb|CAD59137.1| Hypothetical
IVTALPVPSQHLLALLFGTFRVITDSAQTFGTRMTPDAIGISVAPSLFHTCIHDGQRAKLEDIMRFKLASQVISKIIQSFGA

SEQ ID NO: 132661 - protein, 225 aa, Heterodera glycines
  Coding regions on vcDNA: vcDNA=SeqID_59084; Strand=+; Position=1 -111,188-261,426-849,1259-1327
MDELGAQLKKCLILRLLQIDANFGQRPFVFDIFAEMNAAEQATKNAIAAIELPPEKVLWMNSLIAKWMTYEGYSRALEALNRSTANPKSSISEQAKEDRQQQQQQQQSPPPTTAAETVANSVMQSIIVFGGGGGSAADGGTDAAAPATTTSAGSMANKRRTVVRSVQEALDEEMEHHDKMDQRRSILRMVKRGQLDDAISHIEHHYPTLMETNRQLALLLKIQPN

SEQ ID NO: 132662 - protein, 21 aa, Heterodera glycines
  Coding regions on vcDNA: vcDNA=SeqID_59085; Strand=-; Position=1-122
KDVIHLPFDRKSIREPYLTFN

SEQ ID NO: 132663 - protein, 965 aa, Heterodera glycines
  Coding regions on vcDNA: vcDNA=SeqID_59086; Strand=-; Position=1 -637,937-1775,2019-2223,2609-3825
  Homolog annotation: Hit_ID=NP_500013.1; Match level="QueryCoverage =17%, HitCoverage=11%, E-value=5e-37, Identity=45%"; Hit description =predicted CDS, polyprotein family member (4B673) [Caenorhabditis elegans] gb|AAC02594.1| Hypothetical pro
MNQHKSLNDVNVVENSSRATALPNNSEIEYEANCPASGRSSPWEGVRMMPRITPLLPFIVFLIVIILDLNGAKAAPPSLPLICQTDIQPTIWGLPKQVQCPLPAEVATHVPLIQTRELFVINDFEHNTQAWACRKIKKKARKFTTLSGVPVVEPLDPELLEMSVDECKRMVEHKTCDFGILTERDGLWGTDHTLDLTPRLWLLGSFSWSDTEKQGFATRIIVRKRKRTKRSYGSVEHLGLATSPEMNAKLTYLDDEWVDSLMYALRHSFKTQCDFFSVMTKMLTNTHLIDPTSLARSLFNNTKVYAVRAGSSLLKIWPCVQLKKGEFRFKPTRLDNKCFDKLPIEFVTQSENRLAFLDPFTMIIVPDSAKVACAQHRKIVVQIEGQPLEVDQVTGETKILKIKDFDIEPRLPGILEIERHSFHQMALFNVSDLNTHAFLSGMVKVSELTYRINELHKKVRVTVSDQWRELTDELEKKVVGDYKLTWLCVLSFTIFSSSDPTAASMTTNVVNKSPRKRLRPSSVMQVGTSTTMAIMMLMISLLVVPLNAEKASQSDLKAGTGQKIFGEIKLIQDEVMSDRRDYQVILGCDLMAKLPPITFDFVQGLISISGKSVTMGERGDLLYSNVKVVARHHVDIQPGSYIMLTGKLDSQIQLDQVVTHSLDGGRLSKMHVGMISTVAKPVEGCIKMILTNPTDAPINICAGMHVALANELKQSADGPWLEEQSQVKEANVNPEITTNDPSFKINFAKSSATGENLNKLKKLCAEFADVFSKSQYDLGSCLVGEHDIITTTEDPITAKPRSTPFRFREEVRDHMQKWIKAGVMVNSDTPWISNIVLVQKKDGGLRPCIDFRKLNEITVPDHFPLPRLEVVLEKIGNCHWYTSLDLSSGYLQIRLTERASRKCGIITEDDVYQMTHMPFGLRNATSAFARVMDHVFSGLEDSVIAYVDDFLIYSKSPDFICIYWH

SEQ ID NO: 132664 - protein, 746 aa, Heterodera glycines
  Coding regions on vcDNA: vcDNA=SeqID_59087; Strand=-; Position=1 -144,278-2174,2475-2674
MPSSTSGSVLSSGATAQPNFSDDESILKVVNKTLFQGKQQNSTVRFEDTFTAEISKVAGKVKSLENLNLANKNIQQATAVTQPPVPHHAHPPVQQLGHQTGQRPNQSQQSSSSDDEDDDQQRNALSFQSVNMITNAYPMALEGYKDDCVVTFDRWAKRFREYMDAFGRKLDEKDKLVRLVIYLDGVPKRILEKMDPNRKATIDLALANLRTDLDSPQSKGLSKQALIACRQMDSEPVKDFLNRFIPLAEASVSDVKDDSQKEAQLRELFLERLRPNISLVMKMLDMSRGKKFEHLCWEAREVEIMLSAQAGGLPFVQKFKSVQAMDNQNLQSNSMTPPGNFRTLAPTQQNRYPPRQNNWRNQPRQSNRNESRNGGRQSRDRDMGHGPTNDRRWNNRPYCNYCRRVGHVANACRTRLRDYQNEQRGSYGNTRSQPQRRTPATGANAIQHDRSIELLNEIASDLRNLSLDMNQHKSLNDVNVVENSSRATALPNNSEIEYEANCPASGRSSPWEGVRMMPRITPLLPFIVFLIAIILDLNGAKAASPSLPLICQTDIQPTIWGLPKQVHCLLPAEVASHVPLIQTRELFVINDFEHNTQAWVCRKIKKKARKFTTLSGVPIVEPIDSELLEISVDECKRMVEHKTCDFGILTERDGLWGTGHSLDLTPRLWLLGSFSWTDTQKQGFATRIIANKRKRTKRSYGSVEHLGLATSPELNAKLTYLDDEWVDSLMYALRHSFKTNATSFSR

SEQ ID NO: 132665 - protein, 371 aa, Heterodera glycines
  Coding regions on vcDNA: vcDNA=SeqID_59088; Strand=-; Position=1 -937,1007-1185
  Homolog annotation: Hit_ID=NP_703169.1; Match level="QueryCoverage =64%, HitCoverage=16%, E-value=1e-09, Identity=22%"; Hit description =hypothetical protein PFB0765w [Plasmodium falciparum 3D7] gb|AAN37613.1| hypothetical protein PFB0765w [P
MKILLIFLLLCALIFKKAINQIEAGKISQEKSFAEIFGQRWDERTEENIYRIGPIIYGQNADQNNQFGQNIRQFDQNFDENVEVKEEESEEMSTDCDELGDQLPMPTNNGQIYDQIRILNDKQKREIVEKFHKIKEKVKQMGKKFTRKEWTKIEIKIAKKLGINQKKIYKWKREFGMMKNKNYSVEEKRIMLKQFDQIYAKLKMKFNEKLEGKREKCKKIIAKHLDTNIRTIFYWKKQLKSGKMVKKQKTDDEKREIVEKYFKLKNEFMQNEKHSRKEWKEFNAKIKQKFGVIFQTIEKWDKKIGLNQILSKGQKHYTFAEKTEKIKQYYQLKNQNPKLNDRQIAEILNITKRSLERYKSEFKRKSEGVTD

SEQ ID NO: 132666 - protein, 65 aa, Heterodera glycines
  Coding regions on vcDNA: vcDNA=SeqID_59089; Strand=+; Position=1-409
NRKKGRISKFFISIFFYSSKFSVIFSRLIEPMKSFRMISRLFDSVNNFKSYIDSKLAQTELARQS

SEQ ID NO: 132667 - protein, 76 aa, Heterodera glycines
  Coding regions on vcDNA: vcDNA=SeqID_59090; Strand=+; Position=1 -110,281-401
MDKKPKERIKRGQSVQIAIVVTDEDAEEGQKTEEKKIAFSANQNNVKPKSNKKHGRSKSGGVLLVKSAGVHWEETK

SEQ ID NO: 132668 - protein, 74 aa, Heterodera glycines
  Coding regions on vcDNA: vcDNA=SeqID_59091; Strand=+; Position=1 -59,133-298
MVAAPDEAQFHISFYTDEEECKNLLPAESINVPASSHSDQLNVLINQIGSMNDGTLSLMILQMFYATLANAFFT

SEQ ID NO: 132669 - protein, 411 aa, Heterodera glycines
  Coding regions on vcDNA: vcDNA=SeqID_59092; Strand=+; Position=1-1236
  Homolog annotation: Hit_ID=AAO50920.1; Match level="QueryCoverage =35%, HitCoverage=51%, E-value=1e-11, Identity=31%"; Hit description =similar to Plasmodium falciparum (isolate 3D7). Hypothetical protein [Dictyostelium discoideum]
MANAFDMDLEVKFEVLKTKVNDLEEKLANKISTNLPSGVRVPKFDATGDFHSFLRDFNILATVSNWHPPDCVRMLPLFLDGEAKELFLHIPPDKKKTWRELTDALAEQTKKIDGPMWPKKMLARVKMGNESITEFANKVRELVEQASPSPKYTKEAREDESVHFFLSGLPTALKRKLFFMDKPKSLVEAISQAKKVVQVREELANDARGDELKQQISELSEKVSAITVRNNGNNERNGREFFNSNWRGNNNNYTQMRGYANNNWRGNQNMVRGRNMGNFNNFNPRNANFTPIGQNRNWNRNFGNRTNFENSRFQRGNFNNNRGMRGRGNERQKYRINAIGNNEEIPSSSTRKSPTPTMTFLTISMVIFSLFGLINGQYQLCSERVPTTPIWLPQYNRMFRGESTRKWQKPK

SEQ ID NO: 132670 - protein, 50 aa, Heterodera glycines
  misc_feature (45)..(45): Xaa can be any naturally occurring amino acid
  Coding regions on vcDNA: vcDNA=SeqID_59093; Strand=-; Position=1-258
LPLDPLHRLTGKCGEIIFFFKIAPLSQPFAHPLGLLLQCAVLLLXCRHCS

SEQ ID NO: 132671 - protein, 39 aa, Heterodera glycines
  Coding regions on vcDNA: vcDNA=SeqID_59094; Strand=+; Position=1-118
VRLGYSNNYGEQKSNAELKSGYREAIPEGFGLPINLGAS

SEQ ID NO: 132672 - protein, 95 aa, Heterodera glycines
  Coding regions on vcDNA: vcDNA=SeqID_59095; Strand=+; Position=1 -141,199-345
  Homolog annotation: Hit_ID=NP_724940.1; Match level="QueryCoverage =93%, HitCoverage=11%, E-value=3e-13, Identity=40%"; Hit description =CG12891-PB, isoform B [Drosophila melanogaster] ref|NP_523685.2| CG12891-PA, isoform A [Drosophila melano
MAEARNIAALSFTVTHDGISVSYDQEVLRDIWHAFSRSYKKRIAKFENDFFAGIFPANIRSLAIVIFLVAALNVSFGNDKTPFNLADKLNYYVFS

SEQ ID NO: 132673 - protein, 205 aa, Heterodera glycines
  Coding regions on vcDNA: vcDNA=SeqID_59096; Strand=+; Position=1 -349,700-968
MVVLNGTRKRIPSPNQPQLQEDDRDRLAPLKSATDGRHCFTPAVGYSARPSTAAVDSSQCHSTSGGRHCADFSNGFYRTTTVVANGGGLLSLGSPGSGTLIGAEQKSRSTGNLDKNGSLRNCALISSSSSSGGQHQLRHQFSTTVPPGDELCGEAATAEQQQHLGFILDRLNDGQHQNQRHKDIDENGTDGMPRPKQTAEECVSC

SEQ ID NO: 132674 - protein, 40 aa, Heterodera glycines
  Coding regions on vcDNA: vcDNA=SeqID_59097; Strand=-; Position=1 -83,147-186
MSGDYSKDELMAYMGEANRIFVGFRQALVEPTLLALSMNG

SEQ ID NO: 132675 - protein, 27 aa, Heterodera glycines
  misc_feature (13)..(13): Xaa can be any naturally occurring amino acid
  Coding regions on vcDNA: vcDNA=SeqID_59098; Strand=+; Position=1-83
KGRSPGVRGISKXKFGGWIEHPWFLRK

SEQ ID NO: 132676 - protein, 166 aa, Heterodera glycines
  Coding regions on vcDNA: vcDNA=SeqID_59099; Strand=+; Position=1 -298,535-601,741-873
MDPGKGLYDKNVDKLTLAIDVTVPNERKERIYEPNGTIEMEIENLSEFAREAFGSGRFSESILFIKELPWKIMAQINSKNGNTDQKWLGFYLWCAAAEKVLLILRTKRSHFFERVELRFSLGCKCSATLRIVSQKGDVTDFSRDFSGQIFNQTSYSSGFPYFITFE

SEQ ID NO: 132677 - protein, 65 aa, Heterodera glycines
  Coding regions on vcDNA: vcDNA=SeqID_59100; Strand=-; Position=1 -109,216-304
MAIFVGHSLHGRLVHWWHFGSCLHICHGTDFARPTDGAVIPWKNRFHKSLSVKKIKPKQMRKDVS

SEQ ID NO: 132678 - protein, 78 aa, Heterodera glycines
  Coding regions on vcDNA: vcDNA=SeqID_59101; Strand=-; Position=1 -183,417-470
MALLKICLPQKIGTNSRVIVPCSPLSRRSAALEQPIPFHSTALQFGWLCGADAYKRALYSQEKCQNTLKIIGSKKGTI

SEQ ID NO: 132679 - protein, 41 aa, Heterodera glycines
  Coding regions on vcDNA: vcDNA=SeqID_59102; Strand=-; Position=1 -43,165-247
MAIRNFLRFSNAFPENVYFFKESIILKNDLFFSFLKIGFLK

SEQ ID NO: 132680 - protein, 215 aa, Heterodera glycines
  Coding regions on vcDNA: vcDNA=SeqID_59103; Strand=+; Position=1 -321,658-984
MPTVREILESLQNPIKRPRIPTNEDSVLNAERTDAEQQMEGTSTRNDLDVAESDDEENCAPVHFQRGKTIRGALCIWHQGLNSFLGFHLFIFRLPISQNTKRWKLVQKGIYFFGQRELNHHPSFSDFIAAFTKDIDKQLDIGRAEQLQKSTKRRQRYIIKEQNVVRILDEADFESEEGLTNSLHLLGLVMQGFVEGLHVRGNEESGEETDDADGN

SEQ ID NO: 132681 - protein, 344 aa, Heterodera glycines
  Coding regions on vcDNA: vcDNA=SeqID_59104; Strand=-; Position=1 -58,1272-2250
  Homolog annotation: Hit_ID=NP_508294.1; Match level="QueryCoverage =97%, HitCoverage=29%, E-value=2e-68, Identity=40%"; Hit description =predicted CDS, endonuclease/exonuclease/phosphatase family and RNA -directed DNA polymerase (XC178) [Caeno
IATTETQFSCIPITRDSILYIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLITVVEDWYEAIINGKVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARTDTEIMHKALHNLFEWANKWQIRVSMQKTFVLYLGSKNPKETYKFDGNRINAVDTIRDLGVKGDNKLQFSDHIN

SEQ ID NO: 132682 - protein, 204 aa, Heterodera glycines
  Coding regions on vcDNA: vcDNA=SeqID_59105; Strand=-; Position=1 -412,491-693
MPQQDEAGPSTSAASTEEAMEPSPSTPGPVPTPEMDEEILEFGFSLPSTSVTPVGDLVPFSTTPTAPMDTGETIPPPLAIDERSERIEQLEKQLKDRDDTIQFLREQVRNREALISDLRRQLEQCAAPPTATPTTSKTTPNRGRPRKAIDELQRSSRKRLTEQILDAIDRDRSRSCCIHPPNFIRKSHGHLGNFLCETKIQIFL

SEQ ID NO: 132683 - protein, 24 aa, Heterodera glycines
  Coding regions on vcDNA: vcDNA=SeqID_59106; Strand=+; Position=1-75
TPFHKTRCVPINRECQRKTLSFFS

SEQ ID NO: 132684 - protein, 92 aa, Heterodera glycines
  Coding regions on vcDNA: vcDNA=SeqID_59107; Strand=+; Position=1 -136,622-761
MPAEGCKLSVGYLKETVSNSFLFTKGFEEEEEDTKKGSDQANASAEQTTAEPSTSKNRRKKSQFLYDPHDEEDTVQDSDVDDDDDDDESADE

SEQ ID NO: 132685 - protein, 93 aa, Heterodera glycines
  Coding regions on vcDNA: vcDNA=SeqID_59108; Strand=-; Position=1 -41,143-383
MSVCRVGECAAKAIITFCFLGQMDPANARLNSQYHMENYEEDNKIATKCKMAQQTKWAKHFEQDKVLHGFQIVMSETDEEKAMDLYTSTHQEK

SEQ ID NO: 132686 - protein, 95 aa, Heterodera glycines
  Coding regions on vcDNA: vcDNA=SeqID_59109; Strand=+; Position=1 -206,267-348
MPMVPFELVNEWTKEKLTLAKENENDLENWIMKRCKIGEAADVQLQKDENWGNNFNNVSIWLFSTNCIGPLSPPSAEEQQEAGQSSEKGASSADK

SEQ ID NO: 132687 - protein, 67 aa, Heterodera glycines
  Coding regions on vcDNA: vcDNA=SeqID_59110; Strand=-; Position=1 -51,109-261
MPAEEIWQEFLDKDEANVIREFFGGKAAMEVEKSLREYAKKKEKRDEILMRKRKEYQQKMENNKDEN

SEQ ID NO: 132688 - protein, 28 aa, Heterodera glycines
  Coding regions on vcDNA: vcDNA=SeqID_59111; Strand=+; Position=1-103
LGCPVGYGVHTWLGNIWPSFVILKHTKH

SEQ ID NO: 132689 - protein, 190 aa, Heterodera glycines
  Coding regions on vcDNA: vcDNA=SeqID_59112; Strand=+; Position=1 -21,73-157,490-683,736-848,1014-1173
  Homolog annotation: Hit_ID=AAH71128.1; Match level="QueryCoverage =97%, HitCoverage=63%, E-value=2e-28, Identity=40%"; Hit description =MGC81473 protein [Xenopus laevis]
MAGKIFVVTGANKGIGYGIARGLAQQVNGATIYMTARTPSLGEKALDDLEKELGTKRISKLAFHQLDITDEKSCADFAAFLKKTHGGLDVLINNAGFAYKHNATESAAIQADVTIGVNYYGTKLISDQLGPLIRDGGRIVNVCSQMGVMGSQIGVMGNLYKQALIDQFKHADVTSDDINTFVEEYKKWEH

SEQ ID NO: 132690 - protein, 70 aa, Heterodera glycines
  Coding regions on vcDNA: vcDNA=SeqID_59113; Strand=-; Position=1 -156,290-346
  Homolog annotation: Hit_ID=CAE75166.1; Match level="QueryCoverage =88%, HitCoverage=62%, E-value=2e-18, Identity=62%"; Hit description =Hypothetical protein CBG23103 [Caenorhabditis briggsae]
MKAFGKLKDYPQGSRWFHERLKNAFARNANVQEEAKVRELIKRGEYVVKELEALYRLRKYRAMKNRYYND

SEQ ID NO: 132691 - protein, 66 aa, Heterodera glycines
  Coding regions on vcDNA: vcDNA=SeqID_59114; Strand=-; Position=1-295
IFVRVRVRGSKWAEMISASNSTAHIKQFYFETFFENFLFQKRGVQSTLLPSLGIIQKWSNRAVRAQ

SEQ ID NO: 132692 - protein, 43 aa, Heterodera glycines
  Coding regions on vcDNA: vcDNA=SeqID_59115; Strand=-; Position=1-130
MSIVGGHSLRAEVIQLYKTVQKKNCFCYCQIIMFVHLAVPLGQ

SEQ ID NO: 132693 - protein, 38 aa, Heterodera glycines
  Coding regions on vcDNA: vcDNA=SeqID_59116; Strand=-; Position=1-122
QGSEIDIRIEFYDPENPLFRKKIFFKRQILRVLTKASW

SEQ ID NO: 132694 - protein, 92 aa, Heterodera glycines
  Coding regions on vcDNA: vcDNA=SeqID_59117; Strand=+; Position=1 -38,132-372
MKSQIFGNNLGFRFFFGAQTSTGHLGSEKIIVQFSKIILNIDIYCMEFSRGHHCGQLVSGTVPQIGHTNTVEEQLVEGRVEQVLLRRAFLKK

SEQ ID NO: 132695 - protein, 29 aa, Heterodera glycines
  Coding regions on vcDNA: vcDNA=SeqID_59118; Strand=-; Position=1-88
DYFSKHLVAWGIIGDCGINRDWAIIRAYT

SEQ ID NO: 132696 - protein, 64 aa, Heterodera glycines
  Coding regions on vcDNA: vcDNA=SeqID_59119; Strand=-; Position=1-193
MQCFFHVISASINERLDGLHSPLPIAFVKDEVNPIRRLIGHIARAWPSVALMEALVSMLKFNVQ

SEQ ID NO: 132697 - protein, 233 aa, Heterodera glycines
  Coding regions on vcDNA: vcDNA=SeqID_59120; Strand=+; Position=1 -120,1018-1167,1248-1377,1415-1644,2087-2158
  Homolog annotation: Hit_ID=AAQ61266.1; Match level="QueryCoverage =76%, HitCoverage=23%, E-value=6e-53, Identity=58%"; Hit description =5-methyltetrahydropteroyltriglutamate-homocysteine S-methyl [Chromobacterium violaceum ATCC 12472] ref|NP_
MINGGDCAKELAENDALLKDHSVSPLIHNGTVKERVTAIEVALALRDDVAELEKEGINCIQMDEPAFREGLPLDPAQHNEYLKITVQAFKISTGCVADSTQIYSHMCYSDFGDIFTHIAELDADVLCIECSRSDLSLLSCFDRFGYPLMVGPGIYDIHSPRVPSVDELKARLRAMLKYIPAGRLFANPDCGLKTRDWPETEAALRAMVGAFRRPQKKTRPCNILTNFMHHNFL

SEQ ID NO: 132698 - protein, 65 aa, Heterodera glycines
  Coding regions on vcDNA: vcDNA=SeqID_59121; Strand=+; Position=1 -93,483-587
MRFFSTKTFRASTRPSVCPNFTSVPTTVPATIEPNQVGPLIDRLLSMFNVDYYAMALYTGDKYGQ

SEQ ID NO: 132699 - protein, 42 aa, Heterodera glycines
  Coding regions on vcDNA: vcDNA=SeqID_59122; Strand=-; Position=1-151
DYFQKISHEFSFLNFLQIFKYLDIFLAYQNFIEPGSFYSHSN

SEQ ID NO: 132700 - protein, 42 aa, Heterodera glycines
  Coding regions on vcDNA: vcDNA=SeqID_59123; Strand=+; Position=1 -11,69-186
MNRRWMCTDVWLNILPFFDHAQLGLNLALLSFRFDVLVDKSF

SEQ ID NO: 132701 - protein, 262 aa, Heterodera glycines
  Coding regions on vcDNA: vcDNA=SeqID_59124; Strand=+; Position=1 -220,264-377,450-556,684-894,1015-1153
TCNILIALECFFGLILDIGYYASPFVAVSGQKFIRYEHCFWALIIPCVCGDLAQFTMVTIAIDRLIAVAFPLWFKQRANNRYLAIVFSFIFGYGIYDLTLRFFDYTYTKEIMVSCATNEMAQSFLGKIFKINGLVLSGLLMSAYSLYVEEWNRKLIKALSFIIVLNLIGVFVRISVELIFQAFAIADVFIRTPYSIVSSFFTIIVYSADGPLLYIVSTEYRTRLNQQFPWLTKIFGPNERNIIHVTPSSMNLQQQQRRERSV

SEQ ID NO: 132702 - protein, 145 aa, Heterodera glycines
  Coding regions on vcDNA: vcDNA=SeqID_59125; Strand=-; Position=1 -48,109-498
  Homolog annotation: Hit_ID=AAP30767.1; Match level="QueryCoverage =100%, HitCoverage=100%, E-value=2e-75, Identity=95%"; Hit description=putative gland protein G21E12 [Heterodera glycines]
MATYLFIAAAAFGAGIYCWKAYLGPMLDQPKSDDEEKPKPEGGEEATTAGDKEEKKAGSKGDKHKKKDKKGEGAAAAPAADKKEEKRKDKHRSKEAGKSDDSKAGKKDKHGKKDKKGKKKDTADASTVDEALGEQSTAETSQAEE

SEQ ID NO: 132703 - protein, 69 aa, Heterodera glycines
  misc_feature (47)..(47): Xaa can be any naturally occurring amino acid
  Coding regions on vcDNA: vcDNA=SeqID_59126; Strand=+; Position=1-226
SDKTKQTVQSMGNCHALFPFDPTPFNFRNVFVLRAFFHFFRFFIIRXKVKRIVDIVIERVVTWLGNHFI

SEQ ID NO: 132704 - protein, 394 aa, Heterodera glycines
  Coding regions on vcDNA: vcDNA=SeqID_59127; Strand=+; Position=1 -89,261-461,762-1038,1241-1304,1405-1679,1739-1879,1945-2079
  Homolog annotation: Hit_ID=CAE60606.1; Match level="QueryCoverage =85%, HitCoverage=81%, E-value=2e-59, Identity=37%"; Hit description =Hypothetical protein CBG04246 [Caenorhabditis briggsae]
MTAAASENFGPLSAHYEEDDELLTPTKRLRELRLNSDEKCAMSDSIPRAVELFMEKKRARISKFLYTYNGNLQLNLPQLHAFACSTGGLIDDEFRERIWPILAKNLPQAKRCKDTQWDALRSEEYNDQTNHSSDELQQQQQTLFLSDSDFESALSTFTPSISGCDDQLMDAEDDAEGVDDQRMAPQNATNELTPLIVRILCENEDFRYYQGFHDVCLTFLLVLGADSALQVTRDICARGAFHNYLCCSLEESAMRELQDLYVLLFLHDQEVEKRLRSAELGTLFALSWPLTWFSHALQNYSQVVLFFDLFLSSHPLMPIYVSAALVSERREEVLGCEVDMPSLHQLLNHIPSTINCHRVADAARALMDRYPPTVICEFREEYLRICDRHKRLIA

SEQ ID NO: 132705 - protein, 25 aa, Heterodera glycines
  Coding regions on vcDNA: vcDNA=SeqID_59128; Strand=+; Position=1-75
MEGTETARIVNGRIALEGAAAVRPQ

SEQ ID NO: 132706 - protein, 457 aa, Heterodera glycines
  Coding regions on vcDNA: vcDNA=SeqID_59129; Strand=-; Position=1 -158,208-485,535-845,895-1056,1102-1143,1440-1539,1589-1911
  Homolog annotation: Hit_ID=CAE63808.1; Match level="QueryCoverage =90%, HitCoverage=26%, E-value=1e-78, Identity=41%"; Hit description =Hypothetical protein CBG08354 [Caenorhabditis briggsae]
MNLRDERAKLLCEIFNGIKVIKLYAWEIPMLKAVGSIRRLELHCMFKSGVIRSLVDMLNFTSPFLVAVGSFTTFILLDPAGGRSLTPQIAFVSLTLFNQIRSPMTIIGMLINLVVQTTVSNKRIREFLLEDELEKNTIEQRKTPNVTSPLIRVINADFCWDNNGKNGKSKEGHRQNVHRRTSSVWNQQKATERPTLTDIGMEIRREKLIAVVGKVGAGKSSLLAALLGEMKRTKGELKMLEGMELAIASVPQLPWIQNLSLRNNILFGQPFEGEWYERVLDACALRADLAMLPQGDATEIGEKGINLSGGQKARVSLVIGPGSILDGKSRVFVTHGLHFLHHVDLILLIQDGRIVERGTFDELSSLLGGKFAQFVAESKKNGEKIGNGTNGQRTAVNYDIEPGVSNNDPDAEPLSGRVTTATPSNATGELTLPNGNTPLPKRLIQKERVETGRVNEH

SEQ ID NO: 132707 - protein, 237 aa, Heterodera glycines
  Coding regions on vcDNA: vcDNA=SeqID_59130; Strand=-; Position=1 -270,867-971,1878-1988,2323-2548
  Homolog annotation: Hit_ID=AAH52406.1; Match level="QueryCoverage =62%, HitCoverage=42%, E-value=1e-46, Identity=51%"; Hit description =Bruno-like 6, RNA binding protein [Mus musculus] ref|NP_780444.2| bruno-like 6, RNA binding protein [Mus m
MVQQQRHDNKNNSAGGAILIECSSSQMPTEIGPRLIMSNNGTRNGAAENGTARAATTSQQQQVQQQRCSSTDSNGFPVKDPDAIKLFVGQIPRNLEERDLRHVFEAYGKIYEFSILKDKTTGVHKVGMLSKQYGEEDVRAMFQPFGHIEEITVLRAADGASKGCAFVKFGQAHEAQRAILTLHGSQTMRGASGALTVKLADTEKERQMRRMQQMATQIGMLNPLMGNQLGAATEFGW

SEQ ID NO: 132708 - protein, 36 aa, Heterodera glycines
  Coding regions on vcDNA: vcDNA=SeqID_59131; Strand=+; Position=1-108
  Homolog annotation: Hit_ID=P30757; Match level="QueryCoverage=100%, HitCoverage=29%, E-value=4e-09, Identity=80%"; Hit description =Histone H2B pir||S16084 histone H2B - sipunculid (Sipunculus nudus)
MPPKPSGKGAKKAVKSTKAVRTGDKKRRKARKESYS

SEQ ID NO: 132709 - protein, 23 aa, Heterodera glycines
  Coding regions on vcDNA: vcDNA=SeqID_59132; Strand=-; Position=1-69
MSGRGKGGKGLGKGGANRHRIAS

SEQ ID NO: 132710 - protein, 91 aa, Heterodera glycines
  Coding regions on vcDNA: vcDNA=SeqID_59133; Strand=-; Position=1 -132,966-1107
VELGKSQQFVLKKIWNRNEDAEEGVLGLGELNAETLEGLDLVIESLTVIMMKPPTAFRLPAMNNDSLPELGALHKLCEESRATNQPKVLYD

SEQ ID NO: 132711 - protein, 33 aa, Heterodera glycines
  Coding regions on vcDNA: vcDNA=SeqID_59134; Strand=+; Position=1-104
PGLNPGLEEPGFFLDLDFCPGNPGPGFFQNVDL

SEQ ID NO: 132712 - protein, 165 aa, Heterodera glycines
  Coding regions on vcDNA: vcDNA=SeqID_59135; Strand=+; Position=1 -82,240-400,443-574,627-662
  Homolog annotation: Hit_ID=AAO33474.1; Match level="QueryCoverage =92%, HitCoverage=100%, E-value=6e-42, Identity=61%"; Hit description= gland-specific protein g4g12 [Heterodera glycines]
MPNIFKILLIVLLAVISFRFSASTDGKKTDNDRNGNDSSAGIGTKIKRIVTAGLLFTSLATGGTGAIGRSNAQGGIAAGAMDTNATQFHQAPPPPPADTNATQFHQAPPPPPANFEKATPVEKISTHLHELSERMLLNKAPRVVPGGPNPLHHRVVPGGPNPLHH

SEQ ID NO: 132713 - protein, 145 aa, Heterodera glycines
  Coding regions on vcDNA: vcDNA=SeqID_59136; Strand=+; Position=1-439
DLNSAFYRKVQDERMRAAGVMPNDELLNPLLPYGGGGGDTLDRHIPTAPFGPPQTMFELKHSQQQLHHAQQQPYRFWESGATSADTMHSAGVGWHPPYYVQQQPQKQSYGSASANTEPTQAEPYQIASIQQEQVGDDELEGRNFT

SEQ ID NO: 132714 - protein, 36 aa, Heterodera glycines
  Coding regions on vcDNA: vcDNA=SeqID_59137; Strand=-; Position=1 -10,615-715
MLLKFCPDLVSAYGCAAKAKPKTNMGLSELKPSEIC

SEQ ID NO: 132715 - protein, 186 aa, Heterodera glycines
  Coding regions on vcDNA: vcDNA=SeqID_59138; Strand=+; Position=1 -90,135-288,435-739,1081-1092
  Homolog annotation: Hit_ID=NP_499298.1; Match level="QueryCoverage =96%, HitCoverage=26%, E-value=2e-74, Identity=75%"; Hit description =FtsH protease (3L509) [Caenorhabditis elegans] emb|CAA88955.1| Hypothetical protein M03C11.5 [Caenorhabdi
MDEAKAEVEEIVDYLRDPRRYTSLGARLPKGVLLVGPPGTGKTLLARAIAGEADCPFFHAVGSEFDEILVGQGAKRVRELFRLAKENQPCVVFIDEIDSVGSKRTNSAIHPHANQTINQLLAEMDGFEQNQGVIVIGATNRVDNLDKALLRPGRFDVQVTVSRPDLPSRKDIFRLTKSKNGLKIVF

SEQ ID NO: 132716 - protein, 373 aa, Heterodera glycines
  Coding regions on vcDNA: vcDNA=SeqID_59139; Strand=+; Position=1 -83,138-191,242-318,371-653,704-760,811-879,940-1008,1317-1748
KKFKLYSIVMAEQQQQNLLGSMPPFGQVAQLVEPMLVNAAQQYFAQPFCTDGTHNIQFLNGCVSQLGQPLPPLCLIVVSIEHRASQQTPAGPLPMTNCVLRTGDGHRVEAAGWQAHAGALADLCVGSAYWFTNCVARARYQRLDCWYRVSVGGPNALVMPHVSTAPMLSAHPMPPVQTGAGVLEVTVPVQLGPPRSRDTDAGDIDINANEVVERGQTSRERLPQRRAAQRAGRPIEECFVIERTTAMRNAPRNTRGEICELRFLPLEDAERPDLLMEALIQHLLDRVLEGQPRPSLIGLQVHPPGFDRPYVIRLRPPEQNNAATLAAAIERLNEQSAAGIDLLAGRTITKVLAVWPLEAIRADPQSGGELSVY

SEQ ID NO: 132717 - protein, 95 aa, Heterodera glycines
  Coding regions on vcDNA: vcDNA=SeqID_59140; Strand=-; Position=1 -51,662-804,897-987
  Homolog annotation: Hit_ID=CAB03869.1; Match level="QueryCoverage =100%, HitCoverage=9%, E-value=9e-33, Identity=75%"; Hit description =Hypothetical protein C09H6.2a [Caenorhabditis elegans] pir||T19171 hypothetical protein lin-10 - Caenorhab
GEELRENGTKRKHSKKVIIHEPAVLIEGVLFRARYLGSTQMSSDGRPSKSSRMAQAQEAVARVKAPDGELQPSTEIDLFISTEKIMVLNTDLQVI

SEQ ID NO: 132718 - protein, 217 aa, Heterodera glycines
  misc_feature (183)..(183): Xaa can be any naturally occurring amino acid
  Coding regions on vcDNA: vcDNA=SeqID_59141; Strand=-; Position=1 -89,169-281,395-444,487-802,868-896
  Homolog annotation: Hit_ID=H88574; Match level="QueryCoverage=79%, HitCoverage=43%, E-value=8e-33, Identity=43%"; Hit description =protein ZK1128.1 [imported] - Caenorhabditis elegans
IQKLAGKLFIQSFSAYYVSKLSPGFNSSPLSGNQLFRIIRDKSGNQLFRIIRDKIRTSGPITVAEYMQICATSQLGYYAAGDFVTSPELTQIFGELIGSWVVHIGSWVVHELEMTSWKDRWQLVELGPGSGELMADVLNVLRQFDVPSVLIPFLILLLKVLQNVEVYLVESSERLVSANEKLXRRNLAKIYLDIRWYDSLDDVPQGVVAFFGPHFLF

SEQ ID NO: 132719 - protein, 81 aa, Heterodera glycines
  Coding regions on vcDNA: vcDNA=SeqID_59142; Strand=-; Position=1-246
MPELPNLKMASLQMPCCPPSTSASASSANTTTSTSSMEPGGGGGGGGTDAESEQSQQNNGLLAKKDQACSRTFQGQDHSMD

SEQ ID NO: 132720 - protein, 103 aa, Heterodera glycines
  Coding regions on vcDNA: vcDNA=SeqID_59143; Strand=-; Position=1 -94,351-568
MRTRLEDIKEIVRTELPDQPNHLHLLEKQLDYYFANHSAEALEASGKLNLGIAERAAAAALAPSVSLSASGSSTNSNWSKREEEDRSRRHAGGGGMEWEENEE

SEQ ID NO: 132721 - protein, 232 aa, Heterodera glycines
  Coding regions on vcDNA: vcDNA=SeqID_59144; Strand=-; Position=1 -91,142-286,487-651,1083-1243,1529-1665
MGDSCLISDSTRGHTISPPSYDFVAVLRRPINTTILIKRQLKNKRTLTKMLSKPRTETAIVLPERRMDTNFLSPKDRELIYLCWHNNIVTSRSDLFHKAMHYCIHASPKMNEIIACGHYCYRDLTKWPKLNRICQAIFKFFDKLINEYKMDEDKMYDACVHLGEMHANYAQYGLKQHFMDLFQQQLLAIIARLEMDNKVETCIAFTHLITFVVDIMIQAYSKKTSEIRATTK

SEQ ID NO: 132722 - protein, 106 aa, Heterodera glycines
  Coding regions on vcDNA: vcDNA=SeqID_59145; Strand=-; Position=1-321
MMAIDGSPPHTTTMASQNNAAALAFAGMNGNRSSPPYNNRLSQQQQQQYGIIMETVPEEVLLHTPDSTDADNGTFFTSAGIMMQLADEQQLQQQQQRTISRNSTHV

SEQ ID NO: 132723 - protein, 58 aa, Heterodera glycines
  Coding regions on vcDNA: vcDNA=SeqID_59146; Strand=+; Position=1 -99,549-626
MVVFREDKTFEDELRTWMLWHKRQHSHKQRIIEKQMFKFKFPNIRVVKLIIFTIKFNN

SEQ ID NO: 132724 - protein, 77 aa, Heterodera glycines
  Coding regions on vcDNA: vcDNA=SeqID_59147; Strand=+; Position=1 -142,207-298
  Homolog annotation: Hit_ID=XP_314763.1; Match level="QueryCoverage =74%, HitCoverage=16%, E-value=2e-13, Identity=59%"; Hit description =ENSANGP00000005081 [Anopheles gambiae]
MENERNGNGGAVLVTGAAGFIGSHTILELLDAGFDVVAVDNFSNSIPDAKNNALSLQRVSELSGGKSIRQVNGNLLI

SEQ ID NO: 132725 - protein, 230 aa, Heterodera glycines
  Coding regions on vcDNA: vcDNA=SeqID_59148; Strand=+; Position=1 -80,547-726,1201-1296,1354-1476,1914-2061
  Homolog annotation: Hit_ID=NP_493274.1; Match level="QueryCoverage =97%, HitCoverage=58%, E-value=1e-65, Identity=54%"; Hit description =UDP-glucose (37.7 kD) (1N569) [Caenorhabditis elegans] emb|CAB16861.1| Hypothetical protein C47B2.6 [Caen
PFSEESVAKPIDYYTNNIVGSLNLIKCCKKFGVKQFIFSSSATVYGQPEHLPLTETGRVGVGITNPYGQSKHMVEQILMDLKRAEQDWQISILRYFNPVGAHPSGRIGEDPQGIPNNLMPYIANVAIGKLPHLNIYGTKMPYIANVAIGKLPHLNIYGTKYDTPDGTGVRDYIHIVDLAKVHLGKHTPSAADGKELCEVYNLGTGKGHSVREMVAGFERAAGKTVGEKTL

SEQ ID NO: 132726 - protein, 54 aa, Heterodera glycines
  Coding regions on vcDNA: vcDNA=SeqID_59149; Strand=+; Position=1 -138,204-230
MPAVDCLNGYRSYTDRCGEFFMGDPLDPNMETDFDFAGNLALFDKAYKKYAGSF

SEQ ID NO: 132727 - protein, 61 aa, Heterodera glycines; identical to SEQ ID NO: 127089
  Coding regions on vcDNA: vcDNA=SeqID_59150; Strand=+; Position=1 -62,108-231

SEQ ID NO: 132728 - protein, 265 aa, Heterodera glycines
  Coding regions on vcDNA: vcDNA=SeqID_59151; Strand=-; Position=1 -84,213-449,525-762,820-1058
  Homolog annotation: Hit_ID=AAC47437.1; Match level="QueryCoverage =99%, HitCoverage=99%, E-value=1e-113, Identity=62%"; Hit description= COL-1
MADFEGRVKAYRFVAYTTVSFSIISLLSHNAKDIWSEVSQLKGLPLLVSGNRTARSAYGSCQECCSGGAQGQPGQPGQPGRPGNPGAPGSPGQPGQTPQTPCEQVHPPPCTPCPGGQPGNNGPPGPPGAPGSPGQPGTGGGQPQPGEPGPPGPNGQPGQPGQPGAPGQPGQPASPPQTEPPPPGPPGEAGAPGQPGQPGAPGQPGASGQPGPKGPPGGPGQPGNGGAPGQPGQPGQPGNPGERGICPKYCAVDGGVFFEDGTRRR

SEQ ID NO: 132729 - protein, 106 aa, Heterodera glycines
  Coding regions on vcDNA: vcDNA=SeqID_59152; Strand=+; Position=1 -154,309-475
MAPRMPLTAVGGIPKSSKNASLFKAITYALINSDAIGLCLICKELSFGKHYVLLCTTRTLCAKSQAFVSSKCRLVDFVVRVDFVGPRWTMNFVVYILIIIGVSRWE

SEQ ID NO: 132730 - protein, 126 aa, Heterodera glycines
  Coding regions on vcDNA: vcDNA=SeqID_59153; Strand=-; Position=1-3,96- 444,525-553
MSFNSPLLSFKENEHHLSASADNGGKREQLDNCLAELEILMNGAMEAIPMEEIDRNEHRLLSDLFEKKNELFSEKIAPKYLKNPCAREKHLQFLFNLHEIAMNKLMEGKDAFTKRLEAYESRHHFL

SEQ ID NO: 132731 - protein, 75 aa, Heterodera glycines
  Coding regions on vcDNA: vcDNA=SeqID_59154; Strand=-; Position=1-225
PGLKCPAQAKNFFYFREKIEIFPKKIPVDRARKTMFWKWSPFLWEKSLKNPKIQKPENRFLGLTRKILKIFEILK

SEQ ID NO: 132732 - protein, 442 aa, Heterodera glycines
  Coding regions on vcDNA: vcDNA=SeqID_59155; Strand=+; Position=1 -1128,3305-3507
NVAPAKLALSAHCSGIEQHSNCSCILLEEVFPNLPAMDPLRRVQLSSLGELIPISIAKQKGILLGHIRSWANLDEESASLLCHIPNFSPDIQNFIPPILMWVDRCAVAFQTLKNTGMKVVQQEICSKNPLHRFGELISEAFEEVKAKNIIGFSSMESEKFLFYGDSSVREFASKMETKTIIFKNTLEMAEAFKNTYFTTKVQEILILIGNDDLDQGLVLNDVEEAIRKIIVHANKFSIKTIFIPPPFHYSKRILHGKLINLLAKMLPNDGKIVLAMKRGKRSLAEVTRFGNLENRRTVNENGKLKPPGIHFTISFLTDVFWMTTPVKMSSESGSSGIRTPATSNSRAPSLLNVQIPPPIIPHPRQEQNAYRRFNRGRMINVEADGNCFYNSLSVLLTGTELKENARIIRRIITQFIDSEVELHDLGIPWHGWWEMLHPGQTI

SEQ ID NO: 132733 - protein, 140 aa, Heterodera glycines
  Coding regions on vcDNA: vcDNA=SeqID_59156; Strand=-; Position=1 -40,116-497
MNRGRNNQNYLIHGISKYWQVVGALGLCVVMVCITYQLFLHVDEKHKSFKLMISGHFNDIKQINNDFTAWSKNFTSHLNERFEQQQARSRARFKQQLAKSRERFDEQHTNFVKIRLDFDKQFQKTMYRFAEVELETVLNK

SEQ ID NO: 132734 - protein, 25 aa, Heterodera glycines
  Coding regions on vcDNA: vcDNA=SeqID_59157; Strand=-; Position=1 -46,102-133
MFPNFFWLVQPRLLDVLHGKGTRMN

SEQ ID NO: 132735 - protein, 54 aa, Heterodera glycines
  Coding regions on vcDNA: vcDNA=SeqID_59158; Strand=-; Position=1 -49,92-208
GPSEDPRAGLATDPSQAVAFVARTWMNRAMSRKRRKPKPVPKLFSKWTGEDLDR

SEQ ID NO: 132736 - protein, 80 aa, Heterodera glycines
  Coding regions on vcDNA: vcDNA=SeqID_59159; Strand=+; Position=1 -108,466-600
MDNAGKYNVTFDTGGKVTECHYENPEMPPWTVQYIAVILKNDPQQLIKPEISCIPQNRCMKMKEVDDLLEKQTNGMKKKL

SEQ ID NO: 132737 - protein, 296 aa, Heterodera glycines
  Coding regions on vcDNA: vcDNA=SeqID_59160; Strand=+; Position=1 -757,1415-1548
  Homolog annotation: Hit_ID=XP_319741.1; Match level="QueryCoverage =83%, HitCoverage=54%, E-value=6e-22, Identity=26%"; Hit description =ENSANGP00000006515 [Anopheles gambiae]
MHHCSEYNRYAESVLPSKPTDFTLAQTIDKLKAMFCATKSIFTRRLECFQLTKSISQSPLDFASQVNAMCERSQMDLTKDEIKAMIFLTGLSDTDQELRERCLRLLEEAKKKTPPEAISYEKLTEEYRPFLSLRNTSNALAHSTHVANSVTIKPQKLRDHKQRKRDGSRSSSKTTSTTSNNQRSSQFQRKPQQPPSPCRFCNQMHWVSDCPKAPICSNCNRRGHHHSKCRLPSPSSKSNSQRNHATKVTHLIDSDGHFGIASRARDRLRVASVQLGPGDHCFMGPSVDALGPPIGR

SEQ ID NO: 132738 - protein, 32 aa, Heterodera glycines
  Coding regions on vcDNA: vcDNA=SeqID_59161; Strand=+; Position=1-95
RTSHILTVLSKLAETNKCWSVECQQTSDTTPT

SEQ ID NO: 132739 - protein, 46 aa, Heterodera glycines
  Coding regions on vcDNA: vcDNA=SeqID_59162; Strand=-; Position=1-177
LDSAEPYLQRFGGLDGESVLTWDRRKYLIVYRDIICCFIIVKISVQ

SEQ ID NO: 132740 - protein, 117 aa, Heterodera glycines
  Coding regions on vcDNA: vcDNA=SeqID_59163; Strand=-; Position=1 -50,182-316,633-799
VSACCCCESEDSMSTKVLRSKPPKSKSGQWATNRSRRELIRVQTVRTTPTAREENNGQYKVNRNAKTAKIAAVPHTLKNCFSRSHFASLSASALSKVLTNELRQRCNSSRCASPPDE

SEQ ID NO: 132741 - protein, 42 aa, Heterodera glycines
  Coding regions on vcDNA: vcDNA=SeqID_59164; Strand=-; Position=1-127
EDKISKFFDSVRRFDKDGFRFAISRSTFGNWSRIFSAITCNH

SEQ ID NO: 132742 - protein, 70 aa, Heterodera glycines
  Coding regions on vcDNA: vcDNA=SeqID_59165; Strand=+; Position=1 -160,222-274
MGYEKFIGGKKKQEQVISFLRQQIRNIDALITALRRQLEEKMAPPMETPTTRKTIPTGRPKMNVDHLAEF

SEQ ID NO: 132743 - protein, 103 aa, Heterodera glycines
  Coding regions on vcDNA: vcDNA=SeqID_59166; Strand=-; Position=1 -249,290-352
MDIWSAGIVIFMIATNIELASELYRSAALNLEADITDDLLIKLHLINTSARPGAKEWWERYFVVIIQILSTWYQMPDIAFLLGISRVINTAIVQNKFLHFYRY

SEQ ID NO: 132744 - protein, 56 aa, Heterodera glycines
  Coding regions on vcDNA: vcDNA=SeqID_59167; Strand=+; Position=1-7,89- 252
  Homolog annotation: Hit_ID=XP_314634.1; Match level="QueryCoverage =94%, HitCoverage=27%, E-value=5e-15, Identity=64%"; Hit description =ENSANGP00000000661 [Anopheles gambiae]
MMEEVKLENLEDEGDSRNGWLIKTRTKSFVVYAATQIEKEQWMSHIRRCVEELIDS

SEQ ID NO: 132745 - protein, 57 aa, Heterodera glycines
  Coding regions on vcDNA: vcDNA=SeqID_59168; Strand=-; Position=1-171
SVISARHHQAQSRNALKPRAPNNTTSFLMSDLEKRQQDEEDDPQQHTDALKEVAGTR

SEQ ID NO: 132746 - protein, 262 aa, Heterodera glycines
  Coding regions on vcDNA: vcDNA=SeqID_59169; Strand=+; Position=1 -141,246-617,767-1042
MTAETSSKSSFCCVAATTAAAEDTNLIKQSENKTEEEGEEDEEAEEGVGDASLPPPLCSSPSSSSFCALPKESELSERKRPAAIQELLEKKRARLAHNESGSKSERRSMTPTTDGGAETKLARGEGTNGGGWRRREREKKGGTTDGQCQCHRREKMTAREGTAATVIGQRNTVSSCGSSSAFGAYNGGIFCNSSSKSPFASSAIGELNLGQLLKRAFGESSRILADPQMFAAIQARQEMKMAPINWAINNNLSGDNVAKICR

SEQ ID NO: 132747 - protein, 33 aa, Heterodera glycines
  Coding regions on vcDNA: vcDNA=SeqID_59170; Strand=+; Position=1 -19,153-235
MHQILQESDLKRTKFYFQVNKPSDAFTIKKGDE

SEQ ID NO: 132748 - protein, 105 aa, Heterodera glycines
  Coding regions on vcDNA: vcDNA=SeqID_59171; Strand=-; Position=1 -231,540-626
MGLYFGLTLLTVFELIIFFLFHKKSTATSSGSGSQPRQNARTVPAVYSIPRPKTVANAPLSVAKDRRQPIIIKRGKTNNFAVSRGIIKQLGNIYKVNAELSLRAL

SEQ ID NO: 132749 - protein, 112 aa, Heterodera glycines
  Coding regions on vcDNA: vcDNA=SeqID_59172; Strand=-; Position=1 -171,433-507,569-661
MNDRMPFQYPRGLNREMFVREKNRQSRMLAERVRRLNNDAFQPYLWAEVFKMKKPIKVSSILKFKNDLIELVNRNWQFDWGRHNEDVTDITFFEAVKYRIPPSPIPVFLAFV

SEQ ID NO: 132750 - protein, 178 aa, Heterodera glycines
  Coding regions on vcDNA: vcDNA=SeqID_59173; Strand=-; Position=1 -43,262-514,676-736,802-981
MTFCLSLFFLSAFFGAPAISSQSATFSATIAWRAVTITRRPRAMLASPAAATTVAIHSTPLLVRMGAKIALRTGRADARRIQQPISSRSSTKFTMTVGYDNSSLSHLESAAKKRGEFGKIDVDKSGGISSKEAIAHLVKTKNGTSADDLAKNMSWFAHMDSNGNNRIEPGEFDRSLTE

SEQ ID NO: 132751 - protein, 149 aa, Heterodera glycines
  Coding regions on vcDNA: vcDNA=SeqID_59174; Strand=-; Position=1 -103,167-272,593-660,1054-1226
NAFNRPQNCWDVTTCQIGLELIDTGFLTVRCKENGNRSAVFAKYPVQNGIHSSATFFYYELSILQMKQKWLIAFFECFRIIPRMFNLVEKEKIAFTLDSPSSKVTKVSALRQGPSFIKVMAIFGLGMNGCQENQFSRLVIPSVVGSIWY

SEQ ID NO: 132752 - protein, 54 aa, Heterodera glycines
  Coding regions on vcDNA: vcDNA=SeqID_59175; Strand=+; Position=1-388
ELLVLFDSSMCLLLICKISKILVKFQKSYGQKELKNPVFRTFFALIFLCINKIF

SEQ ID NO: 132753 - protein, 225 aa, Heterodera glycines
  Coding regions on vcDNA: vcDNA=SeqID_59176; Strand=-; Position=1 -526,613-763
MVAQSSDRPMEEIGKERGEAICDKQQMADHGGEAIDSKTQQQTEKGARETTTSTDRSDLAGKGRTNGGAQKDGRSGGGVMGKWNCNNRSREGIFNKMATNRMPSTSHGSKSTPTTPSKEICETNICKKHREEIASETIDKRRVTDGEGQNEEDGAKRNAIGKCQNGKKKAQKHRKVSALSSDILTWTNSQQSVAYPTETIAQMARHFFTRRDGFKGTKISAILVQ

SEQ ID NO: 132754 - protein, 45 aa, Heterodera glycines
  Coding regions on vcDNA: vcDNA=SeqID_59177; Strand=+; Position=1-506
LANIYKESRNLIKCIYNIQNITFLNLYKVPILSLTLLFFPFISIG

SEQ ID NO: 132755 - protein, 22 aa, Heterodera glycines
  Coding regions on vcDNA: vcDNA=SeqID_59178; Strand=+; Position=1-141
LANIYKESRNLIKCIYNIQNIT

SEQ ID NO: 132756 - protein, 87 aa, Heterodera glycines
  Coding regions on vcDNA: vcDNA=SeqID_59179; Strand=+; Position=1 -162,615-716
MKALAARAVDKINRQTNNAFLFIPVKVLSAKAIPVAGVRYELRILVGKSKCLKKVFEVSVFQQSWKNVEDITFVPEEHMGNSTKNCE

SEQ ID NO: 132757 - protein, 25 aa, Heterodera glycines
  Coding regions on vcDNA: vcDNA=SeqID_59180; Strand=-; Position=1 -28,311-360
MVVVIWEYTAWALRNLLDFAEFINF

SEQ ID NO: 132758 - protein, 270 aa, Heterodera glycines
  Coding regions on vcDNA: vcDNA=SeqID_59181; Strand=+; Position=1-813
  Homolog annotation: Hit_ID=NP_508324.1; Match level="QueryCoverage =92%, HitCoverage=9%, E-value=3e-32, Identity=34%"; Hit description =predicted CDS, peptidase family A16 and RNA-directed DNA polymerase and Integrase, catalytic domain and Zn
MPTRILTENGTQFVLASKVSAALEAGRVPTSALDRFMAREAIHWRFIPQLSPWQGGVYERLVALVKSCFKRELGRAMLSWEELVTYTAEVEAVLNQRPLCHVSEEPDGILPLRPINFLLPRAKLGIVFTAETDHDEFRISSTNQRDALIQRWHSVSSSIDHFWNRWQKQYLLMLRQRLQWKFKKQRNQIAREPTEGEVVLISEEKLPRNCWPMGRIVELQRSHGEIRNAKLRLATGKVLSRPLNRLYPLEVASSAEQNESHQQLTDPPLE

SEQ ID NO: 132759 - protein, 505 aa, Heterodera glycines
  Coding regions on vcDNA: vcDNA=SeqID_59182; Strand=+; Position=1 -793,838-1562
MSNSNQHSPILRSAYQFSSKTCLSEMKSETFSPKSPTHRFSCPFNLRGFESPRKKTSQNAMPCPRVFSGAIHATLDLISICNATPTLVQHLCYVRCSDGTEFTALCHKTPEVLNVSLSFNRAEVDINCTIECSGGRNPFVIGGHLRYVPKHFQAPNEGSSFISKAKPSNSCLIWCPDWNFDFSDVFWYFFGLQNALRTIRIITLALFIVYILLRCNPALRSWRAINRIVLLFLALWPVTCHSAAGGLSRPLSIQNAPKRQFEDHCPIVEHSSLQRPKIAHNYPIKAVPKSLNPPFVQILEFAFHFRNQSQFSSFPMATLLSFLANSMNIDVERFGLAVTTSLSRWNEAQAIVQGLHDRGYELKTRHLHPFERNVRLHGTELSRIAANRLGAYNGQARGPTVSEFYRSRHGIVLRCPSAPCLMEPGGNGHRDFFPIELIRVVSPDRISAPRRLATHPLPGPRPSHSDCSTDFPIPPCPVIFSLTSAPTTCQLESREWSADFHVDKQ

SEQ ID NO: 132760 - protein, 328 aa, Heterodera glycines
  Coding regions on vcDNA: vcDNA=SeqID_59183; Strand=-; Position=1-987
  Homolog annotation: Hit_ID=S08405; Match level="QueryCoverage=100%, HitCoverage=27%, E-value=5e-74, Identity=43%"; Hit description =hypothetical protein 2 - silkworm transposon mag
PKRCKPRPVPFALRSEVEKVINQWEKEGVLEPVATSEWATPLVIVPKPGNKIRLCCDYKVTVNPCLDIHQYPLPRPEELFSALNNGNKFSKLDLKEAYLQLPLDDQAKECLTICTHKGLYRFSRMPYGVASAPAIFQQVMEEILCGIDGVAVYLDDIVVTAANDAEHLKRLDAVLQRLKKAGLRVKKEKCSFMHESIVYLGHIIDRQGIRTSPEKVEAIQKMPAPENLKELQSFLGMVGYYGKFIPSLATVSETLNELRRTEKKWHWGKEQQKAFGEIKEMLASNDILVHFDPEKPHFLATDASDYGIGEVLFHKDAKTGKVGVIAYA

SEQ ID NO: 132761 - protein, 84 aa, Heterodera glycines
  Coding regions on vcDNA: vcDNA=SeqID_59184; Strand=-; Position=1 -47,104-308
MSDDRKEAEEKMAKAIFISGDGWLAVFDLLAPSQLGLGIALISHRFDFYVDEHFKTRKWALGIIRIGSKIGENGTKEMEIANYH

SEQ ID NO: 132762 - protein, 21 aa, Heterodera glycines
  Coding regions on vcDNA: vcDNA=SeqID_59185; Strand=+; Position=1-63
MALRLNLFYDILCPRSWVFYQ

SEQ ID NO: 132763 - protein, 91 aa, Heterodera glycines
  Coding regions on vcDNA: vcDNA=SeqID_59186; Strand=+; Position=1 -111,247-411
MPMPQLRVPKAKGTVPTPGEGMLCLEKRTERTERGERGFASVFPMEEFLAAFSFLSGANNCPLFQHSMKCIFLLNSFFLAIFCDSNQNIYG

SEQ ID NO: 132764 - protein, 106 aa, Heterodera glycines
  Coding regions on vcDNA: vcDNA=SeqID_59187; Strand=-; Position=1-321
MTRIIRHFRRRDQFELPTEYDGENELEKGGENGNDYYNYYQQRMQMDNEFIASLLNEDNANGNGGNANFLYRPQDETFHQQQQQQYNISNNGIDGVEFVLPQNGGE

SEQ ID NO: 132765 - protein, 44 aa, Heterodera glycines
  Coding regions on vcDNA: vcDNA=SeqID_59188; Strand=-; Position=1-229
LIKMPMLLHQREKEREREIEIRERIKKEEEKKKGGWERKGMRRL

SEQ ID NO: 132766 - protein, 91 aa, Heterodera glycines
  Coding regions on vcDNA: vcDNA=SeqID_59189; Strand=+; Position=1-276
MQARREEAEKQAANMGMEGGQMPPAMMMMMMSAATAAGGEGAAANSFTFAAPPSPAVPLDPHLERMFIQQPKHVAGEEQRPQHEDEENYDI

SEQ ID NO: 132767 - protein, 256 aa, Heterodera glycines
  misc_feature (7)..(7): Xaa can be any naturally occurring amino acid
  Coding regions on vcDNA: vcDNA=SeqID_59190; Strand=-; Position=1 -128,199-342,396-540,683-855,906-963
  Homolog annotation: Hit_ID=NP_741868.1; Match level="QueryCoverage =85%, HitCoverage=13%, E-value=3e-44, Identity=43%"; Hit description =apical Junction Molecule AJM-1, Junction Associated Molecule JAM-1, putative protein, with 5 coiled coil-
LSLKLSXAYSKTEVSTVPYSDGRHQSGYTVSTVPSEWGTGRDRHSRVVEVADTFVDRHSRVVEVADTFVDRQLAEAAPLAHRYGGRITLEEALDAIFQSTKPLEEKKSYSRTSKKSYSRTSRLSEQQNQLRNMDGPGIFSPDLALMERLAEQPHLAENLLKNEPLLVRCAFCACVRPLRDARSHFRWCRHCYTYYCSRQCRLSDWHRHRDRCSFARINSLCKEVIMKVRNKKQLVHILCKEVIMKVRNKKQLVHIT

SEQ ID NO: 132768 - protein, 31 aa, Heterodera glycines
  Coding regions on vcDNA: vcDNA=SeqID_59191; Strand=-; Position=1 -50,114-159
MKQLNREIIRVPKQMIRMQKALGKVMMNWKY

SEQ ID NO: 132769 - protein, 86 aa, Heterodera glycines; identical to SEQ ID NO: 130750
  Coding regions on vcDNA: vcDNA=SeqID_59192; Strand=+; Position=1-833

SEQ ID NO: 132770 - protein, 37 aa, Heterodera glycines
  Coding regions on vcDNA: vcDNA=SeqID_59193; Strand=-; Position=1 -33,224-302
LLPRNLKSIIPLDETLYFTNLSYFSSLAKSAFLCCVN

SEQ ID NO: 132771 - protein, 179 aa, Heterodera glycines
  Coding regions on vcDNA: vcDNA=SeqID_59194; Strand=-; Position=1 -206,275-608
MALLSDRFDVLVDTHFDGKTTELTIWRSVIIRKDKGPKAKIYADSKPVQFPFPDRPLPNKIRFKNLRIGYIDHSVLTFLRSNKQIWDRSGTNLELSIWPNKTEDDQPIWDVFVREIWPIFATNIRHLVFCNTDALDNLRRRISPTFLTDLDQLNSINSGNLFPDGIADDGPNGNAAGPL

SEQ ID NO: 132772 - protein, 124 aa, Heterodera glycines
  Coding regions on vcDNA: vcDNA=SeqID_59195; Strand=-; Position=1-373
MANSEGNDRFSHGQALHAFANIRRKMEQAERAVKRSLATMEVPLLMDKLFGETFFEVGFNGFGEKQSIENVRNELETIVQLNFTQNMMDKAKETLKLINGTRAEAESEATAALETIQMIGEEAQ

SEQ ID NO: 132773 - protein, 63 aa, Heterodera glycines
  Coding regions on vcDNA: vcDNA=SeqID_59196; Strand=+; Position=1 -21,606-776
MNTEIYLLSNLCQFPIKPINWPPAPNCDQNGQTQTNGDEHLLKCEQRMESANAQQKGQRTFKD

SEQ ID NO: 132774 - protein, 201 aa, Heterodera glycines
  Coding regions on vcDNA: vcDNA=SeqID_59197; Strand=-; Position=1 -100,836-1024,1116-1432
MYHIKHDLTLINPDKSGQRMVLLGQFEKVFCQNSWEVKALEQDFVEDGDEPSALEVPVEPICAGGDGTSSLTTTNGRQSTNGVDAMIGAGADHDKDNFLEFQLRKTAVGGFAIREANHCTLMMPPETIRHHSDGGDGGTSTAPQTTEEPKDEQTQQNEDKHAEPKPSSCSLLNPSPTIASVELDALKVQLEKVGREMRTLF

SEQ ID NO: 132775 - protein, 108 aa, Heterodera glycines
  Coding regions on vcDNA: vcDNA=SeqID_59198; Strand=+; Position=1 -150,1426-1602
MEQNEPQQQQGQEQQQQGQQQGQEPQGQGQGQEPQGQQQGQRPEMGKTPSRVRTYIDHLERQLETVRAAHAQEMATVRAAHAQVVDERDFLRRIIENFSNHAVAPTGQ

SEQ ID NO: 132776 - protein, 75 aa, Heterodera glycines
  Coding regions on vcDNA: vcDNA=SeqID_59199; Strand=+; Position=1 -70,126-283
MHNDIHLGNGGGNHWWQNAPGHGVPFGGAVANNGGQGGYGQNIVPGLNGGQGGYGQNIVPAQGDLLKTIQFIIFI

SEQ ID NO: 132777 - protein, 98 aa, Heterodera glycines
  Coding regions on vcDNA: vcDNA=SeqID_59200; Strand=-; Position=1 -321,1116-1447
KNRFFCFRGSTLNRCAQIYGETESFGNSFPIACTLILRWIFAPHNCLSTPNGHLKKSIFLFSGQSPRTDAPRFMGRPNPSGIASIYLYFIFTLDFCSP

SEQ ID NO: 132778 - protein, 45 aa, Heterodera glycines; identical to SEQ ID NO: 124527
  Coding regions on vcDNA: vcDNA=SeqID_59201; Strand=-; Position=1-138

SEQ ID NO: 132779 - protein, 95 aa, Heterodera glycines; identical to SEQ ID NO: 125597
  Coding regions on vcDNA: vcDNA=SeqID_59202; Strand=+; Position=1-676

SEQ ID NO: 132780 - protein, 68 aa, Heterodera glycines
  Coding regions on vcDNA: vcDNA=SeqID_59203; Strand=-; Position=1 -201,475-480
MDNRQFGATDQFEKFLATGRQRLQRECAELKRQKLVSARFERKRKRDNEMALLADEVDQLKFELVIKG

SEQ ID NO: 132781 - protein, 204 aa, Heterodera glycines
  Coding regions on vcDNA: vcDNA=SeqID_59204; Strand=+; Position=1-615
  Homolog annotation: Hit_ID=NP_497599.2; Match level="QueryCoverage =65%, HitCoverage=3%, E-value=2e-36, Identity=52%"; Hit description =myotactin, LEThal LET-805 (479.6 kD) (let-805C) [Caenorhabditis elegans] gb|AAK21414.2| Lethal protein 805
NAIQLAWLPPHPETSPVVAYRLRYGPAAGTYRPQEVILQGDELSCADYESRILTGEHLCTSATGLKPATMYRFAVQAQSSSGNWGPFTSDSFGTTEPELKAVEGGQLRLIGAGHDFLRVRWTAPPVIVAHIEQYEVDKAEDEIRNCTYLFKVAHPTDRTTCPSATTARSAGQSDGLPIQRVGAGDSVQRNGTRTGTAGEEPVED

SEQ ID NO: 132782 - protein, 301 aa, Heterodera glycines
  Coding regions on vcDNA: vcDNA=SeqID_59205; Strand=+; Position=1 -84,130-308,385-542,590-844,932-1090
  Homolog annotation: Hit_ID=NP_491515.2; Match level="QueryCoverage =100%, HitCoverage=79%, E-value=1e-138, Identity=81%"; Hit description=atpase (39.9 kD) (1F648) [Caenorhabditis elegans] gb|AAK85455.2| Vacuolar h atpase protein 16 [Caenorha
LKEKLVTEFTHLRNNSLEPLATFLDYITYSYMIDNYSYMIDNIILLITGTLHQRPINELISKCHPLGSFEQMEAIHIASNPAELYNAVLVDTPLAPYPYFVDCISEQDLDELNVEIIRNTLYKAYIEDFYNLCKKMGGKTAEVMCEILAFEADRRAIIITINSFEADRRAIIITINSFDTELNKEDRANLYPRCGKLFPEGLAGLAKADDYEQVKQVCEYYSDYKQLFENSGLNPGEKTLEDKFFEHEVKLNVQAYLHQFHFGVFYAFIKLKEQEMRNIIWIAECIAQRHRTKIDNYIPIL

SEQ ID NO: 132783 - protein, 325 aa, Heterodera glycines
  Coding regions on vcDNA: vcDNA=SeqID_59206; Strand=-; Position=1 -952,1310-1344
  Homolog annotation: Hit_ID=XP_518341.1; Match level="QueryCoverage =100%, HitCoverage=75%, E-value=1e-38, Identity=31%"; Hit description= PREDICTED: similar to KMQK697 [Pan troglodytes]
KSMRGSSKTNGTTSKPNMKQSNITAPPNATGENAEQSTLENANKTATNAEQNKIVAPNKTVTNAEQSNIVTPNKTATNVEQSNIVAPNKTATNVEQNNIVAPNKTQTNAEQNNIVAPNKTATNVEQNNIVAPNKTQTNAEQNNIVAPNKTATNVEQNNIVAPNKTQTNAEQNNIVAPNKTATNAEQNNIVAPNKTATNAEQSNIVAPKKTATNVEQSNIVAPKKTATNAEQSNIVAPNKTATNVEQSNIVAPNKTATNAEQSNIVAPNKTATNAEQNNIVAPNKTETNAEQNNIVAPNKTETNAEQNNVVASPNPPPNFVILITS

SEQ ID NO: 132784 - protein, 44 aa, Heterodera glycines
  Coding regions on vcDNA: vcDNA=SeqID_59207; Strand=+; Position=1 -42,371-463
MPIRPRRYDEAGLYFKELVAGRFANDRFANDRFDNTFSTMPFRQ

SEQ ID NO: 132785 - protein, 441 aa, Heterodera glycines
  Coding regions on vcDNA: vcDNA=SeqID_59208; Strand=-; Position=1 -92,158-312,406-749,824-1008,1054-1600
  Homolog annotation: Hit_ID=CAE60247.1; Match level="QueryCoverage =99%, HitCoverage=44%, E-value=2e-67, Identity=37%"; Hit description =Hypothetical protein CBG03821 [Caenorhabditis briggsae]
MSKFFRGAISSSESSESEESADEQIVQTRTIARDFAYPSDSEDEGPKRIVRTQKDKTYAELKEQIRSSRNARNIKDIAKLQTVFEAQLKLWEKAKTFIVRENLSIPRFYIRYLAELEDFINEQWEDKEGRKVWTIFNQFNREIEQIMSKANSKALASLRQKLKKYNKDFEEDLGTYRTEPDPMGYSSGAAEDDEDEEIPTAPAIATNDVNLKKRFMGAESESEGEESEWGTESDESSSASDLEPLEGKEMEELRRYFLKKDKTDRGKTKEKKEKAAQREKIALEKKKLEEADGQNEESWQKITYKHDVAKPLFDGQAEVTGDLVVKKLLELGANRGRRATNRKVYVRYLQELYKAADEHNLGVGLLAKVLTAIIAALFELNTRISDAMEFNSWMKSVFNCHFVSFAFLRTVETVDGLFSLLSEHPNVIISISTNEDEENIL

SEQ ID NO: 132786 - protein, 57 aa, Heterodera glycines
  Coding regions on vcDNA: vcDNA=SeqID_59209; Strand=-; Position=1 -121,351-403
MSTESVQLGQQQQEREQSPDLAGLNSDSGSEKRRLRVAKRGVPQFSNGIEEGETETD

SEQ ID NO: 132787 - protein, 72 aa, Heterodera glycines
  Coding regions on vcDNA: vcDNA=SeqID_59210; Strand=-; Position=1 -18,275-475
MPKGGGTFMTAFDLNLHMGTHTGFTYDCKDCGKCFPCRKTLAEHNRSHRMILSGGGGGSASPELSKKANHSF

SEQ ID NO: 132788 - protein, 213 aa, Heterodera glycines
  Coding regions on vcDNA: vcDNA=SeqID_59211; Strand=-; Position=1 -228,497-746,900-1060
  Homolog annotation: Hit_ID=NP_763435.1; Match level="QueryCoverage =58%, HitCoverage=21%, E-value=4e-12, Identity=37%"; Hit description =TPR repeat containing protein [Vibrio vulnificus CMCP6] gb|AAO08425.1| TPR repeat containing protein [Vib
MKLDNLLEQMMMMQQQQQHHQQQNQQGENEHGEGNVQQQKEQSQTQQKQQQKHRQQQQQQQWEEMPQNNVGTATNGNDVQSPNGDHQSFAELSASTDNAKRQKTNAFLAISNGTRNAAQCKDPFQSQNHQQMLTVGGFGENNGRESLPQHLESFSAFLRANLSLLSAFSPPLLPPQQNSVLPPILPSPIPQQIVPLSKEIASQGLLAVGGCRP

SEQ ID NO: 132789 - protein, 65 aa, Heterodera glycines
  Coding regions on vcDNA: vcDNA=SeqID_59212; Strand=-; Position=1 -119,968-1044
KAKCRGDRLFSTSSLGIRSKRTARGCSADGCCPSTETQSATRTAKSVRNNGRRRTPLDKAEPKKE

SEQ ID NO: 132790 - protein, 98 aa, Heterodera glycines
  Coding regions on vcDNA: vcDNA=SeqID_59213; Strand=-; Position=1 -192,449-553
LLSKHKLELERAKRKFGDNQRSLVDAKHSLDVIRQKHQATVDELGKIDLRLGKLHDELAEKHKNDQKKCFAELANEIVTKNKEDLKQLEAKEKAEAED

SEQ ID NO: 132791 - protein, 42 aa, Heterodera glycines; identical to SEQ ID NO: 125015
  Coding regions on vcDNA: vcDNA=SeqID_59214; Strand=+; Position=1-703

SEQ ID NO: 132792 - protein, 217 aa, Heterodera glycines
  Coding regions on vcDNA: vcDNA=SeqID_59215; Strand=+; Position=1 -259,439-833
MGTNVRGEKRSKEKAKGKANGEGKRRKASPEGEKCRINRQRKRQSDTKNTRIATTFGFCGRPKAIGRRSFGQFGREDSEQNIPGIKRIDFADSSSTSDSEECPNSIPSTSSDCRNRSISNEPKNPTKTKSNSLKEKHNRNKREKELEEGELISEEEMEKGEEKGGEDGSEPPPAAERATFEDDTGSQSDDDEEDGRLARRQKTEPQFVISRNKQLVF

SEQ ID NO: 132793 - protein, 146 aa, Heterodera glycines
  Coding regions on vcDNA: vcDNA=SeqID_59216; Strand=-; Position=1 -150,567-695,1186-1327,1579-1598
MSNSSNEQQQLGNGQSQNGSNRSSLNNAQANSSNSISPEVEDEVQGQPPEHNRILVDHNTLRTEHERILVDHNTLRTEHERILQRQLDDFHYWCLLFQIMTTIEENLLDGPPAGYCSSSEEDEEEFAVSRGAMPCSSAVRGDKSNR

SEQ ID NO: 132794 - protein, 134 aa, Heterodera glycines
  Coding regions on vcDNA: vcDNA=SeqID_59217; Strand=-; Position=1 -294,675-785
MAELKSRLENATDCTSIDAPSTICPSPPLRQVKHRHHTSALGRAVSLWTRWNKRRRKWLVDGPDSAMNSSIDSLLTPCTGSIPLFMGPSFPRFLRRLSHAENAHFRPNPSQQDDHRDDNDDKCQFCETIFAFVR

SEQ ID NO: 132795 - protein, 106 aa, Heterodera glycines
  Coding regions on vcDNA: vcDNA=SeqID_59218; Strand=+; Position=1 -129,191-284,872-969
MSRKVFKFMLEKNDGWLKKKLDEYLEENDYEFIDELINPPKDMMSNDHWTLRGRTREKSVLYQIVSEPTAGLDVAHKDPQAFCRLDNNVISLVENRPFFKFQQTNC

SEQ ID NO: 132796 - protein, 317 aa, Heterodera glycines
  Coding regions on vcDNA: vcDNA=SeqID_59219; Strand=+; Position=1 -176,491-1146,1247-1368
MDISRLRRICAIYASDGINGYPFSLAVIKKALESKLNVCSLLFLHLRRDLPDTLKNNPKFVALECFGFDSLEAIRKRLAKEDISRESLVFIDSLPVLIEQFSLPSTSWFLTQIAELSACVLALVHSSESEDDQNSEDWRRIESIASTVFELRARDKHTLCRTKTKKRNGTAEEKAMAIEKCTIKNRHLEVTRLFYFQLEQFSIEEDYSITFSPFDYSSDRTDDKFVENSISAGGTVGNGTATHLSTLPFDLGLNLSEEERKAKARVPLPYLDAQTEKGLVGLNISFNKKVRVGGRILYVPDKEDDFDESDPDDDLTI

SEQ ID NO: 132797 - protein, 181 aa, Heterodera glycines
  Coding regions on vcDNA: vcDNA=SeqID_59220; Strand=+; Position=1 -366,688-867
MFKSARGKGLRRVNPTTLLYSTKRDGNERWEEEVAIWEGIGDENENANGGEMLLTPIFAMPPNQSDGAAQMDEHLHQLVRICTIVHRQAYAVTQKLGRAVDAVNATDGESPRKACELLRIYEVEMENAIDSEIGICKEIERILRIRARGEVRGLRIKGETVAKVNAITNEIANKTMKIIEK

SEQ ID NO: 132798 - protein, 45 aa, Heterodera glycines
  misc_feature (14)..(14): Xaa can be any naturally occurring amino acid
  Coding regions on vcDNA: vcDNA=SeqID_59221; Strand=+; Position=1-136
YFVKLIIKIGLESXKEAFRQFERFYTCENERRDRRRIGIKHRKTI

SEQ ID NO: 132799 - protein, 60 aa, Heterodera glycines
  Coding regions on vcDNA: vcDNA=SeqID_59222; Strand=+; Position=1 -37,537-682
MEKERSERLINEMCVKMGGEFTDNQNENDLVTKKAKERMEKGGEFNKLEKQFKLKEHFKI

SEQ ID NO: 132800 - protein, 186 aa, Heterodera glycines
  Coding regions on vcDNA: vcDNA=SeqID_59223; Strand=+; Position=1 -321,372-441,693-862
  Homolog annotation: Hit_ID=NP_496545.1; Match level="QueryCoverage =74%, HitCoverage=34%, E-value=9e-17, Identity=34%"; Hit description =abnormal cell LINeage LIN-29, EGg Laying defective EGL-29, zinc finger transcription factor, heterochroni
NSVSNSSESASSDQHQQKPSLVLHSSTAANRPPMFPHSLLQGFTASASSSSSSAASGGGAVPNGAGGGAVSGASPATPSSLLQTDSKPSPTEMLLSTSATVPRTLMIASATAAQLAVAAQMSAMTPNQQQGSNREPKPFKCGHCPKAFANNSYLSQHMRIHLGIRAFGPCQFCGKKVAQTNFEEDK

SEQ ID NO: 132801 - protein, 310 aa, Heterodera glycines
  Coding regions on vcDNA: vcDNA=SeqID_59224; Strand=+; Position=1 -157,196-311,360-569,640-830,880-936,979-1180
  Homolog annotation: Hit_ID=BAB13307.1; Match level="QueryCoverage =66%, HitCoverage=24%, E-value=8e-28, Identity=40%"; Hit description =vasa-related protein CnVAS1 [Hydra magnipapillata]
TRQKFDLPSLSVDQLVSEQNQQIIGPDFELHQNVSVTVRGGKSNNGDQYLISSFQEANLSQQILQNLAQIRFIRPTVVQSRIIPLIMRTNEDLLCLASTGTGKTGAFLIPLLNILHMFCSIKELGNLLFPVNRHFPKAIIVAHTKELVLQIDKMARILADGTGVGIVLMMGELSYASINSRINRDGCDVLVATPGRLKEFLLKNRIELDCLQFLVIDEMDKFFSDFEFLQLFHELNEKKRQCKSTVWPFRTFLFSATSDSLDGVVPFLRPDFFHVIAGPVNQSVAHVRQRIISTNIFMRIHQLELILQRE

SEQ ID NO: 132802 - protein, 88 aa, Heterodera glycines
  Coding regions on vcDNA: vcDNA=SeqID_59225; Strand=+; Position=1 -132,543-585,702-793
MVNGCSILKQKKTTTGYCIRILTQDDWTGLDDNASIDFVDKNGTIKTIEVRQLRVKKENIDPKQWLQRNPNDMITFKRNGPYGIQTDR

SEQ ID NO: 132803 - protein, 26 aa, Heterodera glycines
  Coding regions on vcDNA: vcDNA=SeqID_59226; Strand=-; Position=1-79
MNIINEEMNIVNLFNLYVHDNDENLS

SEQ ID NO: 132804 - protein, 119 aa, Heterodera glycines
  Coding regions on vcDNA: vcDNA=SeqID_59227; Strand=-; Position=1 -165,498-689
  Homolog annotation: Hit_ID=NP_741452.1; Match level="QueryCoverage =64%, HitCoverage=21%, E-value=1e-23, Identity=49%"; Hit description =IMP cyclohydrolase (67.4 kD) (4I663) [Caenorhabditis elegans]
MSTFSDFIALSQRCDELTARIINREVSDGVIAPDFDDAALSMLAKKKNGNYVVLKVACVAVKYAQSNAVCFAHRGQVNDQSNKSNLKGREKNGIGKVPLVKMPENAFIIELAVDQFHVQ

SEQ ID NO: 132805 - protein, 222 aa, Heterodera glycines
  Coding regions on vcDNA: vcDNA=SeqID_59228; Strand=-; Position=1-669
MSSESLHIKPQASGQTIYQNPNLQLIGQPNYQNPNPQLIGQTNYQNPNPQLIGQTNYQNPNPQLIGQTNYQNPNPQLIAQTNYQIPINPQPIGQTKLTHNLPTEVLSLDMLSLGDTSQNQAQQMAIAPANLANSTETVRPNDKTTTSKPRKKKNSHDPFADNAGNQMPTQYPKVPISKWTNHRLPVHPKELIAKGQFDVKKKFPAETNGLDKIAEFMDDTGE

SEQ ID NO: 132806 - protein, 205 aa, Heterodera glycines
  Coding regions on vcDNA: vcDNA=SeqID_59229; Strand=-; Position=1 -116,826-906,1382-1802
MSRQNFLLYHQGIALLSDKLAPIHVKFSSETPWTLGMKAPGLDPGLEEPGFFLDLDFPGFLSRKSRNCSPMELLPFFLFCASFFCVPLSQVKAASKNGPIFDASPPRDRPNQKPSLTDLSSIGQNKKGAANAWHLPERAAETASAEAANVTSSSSTQADSSHSSRRQTVDITKSRRTRRPSIAENEPITKQLNDLAIQERIHWVS

SEQ ID NO: 132807 - protein, 113 aa, Heterodera glycines
  Coding regions on vcDNA: vcDNA=SeqID_59230; Strand=+; Position=1 -111,752-805,1378-1554
MTWTWIQEKSRPGSRSRSSSINMYYNVFIFTRFSFYEFLSEKINKINNKIDEQQKQLEGMTNDEEDKEEFDNEEEEELEENEGRQFWWPMMREKRGRRRRRRKNFTMRRRRNW

SEQ ID NO: 132808 - protein, 97 aa, Heterodera glycines
  Coding regions on vcDNA: vcDNA=SeqID_59231; Strand=+; Position=1 -155,205-343
EEYVKLCFELSNCAAQSLGADWLKSSDKQFLRLLASLSSGRLRILLDKPEEIDMAQLIACLQLQEYFCGCVEDEQIWMSDDEQVFLSFMKRVDKTVE

SEQ ID NO: 132809 - protein, 27 aa, Heterodera glycines
  Coding regions on vcDNA: vcDNA=SeqID_59232; Strand=-; Position=1-83
TKAPEQGGQVAGQAKSAARAKPSRLFG

SEQ ID NO: 132810 - protein, 22 aa, Heterodera glycines
  Coding regions on vcDNA: vcDNA=SeqID_59233; Strand=+; Position=1 -39,144-173
MNISLCILQNQQSFELFCFFVF

SEQ ID NO: 132811 - protein, 52 aa, Heterodera glycines
  Coding regions on vcDNA: vcDNA=SeqID_59234; Strand=+; Position=1 -22,66-202
MLPNDHKKENKLRKLKQYYEIKESNPKMSDEIIAKKLGIGSATLKKWKKEFV

SEQ ID NO: 132812 - protein, 127 aa, Heterodera glycines
  Coding regions on vcDNA: vcDNA=SeqID_59235; Strand=+; Position=1-384
MASSGASPLSYSNPDESLTPSSTNASTPTATNGATTIVGGQPHNGTSSNMGNGTAMLQGNFEVIGSAGGIAHFASSAGGESNCSSSSSSVVVHKGKKSKKDKSVRKGREGIHGKGIPRGQNRNAISE

SEQ ID NO: 132813 - protein, 16 aa, Heterodera glycines
  Coding regions on vcDNA: vcDNA=SeqID_59236; Strand=-; Position=1-49
EAIPEGFGLPINLGAS

SEQ ID NO: 132814 - protein, 45 aa, Heterodera glycines
  Coding regions on vcDNA: vcDNA=SeqID_59237; Strand=+; Position=1 -52,314-399
MSITQNKVHIHDQRPKLRITFFILIVEKCKNNDKILPIFLHFLII

SEQ ID NO: 132815 - protein, 483 aa, Heterodera glycines
  misc_feature (473)..(473): Xaa can be any naturally occurring amino acid
  Coding regions on vcDNA: vcDNA=SeqID_59238; Strand=-; Position=1 -73,1086-2420,5016-5082
  Homolog annotation: Hit_ID=B36329; Match level="QueryCoverage=98%, HitCoverage=38%, E-value=7e-92, Identity=40%"; Hit description =hypothetical protein 2 - cabbage looper transposon TED  (fragment)
GSHQSRYPGRVGDFGERLEEMSRNDSEKDKMQQFWLGFSDVFALNEFELTQTDLFPHEIKTENATPIKTAPSPIPFGVRTKVTEMINDYLKREIIRPSNSPWASPIVLVAKKDGSRFCVDYRKPNSVTIKDSYPIPNIDQILMYLGNKHYFTVLDLMSGYWQVRVKEEDIEKTAFTVPGGLYEFLVLPFGLCNAPATFHRFMNKILGEFVNDFVFVYLDDILIASKTFEDHMVHLRKVFEKLNENGMKVKAEKCGFALDQTPYLGHILTREGLAKDPEKYKPIKEFPMPKTIKELQRFLGMVNWHRKFIMNFAKIAAPLTKMLKKQDAKVLIWSDEAKKSFESLKSLIVQEVVLKYPDFNLEFHIFSDASKDGLGAVLCQRDQSGKMRPICYASRRCKQTESNYGPTVLECLGIKFAVQKFKHFIAWLPTIVYTDHKALPQMFKSKNSVGNSKVDRWIMELALATKSFCAKRXFQHTQSNAFS

SEQ ID NO: 132816 - protein, 82 aa, Heterodera glycines
  Coding regions on vcDNA: vcDNA=SeqID_59239; Strand=+; Position=1 -120,334-462
MPLHVPASFPRPPLQTFFPRPPPPLPCPQPFSTSNQQFSNNAGAAELIEAYAGMNDDRTNSTTEFWLTEMGAVLNTEHPQDA

SEQ ID NO: 132817 - protein, 45 aa, Heterodera glycines
  Coding regions on vcDNA: vcDNA=SeqID_59240; Strand=-; Position=1 -31,237-343
MPRKDRSSSWSAPHFPSAQLQTADGVPTLQKAAEGTDPARTPMPR

SEQ ID NO: 132818 - protein, 122 aa, Heterodera glycines
  Coding regions on vcDNA: vcDNA=SeqID_59241; Strand=-; Position=1 -177,418-492,551-667
MSQYSIAQVCNHGASIILDPLSNIIRFVHCALGVAILIGVAALIRQCQRSRFIFHGNLMLLIANVLCLYIVYTIALIGMAGRSLALYLFWPVAQFVQQPYNNSSGGNISNSSDGTEMAADKK

SEQ ID NO: 132819 - protein, 48 aa, Heterodera glycines
  Coding regions on vcDNA: vcDNA=SeqID_59242; Strand=-; Position=1-148
FEYPKRTLEKIDFFVFGAVPPNRCAQIYGETESFGNSFPIACTLILRW

SEQ ID NO: 132820 - protein, 90 aa, Heterodera glycines
  Coding regions on vcDNA: vcDNA=SeqID_59243; Strand=+; Position=1-344
LYESNKLIKACVSQPVLPNLNFVGSKVKSEFCSIKMKNDRLDCNTGNVFVFIIRYAEGTTDHELIWSGKAVHFFHADFAGTFHQCPVQYL

SEQ ID NO: 132821 - protein, 644 aa, Heterodera glycines
  Coding regions on vcDNA: vcDNA=SeqID_59244; Strand=-; Position=1 -25,179-296,345-436,498-626,672-706,811-1022,1117-1275,1326-1433,1492- 1631,1688-1767,1854-2040,2410-2580,2620-2775
  Homolog annotation: Hit_ID=AAD09400.1; Match level="QueryCoverage =99%, HitCoverage=90%, E-value=1e-109, Identity=37%"; Hit description= gamma-glutamyl transpeptidase precursor [Brugia malayi]
WCSENRNILLQGGNAVDAALSVGFCVGALNPHSAGLGGGFLMTYYQRFYGKCTTIDFYGKCTTIDARETAPARTAKDTFGNGPKEDNSGYKSVATPGLLHGFWTSSGYKSVATPGLLHGFWTSFKRFGSGKIAWMDLLMPTVHLLTDGFPVSKLMEKTLLLTDGFPVSKLMEKTLGLKALRKQTFPKNHFINPATSDLYKEGEQMRDGILAETLKRLALSHEPLQLFYSANGEIARIIAEEFANNGGFITRKDLHTYRTVVDEQPLLVTSAAEPKLVFCGAKPSSSFAITQLILAVMLKFYPPGSNASIPWHSADYYHRLLKFYPPGSNASIPWHSADYYHRLIESQKRAFAIRHKLGDVKFDKDVKFDKISEEIALNMSKSEMVDEIASEIQRRARPNGHFAESTKEANSGGTTQVIVVDADGNAVSITNSGGTTQVIVVDADGNAVSITSSINKAFGSLIRFGSLIRSPQLGIIWNDHMDDFSQPNRTNYYGLAPSKTNFIEPGKRPMSSMSPLIVYHKENKKKLAIGASGGTMIPTALSQVLVQLLAFNHSVKEAIDTPRVHNQFTPFVTDFEEEFPQSILQSLRARGHSILQSLRARGHNMTTNSRDFSASVQAVLTDDEGNLVANNDFRKRVHSCPVGY

SEQ ID NO: 132822 - protein, 67 aa, Heterodera glycines
  Coding regions on vcDNA: vcDNA=SeqID_59245; Strand=-; Position=1 -95,227-335
MARNGTNTNNNNNNSHHNNNNQRTANILMRKKTSQLSVCIKTGSMAQIRRETWTRRSGRRLAYDPYA

SEQ ID NO: 132823 - protein, 188 aa, Heterodera glycines
  Coding regions on vcDNA: vcDNA=SeqID_59246; Strand=-; Position=1-567
MLFLLFIFVFLIINNSTDKTLSVNLCKKCRPTFAEIFGEEWQNEIIIGGDENENETDQNANFHQNDQNELTDQTDQLDVQQKNEIIHKFHAIREGIKKKGKYSAKFWVKTEQKIAKKLGINRPKIYEWKKEFGIYYYKKKKQEFIERIEEIKRMSKYGKQKQFAKELGINRATLSKWKKEFGIEIGKK

SEQ ID NO: 132824 - protein, 77 aa, Heterodera glycines
  Coding regions on vcDNA: vcDNA=SeqID_59247; Strand=-; Position=1 -209,414-438
MRGTSSRGTSQNAKENGSRRRRSMPFIHSLNVIGKVVVVAAFTENCTRGGFRSSLDLIFFLNGGNGKLERKSLKTFK

SEQ ID NO: 132825 - protein, 216 aa, Heterodera glycines
  Coding regions on vcDNA: vcDNA=SeqID_59248; Strand=+; Position=1 -30,82-220,287-462,505-810
  Homolog annotation: Hit_ID=NP_496595.1; Match level="QueryCoverage =95%, HitCoverage=43%, E-value=2e-21, Identity=32%"; Hit description =splicing coactivator SRm300 like (49.4 kD) (2M517) [Caenorhabditis elegans] emb|CAB60765.1| Hypothetical
MILFNKKIGVGFSESEITSKVNEYRKLLFTEFENGRLDMDTELDLRNTHSRAKVAKDNRDKWRSALRIDAAFVDGSSLEKLKKASESVVEMAKNVDKKALDKEMEKSLMEKLMEKIKKEKEQKKERKKMKRAMRKESSSDSSDSTSSSDTSSSSSESDDSSSTSSSSESSADEKAKRKRKADEKEKRKRKSNRRRSEETKVKREPIESPVGKRSRK

SEQ ID NO: 132826 - protein, 115 aa, Heterodera glycines
  Coding regions on vcDNA: vcDNA=SeqID_59249; Strand=-; Position=1 -42,77-176,356-465,798-893
MDPGPAELCLFVSHENQKINHNRNNRRSKVYFYNKISIFLKFGFQQIGNPWHKQLNGQGQRSSIFLLNDVNEGHGQEDAELLNEDSADSRYLGEYFIDPLKLPRDIAYSLNELIG

SEQ ID NO: 132827 - protein, 106 aa, Heterodera glycines
  Coding regions on vcDNA: vcDNA=SeqID_59250; Strand=+; Position=1 -213,917-1024
MTPSAVLGFQGFGIGTALLNEAQKYAQRQWHVAEMQLEVHGVRRPIGQGEIGPMTAQMNFYAKRSYRRTGKVRWFNKPSDANFVVVPSHLAYLELMVKHLSEFGDY

SEQ ID NO: 132828 - protein, 46 aa, Heterodera glycines; identical to SEQ ID NO: 131652
  Coding regions on vcDNA: vcDNA=SeqID_59251; Strand=+; Position=1 -45,194-235,469-522

SEQ ID NO: 132829 - protein, 90 aa, Heterodera glycines
  Coding regions on vcDNA: vcDNA=SeqID_59252; Strand=+; Position=1 -213,480-539
MTPSAVLGFQGFGIGTALLNEAQKYAQRQWHVAEMQLEVHGVRRPIGQGEIGPMTAQMNFYAKRSYRRTGKRKMFSLNFLHFLFYFSQLF

SEQ ID NO: 132830 - protein, 76 aa, Heterodera glycines
  Coding regions on vcDNA: vcDNA=SeqID_59253; Strand=+; Position=1-231
PINANASSSIEQQNKKEIDQMGSKLPVKSGLNKIEWVLSSQKKRSVNLDNTEIYNELSTSNESIERLNLKECIKKR

SEQ ID NO: 132831 - protein, 139 aa, Heterodera glycines
  Coding regions on vcDNA: vcDNA=SeqID_59254; Strand=-; Position=1 -151,360-472,913-1065
  Homolog annotation: Hit_ID=AAK39230.1; Match level="QueryCoverage =94%, HitCoverage=29%, E-value=3e-33, Identity=50%"; Hit description =Suppressor/enhancer of lin-12 protein 12 [Caenorhabditis elegans] ref|NP_508175.1| Suppressor/Enhancer of
FFQKCLQSIELEKRLLESGLRFPGKNLQKIIKFKNEKILEGAMLEKSPHSSGVKLGLGDFIFYSVLVGKASSFGDWNVTIACYVSVLVGLAFTLMLLALYRKALPALPISIFTGIIFFFATHWLITPFLAQVSVRQILL

SEQ ID NO: 132832 - protein, 65 aa, Heterodera glycines
  Coding regions on vcDNA: vcDNA=SeqID_59255; Strand=-; Position=1 -44,155-308
MTWTWIQEKSRPGSSTECPPPIVTDQAVISQVRSAHDKVGLAFLFLAILTNIGPIRKNDFMQFEM

SEQ ID NO: 132833 - protein, 20 aa, Heterodera glycines
  Coding regions on vcDNA: vcDNA=SeqID_59256; Strand=-; Position=1-60
EEAKVRELIKRGEYVVKELE

SEQ ID NO: 132834 - protein, 90 aa, Heterodera glycines
  Coding regions on vcDNA: vcDNA=SeqID_59257; Strand=-; Position=1 -84,438-532,585-678
MRPVHGQRELMHHECMQRNPTLHRRDQFKKGGSRPAGGGAAQQAVTPPPAAGTALGGLGKYFTALPQGVKVKHTKTHAQTTNDNTQLHPF

SEQ ID NO: 132835 - protein, 77 aa, Heterodera glycines
  Coding regions on vcDNA: vcDNA=SeqID_59258; Strand=+; Position=1-234
MSTIFPPLPFVAIFLFALFANSANAWKKEANSVESADGHTKAFMDLIRFILPMEEPEGSEEREGAKAETEEGAEEAG

SEQ ID NO: 132836 - protein, 89 aa, Heterodera glycines
  Coding regions on vcDNA: vcDNA=SeqID_59259; Strand=-; Position=1 -210,269-328
MTVRLVNAVHLLLRLIKVDQLIKAVAHFAVDQLVTMATVKQIPTRFPAECVEHCRALFLIISCASINAENHYLEAIGNLTFKYYHTIYN

SEQ ID NO: 132837 - protein, 128 aa, Heterodera glycines
  Coding regions on vcDNA: vcDNA=SeqID_59260; Strand=+; Position=1 -24,75-192,265-345,418-498,571-651
MPHDWDAIGWSPSEDEASDDGGTEGQEAAAKSAVVQPKTTSGRTKKEAPKEGSVTAAKSAVVQPKTTSGRTKKEAPKEGSVTAAKSVVVQQKATSGRTKKEAPKNASVPAAKSAVVQPKPTMGGTKKE

SEQ ID NO: 132838 - protein, 236 aa, Heterodera glycines
  Coding regions on vcDNA: vcDNA=SeqID_59261; Strand=+; Position=1 -199,288-442,664-1020
MNNKYFFYLLHGTGEPSCSHAEYFIHSFIREKNAFTVLASGTIGYRINNDDTTVSVSSCGSSSTADVIIFHENFDTKSFLSLVIMKPNMNLNKMSQKHGFSDFWVQDSELANIGFIFMPKTAAGPGGLPAYIPTPIAQLEKEQKERERRREERRARKEDGQPKKEKEHGAEKQSDDAKAARQREQMEQQNDRGRRESVGEGESVLGGGAGSSRETVKEREGGQRNEIKKNKLIIFY

SEQ ID NO: 132839 - protein, 40 aa, Heterodera glycines
  Coding regions on vcDNA: vcDNA=SeqID_59262; Strand=-; Position=1-204
ELLVLFDRSMCLLLICKISKILVKFQKSYGQKELKNPVIR

SEQ ID NO: 132840 - protein, 207 aa, Heterodera glycines
  Coding regions on vcDNA: vcDNA=SeqID_59263; Strand=+; Position=1 -182,225-666
  Homolog annotation: Hit_ID=NP_507780.1; Match level="QueryCoverage =76%, HitCoverage=10%, E-value=4e-23, Identity=36%"; Hit description =predicted CDS, DNA polymerase type B, organellar and viral family member (5T899) [Caenorhabditis elegans]
MPVKLESLKATFNLDCEDKPFFPYYYNKKENYGIRLEHLPPMEDYSPGSMNKDKFIKFEKWYNENKETPFYLDDELKNYCRNDTEILFLSIIEFRRILINDITKGFDPLPRSCTNAGVAMNIFKAMFLLTEQLSIVPEKGYERCDRASVMAIKYLEWRSQRDGIEIRRGRGTDERSKLENINWMDLLRITELGTNASRLWDVTYTDV

SEQ ID NO: 132841 - protein, 56 aa, Heterodera glycines
  Coding regions on vcDNA: vcDNA=SeqID_59264; Strand=-; Position=1 -48,177-299
MYVRLNQQILFPLNWPACPENSACRLYTGQDNGFICCRVQLQSSPFSSRRVHRFLH

SEQ ID NO: 132842 - protein, 48 aa, Heterodera glycines
  Coding regions on vcDNA: vcDNA=SeqID_59265; Strand=+; Position=1-146
  Homolog annotation: Hit_ID=CAE59446.1; Match level="QueryCoverage =93%, HitCoverage=53%, E-value=9e-09, Identity=60%"; Hit description =Hypothetical protein CBG02821 [Caenorhabditis briggsae]
MPAVPSGYQVVQQGRQGPSCMDKLKLGFAMGVLIGGSTGVLIGTFTSL

SEQ ID NO: 132843 - protein, 206 aa, Heterodera glycines
  Coding regions on vcDNA: vcDNA=SeqID_59266; Strand=+; Position=1-621
MGYEFPFSSAELTWAKVKLGEKVMAAAVAAQAFDVKADLRKHTLFVEPVVINEISTRSVVIQFVMPVTSIEELTELCKIWEIDLAVGCKVNPAAKAKPCAHGYVLSIKKRALCRGYEIDVKVILSYQEAKDQDAQEEFDQMRCGELDGCVELIPQTSVRALQERMFTLRSNDCSKVATDEGKVGRIMSILLGRPVKPESPKANNPL

SEQ ID NO: 132844 - protein, 111 aa, Heterodera glycines
  Coding regions on vcDNA: vcDNA=SeqID_59267; Strand=+; Position=1 -113,322-418,477-600
MRSVKHGGKKGMRFRYKLSAVKRQNKKQKKKQRNIAGCSLIKKAWQTQLSSRQNLSAMGLVYDPNEALKKNPEFAMEMDQSEIEVIGLPEAKALGSVKEQKKATKSKKAFP

SEQ ID NO: 132845 - protein, 60 aa, Heterodera glycines
  Coding regions on vcDNA: vcDNA=SeqID_59268; Strand=+; Position=1 -58,133-256
MPSGGDDEQQFEEAVKPALESLLADLQKTTEVLRQGKHGKGRRQQKEDESAALLDLKKLR

SEQ ID NO: 132846 - protein, 38 aa, Heterodera glycines
  Coding regions on vcDNA: vcDNA=SeqID_59269; Strand=+; Position=1-114
FRFSHSVTGDASFVYANLSLNLSWSVLPNIQRITRHAL

SEQ ID NO: 132847 - protein, 473 aa, Heterodera glycines
  Coding regions on vcDNA: vcDNA=SeqID_59270; Strand=+; Position=1 -452,865-1072,1119-1679,1726-1860,2033-2098
  Homolog annotation: Hit_ID=NP_507780.1; Match level="QueryCoverage =41%, HitCoverage=14%, E-value=2e-09, Identity=25%"; Hit description =predicted CDS, DNA polymerase type B, organellar and viral family member (5T899) [Caenorhabditis elegans]
MENYKLMDYQTTTCQKFGFTKNITEFRVNPDVERPDEAMKDAIDNMIKVALKTTEERMKRKVRMFGVAITGAGLAFPVWVPYRAYPQNNADVIMQEINKLGQSGDGDENKKMLLLSEPVTMKITCVTMPSGEGPRNVHKFDFGFKEHQRIGITNVDKLCLFYALVASKFYLELHVDSFRRFMKNIVRQRDAAIELLRNCGIDGNEISYGVEQLPTVQNYWDEIYPGKYRIVAFEKSADPRKSIRVLWKGPMGRESVVPIFLENGHWDGLKNYVCFFNRGKKFCVDCECFYYQDVKHTMECRARCYYCNKVGGVPCQKESGVKIECPKCHRYFYNWECYNYHQGHQTCKLWRRCVICDKTYLFNTKKGHECGETYCQLCSVSHDPKRGCYIIPIEEKEEKDVYRIVVWDSETSQDSIYKGDQKEHIINYISARVTCTECCDDKNRTNCNICREVILFLITSAVPGRTRYRSSMD

SEQ ID NO: 132848 - protein, 37 aa, Heterodera glycines
  Coding regions on vcDNA: vcDNA=SeqID_59271; Strand=+; Position=1-111
MAEEAVVVPEMESLALTSSSPCSPVLSLLSEEMLQKE

SEQ ID NO: 132849 - protein, 253 aa, Heterodera glycines
  Coding regions on vcDNA: vcDNA=SeqID_59272; Strand=+; Position=1 -282,330-419,459-497,543-678,731-945
  Homolog annotation: Hit_ID=NP_740883.1; Match level="QueryCoverage =79%, HitCoverage=38%, E-value=9e-45, Identity=44%"; Hit description =ubiquitin domain and Ubiquitin-associated domain containing protein (54.1 kD) (1H603) [Caenorhabditis ele
PSTSTASAATTPSVSTAPTGGAAPNLAGTPPSLGGIGDLFNNPELVQGILNSPFMERSAIMFVYKFINHFSMLANPDIIRTMLSQNPQFQQIIQNNPELGHIMNDPGTMRQAMEMIRNPTALNELMRNHDQAIRNLQGIPGGEAALQRLYERVQEPLMNLTQPGADNVAGSGAQNTTDASMAASRSQHAGVENAQPLPNPWSSIVNQQNRQAAGSAGNAPAQGAASTGLPFASKVNEYRIVYGLDKGLQILIV

SEQ ID NO: 132850 - protein, 125 aa, Heterodera glycines
  Coding regions on vcDNA: vcDNA=SeqID_59273; Strand=-; Position=1 -55,417-739
MRRSRFSYGTAGFFMDIKVGPNSRVYYGRFRFAEAEFRRVVVKVPSKDAFRVQSIIAETRINAQLRHPRVVEYVGFYRDAFDDVRIVSEFMAGGDLHTFLVDKRNVRRGISFLYDSASNSHRLRH

SEQ ID NO: 132851 - protein, 765 aa, Heterodera glycines
  Coding regions on vcDNA: vcDNA=SeqID_59274; Strand=+; Position=1 -183,267-353,949-1012,1057-1172,1465-1635,1701-1824,1884-2110,2178 -2462,2515-2877,3245-3515,4326-4731
  Homolog annotation: Hit_ID=EAA07881.3; Match level="QueryCoverage =38%, HitCoverage=98%, E-value=9e-95, Identity=52%"; Hit description =ENSANGP00000018227 [Anopheles gambiae str. PEST]
MVQNQQQQKAHEVGEVNAESQKRQTTTREDETAEGQKQITEQQQINSNNSSNTTPTTTTVKVGFYEVDRTIGKGNYAVVKLARHRITKTEVMETNNMLYLVTEYAPNGEIYDLISKQKKLSEEMAKQKFWQIISAVDYLHNLNIVHRDLKAENLLLDANLQIKLADFGFSNFFSYDGTLDTFCGSPPYAAPEVFEGKRYAGPEIDVWSLGVILYVMVCGVLPFEGLNLQLLRDRVLSGRIRIPYFMSSDCENLVRRMLTVDSRRRPTIEQIKHHRWMRYEEFAPKYELNEQERHAATEQHVAEPHPQILRLMNNIGIESEKIKNAIQADAYDNFHAIYLLLLERLRGHPLSRSHSASSHANHPLVNSPSATSLPSPTAPHAQAVLASPTTKAAPAVVLTESAGGGDSGEQRPPIIRGVTIRRQSDGIAIVGGAVPCHCYCCSAARAHPMLQSIQPQYAPLGIMTRFAQHQQTRRDSDGIAMQFAYQMQQQKQQQQEELARGVQNTQQKQQQQNNVVVGHVAAQPQQKTGRQQNGTQLGTMCCPDDSAATPSCSHAAGGGPGGLSLFGGVALPPLHHQPPIGATAFCGADQLPPFDSQLSQDPLFSSQSSNKSATAFRPISGSRSTNNSENGCCYGVAPAGIVVGPSGGSSNLLIKNAQAQPPPMFPNNHANTHLHHRLHPHLLQPYQQQQLPPFLQQHYCQQQQQQLTTLSARAHGTTTNETTNEDGAGGDAAMQRQHQQQQQQQQNSLCPQQHMGMMCENGWRA

SEQ ID NO: 132852 - protein, 440 aa, Heterodera glycines
  misc_feature (241)..(241): Xaa can be any naturally occurring amino acid
  Coding regions on vcDNA: vcDNA=SeqID_59275; Strand=-; Position=1 -80,471-627,688-823,1117-1188,1362-1449,1496-1652,1799-1931,2005 -2183,2384-2459,2524-2692
  Homolog annotation: Hit_ID=CAG01422.1; Match level="QueryCoverage =99%, HitCoverage=37%, E-value=5e-73, Identity=36%"; Hit description =unnamed protein product [Tetraodon nigroviridis]
APDSLIMEKPIWSTWATFWVAVNQTQVESYVDEINSYGMPISQLELDDMWTTAYGDYQIDSAKFPNFAGMVNYIRNKTVFVEAWVFVEAWVHPFVNDDSKNGHLSLRNTIFMKSSQGDVPLTWWGLSGILDLTNSDTRDWWRTQLKNMQKALGIYTFKFDAGETNWFPKNFALNYGQNPNSSFGRDYAHFAAEFGPFGRDYAHFAAEFGPAVENRYGSNSQDANIFMRTMDRSSYWLNTEXLKKHIFQALQASLHGYYWNLPDMVGGNGIDHSPTNIKGTPEEELYIRWTQANAFLANAFLLAMQFSYPPWHELQSEVVEQVKNVLELRAKWPYILESVEDAVKNGEPVIRPMWWSSDNATFAYGCKDQYMVGWKLVVAPVLQKGKTVVAPVLQKGKTKRDIFLPRGEWKDGKGEAAIIVGETLLKDYEVMLFKIKRIIF

SEQ ID NO: 132853 - protein, 18 aa, Heterodera glycines
  Coding regions on vcDNA: vcDNA=SeqID_59276; Strand=-; Position=1-54
MNQGAQRPLEKPKKRQVK

SEQ ID NO: 132854 - protein, 269 aa, Heterodera glycines
  misc_feature (18)..(18): Xaa can be any naturally occurring amino acid
  Coding regions on vcDNA: vcDNA=SeqID_59277; Strand=+; Position=1-813
  Homolog annotation: Hit_ID=NP_920205.1; Match level="QueryCoverage =91%, HitCoverage=17%, E-value=2e-54, Identity=45%"; Hit description =putative DNA helicase homolog [Oryza sativa (japonica cultivar -group)] gb|AAP52492.1| putative DNA helica
IYPLLYLVGTRGWNFDIXNQDGKRISYCDFTKFKLFFRQNYFLPHHYSKKLFQQWVVDQAARVEWGRLNFIRTHQKELRACSYKGLEDFLYKAEQTGSIIRKQVILPSSFLGGPRNKDQHFIDSMAIVGENGKPDLFLTYTINPEDPDIKKCLLKNQKTEDRPDIVARVFKLKYDKLIEEVVKGEIFGKVIAYCWVVEFQKRGLPHLHFLITLHPKDKFKNTNDIDRFIHANLPNKEKEPFLRSLVKFMLHGPCGINKTAPCMRNGNMR

SEQ ID NO: 132855 - protein, 18 aa, Heterodera glycines
  Coding regions on vcDNA: vcDNA=SeqID_59278; Strand=+; Position=1-56
YREAIPEGFGLPINLGAS

SEQ ID NO: 132856 - protein, 69 aa, Heterodera glycines
  Coding regions on vcDNA: vcDNA=SeqID_59279; Strand=+; Position=1-208
MEMNCEGLKGPKQWQRRRPPLTVEKVAAKAEQQQPTRRRRRRAVQAAAKNCWWWMKMQKRVVVLALVLM

SEQ ID NO: 132857 - protein, 65 aa, Heterodera glycines
  Coding regions on vcDNA: vcDNA=SeqID_59280; Strand=+; Position=1 -25,110-282
MLSFTKFDSQCYKQRKAETTAPYNFHGVPTVHVGGGVHRLSVPGRTNAGAFGGQIKIARRTRGST

SEQ ID NO: 132858 - protein, 40 aa, Heterodera glycines
  Coding regions on vcDNA: vcDNA=SeqID_59281; Strand=-; Position=1-121
MHPLVQAASAEAGPKIRRNRAKRLSHRNCEGIDRKLFIVR

SEQ ID NO: 132859 - protein, 696 aa, Heterodera glycines
  Coding regions on vcDNA: vcDNA=SeqID_59282; Strand=+; Position=1-2089
  Homolog annotation: Hit_ID=NP_920591.1; Match level="QueryCoverage =30%, HitCoverage=14%, E-value=1e-47, Identity=46%"; Hit description =putative retroelement [Oryza sativa (japonica cultivar-group)] gb|AAP52878.1| putative retroelement [Oryz
MKAGTLYVSQYARIEEEMLEYRSRLNTLPLATLRTIQRPNITEVIKLIKAEANETLGVVFGNTGWIEMMKNIPEKARNIVNYVKGISVVLIAVGIIILTVIVIYVIVKYRFIIMAGLRAGTIMARVIRAIFGVKRRTRVAAVPTAPDLDSVDQEAYILDYLPPRVAAITNDPRKLPSIRVYLNGLPTSALVDSCASVSYCRQRTAIKAGLEIKDLGSENPNLTAANNSSIQIIGKANAKLRVGDTETGKCAEWEVTLLVSIDKDCPGPLLLGLPLLSDLKGVIAFGEQKVRIGEIWTNIVSVLEADKPNQIKVSLDQTETFEPRTENIITARVNECFSANQNFLVKGIKHQYPSIIIGRTLVTPGDSNCVTIQILNAGKMPVKVYKGSNIAELEMVKINALPGDEIPPKDYIPPETKWHEKLPYLPTEGKKRLPSERINLTGTRLSTKSQTELKNIVDKHDEAFVGDDGKIGLYKGPIVHKIDLVPGSLPFHFRPYRYPPETQKEIERQIKIMLDQNIIRESESEFASPIVMVPKADKKSWRFAIDYRSLNKMTKKRVFHLPNIQELLDLMGSKKYYTSMDMQSGFMQIPMSTEDIDKTAFISHLGIYEFITMPFGLTAAPDTFQRVMNSLRRRLTAAMLIYLDDIIIGSETEEMHLIDIENFLKLLKEVGFKLKMDKCHWGMAEIRYLGFLLSER

SEQ ID NO: 132860 - protein, 56 aa, Heterodera glycines
  Coding regions on vcDNA: vcDNA=SeqID_59283; Strand=-; Position=1 -41,109-238
MDKKLIHENCSNNCIVSSIFDIIKELTKFSGRIAKIEKETKVMAKSKKLLTLTLKF

SEQ ID NO: 132861 - protein, 60 aa, Heterodera glycines
  Coding regions on vcDNA: vcDNA=SeqID_59284; Strand=-; Position=1-181
TVTEHNCSYKGAATSANGPPLKRADGEAKKRAIGDEAQRMPWQEQDGDQTLAFVVGTYAA

SEQ ID NO: 132862 - protein, 34 aa, Heterodera glycines
  Coding regions on vcDNA: vcDNA=SeqID_59285; Strand=+; Position=1 -97,1353-1360
MIQIPAIIINNMLPLFWQEINTNGKVFRELVLKT

SEQ ID NO: 132863 - protein, 32 aa, Heterodera glycines
  Coding regions on vcDNA: vcDNA=SeqID_59286; Strand=-; Position=1 -15,62-145
MASSKFRKLLNRELSLFAGSSKAGPQISKFLL

SEQ ID NO: 132864 - protein, 115 aa, Heterodera glycines
  Coding regions on vcDNA: vcDNA=SeqID_59287; Strand=-; Position=1 -82,578-684,1341-1496
MKMGTETQREEEDEREEEERAKSQSEEDDDCETFEDEQPIDAFASQLAAADKVQKSLPKKPKKYLREDTNYLWKNHCKKEFGKELTKLREEFGSDEEEAEEDDETDEIAWRKRYK

SEQ ID NO: 132865 - protein, 157 aa, Heterodera glycines
  Coding regions on vcDNA: vcDNA=SeqID_59288; Strand=+; Position=1-507
SGSDDDCETFEDEQPIDAFASQLAAADKVQKSLPKKPKKVSMPSAESIQNSLLDSLKNPSNFGPSIGKFLNLVKWKQLMNANLLLAQPQPNNQQISMPTDLNINMFKAPKEKKRVYAGRRKTTGDVQIVPYLFDICMRFLLNNIDGICQFGVGNGNF

SEQ ID NO: 132866 - protein, 1330 aa, Heterodera glycines
  Coding regions on vcDNA: vcDNA=SeqID_59289; Strand=+; Position=1-3993
  Homolog annotation: Hit_ID=S08405; Match level="QueryCoverage=75%, HitCoverage=83%, E-value=0.0, Identity=38%"; Hit description =hypothetical protein 2 - silkworm transposon mag
MAAVVKAGKGPGPYTSETSWTIWEERFEFFIKLRGITDAETKKLLFFSEIGPIYEELRQMALPDDVRDMSIDEIKALMEERFGETKTIAAKRFELFSAKQSSGLSIRDYSIQLRTLISKAEWHKDSVDMCLSALFINGLKKDSIRAELIKKGVNEMKFKDAVETAVLLEQSDLDAEQIGGHKKAEVAKVFAPKGGRKISAPTQQMQCHRCGRNGHRNNECPNKDSKCRKCGNVGHWAVMCKTKQGSNWPRRQGKPVHQVNTESQKAHDIGTLAKSEEVKSISVPPAMIKLQLSKKATDFELDCGADVTLITKNDWMSIGRPKLGQTSGLMAYGKKPIKVLGSFKTDVVYNGKEVNTEIYVVDGEGKNLCGRDLIGELQIDLNKAFGMRSINEVKCKAVDRELGAVLLKYDEVFNDGLGRCTRQISLKFKPEVQSKKCKPRPVPFALRPEVEKVIDNWVKDGVLEQVTTSEWATPLVIVPKAGNKIRLCCDYKVTVNQWLDIHQYPLPRPEELFSVLNGGEKFSKLDLKEAYLQLMLDDKAKECLTICTHKGLYQFTRMPYGVASAPAIFQQVMEDVPRGIDGVAVYLDDIVVTAPNDAEHLKRLEMTLQRIQKFGLRVKKEKCSFMQKQIAYLGHIIDKEGIRMSPDKVEAIQKMPAPKNLKELQSFLGMVGYYGKFIPSMATISEPLNELRRSETKWHWGQQQQKSFEQIKIMLSSNELLAHFDPKKPLYLATDASDYGVGAILFHKDGNTGEFGVIAYASRTLSPAERNYAQIEKEGRAVIFGVKKFNQYLYGRKFILQTDHEPLKRIFGPKGELPVVAARRLHRWSLKLMNYDFEIEYCSTKNFGYADGLSRLPSPEIDQVCKESLELNKIQQESQNALPITAKDIAKEIGNDPVFAKVKGFVLNGWPTRIEDEKIRPFFLVKDELELNNECLMLGCRTVIPSKFRENLLKLIHETHPGIVRMKALARQKVWWPGIDKDIESMKKKCKICQTNAPEMRKVPLHPWEVPEKPWQRLHIDFCGPFFGKMWLITVDAKTKWPEVAIMKSTTTEATIEALRKLIWTHGLPEQIVSDNGPQFASKEFEEFCSKRGIERTLTAPYHPQSNGEAERFVQTFKKGMLLVKKETNWDNELAMNQFLLKYRVTPHSATGRSPAEMMFGRKLRTLLDLVRPSESTEIEGGEEKAKENAEKHGQKYLARAKKNFDRRTWKRSFKTGQRVFARNYRDGSKWMAGQIMSQISPSLFLVRTARGVWKRHLDQLKSDETKPDLESNTDVDSTSSIGDQTEDEKDGGQQTDVEEEPNDPPNLHDPPLRRSVRERTPRQIFDPSA

SEQ ID NO: 132867 - protein, 39 aa, Heterodera glycines
  Coding regions on vcDNA: vcDNA=SeqID_59290; Strand=+; Position=1-117
TKMLQTLGSTIIEMAKVKQTEWHETDIKKFCFAEMSVDG

SEQ ID NO: 132868 - protein, 81 aa, Heterodera glycines
  misc_feature (80)..(80): Xaa can be any naturally occurring amino acid
  Coding regions on vcDNA: vcDNA=SeqID_59291; Strand=+; Position=1 -109,328-462
  Homolog annotation: Hit_ID=NP_491930.1; Match level="QueryCoverage =95%, HitCoverage=18%, E-value=3e-28, Identity=71%"; Hit description =dihydroorotate dehydrogenase (45.7 kD) (1H315) [Caenorhabditis elegans] gb|AAK21481.1| Hypothetical prote
SPHRLTRGQIPIIGCGGISSGADAYEKIKAGASAVQLYTAIVFQGFPVVGRVKRELAELLQKDGYAHVAEAVGAQHRKKXS

SEQ ID NO: 132869 - protein, 204 aa, Heterodera glycines
  Coding regions on vcDNA: vcDNA=SeqID_59292; Strand=-; Position=1-614
  Homolog annotation: Hit_ID=S08405; Match level="QueryCoverage=100%, HitCoverage=17%, E-value=3e-40, Identity=39%"; Hit description =hypothetical protein 2 - silkworm transposon mag
VLLKYDEVFNDGLGRCTRQISLKFKPEVQSKKCKPRPVPFALRPEVEKVIDNWVKDGVLEQVTTSEWATPLVIVPKAGNKIRLCCDYKVTVNQWLDIHQYPLPRPEELFSVLNGGEKFSKLDLKEAYLQLMLDDKAKECLTICTHKGLYQFTRMPYGVASAPAIFQQVMEDVPRGIDGVAVYLDDIVVTAPNDAEHLKRLEMTL

SEQ ID NO: 132870 - protein, 76 aa, Heterodera glycines
  Coding regions on vcDNA: vcDNA=SeqID_59293; Strand=+; Position=1-231
MARMETMLALLNAFSNSNNGTNGVVPQQLQLVEDIVKQQMNPFDAVGPPALPTPAATVSALPNPRPINPMDLERCQ

SEQ ID NO: 132871 - protein, 108 aa, Heterodera glycines
  Coding regions on vcDNA: vcDNA=SeqID_59294; Strand=-; Position=1 -81,131-166,249-335,419-541
  Homolog annotation: Hit_ID=AAH70826.1; Match level="QueryCoverage =91%, HitCoverage=20%, E-value=9e-14, Identity=43%"; Hit description =MGC83917 protein [Xenopus laevis]
VSDEQSHLGRPIQTKVTTKDVSGMLAMSTDFPISLNLALDILSVMEPVNPTVAKLREFCTAKLPEGFPARVIFQQFRWCGEGASPAFPDAMFRTPDDYREDPKRFKRM

SEQ ID NO: 132872 - protein, 77 aa, Heterodera glycines
  Coding regions on vcDNA: vcDNA=SeqID_59295; Strand=-; Position=1 -73,137-297
MSIRRLPFVVASFFALAFMHNFCDALECAQGSIGVVDPEEEPFIVKECPADAKYMFCHKTNCSSGKNAFQQIVLSST

SEQ ID NO: 132873 - protein, 116 aa, Heterodera glycines
  Coding regions on vcDNA: vcDNA=SeqID_59296; Strand=+; Position=1 -298,465-517
  Homolog annotation: Hit_ID=XP_523024.1; Match level="QueryCoverage =84%, HitCoverage=11%, E-value=2e-10, Identity=39%"; Hit description =PREDICTED: MAGE-like protein 2 [Pan troglodytes]
MSPAVIRRGTTVIRRGTTVIRRGTTVIRRGTTVIRRGTTVVRRGTTVIRRGTTVIRRGVTVIRRGTTVIRRGTTVIRRGTPVIRRGTTVIRRGTPVIRREYLLKLKGINFSKIQIK

SEQ ID NO: 132874 - protein, 272 aa, Heterodera glycines
  Coding regions on vcDNA: vcDNA=SeqID_59297; Strand=-; Position=1 -569,3452-3711
  Homolog annotation: Hit_ID=XP_311331.1; Match level="QueryCoverage =99%, HitCoverage=100%, E-value=9e-43, Identity=41%"; Hit description= ENSANGP00000001657 [Anopheles gambiae]
ENCSSSNHSSSSDHCCTSSNHFCTSSNHCCTSSNHSCTSSNHSCTSSNHCCTSSNHFCTSSNNCTSSNHFCTSDNNFTSSNHFCTSSNHCCTSSNHSCTSSNHSCTSSNHCCTSSNHFCTSSNNCTSSMTVTSSNHCCTSSNHCCTSSNHFCTSSNNFVPLLCCCTSSNHCCTSSNHCCTSSNRCSSSNHSCTSSNHWCTSSNHSCTSSNYCCTSSNHCYTSSNHCCTSSNHSCTSSNHSCTSSNHCCTSSNHSCTSSNYCCTSSNHCCTSS

SEQ ID NO: 132875 - protein, 554 aa, Heterodera glycines
  Coding regions on vcDNA: vcDNA=SeqID_59298; Strand=-; Position=1-1665
  Homolog annotation: Hit_ID=NP_913627.1; Match level="QueryCoverage =85%, HitCoverage=33%, E-value=9e-67, Identity=35%"; Hit description =putative helicase [Oryza sativa (japonica cultivar-group)]
MYIHRAHQCAIRQAREQEALADIDWRLHFFNSSCVHCGLPDPPNSKAKNINLAVEEAFFGDDDLNMSPGQQNPRQQQNAPPPLNSDQQTVFDAVVKAIKSDPRDQTVPRRFFIFGDGGTGKTFLFGQIIRRLRKPPYTYKVLATASTGCAAILLPYGKTAHSTFRLGRDVSLDKLPSIPLESFFARRIREAQLIIIDEITMLHNTVIEVINRVCKEMAISQYKNLPFGGKTVIVSGDFKQSLPVVPHEGLTAQVTACFQTSPLFGEFTTMKLTINQRLGQGQQAYLQMCRQIGLGETGEHFWIPPQFLVKSREELIDFVYPDFQKLLGNDKELLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGLKYERLQFPIKPAFAMTILKGQGQTINTVGIDLERDVFSHGQLYTAFSRATDGNNVRVYAPRRETDAQGQTKVLNIVAKNMLKLQ

SEQ ID NO: 132876 - protein, 1421 aa, Heterodera glycines
  Coding regions on vcDNA: vcDNA=SeqID_59299; Strand=-; Position=1 -57,143-4348
  Homolog annotation: Hit_ID=NP_920205.1; Match level="QueryCoverage =79%, HitCoverage=69%, E-value=3e-74, Identity=25%"; Hit description =putative DNA helicase homolog [Oryza sativa (japonica cultivar -group)] gb|AAP52492.1| putative DNA helica
MVWENGLDGVMQYKNMTFGCGTHFADSLPTPYGRLDWQLTEKIGKIISDILPSTVLTGIFNAVNLTVQHDGNSCGYFVCLYAESWLMNNRTFVLPDLSINYEKRRILWHINELYNSDNVPYHPREGVPTPCPIVYRHADEAPSTSKAAEPVEVDDHDDIMIIEPQTSGQAVVAIPTQAQVAGENQADTLGLVSETCVPQEPIAQTDDSIFVRPKTPPRRSSRIGRRQSASISRSPSPAPRRRSSTNAAEQVTAFTRRCYLVHKGWCCAAAAAKHYPEYSDSGKLGDKKCSHCGALHFPHEDSSICCRQGRVVLPKLNPHPKELEELIVEEKQSRKGKEFVRQMSRYNNLLQFASVSAGHKPSPAGGPMAVILNGEFHRRISSMQAGTTQIPGFGQLYILDPVEAMEQRRKNPTFTGEKITNEEEFVQGHQLNEETLEILEQMIQENHPAASAYKQAREQLQELLRQQRTEELRFFRMTLLNERSAPGGMKDPKLHPHQIITPSTGEGMFAIHADPTGAPAPKGIWVENKQGQLNEIAPFSPWTDSLTYPLIKPKGDDGYQIGIPYAKPAQKKRRSDQCVDQMFDTDAMSDDGSCETESIAASDAESVESTESLIDRIDKTRKFISLRDYCKYHLAIRDENLEWQYHHILSCGGGLGQRWVLDQAAKIDWQIASFLRRPDMDLRISTPKNLLHYLVNQYNKQQARQNPNARQKTVDDIGSVVRLSEKNINSLQYWKKRYEDCNTIFARCHDAKKARLFITFTNNREWPEFKQNIYKNGQMFTDRFDMWMRVWCGKIAVFHQELYEKGFFGTILGSGESMEFQGRGGPHAHIVAQTDLDAVPEVIQEYIWAHIPSLPCKDDDSPIAQMHREVRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMNFRGATEAFAVVHSMPFAKLSHHVVHLSIHLPNQQPVVYRAFQLVSKAEEIQRGELPETPCSAYWKQWQNEWQHVPSLKDMLFEKVPEQFRWAKDRWVLYKKKPSKRPPIGRVVPVPPTDRERFALYALMRHFPGDPDHLKLVNGQQYNTFTEAALQHGLLEDDQIWHKTLGEAALHRWPDQMRWLFVSILVFGQPSNALELWNKYKDQMYNPQGITSAAIRQAREQEALADIDWRLHFFNSSCVHCGLPDPPNSKAKNINLAVEEAFFGDDDLNMSPGQQNPRQQQNAPLPLNSDQQTVFDAVVKAIQSDPRDATVPRRFFIFGDGGTGKTFLFGQIIRRLRKVPYTYKVLATASTGCAAILLPYGKTAHSTFRLGREVSLDKLPSIPLESFFAPTIREAQLIIIDEITMLQHT

SEQ ID NO: 132877 - protein, 100 aa, Heterodera glycines
  Coding regions on vcDNA: vcDNA=SeqID_59300; Strand=-; Position=1 -151,2437-2588
MIELIRKFDQLRKEKIHGFKYDDKKRKILNIITENLGICRHKIYEWKKQFAFLTKRLISALFYFHWKTSVKCSIFWCKICQFTRANKAQKWLLALLKEML

SEQ ID NO: 132878 - protein, 165 aa, Heterodera glycines
  Coding regions on vcDNA: vcDNA=SeqID_59301; Strand=-; Position=1 -390,470-577
MEKYTAIDSIPKSFKNQKYTENQSIKETIIGNNENYKQQNAKEIIIKSENYIEKENEDLKPIIKQEIKTEPLEEQKNYLKTTLKVPKIEFDQLSERSFENEINDIDEQFDQNAPYSDQSIFEIDEDYNDTVEKRKGKEKMGADRNTICKLKKKLGQNRSALYLRT

SEQ ID NO: 132879 - protein, 144 aa, Heterodera glycines
  Coding regions on vcDNA: vcDNA=SeqID_59302; Strand=+; Position=1 -111,169-492
MENVKDPRERTLSPEQRAKKQMIWLKNVLFMSPDQIKDNRSTTLVKDLVWFVGLLLYRMLFNNKHPMDNWEPKRRLDMEFMAKMGFSGSDYFYMYKRDDFVPGDFRIFPLKPKSRWIWMPENGRDETGEMALVEERIGMEQVAN

SEQ ID NO: 132880 - protein, 110 aa, Heterodera glycines
  Coding regions on vcDNA: vcDNA=SeqID_59303; Strand=+; Position=1 -80,217-292,339-515
MGKKMEKIWINKMLKRKSIMTGQKCAKLFPRDFDKYLFATWGGLCGGIGNQMWRFASLYGIGKPYGRKPIFKEDQKCEKAHGAHETEGENEIEKLFPVYASQIKYIVKTN

SEQ ID NO: 132881 - protein, 122 aa, Heterodera glycines
  Coding regions on vcDNA: vcDNA=SeqID_59304; Strand=+; Position=1 -75,140-241,561-752
  Homolog annotation: Hit_ID=CAE72864.1; Match level="QueryCoverage =88%, HitCoverage=46%, E-value=4e-15, Identity=57%"; Hit description =Hypothetical protein CBG20163 [Caenorhabditis briggsae]
MHEGLANVCLIGSSMTVVKSKIDMQIARKRKGLSSQHDKSLVAFMNAICAAFVRHVNIEAQAEVKALNTFMELMCTDPQKAIYWYRHVVHAREQQSIDTLMVSDSLFRQANEFGMEIIGRNI

SEQ ID NO: 132882 - protein, 128 aa, Heterodera glycines; identical to SEQ ID NO: 125618
  Coding regions on vcDNA: vcDNA=SeqID_59305; Strand=-; Position=1-951

SEQ ID NO: 132883 - protein, 269 aa, Heterodera glycines
  Coding regions on vcDNA: vcDNA=SeqID_59306; Strand=+; Position=1 -295,578-723,1167-1535
  Homolog annotation: Hit_ID=CAG02702.1; Match level="QueryCoverage =52%, HitCoverage=11%, E-value=4e-10, Identity=29%"; Hit description =unnamed protein product [Tetraodon nigroviridis]
MEERFGVFQHYFDLKLSDAPGLFPSKFPTHRRNKNEGTIEMEIEKVSEFAVEEVGSRRFSDAMDIGGMPWKIMAEIETKNESNEKWLGFYLSDDGLENEYWTCKSSAKLRIVSQKNGTEDLIGRIGDYIFNKEGSSYGGFPNFISFAELLDPGKGFYIKDEDKVTLAIDVIVDEPKTEKSISDPNKSNGTLSTEIEKLSEFAREIVWSERKSETVYIKRMPWKILAKIRKKNESTEKWLGFLLLCDASKKGLVIKLLIEIKIIFSIKLV

SEQ ID NO: 132884 - protein, 120 aa, Heterodera glycines
  Coding regions on vcDNA: vcDNA=SeqID_59307; Strand=-; Position=1 -213,666-815
MNTTKKSEFLHIFTYNFFICRYILVVFGKPIELIKSFRMIQLLLDLVNKEKSYDALNLVQNKPARLNCPSPALRWSDEQCRQKGIECSAENRGKILDPILSNIRFPLIPKEDFTKSVGNK

SEQ ID NO: 132885 - protein, 183 aa, Heterodera glycines
  Coding regions on vcDNA: vcDNA=SeqID_59308; Strand=+; Position=1 -313,373-506,558-662
MDSNKSFYNKAEDKLALAIDVITVDEPKMEKFISDPNKSNGTLSMEIEKVSEFAREIFWSERKSETVHIKGFPWKVWARKRGEIGSTDTAKWLSIYLLCDATEKAENWSCKCSGNVRIVSQKNGVLDEFVDLIFDNKTMLQCVAIISFAELLDSSKGLYDKKEDKVTLAIDVTVKEAKTEDET

SEQ ID NO: 132886 - protein, 221 aa, Heterodera glycines
  Coding regions on vcDNA: vcDNA=SeqID_59309; Strand=+; Position=1 -107,149-302,899-1166,1480-1616
MADEIQQKIVQGIGPDFFSVTSDGWSQITKSPALLSVTVHHINQQFVHADFVLDVIPMTNHTGVDIAEEIGNALRTNGLNPEKIICLFSNEKSSASTVISTIKRLRDFLQEKTFSNRILGVSRVIVESLNERVRELCSNPLLRVAMLLDPRFAYTELFSQQNWRVVEQQLIEFAKENDIWAQPKSPCGISIPSTISGDHDSDFLSKIEAELACYKAGQRME

SEQ ID NO: 132887 - protein, 75 aa, Heterodera glycines
  Coding regions on vcDNA: vcDNA=SeqID_59310; Strand=-; Position=1-269
PQRVLLLLLLVRFAKQIRGRFASSFRVSPRFVPSVAPSPLFRPRAKIALLSAPNCFCRIQSRIATCVQCPQFVLA

SEQ ID NO: 132888 - protein, 82 aa, Heterodera glycines
  Coding regions on vcDNA: vcDNA=SeqID_59311; Strand=-; Position=1 -112,160-296
MVAIIAFSSIFGFTRAMGTMEGRRREVTKQSQNSAAEEALERDRWLTHFFIVLLIGEILLMLTIACIRCNLKFLKQCFRLDP

SEQ ID NO: 132889 - protein, 77 aa, Heterodera glycines
  Coding regions on vcDNA: vcDNA=SeqID_59312; Strand=+; Position=1 -127,298-404
MPGSGPGCIFKNDRVPGPASQNPVNPDFPKNRRAGLPGPGKPGKKVAKTIKKREKKELKKLENLKMKEMKKKQKRRP

SEQ ID NO: 132890 - protein, 47 aa, Heterodera glycines
  Coding regions on vcDNA: vcDNA=SeqID_59313; Strand=+; Position=1 -107,204-240
MDNPSVDNPSVVNPSVDNPAVKDNPSVMDNPSVDNSFLTFLVTSCFN

SEQ ID NO: 132891 - protein, 32 aa, Heterodera glycines
  Coding regions on vcDNA: vcDNA=SeqID_59314; Strand=-; Position=1-95
PDNPSVDNPSVVNPSVDNPSVMDNPSVDNPSV

SEQ ID NO: 132892 - protein, 24 aa, Heterodera glycines
  Coding regions on vcDNA: vcDNA=SeqID_59315; Strand=-; Position=1 -31,84-127
MYKKLFTGAASEFLGSICVILLEF

SEQ ID NO: 132893 - protein, 95 aa, Heterodera glycines; identical to SEQ ID NO: 125597
  Coding regions on vcDNA: vcDNA=SeqID_59316; Strand=-; Position=1-661

SEQ ID NO: 132894 - protein, 83 aa, Heterodera glycines
  Coding regions on vcDNA: vcDNA=SeqID_59317; Strand=+; Position=1-264
STGYREAIPEGFGLPINLGASVRGDCPENKKIDFFKCPFGVLKQLWGAKIQRRIKVQAIGKLFPKGFGLPINLGASGSGGTAP

SEQ ID NO: 132895 - protein, 266 aa, Heterodera glycines
  Coding regions on vcDNA: vcDNA=SeqID_59318; Strand=-; Position=1 -498,749-903,1207-1354
  Homolog annotation: Hit_ID=NP_500989.1; Match level="QueryCoverage =63%, HitCoverage=34%, E-value=3e-10, Identity=31%"; Hit description =prion-like Q/N-rich domain protein PQN-89, Prion-like Q/N-rich domain protein (52.8 kD) (pqn-89) [Caenorh
MRHGTTFFQQLLLCAISVVGIFRAQSMDFRHQQQQQPQMRNQQPSAGGIVGVGTLPAADPAAQRQQQQHRQPNLKNPYDPMLLPLYGHQQNQQQQNAHGIINNRNNGTWSAIGSGTFGQMAPADASQNVTTMAFGQQQQQRMFGAGGSAETGGGGVGHGHGSVQVQVQLRSYANPGFRLPDSRLCTCPAGNERCLHASPQRNGYNCLTSLAVFVLSADDTIHFEETPYFPLNPAGQLGQQQEFGTPLRFHLNSGTGGQHVFKTFST

SEQ ID NO: 132896 - protein, 241 aa, Heterodera glycines
  Coding regions on vcDNA: vcDNA=SeqID_59319; Strand=-; Position=1 -84,128-211,452-571,628-785,839-984,1860-1993
  Homolog annotation: Hit_ID=AAQ84880.1; Match level="QueryCoverage =98%, HitCoverage=21%, E-value=2e-43, Identity=31%"; Hit description =flamingo-like protein FMI-1 [Caenorhabditis elegans]
LDRESRSEFILTVLAEDGGEPPKNASLRIKIHVKDINDNSPFFPQMLYRIELEEDTGAVLSLAREFSPKDEEFLLEILATDEDGLSGQCNVSIKVKDVNRPPQFVPHQFLLRIAENAPIGAPVTKMEATDEDRGENAQLKYTMNSTEFGIDPLNGMVTVRAQLDRERKAVYAVEVRAEDAGNPPLSVGTTLEIELDDGANGQIDHLLDSDDPSVRLGLFRLDRTSGTLRVNQPLDRENVSK

SEQ ID NO: 132897 - protein, 217 aa, Heterodera glycines
  Coding regions on vcDNA: vcDNA=SeqID_59320; Strand=+; Position=1 -238,321-736
MRQSKKKNFKFAIVFWAILFFLALIEKSNGGKAKKVAKQKQQNVKKSERSAEGKAAADSETVAENRKCPEKGEMAENFMVTSAADEDSIELIGQFKKFIIGEYRGTLSAQFELKFQENSLIWHFTQKISELLSADTSQFSGNSVDELEAKIEHFRNKWAQLKKYQKNADRMFVFCILYKYSTEMIRETADLKINDWDQFLKGNRLREQILVSDLRRV

SEQ ID NO: 132898 - protein, 105 aa, Heterodera glycines
  Coding regions on vcDNA: vcDNA=SeqID_59321; Strand=-; Position=1-318
MLKAWIFSQTKFPGDQDLKIRTVNSAVVSTSNRADSRMNPTVVVAPNVTARDRVDPCRIGPFPPQNRRGTSTRHHPYAGQWRNTNRYGPPMNRRSDPSDSRPFRR

SEQ ID NO: 132899 - protein, 16 aa, Heterodera glycines
  Coding regions on vcDNA: vcDNA=SeqID_59322; Strand=-; Position=1-49
EAIPEGFGLPINLGAS

SEQ ID NO: 132900 - protein, 46 aa, Heterodera glycines
  Coding regions on vcDNA: vcDNA=SeqID_59323; Strand=-; Position=1 -72,1155-1221
METAEDGCTKRAQNEKKLLFYDLISKSSESGEPPANGAEVAQIRKK

SEQ ID NO: 132901 - protein, 105 aa, Heterodera glycines
  Coding regions on vcDNA: vcDNA=SeqID_59324; Strand=+; Position=1 -121,310-506
MVQLPCHVRVHFIKNMNKQILFGPFLSTEKALLKNLMNLVGHEDDSCWVHSEWMDAQEMMANFIEQHSVGSVLSAFAGHHVPQHIANLLNENEESTQGQIFKINI

SEQ ID NO: 132902 - protein, 49 aa, Heterodera glycines; identical to SEQ ID NO: 132231
  Coding regions on vcDNA: vcDNA=SeqID_59325; Strand=-; Position=1-176

SEQ ID NO: 132903 - protein, 16 aa, Heterodera glycines
  Coding regions on vcDNA: vcDNA=SeqID_59326; Strand=-; Position=1-49
EAIPEGFGLPINLGAS

SEQ ID NO: 132904 - protein, 341 aa, Heterodera glycines
  Coding regions on vcDNA: vcDNA=SeqID_59327; Strand=+; Position=1 -214,880-1056,1365-1721,2768-2869,3302-3409,3866-3934
LSRAEDGSESSSTKSGGDSSLPSPPALDHETTIGCTLCQHKQQQHQSVAGQGRASSEETLKRGDSRLTVPRGSASSSQPSPSPTTARYTETIIHRQTATAAVQQQFVEVNRQLNTVVATTKGGGTCCQCEECVLACRREQQQLQHEQQQQLAGPSGSGAGRSSGTGVASGALSIALANAQLGTASSGPTTSSSAGSGGTTQQQHHHHQQQQAQHMMMYCNSTGAGPSPLISTNAQTIEEQIKQIDRISKECDNSRKTLEHINRRLDDLNDEVRRYREFLGHEKARRDPTLYKTSTAEPLSSYNDGICRLIDSLTTQLTMEWTEKLRSIQNQTIAKSVAEKG

SEQ ID NO: 132905 - protein, 103 aa, Heterodera glycines
  Coding regions on vcDNA: vcDNA=SeqID_59328; Strand=-; Position=1 -141,226-396
MNVEGPTKDTECSRKCAKASFAIGTSIKKQLRDLRRMGCAAAKTQFAALEDCLKGPAQYFNDISQRSSSRSANDDDEQDEEMAKMRALKKGGGAAAGKMTKIL

SEQ ID NO: 132906 - protein, 73 aa, Heterodera glycines
  Coding regions on vcDNA: vcDNA=SeqID_59329; Strand=-; Position=1 -112,300-409
MLPNKSAPRGVICPTLPPICCAMTLDWRQCEQHRIGEGGVYVPFPGGEQSTCSDRQNQSVFTNCFGNRRTGKF

SEQ ID NO: 132907 - protein, 31 aa, Heterodera glycines
  Coding regions on vcDNA: vcDNA=SeqID_59330; Strand=+; Position=1 -41,92-143
  Homolog annotation: Hit_ID=NP_609808.1; Match level="QueryCoverage =100%, HitCoverage=8%, E-value=3e-11, Identity=87%"; Hit description =CG17912-PA [Drosophila melanogaster] gb|AAF53563.2| CG17912-PA [Drosophila melanogaster] gb|AAK92958.1| G
MGRKKKKPQKPWCWYCNREFEDEKILIQHQK

SEQ ID NO: 132908 - protein, 18 aa, Heterodera glycines
  Coding regions on vcDNA: vcDNA=SeqID_59331; Strand=-; Position=1-55
MERESEKCPFGGQNETPK

SEQ ID NO: 132909 - protein, 34 aa, Heterodera glycines
  Coding regions on vcDNA: vcDNA=SeqID_59332; Strand=+; Position=1 -38,1112-1178
MTASGGVAKLGGRSAMTIMSQRELEKVEFVPFTS

SEQ ID NO: 132910 - protein, 111 aa, Heterodera glycines
  Coding regions on vcDNA: vcDNA=SeqID_59333; Strand=+; Position=1-336
MKWINGQRDKRPKCNGSTGNGTKGQNAMDHRPMGQNTMETANGTKGQNEMDQRPIGQKAKMQWINGQWDKRPKWNWSTANGTKGQNAMDQRQMGQKAKNNMAKANVTKGQK

SEQ ID NO: 132911 - protein, 108 aa, Heterodera glycines
  Coding regions on vcDNA: vcDNA=SeqID_59334; Strand=+; Position=1-327
MQWINGQWDKRPKSNGSTANGTKGRKAMDQRPTGQKAKKQWINGQWDKRPKSNGSTANGTKGQNAMDQRPMGQKAKKQWINGQWDKRPKCNGSKANKEYQEDFEIFIN

SEQ ID NO: 132912 - protein, 178 aa, Heterodera glycines
  Coding regions on vcDNA: vcDNA=SeqID_59335; Strand=+; Position=1 -64,113-281,761-1064
MPRRLPKAEKFAQEAATAGTTARLRLNRMPTAFPFGKPTEWRHFGGGGGRGILRDGVRHHQPVPAGPVHGMFSRRPGSFEKVKSLNAHMKSHAMKARAEAEVQMQHKQQQQSTSLPFPVPTKKEAADSACWGRWAAPLGPVASLNLTSSQAAVAAALNNLNRQFQHSRAKRCKKQWVA

SEQ ID NO: 132913 - protein, 532 aa, Heterodera glycines
  Coding regions on vcDNA: vcDNA=SeqID_59336; Strand=+; Position=1-1599
  Homolog annotation: Hit_ID=EAL39930.1; Match level="QueryCoverage =90%, HitCoverage=30%, E-value=1e-63, Identity=33%"; Hit description =ENSANGP00000029091 [Anopheles gambiae str. PEST]
MWTDSQCSVERLRENKRQDRFVVNRLQKIREANFQVRHVRTDSNPADMASRGADLQCLRSSLLWHFGPVWLSKADKWPKSNVIYRPGDEFKEVEEPPIIELTTPVHVEEQFKPSIHFERFLNWNRLKATAAHAMRFIKKLRTIENGTISEPHQNNKPLTMAQLQQAENWILREAQRLHSPSNDQIRELQLFQQEGIWRCGGRLEEAPDLPYDSKHPIFLPPHAWITKLIIRHYDKQLKHCGPRILLSTLREKFWIPRGRKTVQQLLNSPQHGCLECRRERVKPYTYPEASDLPKGRVSEARPFDKTGVDYFGPLKVKQSNDVVKIYVALFTCLAIRALHLEVAEDYSAEAFLRAFRRFTARRGIPSLIMSDQGTNFVAGAKVIKENWTDTLMPEDMQQQMAQSGIRWIFNTAHAPWKGGIWERLVGITKNALRRTVGRNLLTLDEFGTMLCEIEAIINNRPLTFESDQEPIKVLRPINFLIPYSKADNNFPIIDDDTNDPTYEPNPTNRDKMVATLSHVNARLNNSCELSEK

SEQ ID NO: 132914 - protein, 89 aa, Heterodera glycines
  Coding regions on vcDNA: vcDNA=SeqID_59337; Strand=+; Position=1 -144,296-421
MVMATLKFVKLLTRRFDGRRLYGRKGTLSAGGIRNGNKRHRLEVNIYHIPDNYITEEKRSPQKIFDIGKLNLEGKFSGQHRDCINRTFC

SEQ ID NO: 132915 - protein, 46 aa, Heterodera glycines
  Coding regions on vcDNA: vcDNA=SeqID_59338; Strand=+; Position=1 -76,146-210
MEEALTVSLSQGLKVLALQAFGVLTGLSVMFFMAFYGESIKNVVEF

SEQ ID NO: 132916 - protein, 163 aa, Heterodera glycines
  Coding regions on vcDNA: vcDNA=SeqID_59339; Strand=-; Position=1 -237,282-536
MQPFALLYVASIFAQFPLFFTPFECFLKWAFTLWHFAFCQFLANFVWCIRLAEFAQFTVAKFALFQMVSAQFYADFCHRLIFGSNFAFLPMMVPSVACALFVFFAYFHFILIVFAESVQIHFFKFRCRRKEVIFKNLLKQAREYLLSVYLFLNLKLLFFVEFY

SEQ ID NO: 132917 - protein, 125 aa, Heterodera glycines
  Coding regions on vcDNA: vcDNA=SeqID_59340; Strand=-; Position=1 -185,407-601
ASFLAKNSESQTDYLANLKNSAFLGEFSGLWLLGLDMVPMTGQQTVHLHVNRSCNCAMDAWFIQPMDSNKPIDPKVPTFGSEACPPLSTDQTFALTGRISLFNFSFTALTDANLSNITVILLGTV

SEQ ID NO: 132918 - protein, 361 aa, Heterodera glycines
  Coding regions on vcDNA: vcDNA=SeqID_59341; Strand=+; Position=1 -115,161-341,420-592,648-689,732-844,884-937,1139-1294
  Homolog annotation: Hit_ID=CAE61329.1; Match level="QueryCoverage =99%, HitCoverage=50%, E-value=9e-98, Identity=50%"; Hit description =Hypothetical protein CBG05167 [Caenorhabditis briggsae]
DNEFLHFGHRPPLPSFGSCFNSIFSLHTETGNILTHMYGAIAFIGIFIWFLVQAEAIAFIGIFIWFLVQAEDVVSWPDKLIFSSFFVGAILCMGMSFAFHTVQCHSEDIGRLFSKLDYAGISLLILDYAGISLLIIGSFVPWLYYAFFCRVLPMTIYISMIFLLGIAALVVSLFDKFSQPKYRPLRAIVFMAMGLSSPLRAIVFMAMGLSSVVPALHVVPALHLLVTDGIVWMFEKASLHWLILMGILYLSGATIYMVRFPERCFPGKCDIYMVRFPERCFPGKCDILCQSHQLFHLFVIFAAAVHYHGVLELAMKRLQDGSCSEQLISHSGSDRQPFSGRICILFMYTAIKFWVPSTISW

SEQ ID NO: 132919 - protein, 76 aa, Heterodera glycines
  Coding regions on vcDNA: vcDNA=SeqID_59342; Strand=-; Position=1-377
LISSQKSCQLKTAKKAEFLKFFISIFFYSSKFSVIFSRLIEPVKSFRMISRLFDSVNNFKSYIDSKLAQTELARSV

SEQ ID NO: 132920 - protein, 444 aa, Heterodera glycines
  misc_feature (1)..(1): Xaa can be any naturally occurring amino acid
  Coding regions on vcDNA: vcDNA=SeqID_59343; Strand=-; Position=1 -157,386-525,583-625,884-935,978-1013,1063-1138,1184-1283,1346 -1414,1466-1594,1646-1789,1837-1874
  Homolog annotation: Hit_ID=CAE67653.1; Match level="QueryCoverage =95%, HitCoverage=59%, E-value=1e-129, Identity=61%"; Hit description= Hypothetical protein CBG13216 [Caenorhabditis briggsae]
XLIFQVFQVRKVTGKDSGKIFAMKVLKKATVIRNQKDTAHTKAERNILEAVKSPFICDLQYAFQTGGKLYLILEYLSGGELFMHLEREGTFMEDTAAFYLAEIVIALEHLHRQLAEIVIALEHLHRQGIIYRDLKPENILLDCKGHVKLTDFGLCKECKGHVKLTDFGLCKEAIEGDQKTHTFCGTIAIEGDQKTHTFCGTIEYMAPEILMRTGHGKAVDWWSLGALTGHGKAVDWWSLGALTFDMLTGGPPFSAENRKRTTIDKILKGRLTLPPYLSFEAKDLIKRLLKRHVDTRLGAGPGDAEDLIKRLLKRHVDTRLGAGPGDAEEIKKHAFFTHHDWTNVYRREIEAPYKPNITSEEDASLFDSKREIEAPYKPNITSEEDASLFDSKFTKMTPVDSPTELPPMSVNPFEGFTYIAPSVLEQVSQPTIAPSVLEQVSQPT

SEQ ID NO: 132921 - protein, 28 aa, Heterodera glycines
  Coding regions on vcDNA: vcDNA=SeqID_59344; Strand=-; Position=1 -37,253-302
MKFPLCHPLLRICFQFESDWEDSGKSSP

SEQ ID NO: 132922 - protein, 74 aa, Heterodera glycines
  Coding regions on vcDNA: vcDNA=SeqID_59345; Strand=+; Position=1 -107,254-371
MYLKWYIWVCGLKKLTGNVITDHTPTYETIHRFLMSILKRSLLYPVKLGEINTNMVNGSEAEFRTEGFCKSNRN

SEQ ID NO: 132923 - protein, 257 aa, Heterodera glycines
  Coding regions on vcDNA: vcDNA=SeqID_59346; Strand=-; Position=1 -123,167-301,343-477,535-629,675-812,859-918,1042-1131
  Homolog annotation: Hit_ID=CAE62528.1; Match level="QueryCoverage =94%, HitCoverage=47%, E-value=5e-29, Identity=32%"; Hit description =Hypothetical protein CBG06637 [Caenorhabditis briggsae]
TNGYDVQCFISGTLMTSIDAHGFSVSILRIVDQKWLHVLTEYDSAVSSFWVASRLNKEPIVGQDSVRSIEDERPCQLSLGPQLPKIQESLLRSCIENACQALINAEHDLNRLDSSVGDGDCGTSMKIGASVENGELALDHPKGLFLQLSKLVESSVGGTSGALYALMLNAAANAFESPLCSNVIKKALKLALKSVEYYAGAKPGHRTLVDPLHAAVSFRGENWEDIVKIEPDPGAMAFSTWFKAVFESYEKNRVTNR

SEQ ID NO: 132924 - protein, 43 aa, Heterodera glycines
  Coding regions on vcDNA: vcDNA=SeqID_59347; Strand=+; Position=1 -43,167-255
MNKTYCINPANEWYAVSDGDDELTADSHPALLQQAKAALITDA

SEQ ID NO: 132925 - protein, 75 aa, Heterodera glycines
  Coding regions on vcDNA: vcDNA=SeqID_59348; Strand=-; Position=1-228
MSDFREKQTVGNGRNGSDVSDDEEQTFDRVLNARLKVVPKRKGPLSNGGASTSTGNGNGQKTDEAEMVKGLKLTV

SEQ ID NO: 132926 - protein, 130 aa, Heterodera glycines
  Coding regions on vcDNA: vcDNA=SeqID_59349; Strand=-; Position=1 -88,133-437
  Homolog annotation: Hit_ID=NP_497591.1; Match level="QueryCoverage =100%, HitCoverage=36%, E-value=5e-16, Identity=39%"; Hit description= immunoglobulin binding protein 1 like (37.9 kD) (3D713) [Caenorhabditis elegans] gb|AAF36032.1| Hypothet
MVEQFETRNSHPSSHSDSASTSKDVRFAEPTRLKPLIIARSEAQKRVFGLGYPSVPTVTVDEWYNEMQKSGTFGKGPMPSSFKIDQRKTQEYDETEEGEEEEERKRQAQIQRDEWKDVNRRGCGNTYNKG

SEQ ID NO: 132927 - protein, 34 aa, Heterodera glycines
  Coding regions on vcDNA: vcDNA=SeqID_59350; Strand=-; Position=1 -17,66-153
MWLEFIAKLAQKENPEKLGSSLLFRKCGWNSKEC

SEQ ID NO: 132928 - protein, 99 aa, Heterodera glycines
  Coding regions on vcDNA: vcDNA=SeqID_59351; Strand=-; Position=1 -135,1626-1702,1751-1838
MPGIDLNNPADKLGPKCDTLVFQSKKSHLFGPTLGPFRPAMATVESQTRPERKSRKIRVVAIIPKMWLEFIAKLAQKENPEKLGSSLLFRKCGWSSFEC

SEQ ID NO: 132929 - protein, 16 aa, Heterodera glycines
  Coding regions on vcDNA: vcDNA=SeqID_59352; Strand=+; Position=1-48
MKWARSARPEAAKRPN

SEQ ID NO: 132930 - protein, 42 aa, Heterodera glycines
  Coding regions on vcDNA: vcDNA=SeqID_59353; Strand=-; Position=1-541
LQISILASISKGIEFFYNKLIESKKHDCIIFKKFIYAFVERF

SEQ ID NO: 132931 - protein, 65 aa, Heterodera glycines
  Coding regions on vcDNA: vcDNA=SeqID_59354; Strand=+; Position=1 -30,618-785
MRDIQKGFYVSSQVSFFLRFVLYLSRPPYFVLILGFENKITKTNNCFELFMYHFLWKQIFELIRF

SEQ ID NO: 132932 - protein, 62 aa, Heterodera glycines
  Coding regions on vcDNA: vcDNA=SeqID_59355; Strand=+; Position=1 -37,354-505
MSMDRMKHLLSTVSGNCPDVVEIPDVEAAAFKVMLSFIYTEELSDLNGDNAMVVLYAGGFNF

SEQ ID NO: 132933 - protein, 249 aa, Heterodera glycines
  Coding regions on vcDNA: vcDNA=SeqID_59356; Strand=+; Position=1 -240,294-432,612-982
  Homolog annotation: Hit_ID=XP_194043.2; Match level="QueryCoverage =48%, HitCoverage=27%, E-value=2e-10, Identity=32%"; Hit description =similar to Btbd1 protein [Mus musculus]
MLLFEFGFVEFETCRNCVRFMIQVKAIFKDFSIKCLRYICQNAADLFGSDDFLQIDQKILCNLLESDRLLLNDEFEIWKIALRWADEKCRQNGIECSSGNRRSVLGPALFKIRFPNIHEEDFAKCVVPFGVLSKDEVIAVYQFNSHPFLYLRGVPGLYSLKFPSHGRIFNWNKARGNRRGTLSMEIEKMSEFAGESVGRSRFSDAVYINGFPWKIEAQIMNCIDEKKYLGFYLWCDAKKGPILITILKI

SEQ ID NO: 132934 - protein, 106 aa, Heterodera glycines
  Coding regions on vcDNA: vcDNA=SeqID_59357; Strand=+; Position=1-321
MDPSNGFYNREEDKVTLAIDVTVKDEKIEKFVSDPDKSNGTISMEIENLSGFARDTNQSERKSETVHIKGFPWKVWTRIKTKIGSTDNEKCLGIFLLSDAPEEGAN

SEQ ID NO: 132935 - protein, 39 aa, Heterodera glycines
  Coding regions on vcDNA: vcDNA=SeqID_59358; Strand=+; Position=1 -39,89-169
MPYRGFPNFISFAELMDPSKGFYDKNEDKVTLAIDVSVK

SEQ ID NO: 132936 - protein, 76 aa, Heterodera glycines
  Coding regions on vcDNA: vcDNA=SeqID_59359; Strand=-; Position=1 -6,221-445
METKSKERTNGKRQHKMNEHRYFFCFCSCLSIGRLFRIDGIAKTKSHNYAEHFTMRTEATKLKQKIQIDVVRRIGI

SEQ ID NO: 132937 - protein, 314 aa, Heterodera glycines
  Coding regions on vcDNA: vcDNA=SeqID_59360; Strand=-; Position=1 -139,317-700,757-905,959-1229
ALRWADEKCRQNGIECSSGNRRSVLGPALFKIRFPNIHEKDFAKCVVPSGVLTVEEVLGVYQFNSHPFLYLRGVPGLYSLKFPSHGRIFNWNKARGNRRGTLSMEIEKMSEFAGESVGRSRFSDAVYINGFPWKIKAKITKGIDEKKYLGFYLWCDAKEGPILITILKIYATEKDSNWRCYVRSATFRIISQKNGTENSIGTLHDHVFDNELNGWGFGFFITFAELMDSNKSFYNKAEDKLALAIDVITVDEPKMEKFISDPNRSNGTLSMEIEKVSEFAREIIGSQRKSETVHIKGLPWKIVAKSSNCFAKER

SEQ ID NO: 132938 - protein, 397 aa, Heterodera glycines
  Coding regions on vcDNA: vcDNA=SeqID_59361; Strand=+; Position=1 -532,663-1321
  Homolog annotation: Hit_ID=NP_500013.1; Match level="QueryCoverage =51%, HitCoverage=14%, E-value=3e-37, Identity=39%"; Hit description =predicted CDS, polyprotein family member (4B673) [Caenorhabditis elegans] gb|AAC02594.1| Hypothetical pro
MVHEHFLLTITARDIEGKTFAIDVRKEQNDDSEIRKLIEFVNFGSFPEGTTEVEKEDIASRAENLSLSSGILYQHLPDQNARMYIPLSLRPLIFEAFHTSQINGGHMNIKKTLGKCRKFYWPMMHRDITNWTRQCITCQLRHSPNPSYRAEMQMPPKNTLFAQIALDLAGPLPLTQKGCTSLLTDNATAFTSDFFKSFCSLLYINKCYAIPHWSQGNAVVERSFRTFHNILAKYISSEEPDFDEFLECANFCYNTSIHSSTKETPFFLVFGRDPIFCIEQILNPNTEPENTSEVDNVKQKLVKSLRKAWESAAAVIKEAQLRSKVQYDKLVRNQTVQIGDRVLLRNYAGKVKTSKKFQLPWKGLYRVIEINDVLITIVSCTSPQRRKSAPPEPRRGR

SEQ ID NO: 132939 - protein, 162 aa, Heterodera glycines
  Coding regions on vcDNA: vcDNA=SeqID_59362; Strand=-; Position=1-488
  Homolog annotation: Hit_ID=NP_500013.1; Match level="QueryCoverage =94%, HitCoverage=10%, E-value=6e-31, Identity=43%"; Hit description =predicted CDS, polyprotein family member (4B673) [Caenorhabditis elegans] gb|AAC02594.1| Hypothetical pro
FKHCYLKFGGCTSLLTDNATAFTSDFFKSFCSLLYINKCYAIPHWSQGNAVVERSFRTFHNILAKYISSEEPDFDEFLECANFCYNTSIHSSTKETPFFLVFGRDPIFCIEQILNPNTEPENTSEVDNVKQKLVKSLRKAWESAAAVIKEAQLRSKVQYDKL

SEQ ID NO: 132940 - protein, 45 aa, Heterodera glycines
  Coding regions on vcDNA: vcDNA=SeqID_59363; Strand=-; Position=1-427
STGYSEAIPEGFGLPINLGASVQGDCPENPKKNFLDKNYLNELTR

SEQ ID NO: 132941 - protein, 110 aa, Heterodera glycines
  Coding regions on vcDNA: vcDNA=SeqID_59364; Strand=-; Position=1 -11,457-638,1070-1209
  Homolog annotation: Hit_ID=AAV34698.1; Match level="QueryCoverage =77%, HitCoverage=35%, E-value=9e-14, Identity=42%"; Hit description =IC5 [Globodera pallida]
MLIISIGIGLFGKSLYMYGDNGFIFGHNVNGFWGYPSFEEGDTIGCGANLTSMEIIYTKNGQKLNTSNLFVTDTDLLPVVFLYLPGDIIEANFGPRFAYNFNASESFLDD

SEQ ID NO: 132942 - protein, 38 aa, Heterodera glycines
  Coding regions on vcDNA: vcDNA=SeqID_59365; Strand=-; Position=1 -18,60-158
MEEFINGSNPWGNKRRSGGRGLMDPVDFVSQLKQFVAF

SEQ ID NO: 132943 - protein, 403 aa, Heterodera glycines
  Coding regions on vcDNA: vcDNA=SeqID_59366; Strand=-; Position=1-1209
  Homolog annotation: Hit_ID=NP_001004509.1; Match level="QueryCoverage= 92%, HitCoverage=25%, E-value=1e-41, Identity=31%"; Hit description =si:busm1-180o5.3 [Danio rerio] emb|CAD60788.1| novel protein similar to DNA polymerases [Danio rerio]
MVLVFRELFRRGFNPSMLRKGNKLYEMKVGKQKKRNPNVVFRDSYNLMPCSLAELVTSFGLDVEDKPFFPHMANQPDNYGKQIYPTPEDYLADGMMPDKRQKFNVWYEQHQHKPFLLDEALASYCTNDVEILTAALVAFRMEFFDVSRREEGIVAERAHEGIDVLRECMTIAGACMKHFRINHLPAEHLAIVPERGYDNAQNQSRLARRFLQWYTEEHNVEVRMANSPGGEKKFGQYSVDGWVEAERKAIEVNGCVWHACSECYPDDNMMMPNGKTAGKVRERNAKRLEFIRSQVGQLEVYWECEIEKMLTKDKEMREKFEDYMDDGPLTIRTSFMGGRTGPLKLLHKAGPNEQISYFDFTSLYPFVNFTTRYPIGHPTVHVLNEEVEWKCPEDSRYPLAILK

SEQ ID NO: 132944 - protein, 28 aa, Heterodera glycines
  Coding regions on vcDNA: vcDNA=SeqID_59367; Strand=-; Position=1-85
KTITDAGYAYSDQHKVCVHKNVVTSRGP

SEQ ID NO: 132945 - protein, 21 aa, Heterodera glycines
  Coding regions on vcDNA: vcDNA=SeqID_59368; Strand=+; Position=1 -37,147-175
MIPNLSELSVLNENRNSVFTS

SEQ ID NO: 132946 - protein, 65 aa, Heterodera glycines
  Coding regions on vcDNA: vcDNA=SeqID_59369; Strand=+; Position=1 -80,162-279
MATNFQTSSFSVTFARRRTDWEEHKKGTSSSPVFTKLFSLGAKNLLLAVQCSAIPTKTVAIRPKV

SEQ ID NO: 132947 - protein, 56 aa, Heterodera glycines
  Coding regions on vcDNA: vcDNA=SeqID_59370; Strand=-; Position=1-169
MQSFRALLFILAGTARVWSILSTARRRERQKRFAIPCTKAWKGWERKICEIAIIQF

SEQ ID NO: 132948 - protein, 44 aa, Heterodera glycines
  Coding regions on vcDNA: vcDNA=SeqID_59371; Strand=+; Position=1 -34,722-822
MTKPLNCTNLYGFGFATRAFFSSILAPQAAIFVRNEHLLSETKM

SEQ ID NO: 132949 - protein, 75 aa, Heterodera glycines; identical to SEQ ID NO: 132731
  Coding regions on vcDNA: vcDNA=SeqID_59372; Strand=-; Position=1-225

SEQ ID NO: 132950 - protein, 118 aa, Heterodera glycines
  Coding regions on vcDNA: vcDNA=SeqID_59373; Strand=-; Position=1-698
LFEYPKRTLEKIDFFVFGAVPPSRCAQIYGETESFRNSFPIACTLILRWIFAPHNCLSTPNGHLKKSIFFVFGAVPPNRCAQIYGETESFGSSFPIACTLILRWIFAPHKCLSTPTDT

SEQ ID NO: 132951 - protein, 43 aa, Heterodera glycines
  Coding regions on vcDNA: vcDNA=SeqID_59374; Strand=+; Position=1 -55,708-784
MSGVWSFLTIPVANGQVLGASTQQKPFISTAWSPFAFPSVDKV

SEQ ID NO: 132952 - protein, 99 aa, Heterodera glycines
  Coding regions on vcDNA: vcDNA=SeqID_59375; Strand=+; Position=1 -168,418-549
MYKLMRNIFVVIGEAFSLDDCGQKEESAEQVGDEKLRKEAKSKQQDDDDDDDDGILKALQAELKQQRLIEENIELKVKIYRMEKEKEQMEKDGEKENKL

SEQ ID NO: 132953 - protein, 63 aa, Heterodera glycines
  Coding regions on vcDNA: vcDNA=SeqID_59376; Strand=+; Position=1-191
MANWKTTSFAETEFIAVTSYQNNLASDGGKGEKRDKKSRERENEKEKKSKMGEEQKGKKKREK

SEQ ID NO: 132954 - protein, 18 aa, Heterodera glycines
  Coding regions on vcDNA: vcDNA=SeqID_59377; Strand=+; Position=1 -38,385-403
MCWCCSNCPTTFRITFCI

SEQ ID NO: 132955 - protein, 53 aa, Heterodera glycines
  Coding regions on vcDNA: vcDNA=SeqID_59378; Strand=+; Position=1-171
FFEFFEFLKFPVGPGSRSRRKIEVPVPVPASQVPASPGPGFAQNSRSRSTLVK

SEQ ID NO: 132956 - protein, 540 aa, Heterodera glycines
  Coding regions on vcDNA: vcDNA=SeqID_59379; Strand=+; Position=1 -357,438-495,2761-2857,2922-3025,3071-3816,4378-4554,4885-4968
  Homolog annotation: Hit_ID=NP_982067.1; Match level="QueryCoverage =27%, HitCoverage=32%, E-value=2e-14, Identity=37%"; Hit description =surface layer protein [Bacillus cereus ATCC 10987] gb|AAS44910.1| surface layer protein [Bacillus cereus
MLRLTLSSACRSDAFMILQETSNRDKYTLEIVDCRLIVKTVDLMDGLILDIAKKLELEPARYGIRKTLMKSLFINGGRYDFSANLFTEEVPRRVIIGLVPTQIYIGRNEQHPFCFNHENGILPASVNEVESDDSSEEKGRDFSSISDPESHSSKQTVPLSTFNMNKWSALVLLIALISALDSAVVRQQRATNADASKPEPNNQKPGTVDSDKGNADKSQGADTDGKNPEKPKESQEVEEDGPNPKEPTKSQKLEEDGPNPKGATKSQEVEEDGPNPKEPTKSQEVEEDGPNPKEPTKSQEVEEDGPNPKEPTKSQEVEEDGPNPKEPTESQEVEEDGTNSDEDELTERQEAEVDRMRVRAGATSMHGLDKLAPTPPPSATSTNAIAIREKRVPWLALAGLAIPIGEIVIPFVTNKLCEHRTQYCPCGRGRCVPVTTYKADECCESNFEWKCCPDEKCVPVRYYWDWICMGFYGHNEILASSPKCKKWYEQSFTCMCDFKSVDWFPEIEGICRKDCKTATPGAIAEGLCDCGYGNHCAVIE

SEQ ID NO: 132957 - protein, 412 aa, Heterodera glycines
  Coding regions on vcDNA: vcDNA=SeqID_59380; Strand=-; Position=1-1236
  Homolog annotation: Hit_ID=NP_491240.1; Match level="QueryCoverage =98%, HitCoverage=30%, E-value=1e-109, Identity=48%"; Hit description= zn-finger, CCHC type and RNA-directed DNA polymerase  and Integrase, catalytic domain containing protein
MIDNFSAVKPPNKSINDVSTLKAALQNDFPEVFEEGLGHCSKAKAHLILRSDAKPVFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDEESKQLCAINTHRGLFQCQRLPFGVKSAPAIFQHLMDQICAGIPGVFAYLDDGLIATKTLEQHITAFYTLFGRIKEYGLRIQLDKCKFLQPELLFLGHIVSANGIRPDPSRSDAIRKMPAPIDKSTLRSFLGALNYYGRFVKCMRELRAPLDKLLQKDVAWEWTSEQQNAFEKAKQIMTSDLLLTHYDPARPIVVSADASKDGIGATLSHTFPDKKEKVVEHAACTLTAAQQNYSQIEKEALAIVFAVQKFHRM

SEQ ID NO: 132958 - protein, 25 aa, Heterodera glycines
  Coding regions on vcDNA: vcDNA=SeqID_59381; Strand=-; Position=1-76
MSQKIFDDACSWWYYFIRTDETHVK

SEQ ID NO: 132959 - protein, 106 aa, Heterodera glycines
  Coding regions on vcDNA: vcDNA=SeqID_59382; Strand=-; Position=1 -69,552-606,663-726,991-1123
  Homolog annotation: Hit_ID=A46281; Match level="QueryCoverage=80%, HitCoverage=15%, E-value=1e-25, Identity=63%"; Hit description =tetrahydrofolylpolyglutamate synthase (EC 6.3.2.17) - human gb|AAA35852.1| folylpolyglutamate synthetase
MKIFFNFPESRHPAERLAKQRTNLDDIDRLNVVHITGTKGKGSTAAFLESILRSLGYKTGFYSSPHLVHVRERIRINGRPISKQIFTQQFFHIYNTLFEHKKEVAN

SEQ ID NO: 132960 - protein, 100 aa, Heterodera glycines
  Coding regions on vcDNA: vcDNA=SeqID_59383; Strand=+; Position=1 -85,203-379,447-487
VEALDDKLGTLLAKVAHERRNTLYCAIILLSSKFRVPTKFGLCLEKPNLTEAASENYNIGKFRAHLAEIRAHIVTSGDTQLIQKASVCLQKLIVFLDEQD

SEQ ID NO: 132961 - protein, 326 aa, Heterodera glycines
  misc_feature (1)..(1): Xaa can be any naturally occurring amino acid
  Coding regions on vcDNA: vcDNA=SeqID_59384; Strand=+; Position=1 -189,410-489,533-614,660-764,811-1159
  Homolog annotation: Hit_ID=CAE71913.1; Match level="QueryCoverage =95%, HitCoverage=44%, E-value=9e-31, Identity=29%"; Hit description =Hypothetical protein CBG18975 [Caenorhabditis briggsae]
XLQRIGGRTSSAPQVQQQLQTRLSDSEADRSRAAAHPRQIPSTHFQVDQHCSIPADGQQHKVDIAHIELTPTLWHECVPSRLCSAFVSAQLVNSSQLPLLPGPLSVFFNNTFTAQLVNSSQLPLLPGPLSVFFNNTFTSTTHLNLVLPGEEFRCLLGVDPALKSTTHLNLVLPGEEFRCLLGVDPALKVEYKRAQLSNQQVGFMSRSCLCTHEVGFMSRSCLCTHEQVISLRNAKASQSCRVTVREPIPKAADEKIKVKLRNLIAFNFRFLCCIDLKAQRAEARLLAKESQLEWTVKLGPGEQRELSVKWTAEYPAQEVKRRQKQS

SEQ ID NO: 132962 - protein, 19 aa, Heterodera glycines
  Coding regions on vcDNA: vcDNA=SeqID_59385; Strand=+; Position=1 -32,509-536
MQNVNFFFSHIAGEQKQEL

SEQ ID NO: 132963 - protein, 964 aa, Heterodera glycines
  Coding regions on vcDNA: vcDNA=SeqID_59386; Strand=+; Position=1 -423,641-1135,1207-1539,1582-1739,1782-3268
  Homolog annotation: Hit_ID=NP_507780.1; Match level="QueryCoverage =81%, HitCoverage=53%, E-value=5e-75, Identity=27%"; Hit description =predicted CDS, DNA polymerase type B, organellar and viral family member (5T899) [Caenorhabditis elegans]
PQVEFRSCVHNAVEDAIHDAQNTIGGANKVGVIISSELLDQGDIIMPITPITSNVVDAVFNQFCKVEQSKAKHVNFYGAPFFITVTVLNTDCLPRRRTTKGSAPPIHSSQSHIFKINNNDNYCLFLCTGTDALLLIIYQGSEYKIFIFNDYQTRPITKSDVIDYQFPILLYHHDKHFDGIKTLPKFWNKRYYCLSCESAFSNKPQHSMNCTSLCHGCREVGVDYPCEPQQGYFKKCDQCNNNFYNKDCYERHLHKDLCTKFQRCEDCGVIYNVKYHGKTGHQCGEKFCRLCKQFHVKEDDEDNPCSEQDKKVGNKFEHEVNFVSAIIICTDCINGNWKDSLKGSSCKIRGPHRTITFAPFDFSNTIVDQKVTTQNPLRDFVQWLLFDHNKKFPTVAFAHFGGRYDMTMVIKEVVSQGIHNPDIIKQGNRLYELRINQNEHGPLTILRDSYNLMPIKLSGLIKSFGLKIQDKQYFPHMFNKASNYDNFLSHLPPCEYYCPDQMKVPDQQKFNDWYNNNYNQPFNLKEKLPEYCCNDVQILTHALVELRREFKQLTQRNGKHGGIDILWQAMTIASACVKNFALNHLKPNSLAIVPEKGYTPQQNQSALAIKYLDWYAHINNINIQTAHSRYGEYVFKREGQVYQVDGYIKGTNGKRDKIIEVNGCLWHGCEECFEDLDEETRMPNGKTLREIREREVRKHEILRRYVDLEIVWEHEINEQLKKDAAMKDYFDNWKDRSPIKIRDAFHGGRTGPMKLLHTAKPGQKISYKDFTSLYPWTNFSTSYPLGHPKIINFRLNEQTVNWRAPSDNPYKGLLKVLLLPPNRNINVTVMPVKFDERLLFPLYEKCAKHITNEHPNGLKDDNYSCPHFNPNDRAFVSTCTHLELSAALEVGYTVRKLFHVLQYDQWSDNIFKSYVSEMMALKIHATGFPSWCSNEEEKKEYIEENRQRFGILLDNEKMKAEPGK

SEQ ID NO: 132964 - protein, 389 aa, Heterodera glycines
  Coding regions on vcDNA: vcDNA=SeqID_59387; Strand=+; Position=1-1170
  Homolog annotation: Hit_ID=NP_001004509.1; Match level="QueryCoverage= 99%, HitCoverage=26%, E-value=4e-39, Identity=28%"; Hit description =si:busm1-180o5.3 [Danio rerio] emb|CAD60788.1| novel protein similar to DNA polymerases [Danio rerio]
MPVKFDERLLFPLCEKCAKNITNEHPNGLKDDNYSCPHFNPNDRAFVSTCTHLELNAALEAGYTVRKVFHVLQYDQWSDNIFKSYVSEMMALKIHATGFPSWCSSEEEKKEYIEENRQRFGILLDKEKMKAEPGKRYIAKLCLNSLWGRFSMRNLLSKAIINNDESLIRQYTDDKKIELVDLEMMDEDNDVFMLTYRPKEEFVDENKYSNVVISLFTTSAARLYLYEALKKVADTPDCEILYYDTDSVIYVHPEENDPLPTGKGHLGELTDENPDHNILEFISAGCKNYGMKLQRKDTGEIEHELKIRGFTLDAQTVQRIHYDTVKDQILRYGSDDPADPIIVTYPHFIRPNLIQGKVYTHSLTKHYQPIFTKGIINDSFQVLEFGYRK

SEQ ID NO: 132965 - protein, 358 aa, Heterodera glycines
  Coding regions on vcDNA: vcDNA=SeqID_59388; Strand=-; Position=1-1077
  Homolog annotation: Hit_ID=NP_502797.1; Match level="QueryCoverage =99%, HitCoverage=99%, E-value=3e-55, Identity=34%"; Hit description =HASI (4P602) [Caenorhabditis elegans] emb|CAB16520.1| Hypothetical protein Y57G11C.19 [Caenorhabditis ele
MEMINTTLDKLYNDPSSPAAFAGVSALWKEARKKLKNLRKKDVQHYLEGHRTYTLMRPRRVRFPRAKTVAAGFMTDVQVDLADFQALSRHNRSHRYLLVAVDVLSKRLFVVPLKNKKAEEMLDAFKELVKQMPMVPHRIFSDKGTEFKNKLLKEFFEEQEIEKHEPVHSSVKASVAERAIRNVKQRLYRYFAERETLNWVDVVQQIVDGINSTPSRVHGMRPIDVNFENAQKVWKRIYESPQKRKKPRFRKDEFVRMSREKGQFEKGYLPNYGDEILEIDEVLKAVRPNRYKLRDDRGEKFRGTFYEQELARVRKDADTSYRIEKVYRKRRKPDGTTEMLVKFIGYPEREWIDESQIV

SEQ ID NO: 132966 - protein, 228 aa, Heterodera glycines
  Coding regions on vcDNA: vcDNA=SeqID_59389; Strand=-; Position=1 -57,351-598,822-940,1012-1229,1290-1334
IRFWQEYMEPIESMHHSTATLAESNATIVAGGGGGMNGTANDLDSSPLLLPPEKGILEENCGVILIAAINKSDMHTDLSAEQLDRLQYHVRKFCLQHGAALGWDSEQKLSIIKEALVGSDLLDVPMLAQQSSDASPFSNYRATGEKEVKAEDEQSFLARLYTIALDGSVSGQSSTGGGQQSPRRPGGDVGKGHGDNTMLANFFSSLLKDKDHHQRSQASSVKSGHSGT

SEQ ID NO: 132967 - protein, 132 aa, Heterodera glycines
  Coding regions on vcDNA: vcDNA=SeqID_59390; Strand=+; Position=1 -75,116-301,431-565
  Homolog annotation: Hit_ID=ZP_00325198.1; Match level="QueryCoverage =100%, HitCoverage=26%, E-value=3e-53, Identity=75%"; Hit description= COG1012: NAD-dependent aldehyde dehydrogenases [Trichodesmium erythraeum IMS101]
MDAAARGRLLHKLADLMERDAVHLASLETLDNGKPYKDAFLADVPLSIAVYRYYAGWADKCHGKTIPIAGDYFCYTRHEPVGVVGQIIPWNFPLLMQAWKLAPALALGNTCVLKPAEQTPLTALYVAELIRE

SEQ ID NO: 132968 - protein, 100 aa, Heterodera glycines
  Coding regions on vcDNA: vcDNA=SeqID_59391; Strand=+; Position=1-303
MIGMMNNACMDGPAEFFAGRRDLCELLVPASSLAAVDGQAQPHAPPPKVFEPTQQKKLSYTGSGRRLVDGKPEVNETPEEMWRKAMLRATCTRAVKGGGE

SEQ ID NO: 132969 - protein, 259 aa, Heterodera glycines
  Coding regions on vcDNA: vcDNA=SeqID_59392; Strand=+; Position=1 -11,71-839
MNRRWICADVWMDILPSFDHAQLGLKMALLSDRFDVLVDTHFDGKSEFTIWRAIEIEKEEGPKPKMFIRIDGSFVDFPLSVRQMPNKICFKNLWIESVLTFVYAKAFLSFFSYIDHSVIKFLRSKKRFFDKSGTKLEVFVDAFDTDVQPIWDIFFREIWPIFATNIRHLAFHGADALDNLRRRTSPTLLTDLVQLYSITSYELCPDGISDDGPKATAGQALSKWLHTKSKNGKANELYCCAYFCEITWINTFNEVIETT

SEQ ID NO: 132970 - protein, 47 aa, Heterodera glycines
  Coding regions on vcDNA: vcDNA=SeqID_59393; Strand=-; Position=1-143
LQIYWLKLHMRYISKFFDSVRRFDKDGFRFAISRSTFGNWSRIFSAI

SEQ ID NO: 132971 - protein, 162 aa, Heterodera glycines
  Coding regions on vcDNA: vcDNA=SeqID_59394; Strand=-; Position=1 -102,158-543
  Homolog annotation: Hit_ID=CAD22154.1; Match level="QueryCoverage =62%, HitCoverage=51%, E-value=1e-11, Identity=44%"; Hit description =pherophorin-dz1 protein [Volvox carteri f. nagariensis]
MKLIRDSILSGNFAVNEMGNNNMIVWTVPVPRNAGPQWVAPPRPLAPSCPPPPPQLPVFPPPPPQLPFLPPPPQIGMAPFCPRPPQMGPVLAPLALPPLAPAPLPLPSCSTFANPFGVRAPPNKCAVCGRRFLAPRRRATTEKLPSAKKARVHGPEEPMDEE

SEQ ID NO: 132972 - protein, 491 aa, Heterodera glycines
  Coding regions on vcDNA: vcDNA=SeqID_59395; Strand=+; Position=1-1476
MKRGVSASATATDSADLRTPNDASAAAATAFIGENLNKKRAKRSRRQQRRWDFRTVAFFEQRSSSSSEFDDADQDSKSSAKVDHCMQIGYGRAPAAAAAAGNSQRNNNNNNVDSGGGGGGGGGGSGNDRRSEAENNASNPEADDDDDDEKGGATADQLYEEKQHSVHRLERFALQRHVTEFVLNGQHERPDEALRDAFERIIKRAIRNAEQQQQQQQNEQQSGNQEEEQPQDGGGAAQQSPRRRVTKIGIFLDGNGTSFFCLFWQMSPSNIHHHHIGLTDPIVLPIRPPEQNTADTLMGELEKLGQSDGDEDVHGGGMSKRSLLLSEPVQIVITCIAPPVGAAPRFHHYQHWGYNERQLIRIRNVGDHFCLFHALIAARSYTDHDLTKMIAPQQQQCHQGDVSSSSSNSDHLINVPSAAATAVMRRPDFCANHEVLNRLLSSPGRMQETVRGLMLHAGIDPEGQAYGVEHVPHVQQHWVSAILKMLSAAAT

SEQ ID NO: 132973 - protein, 100 aa, Heterodera glycines
  Coding regions on vcDNA: vcDNA=SeqID_59396; Strand=-; Position=1-405
  Homolog annotation: Hit_ID=NP_502882.1; Match level="QueryCoverage =98%, HitCoverage=19%, E-value=2e-16, Identity=39%"; Hit description =DNA polymerase like family member (4Q408) [Caenorhabditis elegans] emb|CAB60306.1| Hypothetical protein Y
MPVRLDQLPKTFNLDCAEKPFFPYAFNRRENYDVRLPHLPPIEDYCAGSMKREKYDKFVSWYEENKTTTPFYLPDELQSYCQNDTERRVKAIVQFRKILM

SEQ ID NO: 132974 - protein, 714 aa, Heterodera glycines
  Coding regions on vcDNA: vcDNA=SeqID_59397; Strand=+; Position=1 -134,185-280,557-1519,1571-1619,1674-1834,1879-1969,2033-2224,2268 -2388,2430-2767
  Homolog annotation: Hit_ID=NP_001004509.1; Match level="QueryCoverage= 98%, HitCoverage=51%, E-value=3e-91, Identity=30%"; Hit description =si:busm1-180o5.3 [Danio rerio] emb|CAD60788.1| novel protein similar to DNA polymerases [Danio rerio]
HSRQNSLLIWRDSCLLMPVRLDQLPKTFNLDCAEKPFFPYAFNRRENYDVRLPHLPPIEDYCAGSMKREKYDKFVSCICMSIFRAQFLCENQLAIVPERGYERNDRASVFAIKYLDWRAKTDAVKIQHAGNGMEKRWRQFKLDGWIEEQNRCIEVLGCYWHGCERCFDPGDKLVDAKSCRELNEETNLRLMQLREGDVDGQGLQVEAVWECEINAQLACNAEMRAFFSDLGMDRGPIEPRGAYFGGRTGPLKLFAEPKEDEKISVFDIISLYPFVNYTCEYPVGIPTIIRPMADEMCVNWTRPEQLPYRGILRVRVVPPRGLRVPVLPVKIDERLLFCCCHHCATMFRKKSTRRPHKCPHTDAQRSFTGSYTHIELERALEHGYKIDRLWRAWHYDEWSDQIFKDYVRLLIKLKIESSGFPEGVSSADQKQRYADEYRRIYEVNIELENVKKNPGLRFIAKLMLNSLWGKFSMRNELGANKVITRPQEFFSLLFDHKIEVSAIVPFSDQALRVLYKPKKNFVSEHTTSNIVISLWTTSCARLKLHDYMVQVDQREDSDLLYTDTDSVIVLHKRDTTPLETGEFLGQMSEEYLDYDIKTFICGGAKQYAFRMRHRRTNELEFVQKIRGITFDVNNSKALQFDNFVEKVLNYGKVDDKDNDDDHDSSVSPAVFSYQKIMPTRDSKIITRKQLKKYLPVCQKGIINNSYEVFPFGYE

SEQ ID NO: 132975 - protein, 118 aa, Heterodera glycines
  Coding regions on vcDNA: vcDNA=SeqID_59398; Strand=-; Position=1-523
  Homolog annotation: Hit_ID=NP_502882.1; Match level="QueryCoverage =83%, HitCoverage=19%, E-value=8e-18, Identity=41%"; Hit description =DNA polymerase like family member (4Q408) [Caenorhabditis elegans] emb|CAB60306.1| Hypothetical protein Y
MPVRLDQLPKTFNLDCAEKPFFPYAFNRRENYDVRLPHLPPIEDYCAGSMKREKYDKFVSWYEENKTTTPFYLPDELQSYCQNDTEILLKAIVQFRKILMRDITGGYDVLPISCTIAR

SEQ ID NO: 132976 - protein, 73 aa, Heterodera glycines
  Coding regions on vcDNA: vcDNA=SeqID_59399; Strand=+; Position=1 -101,297-417
MEEKYAKMEEEMSSEDSDDAIDFFQDTIEDIVENSGVVNGEIDDMDDQQDDDDAPTSTVYLNLGKDERTAENY

SEQ ID NO: 132977 - protein, 189 aa, Heterodera glycines
  Coding regions on vcDNA: vcDNA=SeqID_59400; Strand=-; Position=1 -36,86-619
MLSQEEDRGRSVERTSVCGTEGSDDLSGRLAGMSLTLRTSEQQQQLLPASSGRVGSAQRKQQRRRQRERRDLVRVLCRFNRCSPTWLHKMLQKRKEENVKFLNKLSLATHHLKRNVAVSADALSRHGANMMFAYRGFMGITVQQHLYVRHRIMLKYPQLPCVVQFGGNSHQDNFPIELLHVVSEEQKTD

SEQ ID NO: 132978 - protein, 766 aa, Heterodera glycines
  Coding regions on vcDNA: vcDNA=SeqID_59401; Strand=-; Position=1 -2295,2430-2435
  Homolog annotation: Hit_ID=NP_502799.1; Match level="QueryCoverage =69%, HitCoverage=73%, E-value=3e-15, Identity=23%"; Hit description =putative nuclear protein, with 2 coiled coil-4 domains (4P607) [Caenorhabditis elegans] emb|CAB16521.1| H
MDEFYVVLPSNSPGPGNTTSKFTVRLPHTLELDANWMVALSSIIYPYSFPSVGIDDDDFISIKLVNPNFKFADDKRFVDIELKIPSMQFSSVGHLRQTLNDIINDAYKQRFGLSSQKAAKVKRQIDVTELFFYDHPVDYWEKIEELEKRLVELREEIDTKEREHGAEGTEQKRKNELEGELKILRLRLKRKDDELEELKRAAKRRDDDTPENQQKKIREFFHHHPDDHEKKLNESRLIFTKYLSGLQEKMSEYIGERDGAKIVQLNEQTGKLREKIKYLLRNLNLFESAVLQRANSDDPSRKTREEYEKSSHEQNSVYVQEFFQRHPTNYWQIIHNNYDGLREQFDKIEELQQKTAQKQLKDDEHSSFQQQIDRAKQLLEYRRKRFAALEFEAKKRDGQQQQSSPFSSPISSALTAGEALKERLGAVQVKQTEKSDQDNNNSMEKPKTHAEVLKEKIQQQQDIATSTPNELQNDGKAVAEPKTHAEVLKEKLEQKKGTSASAERDGDHDSDAVDLLSRGHKLVSMIAKKRDGAQSLTGSAITIEQTHGELLKKMLSLADKEPIRDVTQNSGEGHTRGQILKELLENIVKEDKLRPPPHGSSDSDRQLTRGEALKELIEKKKDEKQHQYYSSAKTRGEIFKLILEHHKYTGEAEASFKRLVEEQRKGKTAAEFHFNELAQRFVLKTGSGVVQIDVSKHLAYVLGFNSIRLYDGEQAQYMPDLSGGVKQLYVYAPKLVDESIIGDKMAPLLRVVNVSATPGGTDVPEA

SEQ ID NO: 132979 - protein, 931 aa, Heterodera glycines
  Coding regions on vcDNA: vcDNA=SeqID_59402; Strand=+; Position=1-2795
  Homolog annotation: Hit_ID=NP_508324.1; Match level="QueryCoverage =91%, HitCoverage=32%, E-value=1e-100, Identity=31%"; Hit description= predicted CDS, peptidase family A16 and RNA-directed DNA polymerase and Integrase, catalytic domain and
MCEQTHENVPDSEVFPDMEGLSITTNVMASVVAKKPHAYLMTRKILVRTKNNRRVWMKVPFLFDPASQATYISDPLIEKLKPPKVSSEELEVYGFGGERTGPIRFHSPVYSIQIKRTDGKWEDILLNRTERISTPFKMAEWNSEEFPLVGKDAAHALSFSREEPEILIGARHFWQFFQAKEEVSPGLFVIQTTLGPLVNGESDFGPEIPNPELSMMVIDESNQGQMPTVKEIEYFFNLESLGIKDDPNENDDQTAMGLFNKSIRREKDGRYSVKWPWKEEVPDLPSNYRMAFSKLMSTFGKLRNSPDLMEQYDATIRDQLQKGIIEEARKAPGTLEHYIPHQGVLAKGKKLRVVYDASAHTRGTNSLNACLYRGPVILPDLVGMLMRFRCPKFPLLSDIQAAFLQIALEPEDREVTKFLWVKDASKPLAPTNLSTYRFCRVAFGVISSPFILAATLQHHLKGYESPVAKELAQSLYVDNTLLECESAEEALHKYAESKAILKEGFFNLREFVTNSPEVMKAIPEEDRLNKPKVKVLGLIWDTDKDEIVFEFPTNGLEKVATRRLVLSFLASLFDPLGLMGPCIQPLKLFFQTLWEEKKGWDDVLSEKEQTQWESFQENWKDQTIRIPRRSMLQGNPSLQLHAFVDASIHTFAAAIYLRAAEGNQISVWLIFSKNRLKPKNASKALTIPRMELMAILIGIRGLKFIADQIRRPISNLHLWGDSQIALNWVASKEAQPKFIERRVKEIRTLNECAFHFVRTAENPADIATRGAKPGELRDKSLWWNGPSWLKEGHNQWPKEIEFKIKDPPENLEEVSLDNEEKVFFVNTRTKELIESPLIDPKRFSSWTKIVQVTLYVLRFLRLKLIQRGNPHQLFESHRKEIVKVSEKGPFSAEDVHLAENLLIRIDQIKNAEDFLSYPSLKDSEGILRLKT

SEQ ID NO: 132980 - protein, 1510 aa, Heterodera glycines
  Coding regions on vcDNA: vcDNA=SeqID_59403; Strand=+; Position=1 -4491,4617-4658
  Homolog annotation: Hit_ID=NP_508324.1; Match level="QueryCoverage =98%, HitCoverage=52%, E-value=1e-100, Identity=28%"; Hit description= predicted CDS, peptidase family A16 and RNA-directed DNA polymerase and Integrase, catalytic domain and
MLMRFRCPKFPLLSDIQAAFLQIALEPEDREVTKFLWVKDVSKPLTPANLITYRFCRVAFGVISSPFILAATLQHHLKGYESPVAKELAQSLYVDNTLLECESAEEALHKYAESKAILKEGFFNLREFVTNSPEVMKAIPEEDRLNKPKVKVLGLIWDTDKDEIVFEFPTNGLEKVATRRLVLSFLASLFDPLGLMGPCIQPLKLFFQTLWEEKKGWDDVLSEKEQTQWESFQENWKDQTIIIPRRSMLQGNPSLQLHAFVDASIHTFAAAIYLRAAEGNQISVWLIFSKNRLKPKNTSKALTIPRMELMAILIGIRGLKFIADQIRRPISNLHLWGDSQIALNWVASKEAQPKFIERRVQWPKEMEFKIKDPPENLEEVSLDNEEKVFFVNTRTKELIESPLIDPKRFSSWTKIVQVTLYVLRFLRLKLIQRGNPHQLFESHRKEIVKVSEKGPFSAEDVHLAENLLIRIDQIKNAEDFLSYPSLKDSEGILRLKTRLGRCDQPFGFSHPIILGGQSSIRDLIILKCHQKRHHFGVEGTLTEFLLGYWTPRARTKVKKALKGCLRCKRMQAYQFALPKMPPLPDERVCRQAPFKTIGIDFLGPTETRLAGEKVKAWILLMTCLVTRAVHLEAMLDTTAESFLNVLRRFISRRGKPDLIWSDNATSFKLAQKTIEHLTTPGVDQNTQEFFALNKIKWRFIPQISPWAGGVYERLVQLCKNCFKRTLGRKVLSYDQLITFVAEVEATLNHRPITSVSEGMDEFLPLRPVDFLQPEVRIHWDTNGEEFDPSDRNLSSHQKLVALFQATKESHEFFWEMWQKEYLLLLRERGKWDHKSPRLQDRTEPKEGMIVLIHEEFTPRNQWSLGKIIELNGRPGAIRSVQLELPIHGIKSKRYGTMPRKIIITRPVNKIFPLEVGLDNPTENEEKFEESSNGTPQITNEKEISHLEAPMDEKETETLQLVDQPIDQNRHGMITRSKAKMGTVLNCLSILFAMFALVGAYPTNHCNECKLLCFNKGVKAKIPKEINKVELCCAENCYIHANVKKLTYELPKEILLNDFKCEGHFWMDSKHMFKKDILCPAVDECELIECYFCIEQLANPTCYPLISSMLAGGLCLSFISISFVAFSILKVLFSGLYMVIWLIIQFIRPIIYLAGPNRPPKDRRPRATASQNWTSRRVYRTMAFVVLMANSLQNLTGAETIAVMAKSEKCIKNATSMRCIVENSAMLTLLPVGQTNTLLLKTEEGVLLGSINVVLKALALECQSFTKAWQRSYAINVLAGKRCPKMGSCEGKYCSEVRHNTSIPELKDANDLPGNSFCLDSTAFWGNKCLLGGSACLFYRWYAQEKSKTVYEIMGCNSWEFIVYTIIRLETLGEKPKSTQVFLYPGRTLKWNNISITPIGVTFPPAPVLNSDFVFDGSNMALTREPLAIDFNCKNRQEAIDFNCSLGVQACTDCIPDHSSGLVNCNCRSHNLEKLMESPERRLPLNIKNYQLRNTGRKMFNGSTIPLCVLD

SEQ ID NO: 132981 - protein, 211 aa, Heterodera glycines
  Coding regions on vcDNA: vcDNA=SeqID_59404; Strand=-; Position=1-633
  Homolog annotation: Hit_ID=NP_504186.1; Match level="QueryCoverage =100%, HitCoverage=25%, E-value=2e-12, Identity=24%"; Hit description= vglm uuk m polyprotein like family member (5E780) [Caenorhabditis elegans] gb|AAB63927.1| Hypothetical p
CLLGGSACLFYRWYAQEKSKTVYEIMGCNSWEFIVYTIIRLETLGEKPKSTQVFLYPGRTLKWNNISITPIGVTFPPAPVLNSDFVFDGSNMALTREPLAIDFNCKNRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 132982 - protein, 66 aa, Heterodera glycines
  Coding regions on vcDNA: vcDNA=SeqID_59405; Strand=-; Position=1 -84,158-274
MLSTKFRQQLLALNSIVQFVSIQFRVAQHIFHEDCLSTWYFLKTQLDYIFILLNFDDSNERMIHIF

SEQ ID NO: 132983 - protein, 175 aa, Heterodera glycines
  Coding regions on vcDNA: vcDNA=SeqID_59406; Strand=+; Position=1 -120,575-747,1216-1456
  Homolog annotation: Hit_ID=NP_509786.2; Match level="QueryCoverage =93%, HitCoverage=65%, E-value=3e-38, Identity=37%"; Hit description =adenylate kinase (80.6 kD) (XL288) [Caenorhabditis elegans] emb|CAA92123.2| Hypothetical protein F13E6.2
SSSAGSRNNESSKRNGTSHSASQKNVGTPPNVPIVLVIGAPGSSKSKFAQNIAKKYDGFVFISMGELLRRKVQQNGENELWAKIGKKMDAGEMIPMRICRELIYASVHERCPNSWGFVVEGFPRTLAQAEDIEAQLGHIDLALLIDCTEQFCKDALRKYTRDKEEGAERAGNGGK

SEQ ID NO: 132984 - protein, 56 aa, Heterodera glycines
  Coding regions on vcDNA: vcDNA=SeqID_59407; Strand=-; Position=1-595
RQNAHLKLRKYKLIFAIRTDYLVNRKQINHKIRTKNDFILECKLKMHNKLIYSNLF

SEQ ID NO: 132985 - protein, 118 aa, Heterodera glycines
  Coding regions on vcDNA: vcDNA=SeqID_59408; Strand=+; Position=1 -42,303-484,624-755
  Homolog annotation: Hit_ID=NP_497185.1; Match level="QueryCoverage =99%, HitCoverage=19%, E-value=4e-25, Identity=44%"; Hit description =alkyl-dihydroxyacetonephosphate synthase, with confirmed activity (66.6 kD) (ads-1) [Caenorhabditis elega
PIKLLLEIVHNRYTNHFEFIRSQILQKCQPASLRLVDNQQFQMGQAMRVESASLWYTFERQLARLYVTRWKGFRIDQMVAVTCVFEGTAEEVERQQKALIKLADLFGGMDAGEENGLY

SEQ ID NO: 132986 - protein, 68 aa, Heterodera glycines
  Coding regions on vcDNA: vcDNA=SeqID_59409; Strand=+; Position=1-204
MPIKICSQFAPIGRPPPPTAPPAPHSRSIAQQQAQPWRIAPEHLSPKEWKVPREEETEKTSIRHKDKV

SEQ ID NO: 132987 - protein, 18 aa, Heterodera glycines
  Coding regions on vcDNA: vcDNA=SeqID_59410; Strand=-; Position=1-54
MAARKLSGNARKGNGKSR

SEQ ID NO: 132988 - protein, 47 aa, Heterodera glycines
  Coding regions on vcDNA: vcDNA=SeqID_59411; Strand=+; Position=1 -46,375-472
MSSQQQQLDVLIVIDGIWCFNCQSFNDRLRESDFRQILEMISCSYNI

SEQ ID NO: 132989 - protein, 44 aa, Heterodera glycines
  Coding regions on vcDNA: vcDNA=SeqID_59412; Strand=+; Position=1-132
  Homolog annotation: Hit_ID=ZP_00195010.1; Match level="QueryCoverage =100%, HitCoverage=12%, E-value=4e-11, Identity=75%"; Hit description= COG2008: Threonine aldolase [Mesorhizobium sp. BNC1]
MAVSITQSTESGTLYSLAQIRRIANIAHSHGIPLHMDGARFANA

SEQ ID NO: 132990 - protein, 147 aa, Heterodera glycines
  Coding regions on vcDNA: vcDNA=SeqID_59413; Strand=-; Position=1 -78,266-334,1373-1522,1658-1804
MIQADLLSSLDGKIKIIVKISTSDYKVPAVFKKFYYIKMFAPNQESIKSTEKKRINTHCVSKEEFLGDIEILLAGAIGEEVIYNRRFNGSETDIKKATSLAAAMVKEYGFYPEEIGYQNFLVINYLKEKIYNIVLKRWKNRQKKQAP

SEQ ID NO: 132991 - protein, 248 aa, Heterodera glycines
  Coding regions on vcDNA: vcDNA=SeqID_59414; Strand=+; Position=1-747
  Homolog annotation: Hit_ID=NP_920205.1; Match level="QueryCoverage =82%, HitCoverage=13%, E-value=1e-22, Identity=32%"; Hit description =putative DNA helicase homolog [Oryza sativa (japonica cultivar -group)] gb|AAP52492.1| putative DNA helica
MNFRGATEAYAIVHSMPFAKLSHQVVKLSIHMPNQQPIVYRAFQLVSKAQQIQQGELPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLFMSILVYGRPSNAVELWNKYKDQMYFPQGITTPAQRQAAELEALADIDWRLHSCFNLSCAF

SEQ ID NO: 132992 - protein, 48 aa, Heterodera glycines
  Coding regions on vcDNA: vcDNA=SeqID_59415; Strand=+; Position=1-147
RLALFSRKRSMLFVGPGELCPIPGPASTKSGHMAKGRKAKSAQNQPSN

SEQ ID NO: 132993 - protein, 109 aa, Heterodera glycines
  misc_feature (22)..(22): Xaa can be any naturally occurring amino acid
  Coding regions on vcDNA: vcDNA=SeqID_59416; Strand=-; Position=1 -113,179-250,299-443
ASTGGWFGGEADQNGQFASSGXHAKSFLTRLDSAHSPGSPNSRNSFMQMMVLDRSRQPSADVIETVCLQNGVCTCAETTCTLRCSSCARLTFREICLNIYSPHGQMQKF

SEQ ID NO: 132994 - protein, 37 aa, Heterodera glycines
  Coding regions on vcDNA: vcDNA=SeqID_59417; Strand=+; Position=1-224
IFKCLDFFWLTKTSSNLVLSILFQIAPNFFYSLTRPY

SEQ ID NO: 132995 - protein, 75 aa, Heterodera glycines
  Coding regions on vcDNA: vcDNA=SeqID_59418; Strand=+; Position=1-225
PGLKCPAQAKNFFYFLEKIEIFPEKIPVDRARKTMFWKWSPFSREKSLKNLKIQKPENRFLGLARKILKIFEILK

SEQ ID NO: 132996 - protein, 70 aa, Heterodera glycines
  Coding regions on vcDNA: vcDNA=SeqID_59419; Strand=-; Position=1-213
MEGNEQWEEEEDEKEEEEKGMEEEMGEDEKGEDECIGGKAFVFVGVVQIYADAREGITAAEFTAMLRWTI

SEQ ID NO: 132997 - protein, 55 aa, Heterodera glycines
  Coding regions on vcDNA: vcDNA=SeqID_59420; Strand=+; Position=1-166
MTQFSASFLAGQNEQKLKENEKTNSTRKRKREEKEGEEEREGQKGDEEFEREEEE

SEQ ID NO: 132998 - protein, 173 aa, Heterodera glycines
  Coding regions on vcDNA: vcDNA=SeqID_59421; Strand=+; Position=1 -145,189-365,1005-1151,1798-1849
MRSVAICADSTRTRGRQMRKYGGTISRCNGRRRRIERGDGGGPIRTASRIAGGRGQRTDLGGRGGKVAIGVGRVGGESALQPQRGATAAAGGGGGGGHGECVGTTKARTLRGHSTIVRPAFIEPFQEMRLDAYPLMGHGRRAGGTRLECNAPAHYPRNRNSKTEILEQSIAEE

SEQ ID NO: 132999 - protein, 42 aa, Heterodera glycines
  Coding regions on vcDNA: vcDNA=SeqID_59422; Strand=-; Position=1-126
MKKWMREGRKEDDEMDRRKTHEEEEEEMEEEAEKEESGREME

SEQ ID NO: 133000 - protein, 58 aa, Heterodera glycines
  Coding regions on vcDNA: vcDNA=SeqID_59423; Strand=+; Position=1-174
MAFWGNGTYALLVDWKAVELTMRLTEGEAEGGGGGGEVKEVEAMPSKEEERSWDRGYK

SEQ ID NO: 133001 - protein, 101 aa, Heterodera glycines
  Coding regions on vcDNA: vcDNA=SeqID_59424; Strand=+; Position=1-306
MTSTDRPNWAGHFRMDGLEANERYQVNFAKTDFDLVMEWSLQFRLRPFGEGSRAVALSQWVRTEQSVPVEAVRHIRFRMLDDTHVLLEWEPVEKVVLLSLA

SEQ ID NO: 133002 - protein, 195 aa, Heterodera glycines
  Coding regions on vcDNA: vcDNA=SeqID_59425; Strand=-; Position=1 -32,116-671
MRQLVINHFGRPEQRANHGGGGGGDIAEAATEQRTIAVPCQRFVRTRQADIFTRRSTRVYRPVYTKGRVLRPPPTAGGEAAAAEEEAEAVTPTPLSIRTRPFGWCSAEAQQMETDDEEEEGEEEADANSDDAGGESDGLEQPVRKRARAEPVQEMLVEVEEAAVPPADPDLEEEPVAGCSTWNQQRRLNEHIFRN

SEQ ID NO: 133003 - protein, 166 aa, Heterodera glycines
  Coding regions on vcDNA: vcDNA=SeqID_59426; Strand=-; Position=1-498
QAEANNLVVAKSLSPRVQQQPLATVQSFSPTNGAIGNEQFRFSFFSSVCRPPWTPQTEKRRLIGVKDFVSQNTFSKEAASNTCHVAVPSVTPNLTKVSALSSEVARRCSTSALCANGSNFLGKNDGILEESTKSAKTPQKLEKQSHLTKYIPPKRTAEELLLDKLE

SEQ ID NO: 133004 - protein, 205 aa, Heterodera glycines
  Coding regions on vcDNA: vcDNA=SeqID_59427; Strand=-; Position=1-618
MAEKLWEKAKLGTKTANECVGEEMGQKMMEMCAGGTSKAKEIAQNWGKSALIATGQCVLAQMQTEEEQIQEEQNAEGMAKLAEFDASFKECAKALAPEQKAKSGIDMEAKANQQLKPSDLVNAVLKNKGKADDGKSEGNDDKKSKKTQKNGKLITLEKGKGKGNLEFYPYMGMIVVLFFLGQQSLIASLLLLCALPWILRPKNSD

SEQ ID NO: 133005 - protein, 95 aa, Heterodera glycines
  Coding regions on vcDNA: vcDNA=SeqID_59428; Strand=+; Position=1-661
LFEYPKRTLEKINFFVFGAVPPNRCAQIYGETESFGNSFPIACTLILRWIFAPHNCLSTPNGHLKKSIFLFSGQSPRTDAPRFMGRPNPSGIASL

SEQ ID NO: 133006 - protein, 42 aa, Heterodera glycines
  Coding regions on vcDNA: vcDNA=SeqID_59429; Strand=+; Position=1 -100,212-240
MLIKPLFTFSILLAFFGQIFCDILGREQSAGAKGIDADDLMV

SEQ ID NO: 133007 - protein, 135 aa, Heterodera glycines
  Coding regions on vcDNA: vcDNA=SeqID_59430; Strand=+; Position=1 -262,349-494
MLSIEPQKRMTAKGIIDYLEGKCKPKEYEKNAEKMALFGDVSAEKLRELMEKEGFKRTTMKKVKNNLKSAEENTKIFMQQLEERSEFFSIWQNFPILSFSNLLTWVVIPFPNPFRLFSESNSLKLSFRIVSRVAR

SEQ ID NO: 133008 - protein, 108 aa, Heterodera glycines
  Coding regions on vcDNA: vcDNA=SeqID_59431; Strand=-; Position=1 -156,204-374
  Homolog annotation: Hit_ID=XP_418332.1; Match level="QueryCoverage =94%, HitCoverage=32%, E-value=1e-21, Identity=50%"; Hit description =PREDICTED: similar to CGI-77 protein [Gallus gallus] emb|CAG32397.1| hypothetical protein [Gallus gallus]
MAADYIQQNPEDFLPFLANENGEMFKDEQFDDYCSKVARMCASGGTWGGEPELRALSCVLRCPIEVLHADGATIKFGEVFSGHPLIVTYHKFAYTLGEHYNSTKPTGE

SEQ ID NO: 133009 - protein, 201 aa, Heterodera glycines
  Coding regions on vcDNA: vcDNA=SeqID_59432; Strand=-; Position=1-606
MEHLTDAPPWASAMLGLVNQMVGMCRELIFMVREQDGGSNPNSVFDEERRLHSVVIAQLQESNSQTPTQRATDDLANVKELMDHCDIECLPTQVYRMGKKQADGRPRLLKVELPTKFHTNLFLRNKNKIKNFNKFSKVLLRPSLSKSDLIDRARLITLCKSQRENDPSCDYIVYAGHVLARDDIPAFKSDLNFKCICHNKS

SEQ ID NO: 133010 - protein, 84 aa, Heterodera glycines
  Coding regions on vcDNA: vcDNA=SeqID_59433; Strand=+; Position=1 -58,95-291
MAQHSAMRFVMALEQSDVIYLGASEFSAIILFSMLSQRSNNRRRRHPMTCPPMVMPAPPASMISAITPLMCNSSVTLSRPFDRF

SEQ ID NO: 133011 - protein, 68 aa, Heterodera glycines
  Coding regions on vcDNA: vcDNA=SeqID_59434; Strand=-; Position=1 -81,400-525
MLDFMLQNLTKDHFKIIIPHLFIICVVKTLNISYSSLSIPKKILRQDALFDCPNNSKEARDLRSQTGS

SEQ ID NO: 133012 - protein, 54 aa, Heterodera glycines
  Coding regions on vcDNA: vcDNA=SeqID_59435; Strand=+; Position=1 -58,388-494
MTISTYAWNSCHKKVFFRGGFIAIAPAPFGQFQRTRYRRTHRMNPIFILLIIIF

SEQ ID NO: 133013 - protein, 178 aa, Heterodera glycines
  Coding regions on vcDNA: vcDNA=SeqID_59436; Strand=+; Position=1 -205,530-818,872-914
MTEKNIRGMRLCADTFYHLRQLAPSILNDCPLLRVINFQVTDLFTEFPADDSAMASDGQAVAKWLFTPRICLGFFSRQFLVVIWVFPPSLADSVLPFDQTNELTREHLALKRSVNRDDCFLLVRCPITRNESKWTKWEEETIGGDFFDQWNRIDINIWEDEIGDGLLDATPGPNDQQQ

SEQ ID NO: 133014 - protein, 53 aa, Heterodera glycines
  Coding regions on vcDNA: vcDNA=SeqID_59437; Strand=+; Position=1 -89,148-220
MPNWGDKGRVKRKFGNLNNISFTFYGKCIGPLSPPAEEEKAGQSVEKGAPSDK

SEQ ID NO: 133015 - protein, 27 aa, Heterodera glycines
  Coding regions on vcDNA: vcDNA=SeqID_59438; Strand=-; Position=1 -36,1149-1196
MFNKNANKIQILFSMGRKRDYFLIIKY

SEQ ID NO: 133016 - protein, 62 aa, Heterodera glycines
  Coding regions on vcDNA: vcDNA=SeqID_59439; Strand=+; Position=1 -33,81-164,749-817
MASLLNTSCCLLFINIILIGRVLASAQSEPGENEWFSNDTNMLDKSAFTLHAAATGSVDNDL

SEQ ID NO: 133017 - protein, 132 aa, Heterodera glycines
  Coding regions on vcDNA: vcDNA=SeqID_59440; Strand=-; Position=1 -45,310-485,1288-1465
MSKNTIKFNILGKPEAWLSRRSCDFLVNFAWINATISYRGDVSVRNICQMQPGCERNSACHFLKLLSTQRMHELKDYYLFGNSLFDKETLYPLIDNPCICKDGLQMNVRVVGDLYRRNMAIIQLDGSVFFNN

SEQ ID NO: 133018 - protein, 32 aa, Heterodera glycines
  Coding regions on vcDNA: vcDNA=SeqID_59441; Strand=-; Position=1-96
MTTEGREEKEKKTNDNNNNRDGGMVLMEWRKK

SEQ ID NO: 133019 - protein, 203 aa, Heterodera glycines
  Coding regions on vcDNA: vcDNA=SeqID_59442; Strand=+; Position=1-612
MDNTAPKKFLTSLDQLQIPPEIDNDSAIPDYAKLLIKQLHSLLATASSLVQSQVTANDAIEEDCRQRTVVITNVPEFQSWKASERGEADRALVNLILDTVDLDQTPVVFRVGMRTPNRARPLKMEFPTRHAARHVLRMKGKALALNALHGARIRESMTKEQLAERRKLIEQCAKKRKEDAGDWIIYANQVILRSDIDTIRKNF

SEQ ID NO: 133020 - protein, 161 aa, Heterodera glycines
  Coding regions on vcDNA: vcDNA=SeqID_59443; Strand=+; Position=1 -120,956-1144,1244-1420
MHSAAGTSSSNFNWSKYLEGIFLCLIIFLVESDWVLAGDILFLLGYDSNFDLQKGIYESSNQMVARLSDVVDTGQSASMNMDCIALSDEPYYGQFLIVAGQDEFCALYETKHFSLSEMDGVVNFDRRFDAPSNLSFNVQELVRVQTDKHPGDDSYQAILFY

SEQ ID NO: 133021 - protein, 24 aa, Heterodera glycines
  Coding regions on vcDNA: vcDNA=SeqID_59444; Strand=+; Position=1-74
ALPGPGPGPELFKTRDREPGQTRT

SEQ ID NO: 133022 - protein, 150 aa, Heterodera glycines
  Coding regions on vcDNA: vcDNA=SeqID_59445; Strand=+; Position=1 -159,228-347,476-649
MGVCALDLFLFTCTMENVEPNDDIQQNNMMNMFSVEFSNKNNNNTFDMKRQLNLSPMQPSYKPRALVLCISRIFLFEKWQLLIACLEAYRIFKVDLVVAYVQSAILSVFELMRAYEKDGILKIRPGIRFPHHRGMKWDPNAETELEQTKK

SEQ ID NO: 133023 - protein, 125 aa, Heterodera glycines
  Coding regions on vcDNA: vcDNA=SeqID_59446; Strand=+; Position=1 -253,336-460
MAAATAMQSQQQQQQQQQQLAQQATTAAAALRGDRASAAAIAAGAYGGVAVSGGYGGATTSGAFGAGSSGANVNGPPMATANVVSRPNGHRQFRAVPAELLPAVLPAAVWHRWARQRHAKRRERH

SEQ ID NO: 133024 - protein, 213 aa, Heterodera glycines
  misc_feature (9)..(9): Xaa can be any naturally occurring amino acid
  Coding regions on vcDNA: vcDNA=SeqID_59447; Strand=-; Position=1 -60,507-617,753-881,936-1048,1237-1290,1870-1977
  Homolog annotation: Hit_ID=CAE73320.1; Match level="QueryCoverage =91%, HitCoverage=89%, E-value=5e-35, Identity=39%"; Hit description =Hypothetical protein CBG20748 [Caenorhabditis briggsae]
LRFFVIFIXTFFLILFISPSTPSSNRAAAPFGAGAAQTHRCFSCMSPMYAELFKDSVFRHFYEPKNFSAKCDDPMEPTGIGTVPCRGICLTLSQEFIIMGRKTGKRLTMRGCASTLSRHGYGRKTGKRLTMRGCASTLSRHGYHNRTIAFFAEFDLCREVLASELFRLTSESSSEEIVCSCLGDKCNKQMSSGSAVVVRRHFFFVGMAPVLYA

SEQ ID NO: 133025 - protein, 109 aa, Heterodera glycines
  Coding regions on vcDNA: vcDNA=SeqID_59448; Strand=-; Position=1 -77,225-367,1424-1533
MNPSLRHSFSIENILTKSVNFEAFSEPLLPHHFLGRCFDKVPTFVLEPPPKAFPTEFSSAFFERNNGEREGVRKLEFLLKFRLWIWNCELDDGFVIIDPEKLQDQDFMT

SEQ ID NO: 133026 - protein, 47 aa, Heterodera glycines
  Coding regions on vcDNA: vcDNA=SeqID_59449; Strand=+; Position=1 -13,831-961
MIYPAPKLKAQKWTESIPTVRAVLSLGAMNMMNIYQIGSCPFSVSLP

SEQ ID NO: 133027 - protein, 177 aa, Heterodera glycines
  Coding regions on vcDNA: vcDNA=SeqID_59450; Strand=-; Position=1-533
  Homolog annotation: Hit_ID=AAG56464.1; Match level="QueryCoverage =100%, HitCoverage=76%, E-value=2e-97, Identity=100%"; Hit description=partial putative pump protein; disrupted by IS629 [Escherichia coli O157:H7] ref|NP_287850.1| partial pu
LPHLMIEPMKEMAGFIVMVFPLAQFVAMFNWSNMGKFIAVGLTDILESSGLSGIPAFVGLALLSSFLCMFIASGSAIWSILAPIFVPMFMLLGFHPAFAQILFRIADSSVLPLAPVSPFVPLFLGFLQRYKPDAKLGTYYSLVLPYPLIFLVVWLLMLLAWYLVGLPIGPGIYPRLS

SEQ ID NO: 133028 - protein, 330 aa, Heterodera glycines
  Coding regions on vcDNA: vcDNA=SeqID_59451; Strand=-; Position=1-990
  Homolog annotation: Hit_ID=XP_415982.1; Match level="QueryCoverage =84%, HitCoverage=17%, E-value=7e-12, Identity=28%"; Hit description =PREDICTED: similar to MOV10-like 1; Mov10 (mouse)-like 1 [Gallus gallus]
EHKNRRLCFATLSFCEQLPALFGETTHLIIDEAGQAPYVQILNLVSQLPCLTKVLITGDRRQLRVHLPSLPIAIREGFGMDTVIQNLDVAQGTDVTTLSVCFRSHSALVRCTEAGFYKPHGELLTPGRDDSERALMTDQAAFKLPKKGVPLILVHQSTPAQRDEVSTSSANPGQTDTAMRALWRLARAFPGTLVRCICFYAAQALEIERLVAQQEIPDILVTTADATQGHESSLAVVVTTCSVLDSGADSQPFWAYAARVDVAISRASHGMIIIGDLLLLNRTVPWRRYLDQATTETTVVGPEYFDFEQFNNPDNYHDKDGQLISANGGA

SEQ ID NO: 133029 - protein, 87 aa, Heterodera glycines; identical to SEQ ID NO: 129152
  Coding regions on vcDNA: vcDNA=SeqID_59452; Strand=+; Position=1-685

SEQ ID NO: 133030 - protein, 25 aa, Heterodera glycines
  Coding regions on vcDNA: vcDNA=SeqID_59453; Strand=+; Position=1 -36,136-177
MTYQLSYVHQDHCILGCAGHHEGVV

SEQ ID NO: 133031 - protein, 60 aa, Heterodera glycines
  Coding regions on vcDNA: vcDNA=SeqID_59454; Strand=-; Position=1 -24,76-231
MQKSTSFEDWCHERRVMNESGKANANIAKENALCAETMKNKEVSGKLGGSSKKSAVAAEK

SEQ ID NO: 133032 - protein, 21 aa, Heterodera glycines
  Coding regions on vcDNA: vcDNA=SeqID_59455; Strand=-; Position=1-64
GRFAPVFKFSWAFSAASRPQT

SEQ ID NO: 133033 - protein, 368 aa, Heterodera glycines
  Coding regions on vcDNA: vcDNA=SeqID_59456; Strand=+; Position=1-1107
  Homolog annotation: Hit_ID=AAG23159.1; Match level="QueryCoverage =55%, HitCoverage=89%, E-value=3e-67, Identity=60%"; Hit description =polyprotein [Heterodera glycines]
MKNLARQYVYWPGIDDQIEEIVRSCQTCASEAKAPVKTILHSWPKSDGPWKRVHMDYAGPFFGKMFLVIVDAYSKWPEIFEMNSTGSAATIGKLRYLCARHGLPETLVTDNGTQFSSKEFKEFTRLNGINHLFSAPYCPMSNGQAERFVDTFKRTCRKLKKEGITEMLNTFLATYHVTPNESLPECKSPAELFLQRKLRSTLDLLKPKNRIVIRDEAMERKFNRRHGARPRSFDLDDMVYARHRLSQDWRPGHITQKKGVMYDVTFQDGSVGRFHANQLLVRHSDVDEEDPLDILNDAFGLPLAQANQQLGDVVAQPAGGVIEIAPPSPRPDQPQQLNEVNEERAVQQNVQNERPQRNRRPPDRYSPG

SEQ ID NO: 133034 - protein, 158 aa, Heterodera glycines
  Coding regions on vcDNA: vcDNA=SeqID_59457; Strand=+; Position=1-477
MKFAKKMLMIPEAEYLALRSAMNSGDYLQNEKASLDAKISQNLQDPDISEDLKAKRHDWLYKERRTVKGILENRPQKVVIENHVPGPNVAPYLGLNNQSKPQETEEPRKIIIPRKRLEEQTPDPESDNDTLEELTPEPQTTSTLKTPITIKTIIHPTL

SEQ ID NO: 133035 - protein, 135 aa, Heterodera glycines
  Coding regions on vcDNA: vcDNA=SeqID_59458; Strand=+; Position=1 -196,290-363,413-549
ESSMWSLEVPDIDNFETLRNIMDSSKRQDYLPTIQWVKANRGEDNDRHDLLFRLQCQHVIRLLETNGKRQALGYVKEMQDEEKEKYKEELKHLMFVVMTHPQKGPHDYLFNEGRRFELEWKLANAITDYRSSLST

SEQ ID NO: 133036 - protein, 64 aa, Heterodera glycines
  Coding regions on vcDNA: vcDNA=SeqID_59459; Strand=+; Position=1 -90,465-569
MPQRSLLILFHDTAGITDFGSIELRKPYLQVPIAVVGTNCEMSGKKVNTESALLWASRVKKVGR

SEQ ID NO: 133037 - protein, 141 aa, Heterodera glycines
  Coding regions on vcDNA: vcDNA=SeqID_59460; Strand=+; Position=1 -198,970-1199
FFTPVLPKPLRKVSSSTTKTSSTSPVPKSHVTTLPRRTKAWTTKRTTTIATTETTTPLTTTAPTVEPLDFEKVGIGIRDWHQIGVGLAGLKSLFCSRFCRDPDPGSFFKKGPGSRAWENPGGIPIRVWALITIQIFKIKKL

SEQ ID NO: 133038 - protein, 151 aa, Heterodera glycines
  Coding regions on vcDNA: vcDNA=SeqID_59461; Strand=+; Position=1 -97,420-620,758-915
MDDINGSNSQALSAADQQSINDDHSVNQEQDDDINNVYKHKGQIEFRMTNFKAFSEGTEPKEVLSEPVVYMNGLPWRILAKHNDDASFGLFLCCFGDETDMAWNCLATKQLSVVSCAKSGQKCQNEKGNTNDYDRFDAKKLRWGWGKICKI

SEQ ID NO: 133039 - protein, 100 aa, Heterodera glycines
  Coding regions on vcDNA: vcDNA=SeqID_59462; Strand=+; Position=1 -89,230-290,1411-1563
MNEQKGFYDANDDAVTFKAQVVTQPPNGMPGLRTVDTLRVNGQLVYVNKFKQVLDAMNKSDFEITGRNYMVALFDHNKMDRYALKELDERHKQLFATSPQ

SEQ ID NO: 133040 - protein, 86 aa, Heterodera glycines
  Coding regions on vcDNA: vcDNA=SeqID_59463; Strand=-; Position=1 -170,322-412
MATLIRRAIELGRERTAELEETHATTSIADWLNVGQAATQIRQRRERVIGREMKRKDKEMLKMVKLMRIETNLSNLNGNEIENVKK

SEQ ID NO: 133041 - protein, 145 aa, Heterodera glycines
  Coding regions on vcDNA: vcDNA=SeqID_59464; Strand=-; Position=1 -195,485-726
AFVGTFNPSGPINKEKNTVKINFINAIEQFMYDYTVLKENKKERKDVEYLKVVFAKFAKLWDLAHFAQICAEGKEYEQTYVNGTPFVRNVRYIFAKWADIKKMAVDTANNQVSEQSLEFAFGPLFWNYKNKFHGPTAKKHSVLKE

SEQ ID NO: 133042 - protein, 318 aa, Heterodera glycines
  Coding regions on vcDNA: vcDNA=SeqID_59465; Strand=-; Position=1-955
  Homolog annotation: Hit_ID=AAL90446.1; Match level="QueryCoverage =99%, HitCoverage=50%, E-value=3e-28, Identity=30%"; Hit description =surface protein PspC [Streptococcus pneumoniae]
MSEMGTPTPNVRNRTPTPNVRNRNPRPQMSEIGTPTPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCQKSEPRPQMSEIGTPTPNVRNRNPDPKCHKSEPRPQMSNIGTPTPIVRNRDPDPK

SEQ ID NO: 133043 - protein, 50 aa, Heterodera glycines
  Coding regions on vcDNA: vcDNA=SeqID_59466; Strand=-; Position=1 -52,211-311
MFMELRLISPNVREGFPFVLGRFVKSANLGMFRKSANLGMFRKGATVVVL

SEQ ID NO: 133044 - protein, 105 aa, Heterodera glycines
  Coding regions on vcDNA: vcDNA=SeqID_59467; Strand=+; Position=1 -60,103-229,452-582
MDVGRVRQLSSYAFKLFVIADVFLEHDTVFWVDTSIVFHNNNTKPILASIQTGKIGPVQMPSNQMVALRIFLMFGQSVSEGQFVSGQFLICFINDQNLRKSLLNL

SEQ ID NO: 133045 - protein, 80 aa, Heterodera glycines
  Coding regions on vcDNA: vcDNA=SeqID_59468; Strand=-; Position=1-243
MHQTGVVVALPFAISIFLSIAVGRLFDRLIGTKAALVLLTCVLQARMVDQSFGNADQYSTNAKPRKRIRTKKISKLQTPD

SEQ ID NO: 133046 - protein, 247 aa, Heterodera glycines
  Coding regions on vcDNA: vcDNA=SeqID_59469; Strand=+; Position=1 -147,236-332,548-731,898-983,1066-1131,1439-1518,2188-2217
  Homolog annotation: Hit_ID=CAE63106.1; Match level="QueryCoverage =97%, HitCoverage=60%, E-value=6e-49, Identity=45%"; Hit description =Hypothetical protein CBG07401 [Caenorhabditis briggsae]
FKIKFSFINFEEKYFKKFHFTSNFDKKTRTEIAVKRKLTQRKYNFTSRDFAPLERVDFAPLERVVVKSIPFAAGSQWQFLGALYFCTVVITTIGYGHSTPITVGGKLFCMMYALGGIPLGLIMFQSVGERINHFIASLLGKIKASFNSNDIDWLVHVKSRHLLCVSFAIGCVTISVATCVFHQHERWSVCVFHQHERWSVFNSAYYCLITLSTIGFGDYVPAQTDQRLHKEPFYLVNKILKILMQFI

SEQ ID NO: 133047 - protein, 21 aa, Heterodera glycines
  Coding regions on vcDNA: vcDNA=SeqID_59470; Strand=+; Position=1-64
GITVDGLSMVLVNATADTYAN

SEQ ID NO: 133048 - protein, 55 aa, Heterodera glycines
  Coding regions on vcDNA: vcDNA=SeqID_59471; Strand=+; Position=1 -85,281-363
MKNTFYYFTIFTVFSNLHVKALPSKDKAGTRNGQIADSLADQMEKVLNKREYSDV

SEQ ID NO: 133049 - protein, 198 aa, Heterodera glycines
  Coding regions on vcDNA: vcDNA=SeqID_59472; Strand=-; Position=1 -171,323-748
MAKVHHQMPFLPNIKNNGPPLIHQSASTDAKQHKQQQNIIAVIEKHLEQYTSDSTKEEQHEAELFGLGHIGDDTPLEKKRLKQAATDNDRNAGDDAQALASSAGTKNEHCEALHGWLSTFLPLLYVNKLNSLCAKQPQSESTRLLMAMKAQDDPKDGNDDGTVAPHESLWTKKRATVEEEMCEFGIRMGCAPSIYEII

SEQ ID NO: 133050 - protein, 211 aa, Heterodera glycines
  Coding regions on vcDNA: vcDNA=SeqID_59473; Strand=-; Position=1 -111,525-1049
MNKPQPNFHCPLCGRYLCASVFSSDNPLDPREQHQPLKRESLIPSMRNVKSMLKRLFGGGGVENGGKASATKLVVTAQNDGPSRNHLMDIVGSEEEETVKKKKRKLNEDEGNNDQREEEESGKKVRVVEESGKKARVVEESGKGMERVEESGEKEGRDVGENGLGNETMGESLGEEGKEVKKGETVGDVPATIENGNGHDQTEEEQQTKAD

SEQ ID NO: 133051 - protein, 67 aa, Heterodera glycines
  Coding regions on vcDNA: vcDNA=SeqID_59474; Strand=+; Position=1-202
MHFSLPLALLFALILTLCNNFCDGMRRNNNKSLLNNLSKNGNTVPRTQISGIMNRQAGQELTLGQPA

SEQ ID NO: 133052 - protein, 131 aa, Heterodera glycines
  Coding regions on vcDNA: vcDNA=SeqID_59475; Strand=+; Position=1-396
MQSMDLLRELSEYSGGTRRTKRWEEKAREIDQTEEGKAKNAANDQQSDQNEGIPIEVIVYPGTASQEEAEKGYEGEQMEEEEEEEEEEPTPEQMARWRRRRLLPNEVSVSMKCHLSRANQWVGLDKVVILT

SEQ ID NO: 133053 - protein, 51 aa, Heterodera glycines
  Coding regions on vcDNA: vcDNA=SeqID_59476; Strand=-; Position=1-154
AFSDATSLLQTIQANSGGGAVGVVPLSSPAVDSAGAKSAILQQQQQAHAAP

SEQ ID NO: 133054 - protein, 21 aa, Heterodera glycines
  Coding regions on vcDNA: vcDNA=SeqID_59477; Strand=+; Position=1-64
GPGSRSRVLKSSGPGPGPGRA

SEQ ID NO: 133055 - protein, 48 aa, Heterodera glycines
  Coding regions on vcDNA: vcDNA=SeqID_59478; Strand=+; Position=1 -35,345-456
  Homolog annotation: Hit_ID=NP_509531.1; Match level="QueryCoverage =100%, HitCoverage=6%, E-value=4e-12, Identity=52%"; Hit description =organic anion transporter K2 (82.5 kD) (XJ679) [Caenorhabditis elegans] gb|AAK72059.1| Hypothetical prote
MLILGLGRTMPWALGIPLIDDNVKRHKMPMYFAAINFFKIMGPSCGFL

SEQ ID NO: 133056 - protein, 38 aa, Heterodera glycines
  Coding regions on vcDNA: vcDNA=SeqID_59479; Strand=+; Position=1-117
EDDQHQDSASNSNTATKSSKVDTISLENIQQKELDKQI

SEQ ID NO: 133057 - protein, 141 aa, Heterodera glycines
  Coding regions on vcDNA: vcDNA=SeqID_59480; Strand=-; Position=1 -407,759-777
MALTLGPIPLWQILRGAWPAVLCTRNVCVFVLIDSPGGLKGTHRHTHRDEAKQLIRKEGEVEEKQCYWQRKRERGRDNAIGRKEGKERKNVEAKRVKSGDLHLKGRQRSMEVRDRERMKRKREREKGGKGEGMGRNVGQVD

SEQ ID NO: 133058 - protein, 18 aa, Heterodera glycines
  Coding regions on vcDNA: vcDNA=SeqID_59481; Strand=-; Position=1-54
MRNSKTLKFRLLFEFGSK

SEQ ID NO: 133059 - protein, 130 aa, Heterodera glycines
  Coding regions on vcDNA: vcDNA=SeqID_59482; Strand=-; Position=1 -138,268-522
MDNGSYLLGAQLEGSDMDLICFVPNDINVYNFYGENKDSLLSAFKMTKLTDVDLSFVPAPKSFVNLLNADFKSDEIVKEIKFESALYSLAGSLNISDNWILKLRRFSELRKSETRNYWGPKCIISIIRKF

SEQ ID NO: 133060 - protein, 129 aa, Heterodera glycines
  Coding regions on vcDNA: vcDNA=SeqID_59483; Strand=-; Position=1-1060
ALSVPSSSVSRPLLLSLQSALQLSPQRYCSLSDSWPYLVLDEVYHLIWAAIPNNPTPRHVKMDRHRQLDRSCTFSGAPVKGNLNKRANPSSRSIRYTSQPRGAAIQRWTLPSSLAVTTGILVSFFSSAY

SEQ ID NO: 133061 - protein, 39 aa, Heterodera glycines
  Coding regions on vcDNA: vcDNA=SeqID_59484; Strand=+; Position=1-118
MPQHLARCACLLLAHAKAVALVCHVERRGAKSLVYDLTT

SEQ ID NO: 133062 - protein, 47 aa, Heterodera glycines; identical to SEQ ID NO: 127360
  Coding regions on vcDNA: vcDNA=SeqID_59485; Strand=-; Position=1-430

SEQ ID NO: 133063 - protein, 99 aa, Heterodera glycines
  Coding regions on vcDNA: vcDNA=SeqID_59486; Strand=+; Position=1 -94,206-360,607-657
  Homolog annotation: Hit_ID=NP_499126.1; Match level="QueryCoverage =77%, HitCoverage=19%, E-value=2e-10, Identity=42%"; Hit description =DNA PRImase homolog (48.1 kD) (pri-1) [Caenorhabditis elegans] emb|CAA80161.1| Hypothetical protein F58A4
MDLTKLEPCLKEYYLNCYPYDLIFKWLSYSNKNRDYLSKREFAFIKGQSHLRFFSFVEPKEFMVQLRKTPPQKIDLGAVYNRPGHKCVQKVLALDHNCG

SEQ ID NO: 133064 - protein, 171 aa, Heterodera glycines
  Coding regions on vcDNA: vcDNA=SeqID_59487; Strand=-; Position=1-513
  Homolog annotation: Hit_ID=YP_102734.1; Match level="QueryCoverage =76%, HitCoverage=30%, E-value=6e-11, Identity=33%"; Hit description =outer membrane protein, putative [Burkholderia mallei ATCC 23344] gb|AAU48866.1| outer membrane protein,
MRAKAKRANRLSAISERLSRNAAMRNAKRDENGGQTEQSNGKRDEDKTNTTEEEQHKTAERGTNTTALAQLATERGTNTTALAQLATERGTNTTALAQLATERGTNTTALAQLATERGTNTTALAQLATERGTNTTALAQLDPEFFRRLVTNVINRGGGNEEKGAEEKVKK

SEQ ID NO: 133065 - protein, 105 aa, Heterodera glycines
  Coding regions on vcDNA: vcDNA=SeqID_59488; Strand=-; Position=1-318
  Homolog annotation: Hit_ID=XP_345184.1; Match level="QueryCoverage =100%, HitCoverage=35%, E-value=6e-10, Identity=41%"; Hit description= similar to CG14852-PA [Rattus norvegicus]
GRFAPVRGTTAIRTRTKVIRRGTTVIRRGTTVIRRGATVISRGTKVIRRGTTVIKRGTKAIRRGSTVIRRGTTVIRRGATVMRRGTTVIRRGTTVIRRGTTVISR

SEQ ID NO: 133066 - protein, 678 aa, Heterodera glycines
  Coding regions on vcDNA: vcDNA=SeqID_59489; Strand=-; Position=1-2035
MPNKAKNLRKKMKEDRRPAEKSVSPGCSPVPDGSADGNGAASPRGFNTPNISALQLSTPASSIGSKRRGRPPKARAEPITASQNSVSTIDIPIESSSQKADFSPASKKVKITDVGRALAVNEAIASTPTTTQRNRGGRPAKKRGGHAGSGRSKANDSMSESSSMDQSSEATTSVAVLPTVPEKINFSTVPINFATSRNMACKIRRWADVGLYERDGETSQGPRSGPRFIETCWNDLTQFLNDAFVVEYLAYLASISQRKVVVVDPVVWQMGIDRVIQYKNMTFGYDANVPAEVILLPVHFPGHWTLIVHDVQCGTHFADSLPTPYGRLDVQLTDKIIKIISDILPSTMLTGIVDVQNLTAQHDGNSCGYFVCLYAESWLMNNRTFVLPDLSINYEKKRILWHINELYGSDNVPYHPREGVPTPCPIVYRHADEAQSTSKAVESMEVDDNDDIMIIEPQTSGQAANAILTQAQVAGENQVDSLGLVSESCAPQEPIAQADDVIFVRPKTPTRRSVRIGRRQSASISRSPSPAPKRRTSENVPGQVTRFTKRCHLVHKGWCCAAAAAKHFPEYSDSGKLGEKKCAHCGALLFPHEDSSHCCRQGRVVLPKLNPHPKELEELIVCDKQPREGKEFVRNMSRYNNLLQFASVSAGNKPCPAGGPMAVILNGEFHRRISSMQA

SEQ ID NO: 133067 - protein, 223 aa, Heterodera glycines
  Coding regions on vcDNA: vcDNA=SeqID_59490; Strand=-; Position=1 -24,71-226,269-593,1618-1784
MSKSASFEEWCHERRTLNDGGKSNVKIPNENALSEEMTKTKKHSGKFGVSSKKIAVTAEKDQASRRNKNAEKNVDENVVLEVLDAATMEPLSSQTAAAIEADARIIITKAKKGKKREQKIANRSQTKKLRATTEKTPNAVPEENLGTSTEFEKKKTRSYESGWKKYPKAKSKLSDEQIVRATVNRLVAHVLYEETMKTAEAKKRKNQETAQDCNTQKMRKSNI

SEQ ID NO: 133068 - protein, 99 aa, Heterodera glycines
  Coding regions on vcDNA: vcDNA=SeqID_59491; Strand=-; Position=1-300
LFGKASESLRIVMNPMMDTIPIPFAMGMATIPIPFARGMATIPYRLLGGWTTSPYRLLGGWPPSPYRLLWGWLPSAYRLLEGWPPSPYRLLGGWTTSPY

SEQ ID NO: 133069 - protein, 332 aa, Heterodera glycines
  Coding regions on vcDNA: vcDNA=SeqID_59492; Strand=-; Position=1 -601,647-1041
  Homolog annotation: Hit_ID=AAG23159.1; Match level="QueryCoverage =58%, HitCoverage=87%, E-value=1e-74, Identity=66%"; Hit description =polyprotein [Heterodera glycines]
MHLNTGLEEDLLKLATKNLPIKFHDLILATKNDALLKNVVQFVQKGWPNDKDLGQEEEIVRLFHRRKDDLSILKDCLMYGERVVIPKIFQSKILHLFHKGHPGMKRMKQLARQYVFWPKMDQNIEEFVQKCEPCQAAAKAHVKVNLHSWPKSSEPWQRIHIDYAGPFYGKMFLIVVDSFSKYPEVFEMTTSSATATLDKLHNGTQFSSSEFAKFTAANGITHLFSAPYNPMSNGQAERFVDTFKRAFRKLKGEGMPNQEIIETFLITYRTTPNDSVPNSKSPAEMLLGRKPRTTFDLLKPPPFRPLIRDLAMEEKFNKRFGTKPRKFGIDDK

SEQ ID NO: 133070 - protein, 255 aa, Heterodera glycines
  Coding regions on vcDNA: vcDNA=SeqID_59493; Strand=+; Position=1 -58,243-952
MRGGQMVTNTINRMCLTVKGVENAIGDFPFYYTFKYERNSGEDGNECKYNHVDAKDAELEEHLSFYHDNGKDEKLAILLRSYYNEKKELEEREKNFAQVNSLNDLRAVLRAHDNRHKGLAEQEYYEQVINQQHMFGFLHPISEGNLERQKVIYDAAKNELDAYMTKMKGQLEGQHKQLENDDDEFSSKIKQIEGQPEQSEKDDDELNSNMKQIEEKQPEQSVIMKYIRKIAKKLKTCMKGHVKNGGDNSNEKCED

SEQ ID NO: 133071 - protein, 33 aa, Heterodera glycines
  Coding regions on vcDNA: vcDNA=SeqID_59494; Strand=-; Position=1-102
CSPPPSSDLFICYFNLSSINYLFVRPFDISRTE

SEQ ID NO: 133072 - protein, 58 aa, Heterodera glycines
  Coding regions on vcDNA: vcDNA=SeqID_59495; Strand=-; Position=1-174
MQQKSGEANDGHTQRQSDGAKATKSNDGVTDCCRTTTTNATEPIQRGTIRHAIIAKSK

SEQ ID NO: 133073 - protein, 63 aa, Heterodera glycines
  Coding regions on vcDNA: vcDNA=SeqID_59496; Strand=-; Position=1 -64,201-328
MARAIPQFCPVIFSLLLGDYFAQQQKEREREEKKSNPLNVRESAWGREGEQEKNEEERKGAEK

SEQ ID NO: 133074 - protein, 18 aa, Heterodera glycines
  Coding regions on vcDNA: vcDNA=SeqID_59497; Strand=+; Position=1-56
YREAIPEGFGLPINLGAS

SEQ ID NO: 133075 - protein, 93 aa, Heterodera glycines
  Coding regions on vcDNA: vcDNA=SeqID_59498; Strand=+; Position=1 -161,206-326
MDQEMSAGIQQSRPSGKINHEILMEETRRIPILGEVVGQLRNIYGSSLAEQFKNELIIASQLNRGPMNNGISNPHMDMLLGVDEKISDLLHQL

SEQ ID NO: 133076 - protein, 23 aa, Heterodera glycines
  Coding regions on vcDNA: vcDNA=SeqID_59499; Strand=+; Position=1-69
MVLDPKSKDKARELGSYRDMRFE

SEQ ID NO: 133077 - protein, 70 aa, Heterodera glycines
  Coding regions on vcDNA: vcDNA=SeqID_59500; Strand=-; Position=1 -201,421-432
MDTAKFCATDQFEKFLATGRQRLQRECAELKSQKLVSALFERKRKRDNEMALLADEVDQLKFELVIKIMI

SEQ ID NO: 133078 - protein, 29 aa, Heterodera glycines
  Coding regions on vcDNA: vcDNA=SeqID_59501; Strand=-; Position=1 -66,123-146
MAISFFEKFSMQQTLSNMKRSAKNGYLFF

SEQ ID NO: 133079 - protein, 29 aa, Heterodera glycines
  Coding regions on vcDNA: vcDNA=SeqID_59502; Strand=-; Position=1 -66,123-146
MAISFFEKFSMQQTLSNMKRSAKNGYLFF

SEQ ID NO: 133080 - protein, 29 aa, Heterodera glycines
  Coding regions on vcDNA: vcDNA=SeqID_59503; Strand=-; Position=1 -66,123-146
MAISFFEKFSMQQTLSNMKRSAKNGYLFF

SEQ ID NO: 133081 - protein, 29 aa, Heterodera glycines
  Coding regions on vcDNA: vcDNA=SeqID_59504; Strand=-; Position=1 -66,123-146
MAISFFEKFSMQQTLSNMKRSAKNGYLFF

SEQ ID NO: 133082 - protein, 20 aa, Heterodera glycines
  Coding regions on vcDNA: vcDNA=SeqID_59505; Strand=-; Position=1-61
MAISFFEKFSMQQTLSNMKR

SEQ ID NO: 133083 - protein, 29 aa, Heterodera glycines
  Coding regions on vcDNA: vcDNA=SeqID_59506; Strand=-; Position=1 -66,123-146
MAISFFEKFSMQQTLSNMKRSAKNGYLFF

SEQ ID NO: 133084 - protein, 29 aa, Heterodera glycines
  Coding regions on vcDNA: vcDNA=SeqID_59507; Strand=-; Position=1 -66,123-146
MAISFFEKFSMQQTLSNMKRSAKNGYLFF

SEQ ID NO: 133085 - protein, 29 aa, Heterodera glycines
  Coding regions on vcDNA: vcDNA=SeqID_59508; Strand=-; Position=1 -66,123-146
MAISFFEKFSMQQTLSNMKRSAKNGYLFF

SEQ ID NO: 133086 - protein, 27 aa, Heterodera glycines
  Coding regions on vcDNA: vcDNA=SeqID_59509; Strand=-; Position=1 -60,121-144
MAISFFEKFLCNKRSRNMNEKNGYLFF

SEQ ID NO: 133087 - protein, 29 aa, Heterodera glycines
  Coding regions on vcDNA: vcDNA=SeqID_59510; Strand=-; Position=1 -66,123-146
MAISFFEKFSMQQTLSNMKRSAKNGYLFF

SEQ ID NO: 133088 - protein, 29 aa, Heterodera glycines
  Coding regions on vcDNA: vcDNA=SeqID_59511; Strand=-; Position=1 -66,123-146
MAISFFEKFSMQQTLSNMKRSAKNGYLFF

SEQ ID NO: 133089 - protein, 29 aa, Heterodera glycines
  Coding regions on vcDNA: vcDNA=SeqID_59512; Strand=-; Position=1 -66,123-146
MAISFFEKFSMQQTLSNMKRSAKNGYLFF

SEQ ID NO: 133090 - protein, 70 aa, Heterodera glycines
  Coding regions on vcDNA: vcDNA=SeqID_59513; Strand=-; Position=1 -106,166-272
MNMLHPFHLHGTKFYVLKVGTMEPEYGLNSDVQCAGRLFGDEMVKYKLLQRKHTTFEEGITILIKFTMNK

SEQ ID NO: 133091 - protein, 168 aa, Heterodera glycines
  Coding regions on vcDNA: vcDNA=SeqID_59514; Strand=-; Position=1 -303,348-549
  Homolog annotation: Hit_ID=NP_495447.1; Match level="QueryCoverage =83%, HitCoverage=38%, E-value=1e-15, Identity=31%"; Hit description =BRCA2 protein BCCIPbeta like (39.5 kD) (2H343) [Caenorhabditis elegans] gb|AAB93435.1| Hypothetical prote
MNSTKRPLEKNKKDSIKSITKERKLELRNIAENGQIENENKEEEESDQLSEEGEESDDGEVMPEIEDGNDQSEEMAKLDFEFEALPPAEDDLDDIERLLIQIFLQAEVDEREMAKAVVGQSPMGCVFRPTEESEDDESEAITYGVLSIVPLNGTQANLGRQFEKKIKL

SEQ ID NO: 133092 - protein, 52 aa, Heterodera glycines
  Coding regions on vcDNA: vcDNA=SeqID_59515; Strand=+; Position=1 -38,90-188,548-569
MLAQNNEDKKGTGVFPFQIIQIDGKGKHLWVELLNQIKFRTKEIYCTKLDCA

SEQ ID NO: 133093 - protein, 148 aa, Heterodera glycines
  Coding regions on vcDNA: vcDNA=SeqID_59516; Strand=+; Position=1 -62,363-498,585-833
  Homolog annotation: Hit_ID=Q9KX73; Match level="QueryCoverage=69%, HitCoverage=23%, E-value=7e-11, Identity=35%"; Hit description =Xylitol oxidase dbj|BAA95146.1| xylitol oxidase [Streptomyces sp.]
MGNNVLMMTTFANSSVWDRVTVEVNKVQPWYYGLMNIRPGLTGKDGNELQSEYIMPYKNGVPAIKAVSSLHQQIQPLLNGFVIRTVKGDDLWLSMSNGDGPMVALHFSWAESRPTKVNAVLAQIERVSERISRRTEEFLIRQVEKGAH

SEQ ID NO: 133094 - protein, 42 aa, Heterodera glycines
  Coding regions on vcDNA: vcDNA=SeqID_59517; Strand=-; Position=1 -41,109-196
MSKENTLTGEEILYIRSLFVVDNEKQFIISNFMLSNSCDFKF

SEQ ID NO: 133095 - protein, 333 aa, Heterodera glycines
  Coding regions on vcDNA: vcDNA=SeqID_59518; Strand=+; Position=1 -733,785-922,972-1097,1336-1340
  Homolog annotation: Hit_ID=NP_491423.1; Match level="QueryCoverage =89%, HitCoverage=20%, E-value=2e-13, Identity=23%"; Hit description =human XNP gene related (156.2 kD) (xnp-1) [Caenorhabditis elegans] gb|AAC24256.1| Human xnp gene related
MVRISCLFVVATYCLNGLLLSTTIMANSDEETETKMPAKRPRKQKETPDYYLSSYLPTDYSRSSSSAEPDNSSDEDWNAKEEADTKDEESPNVSLANSSSSAADEKQLLGHKVTVQNRPKTGQSVQNKPKKQKSVESSPEDNENIERLKAEVQELMRKSKAKAAAGVGSSKTKTNLQTSKSFKESGDRGKGKGKTTEETGEPSKKMKKATKGKVPKKQTSFDDLNISEILANLDNSSSDEVVSKKSKAPANSSKSLKLSSPSKNKQKQKQNSSDESVEIITPVKKERMQKKGKGVKVEKPTASENAKAMETLNINAGRISGAMTLVKNHHNGR

SEQ ID NO: 133096 - protein, 199 aa, Heterodera glycines
  Coding regions on vcDNA: vcDNA=SeqID_59519; Strand=-; Position=1-600
MHDLFNSFIIGQLSAANGTDGSMSQPSDPMTHNQNRLVETNFAKFSRETNQANNHRGGTSKQQTKSMSSKSEEKMLWPSTNQPNGVPLDMDKVRLFSNAIAFIAMEFVASSSESRAELYTCKCLSDNEMEKKIFGPNGAILSHLNASFLNSAQKKRQFLKLLFSFGSILSTETAQIRGAKQKVKVNAIVKAYECAGINR

SEQ ID NO: 133097 - protein, 25 aa, Heterodera glycines
  Coding regions on vcDNA: vcDNA=SeqID_59520; Strand=-; Position=1-77
MRSPPAIPRSFCSAAKAKVRFQCPG

SEQ ID NO: 133098 - protein, 41 aa, Heterodera glycines
  misc_feature (21)..(21): Xaa can be any naturally occurring amino acid
  Coding regions on vcDNA: vcDNA=SeqID_59521; Strand=-; Position=1-182
NFLKYKPKLFGLFKKELKIFXIFIHLPFDRKSIREPYLTFN

SEQ ID NO: 133099 - protein, 267 aa, Heterodera glycines
  Coding regions on vcDNA: vcDNA=SeqID_59522; Strand=-; Position=1-801
MNFKTAGGLGNKINEAFSHHYKIKKQRGKREAKAEDTKDSKIDVAKRAAERAGRDVERHFNQINNISNSIQTQLNTLRETNPHILEEPDIKIWFDKMVEMGTEIQTSRNELKSFQEEVDKAKNTTLEHVEKNDLKKAKKSADVAKGIARQAKTKYTSTLEGYNDKSEKGFSGIVNRLNEALGEHIKRKDIENRQVSEAEKGPQKRERLANEDVQFQYDSIDQKFIVYLSAAVSHIDLSKHLAYVLGFKNTRLFHAEEANYMPDLTGG

SEQ ID NO: 133100 - protein, 198 aa, Heterodera glycines
  Coding regions on vcDNA: vcDNA=SeqID_59523; Strand=+; Position=1 -82,130-203,344-466,523-644,839-897,1080-1131
  Homolog annotation: Hit_ID=CAE59027.1; Match level="QueryCoverage =98%, HitCoverage=57%, E-value=1e-42, Identity=46%"; Hit description =Hypothetical protein CBG02304 [Caenorhabditis briggsae]
LPHRVHNISIHPLYQIHSAYDAALIRISPVSKFGDSVWISPVSKFGDSVWPICLPTFPASVNRMCVVTGWGRLAEGGKPQNLREIHVPIMRSTTCNGVSHYAGRLHYPSMLCAGFNAGKADARLHYPSMLCAGFNAGKADACQGDSGGPLQCQNENIWELQGIVSWGIGCANPKFPGVYTKTFVISPWIRAEMLRLKT

SEQ ID NO: 133101 - protein, 179 aa, Heterodera glycines
  Coding regions on vcDNA: vcDNA=SeqID_59524; Strand=-; Position=1 -208,411-477,524-641,1189-1230,1286-1388
  Homolog annotation: Hit_ID=NP_731868.1; Match level="QueryCoverage =61%, HitCoverage=23%, E-value=3e-21, Identity=48%"; Hit description =CG2988-PA [Drosophila melanogaster] gb|AAF54999.1| CG2988-PA [Drosophila melanogaster]
MRPFDSVDTEFGPRAGDDDTSLVISRWALQCIRMIAGDDAKMTTMKTVNADSPEQISPTDAANSIFLNPSIALGNGNAFPLFQQMQKAKRIRTAFSPSQLVKLEQAFNGSQYLVGSERKVLAKQLALSETQVKVWFQNRRTKSKRLDNGEMMPSKRGAEEESERGTKRKETAQNTSNET

SEQ ID NO: 133102 - protein, 51 aa, Heterodera glycines
  Coding regions on vcDNA: vcDNA=SeqID_59525; Strand=-; Position=1 -103,168-220
MTLVGSIALLLILFIVFLAVLLRMNLNKKENRGHCVKNEEVRMALFITLIN

SEQ ID NO: 133103 - protein, 45 aa, Heterodera glycines
  Coding regions on vcDNA: vcDNA=SeqID_59526; Strand=-; Position=1 -51,101-187
MGKRHGVHLCPLDIQTGRNQPQNSDFLRSATPGNEHKFTQLNHFG

SEQ ID NO: 133104 - protein, 635 aa, Heterodera glycines
  Coding regions on vcDNA: vcDNA=SeqID_59527; Strand=+; Position=1 -363,785-964,1078-1217,1275-1709,2064-2409,2463-2633,2815-2958,3111 -3239
  Homolog annotation: Hit_ID=F88504; Match level="QueryCoverage=41%, HitCoverage=89%, E-value=6e-35, Identity=35%"; Hit description =protein B0361.2 [imported] - Caenorhabditis elegans
MQAILTQKNRTKLQHNGHSYIFHKLSAEGEVRFWSCEHHHAKDIRCKGRLHTNLNNNVLREVGNHQCEPSAARMEAQRVITKIKRRAEQTMEPPATIRSLSLQNVATPVLPQLPTKNAIKKSESLVIPVCYCMLSNKTHTTYERMFRMLVAVWPDFNPDSVSIDFETAAITALNVVFPFTERYQNDPTFAEMARCVTSLAFLPIGDLTPGIIALDMALPDELTPVLDWFIMNYTGRLKHDGNRTRPRFDPNIWSVYTRTLQGDDRTNNHSEAANRRLQCAFACSHPSIWHFIDLLRKDQKLSDDDFAKCSTGQEPPQKAKKYREADRRILTMVQNYLPLNNADTNIFPIHHPFNHHFIITFLIGISRNYEMRPTMHRSYLMRRPNDEDDSYDYGEQDLVRAKPIDARFSRNLGPTYAGGKDFVRASEHSQKQFYGSQMVVGSESQQHNEEFGEGTSKEADDKSSRPMTHDERNKISASILKAELRGDIERVKKLKRKLEEGIVENENGGNGKDEEGEGRERRREVLLLSMDKRSGVVMPAKGPQKNRNEPSEKRRIGTVDEEFGKHMELSQMVAEEKTTTAEQQIAMFNRSAKVCSDSKTDDDWVVDDNMMSHPKKRRHEEKEIVRKKRNMVEGG

SEQ ID NO: 133105 - protein, 227 aa, Heterodera glycines
  misc_feature (223)..(223): Xaa can be any naturally occurring amino acid
  Coding regions on vcDNA: vcDNA=SeqID_59528; Strand=-; Position=1 -136,182-348,399-521,759-905
  Homolog annotation: Hit_ID=NP_498608.1; Match level="QueryCoverage =96%, HitCoverage=93%, E-value=5e-40, Identity=42%"; Hit description =n/apple PAN precursor (22.0 kD) (3I388) [Caenorhabditis elegans] gb|AAK18868.1| Hypothetical protein B036
QFYILLNVLASTGFVFCTTEWFGDLRAHMNPPKFPPFYDIVYDEPVADCPFGLESVAIPEFVYFGEMIATVADCPFGLESVAIPEFVYFGEMIATKFVQEHSQCLQFCLETSKCKAVNFFESIEGKEVGFCELLVEGQEVGFCELLVEGQYDNPRLMRPFKKATYHEKIHCRAENEEEKTKEETAQKSETQEKATEPPTAQLSLILKRLAERIQELKKRFRNXQMRN

SEQ ID NO: 133106 - protein, 87 aa, Heterodera glycines; identical to SEQ ID NO: 132477
  Coding regions on vcDNA: vcDNA=SeqID_59529; Strand=-; Position=1 -459,787-1295

SEQ ID NO: 133107 - protein, 48 aa, Heterodera glycines
  Coding regions on vcDNA: vcDNA=SeqID_59530; Strand=-; Position=1-156
RRRVNVRADEVQIGHPFFVLLQSFAVTAHQNGLCFCLVAFLLFIKLGF

SEQ ID NO: 133108 - protein, 256 aa, Heterodera glycines
  Coding regions on vcDNA: vcDNA=SeqID_59531; Strand=+; Position=1-769
  Homolog annotation: Hit_ID=NP_648504.1; Match level="QueryCoverage =100%, HitCoverage=79%, E-value=1e-34, Identity=36%"; Hit description= CG6004-PB [Drosophila melanogaster] gb|AAF50015.2| CG6004-PB [Drosophila melanogaster]
EESSASANEEVSTSDDPASTTEESSASANEEASTSDDPASTTEESSASANEDDPASTTEESSASANEEVSISDDPASTTEESSASANEEASTSDEESSASANEEASTSDEESSASANEEVSTSDDPASTTEESSASANEEASTSDDPASTTEESSASANEDDPASTTEESSASANEEVSISDDPASTTEESSASANEEASTSDDPASTTEESSASANEDDPASTTEESSASANEEVSISDDPASTTEESSASANEE

SEQ ID NO: 133109 - protein, 256 aa, Heterodera glycines
  misc_feature (240)..(240): Xaa can be any naturally occurring amino acid
  Coding regions on vcDNA: vcDNA=SeqID_59532; Strand=+; Position=1-772
  Homolog annotation: Hit_ID=NP_500227.1; Match level="QueryCoverage =87%, HitCoverage=21%, E-value=4e-48, Identity=46%"; Hit description =predicted CDS, reverse transcriptase like family member (4D351) [Caenorhabditis elegans] gb|AAK68554.1| H
YENFEKFAVSSLSTVITDLFRISLDIGSLPDIWKESIVFPLFKKGDKNNPENYRPISLTCSLCRVMERILSKNIYNFLLKNKKISEFQFGFVRNRSTTSQLITVVEDWYEAIINGKNVCIYIDFQKAFDSVPHELLLYKLEKIGIRGKLLMWIKDFLSNRTFRVKIVEDLSSSKKVGSGVPQGSVLGPLLFLIYINDLPDALSSGVRIKLYADDVKLYICYKARTETEIMHKALHNLSEXANKWQIIISIKKTFVL

SEQ ID NO: 133110 - protein, 456 aa, Heterodera glycines
  Coding regions on vcDNA: vcDNA=SeqID_59533; Strand=-; Position=1 -628,907-1020,1225-1853
MTLVKTTVEALKQLQTSFTSDQMPIFNTLITTLSSQIDLLNGSISQLRSTALSTEGMPISAEELERQRSVVIIGMPEHNDSSPAKRAEMDRSKINCLFDSLGIECGTIAYRMGRSFNPAQKSPRPLKILLPSRGFQKQALAAWQKKQNTIRAADSSLHHVRLRESLTKAQLEERRRLHLQCVEKRQKDGQDWIVYAGNVILRDEVHIFRKTWTKDNEGIPLSPWIKENYNYIFASRKSENSSRGGGCGDLNLSNRELVWRQGQPHAINHIGEIFCDFFNKFTFINATNEPTRGKSWLDLILSANDKIVKHCTVEGGIFSSDHLAQLFVLSVPEIRAKPKEICLRRFTPSNVSHLNAVISARLSSLSLSHFSINEKCRAFNSALLNALNECIPIKKLLKKDLAPKYPQHLLASIKEEAKLYRQCKIDPTKKALYDSITLHIKIQTKKIHNLIEHKAI

SEQ ID NO: 133111 - protein, 185 aa, Heterodera glycines
  Coding regions on vcDNA: vcDNA=SeqID_59534; Strand=-; Position=1 -134,197-285,381-514,804-1004
MPDCAQSFAGQNEALKKHYNDHGRYEPDQHKLFSMAPVIVHGDFWSNNMFFKTCNGQSVADQLSAVFDWQICHTGTGVNDLLRIIYVSVDAPLRRVHFDDWLALYCSELHSVLAQLGKVFSLAQIHPDQHRSLELIRQMVAHQNGYELCFQLFLITNILGTVQQQNEQKRAKLIKRMRELYDDIC

SEQ ID NO: 133112 - protein, 62 aa, Heterodera glycines
  Coding regions on vcDNA: vcDNA=SeqID_59535; Strand=+; Position=1 -57,98-229
MTRSGQTQKPFKTRALIALLRMWKKGSNKILWFIKLAFTFSSQSSSALSVNESTNSPGQAQA

SEQ ID NO: 133113 - protein, 209 aa, Heterodera glycines
  Coding regions on vcDNA: vcDNA=SeqID_59536; Strand=-; Position=1 -255,314-364,834-1070,1440-1526
MPLDNLDSAIDQSHADFTVGYVLDKLATVGKLGPSAGLANVENAQFVQLSTGGFLSDIYRIQIQFKQADDTEEATTPTAFSCIFKVPTSRRLDMHTGSEKAKEDMKMWMYTVHNSECHFYATVVPLLRAMPVPLPFHIPELYACRNAASPDCLAGGYLLMEDVAGDGIIETDLSEGLTKEQVGSAIRGLAHFHALCLCLPRGIGGLVHA

SEQ ID NO: 133114 - protein, 38 aa, Heterodera glycines
  Coding regions on vcDNA: vcDNA=SeqID_59537; Strand=-; Position=1 -56,260-320
MAMLMDNNEECRSIIFYKLNLWEKIHLAFIAVASYMYT

SEQ ID NO: 133115 - protein, 343 aa, Heterodera glycines
  Coding regions on vcDNA: vcDNA=SeqID_59538; Strand=-; Position=1 -110,251-559,604-1216
  Homolog annotation: Hit_ID=CAE71374.1; Match level="QueryCoverage =80%, HitCoverage=29%, E-value=3e-55, Identity=41%"; Hit description =Hypothetical protein CBG18278 [Caenorhabditis briggsae]
MSDGERRKLHQAMGELKRSGEFDRFNDQHRQANNGIDKVCAFANWSVISQVGVSSGAHSGPGFLPFHREFIKRFEIALRLVDPSLSLPYWDSVLDSYLPNPADSVIFTPQFMGETDQLGNVVSGPFAGWRTLEGRANILRWPGAEGRVIDGERREQRVRDRPKSNKCWLIRHHNKVKASGRGEGTAGRIERQRMADRSVENRKKPLIRSFPFTILPITTRFSLNRLITSSDCPYQPNFGALEYSHSQVHLFVGGDMKPPTLAANDPIFYVHRNLIFYGRKAIDKKRLNPLIKTHSLTWSGNSGGSYDRRDGQENRWNRQKTMEKQSKLMTNPITDPNKSMLRD

SEQ ID NO: 133116 - protein, 370 aa, Heterodera glycines
  Coding regions on vcDNA: vcDNA=SeqID_59539; Strand=-; Position=1 -111,161-204,252-288,344-448,508-604,664-744,820-901,955-985,1050 -1115,1162-1258,1566-1588
  Homolog annotation: Hit_ID=NP_504821.2; Match level="QueryCoverage =95%, HitCoverage=40%, E-value=4e-80, Identity=48%"; Hit description =glycine receptor family member (5H653) [Caenorhabditis elegans]
RSRKAERVRTIRRFIISDLYFLDAKFAYLQEVTMPNFMLVIYPDGLVFKTLRMLVIYPDGLVFKTLRIDVTIDVTLSCNMDLQLFPFDRQECPMVIQLFPFDRQECPMVIQPFAYIENLVNLSWHVDPPYYPITTNPELKLNDMVITGMRFITTNPELKLNDMVITGMRFERCTSPYTLFRGIGVWSCLRGVWSCLRGYIVMKRLVLFHLIQTYIPSAMLVSVSWMTFWLDPRASPARITLTITSLLTLTTMSNGLLTLTTMSNGARQDLPQVSYIKAMDIWQTARQDLPQVSYIKAMDIWQTFSQALIFLVLLEYSFVSYFFSRRSFSQALIFLVLLEYSFVSYFFSRRSFDCAHRILRSEKLIRECEE

SEQ ID NO: 133117 - protein, 65 aa, Heterodera glycines
  Coding regions on vcDNA: vcDNA=SeqID_59540; Strand=-; Position=1 -59,187-252,381-453
MEIHAHFKSFKITVYVDLAGQLNVKLTDGESNFAYNVLLMERLCPMVNKMGVAANKSNLIMQPLE

SEQ ID NO: 133118 - protein, 96 aa, Heterodera glycines
  Coding regions on vcDNA: vcDNA=SeqID_59541; Strand=+; Position=1 -67,219-442
MSFPTKEAAINEIGQLSTDQQKTSASKRPRSQNDAGAETAVPKRPRGQNDLAENSVATETETNNGVDHLLATDQHQSWKLIQNLRINFKLSVPIWR

SEQ ID NO: 133119 - protein, 222 aa, Heterodera glycines
  Coding regions on vcDNA: vcDNA=SeqID_59542; Strand=+; Position=1 -211,470-711,842-1057
  Homolog annotation: Hit_ID=AAD00842.1; Match level="QueryCoverage =54%, HitCoverage=37%, E-value=3e-26, Identity=42%"; Hit description =OvB8 [Onchocerca volvulus]
MESNFVAFNNNITDQNNEDNDDKADNHAKQSKEMLKESQSEAETSSKEEAKNELEETEKEERKQKSVGSESTRELIDLHITLMRKIYLKSARADKWEQSLLKFCAIAPGLDAEFRQLQRNTYGNIPMGSKLAVMKALCDSQFDYNLKFKENVDYDLEFRVYSEETDDMAGVSWSLRARTEAELAELIETLRNPDYGLVTKEQQEEEEADIDEEQLLDQPNEG

SEQ ID NO: 133120 - protein, 68 aa, Heterodera glycines
  Coding regions on vcDNA: vcDNA=SeqID_59543; Strand=+; Position=1 -63,166-309
MPYLLTNSNGIFCWSLNFISYKLINQSPPFNAAARINCVLCSRGNIVMVTFKNDGAAIFRFKNARHSH

SEQ ID NO: 133121 - protein, 17 aa, Heterodera glycines
  Coding regions on vcDNA: vcDNA=SeqID_59544; Strand=+; Position=1-53
MIIDKVKGYTYKILFYA

SEQ ID NO: 133122 - protein, 76 aa, Heterodera glycines
  Coding regions on vcDNA: vcDNA=SeqID_59545; Strand=+; Position=1 -76,161-226,402-490
MSLLFARIGEPNRAKTMESSIASSSEVDDDGTSSSFSDGNSRKSAIADRRKINKLFILTVVNITVTVAVIIFFTVV

SEQ ID NO: 133123 - protein, 105 aa, Heterodera glycines
  Coding regions on vcDNA: vcDNA=SeqID_59546; Strand=+; Position=1-330
PGLKCPAQAKIFFYFREKIEIFPKKIPVDRARKTMFWKWSPFFWENSLKNHKIKKPENRFLGLTRKILKIFEILKSGKIELIELYNKSAGHPALRSNPNELFGWY

SEQ ID NO: 133124 - protein, 16 aa, Heterodera glycines
  Coding regions on vcDNA: vcDNA=SeqID_59547; Strand=-; Position=1 -3,563-610
MRVLITFRKYAPFYNW

SEQ ID NO: 133125 - protein, 130 aa, Heterodera glycines
  Coding regions on vcDNA: vcDNA=SeqID_59548; Strand=-; Position=1 -37,97-264,358-542
MAAKNENGIQLPQKLNNDHGVRGIAPVDVLINAFELNLKGAPDMVYQHELRFVGEYQMKKGREGQLETPSVKRRVVSCIGRSGDFARSECRLLWGREEQFSYDCALLLYSVRRLMVNGEMREFGDHAEEL

SEQ ID NO: 133126 - protein, 86 aa, Heterodera glycines
  Coding regions on vcDNA: vcDNA=SeqID_59549; Strand=-; Position=1 -22,358-461,695-829
MKAEIQAQKNKQKKIMPKSNSKRKKLDGGVQNFLMKQNDGTKATEPTNLTLPNTVTPNQFSMGNLLNGTAAASLPFAHNFWNGKLS

SEQ ID NO: 133127 - protein, 30 aa, Heterodera glycines
  Coding regions on vcDNA: vcDNA=SeqID_59550; Strand=-; Position=1 -44,544-592
MSGPPNCLRHKKSEMAFYSSTIPATNDLAA

SEQ ID NO: 133128 - protein, 126 aa, Heterodera glycines
  Coding regions on vcDNA: vcDNA=SeqID_59551; Strand=-; Position=1 -285,332-426
QRSVLSSDCDDFDLVNSTASPLFAYPCVRLIPIGQIKQILHDKITSLNEEEFQCKVEGDLFRSEDGLLNSLLSFEHFARKLRIVERGWPSGFRMWFREKSGWIYERCSLVARIKAGFAQNDAHFDM

SEQ ID NO: 133129 - protein, 17 aa, Heterodera glycines
  Coding regions on vcDNA: vcDNA=SeqID_59552; Strand=-; Position=1 -18,536-571
MCHNRRRFLDKFLKKRT

SEQ ID NO: 133130 - protein, 84 aa, Heterodera glycines
  Coding regions on vcDNA: vcDNA=SeqID_59553; Strand=+; Position=1 -140,347-461
  Homolog annotation: Hit_ID=NP_500088.1; Match level="QueryCoverage =98%, HitCoverage=18%, E-value=2e-26, Identity=66%"; Hit description =hexokinase (50.1 kD) (4C273) [Caenorhabditis elegans] gb|AAF36071.1| Hypothetical protein Y77E11A.1 [Caen
DNSGVFKNCRRICDELEVPSHGSNDYLIMREVCHVVSLRSAAIVAAAITALLRHVGKRKVKVGVGGALIQFHPTYHELLESQLH

SEQ ID NO: 133131 - protein, 66 aa, Heterodera glycines
  Coding regions on vcDNA: vcDNA=SeqID_59554; Strand=+; Position=1-244
SAASNCTRRKWSFVWSIFASGLLHVVLLTPPHSPPPPTIYLIIIITIVFFYHTLNMFFVVDQQINF

SEQ ID NO: 133132 - protein, 55 aa, Heterodera glycines
  Coding regions on vcDNA: vcDNA=SeqID_59555; Strand=+; Position=1 -101,534-599
MSPNTLCSIVCLLLVCNFIWADDEHRSFAEELVRPTSHPKKTATIGALGLPCTKR

SEQ ID NO: 133133 - protein, 72 aa, Heterodera glycines
  Coding regions on vcDNA: vcDNA=SeqID_59556; Strand=+; Position=1 -52,102-268
MTAPTSAVVREQHLALRVMRLSNPKFHETICLGRDPADPFSMAICDSIGKLSGQSSVDLPLDSYLIAPHAMR

SEQ ID NO: 133134 - protein, 221 aa, Heterodera glycines
  Coding regions on vcDNA: vcDNA=SeqID_59557; Strand=-; Position=1-667
QRHKQKAKSTLGSIYLQREFDQLSQSSLSDQNDHFSYESPRSYQIGTEIVEVANDHSNEGNATDHFNRRQFNETNNEIVPIEKSQNDGSVSAHFSHNENGQMHYGRAITVVSDRINDSRADGLDRSHSSSADYTTQKCGIMPKLPNLGEKFRHWQLKMKMDMQLRMHCVKNTKLPRNLVDDHKNNNFFLHEHPGNGEENPYSKLGWDENPFYGKTPSFKSN

SEQ ID NO: 133135 - protein, 18 aa, Heterodera glycines
  Coding regions on vcDNA: vcDNA=SeqID_59558; Strand=+; Position=1-54
MRTRPIWQVKQRLLTSQK

SEQ ID NO: 133136 - protein, 72 aa, Heterodera glycines
  Coding regions on vcDNA: vcDNA=SeqID_59559; Strand=+; Position=1 -127,189-280
MCCLLLALASRSRSYTVNGRRSISRRSRRRTTLAAFQAHSSDAGARTAAEPLAVPNRPVEEKESTSRRVPGI

SEQ ID NO: 133137 - protein, 130 aa, Heterodera glycines
  Coding regions on vcDNA: vcDNA=SeqID_59560; Strand=-; Position=1 -235,282-439
MSSPIKFSPSKSSDAKNETNIKAAVLTPNSLKLPNRKHQLNSAGNNGEQPPTKVRKVEDRELWKLAKGKYMLGFYLCSDDWNRLYNNNAKVVRTEDGRFAVNFELCAECTLKNARATDLLAPPKQKKSAE

SEQ ID NO: 133138 - protein, 215 aa, Heterodera glycines
  Coding regions on vcDNA: vcDNA=SeqID_59561; Strand=+; Position=1-648
MAINMNDKKGLLKQLLGESDITVTTSGLTISRPRLTNPRFLPFEESGRCRSCKATEVEVDTMVTKEGITLWCTRIDKVQFVPFDVVYDLPGHCFFRVKNKARVFNIPYGDLPSDNTCDQIQLTLHADEERRLKRKAKAALDLVEQGLMADAMHDGASWKKAKTAIGVLNKLPARRNTWRQRKQRNGCFDNIGKPAQRTATADGTSVGRNRFHRAI

SEQ ID NO: 133139 - protein, 367 aa, Heterodera glycines
  Coding regions on vcDNA: vcDNA=SeqID_59562; Strand=+; Position=1-1103
  Homolog annotation: Hit_ID=AAN75564.1; Match level="QueryCoverage =74%, HitCoverage=8%, E-value=9e-16, Identity=34%"; Hit description =adhesin FhaB [Bordetella avium]
MANKFLLVPQEIYRGLTSAADTGVINLDAVRHDLDRARGERTNPSTKNVRYNQQLRRYLQMRRELTDRPTKVELTKGLSVLLKRDGGADEDDEVVNTQPRPPAPPPPPPPPHHSSQQHHRRPPSLPDQQSSSSDDSHPPRPPRPQRTKKNHQSSLKHGRLNQWQQRRRDLQQQQPVVRDLLAEAAAAPLPESDDDDEQMLEGGYLLPAPSQNYGDIPVLPDYADEIEEMDTAQQRLASRRKLKEEQRLDKNKKYKIYYSPPPSPTLPPVYKRLDHPPPPRSIPKVELKRDPQPTKLKKSASPPPPPLPPHRAKREPKIELAPPPPPRNVSKREPKIELAPPPLPPRHFTKKEPKFEVDPRPSTSKQA

SEQ ID NO: 133140 - protein, 81 aa, Heterodera glycines
  Coding regions on vcDNA: vcDNA=SeqID_59563; Strand=-; Position=1 -78,127-216,567-642
GMTSSAAKIGGGGGASVEELNQLLSKDEEWLSSFQGILEKSATLTGSVCSLMDNFQERIDSLSTNVQTLVAKSSVIQKEQQ

SEQ ID NO: 133141 - protein, 44 aa, Heterodera glycines
  Coding regions on vcDNA: vcDNA=SeqID_59564; Strand=-; Position=1-170
PWKSESAKECVTTHLPNQLALKMDGAGAGHLYSTVIWLVHVLVA

SEQ ID NO: 133142 - protein, 63 aa, Heterodera glycines
  Coding regions on vcDNA: vcDNA=SeqID_59565; Strand=+; Position=1 -33,79-237
MDFFETNATTQAFNKSIFTISSPTMEEVKNSVFLKMIFIINLFINLIGGIMHFTVVYISIKNR

SEQ ID NO: 133143 - protein, 78 aa, Heterodera glycines
  Coding regions on vcDNA: vcDNA=SeqID_59566; Strand=-; Position=1 -192,251-295
  Homolog annotation: Hit_ID=AAP80600.1; Match level="QueryCoverage =98%, HitCoverage=21%, E-value=3e-32, Identity=87%"; Hit description =putative alpha-tubulin [Oikopleura dioica]
VHRAVCMLSNTTAIAEAWARLNHKFDLMYAKRAFVHWYVGEGMEEGEFSEAREDLAALEKDYEEVAEDNEPDADNEEF

SEQ ID NO: 133144 - protein, 70 aa, Heterodera glycines
  misc_feature (3)..(3): Xaa can be any naturally occurring amino acid
  Coding regions on vcDNA: vcDNA=SeqID_59567; Strand=+; Position=1-302
CKXNRQQNGKQFVPPLSASFRIGINSSFHGNVFNFQFNSIFCVYFYVPANSIIKLLFIQFSLHFQKSICI

SEQ ID NO: 133145 - protein, 480 aa, Heterodera glycines
  Coding regions on vcDNA: vcDNA=SeqID_59568; Strand=-; Position=1 -936,1002-1376,1439-1570
MPNPSPQNVLDLKEQLQNLSAKVSELVALVNTEPIQYPANFYTIFKKIKQRMANPLEAAIAYCEQLQKGADSFGQMTDRTYLEGIVPKVVHIVERLSIEFGTLATEIGIDPVEKFVDSKCKDGEDKLKELSETIAKIRREIKENNYFNEAPFENAMAQLNGTQTADDWQSMRRKSVRRHSTGDAHISNWDKNSGENGTNVEKKMPRRHSENNLIMPRKILGDLKMNDGQRVRRKRNATIGRKAGEKMCQILTEMILEAKTDALERETAAKIKAIAEPPIKGDELMQLIDTFDWEWRQISDRIDRWTKTDGEKDNYRIKLVETSMAAYEISKPLKLAMVSALDGLNSAAKTEMKRWEEELHKLLHERIEICTRAKDTLAKLSTDLQTAIGLPRQIVNAQIGPVIDLLRGNGAEQSALSYYVIENSLYAAKQKVQSAFQIPSNAFKWSIFVDEQNEQDDKPAAEIEEANQPQIETAAEDTEI

SEQ ID NO: 133146 - protein, 216 aa, Heterodera glycines
  Coding regions on vcDNA: vcDNA=SeqID_59569; Strand=-; Position=1 -233,293-496,605-819
  Homolog annotation: Hit_ID=NP_505680.2; Match level="QueryCoverage =98%, HitCoverage=40%, E-value=2e-61, Identity=52%"; Hit description =amino acid/polyamine transporter, family II (57.3 kD) (5K912) [Caenorhabditis elegans] emb|CAD54163.1| Hy
TIVSICVNVTQYGATTVFLLLCAKNIRDFIRAFLDKEISFCYLIVVIALVLLPVTLLKSPNDFWPVIVGGMLSTIVAIVFICIGAMMDWRSCAPSRQLPSFDLTNYLSALGTMLFTYGGHSAFPTIQHDMKKPSEFNKSAILGFFIISVFNFTTVIVCGTVYGNSIRESVINSIQTVWIQQAINLMITAHCLLTVTLLINPLNQEMEEVFSVPHGH

SEQ ID NO: 133147 - protein, 175 aa, Heterodera glycines
  Coding regions on vcDNA: vcDNA=SeqID_59570; Strand=+; Position=1 -82,133-464,516-629
MHVIRVRTSGRRKAQTAKAMKARWAKKTSPEPNPNAEMPPQDEAGPSSTSAVPAEELMEPPPPAPAPVPTPEMDEEILEFGFSLPSTSVTALKFRLSTAKDNLIPARDLPLKISGDCCFTTLFHLRANTDFWGFWMSREMRHCIPCGGDLSNFGRRCRTLNKCANSWSIISSQIG

SEQ ID NO: 133148 - protein, 25 aa, Heterodera glycines
  Coding regions on vcDNA: vcDNA=SeqID_59571; Strand=-; Position=1-77
HTPSEKTRCVPINRECQRKTLSFFL

SEQ ID NO: 133149 - protein, 194 aa, Heterodera glycines
  Coding regions on vcDNA: vcDNA=SeqID_59572; Strand=-; Position=1 -108,479-603,841-998,1044-1088,1422-1496,1542-1614
  Homolog annotation: Hit_ID=NP_872170.1; Match level="QueryCoverage =74%, HitCoverage=14%, E-value=3e-39, Identity=49%"; Hit description =ankyrin and patatin family member (5V188) [Caenorhabditis elegans] emb|CAD54162.1| Hypothetical protein W
MGEPIFPYFDWVGGTSTGAMVTAGLAMGQTLHQIQRLYLRFKDMVFDYRRPHNTRVLEKFICQEMGAETMFSDLKWPRLMFTTTRAEFFPVQLELMRNYKLPTNDEENEELGYRTPDDLLLWKVLRRSSAAPTYFASVDNKYIDGEFSQFRERWMLSQHLHRCHSAHSIGAHLYRSFAKLDRPTEHLNKRLLDH

SEQ ID NO: 133150 - protein, 129 aa, Heterodera glycines
  Coding regions on vcDNA: vcDNA=SeqID_59573; Strand=+; Position=1-670
SVGNQNAFGGKKNAVFRNLNDEFLFFDFCLILMKFHPIIICVFSVHNLIFVRHYCEQPVIGTAPGNPILEQLQQVQGKTPITTAKYFFKNFFFVFSEFSQFRERWMLSQHLHRCHSAHSIGGFFKNKVS

SEQ ID NO: 133151 - protein, 220 aa, Heterodera glycines
  Coding regions on vcDNA: vcDNA=SeqID_59574; Strand=-; Position=1 -87,340-915
MDGRTAEAIGSEKVITTSGQNCDQIALGLLLNVVNCSDDQIFAVRQRKAITIEFRVQWTDLRHRSQIDIGKGQFVVGRINDSRPIGTGENIKRILFGRLEKTQRSGLSAQCKFLLRRQSAGERIDAEMNHCAIAQSDEKKVRALHGHLNERGQMRNGRKARRDACHKHGTGHKFTGQTLLRDQCWHSARFKCVDSDRMLRPKANGEEVGQSLAILDSQTR

SEQ ID NO: 133152 - protein, 28 aa, Heterodera glycines
  Coding regions on vcDNA: vcDNA=SeqID_59575; Strand=-; Position=1-85
MQLISTDIFIILSLVAAFSHSAPITQGK

SEQ ID NO: 133153 - protein, 39 aa, Heterodera glycines
  Coding regions on vcDNA: vcDNA=SeqID_59576; Strand=-; Position=1 -48,385-453
MSVLLREAVVERLVEPAWAAMSMSPKELLSRQLMPKIGK

SEQ ID NO: 133154 - protein, 128 aa, Heterodera glycines
  Coding regions on vcDNA: vcDNA=SeqID_59577; Strand=+; Position=1 -93,432-599,881-1006
  Homolog annotation: Hit_ID=CAG09769.1; Match level="QueryCoverage =98%, HitCoverage=99%, E-value=1e-27, Identity=47%"; Hit description =unnamed protein product [Tetraodon nigroviridis]
MKLLLHNFFSSNFLKGVTNGYPLLLRATKIERIDGTEFNGDFVKKMMPRLDYPALIQAAKAVDERAADELPKELGTDWEKDDDFLKKVHSLLVSYEIVEGELECPESHRIFNIKEGIPNFLVGADEVE

SEQ ID NO: 133155 - protein, 90 aa, Heterodera glycines
  Coding regions on vcDNA: vcDNA=SeqID_59578; Strand=-; Position=1 -92,577-609,1425-1572
MLTRTQLDAAAAKRLFRDMREVQPQTAGVSSFFERCDGVDNGALTSLEQLYALAFAEGDKQGHEEHKDEQKSLDISLMKGCLIIGPLTQW

SEQ ID NO: 133156 - protein, 254 aa, Heterodera glycines
  Coding regions on vcDNA: vcDNA=SeqID_59579; Strand=-; Position=1 -35,445-901,1375-1647
MSDHPDAALADLYVDLEVIAFLQCLQRVINRGIAVQFTIHSTDLRCWAVMAQRIWPLISHAVLALNDMKAVNFALLRRHVSPNVLFDCANLRAITNTHMFPIRPPPSAVHINALLNPPDEFDEKPKHNLFRWLHTPRKDGRPKIVTIRKWRKPQWASFMPSLITFFIAPSAVPVNFLVICHIACHTNFQKMERENEETDERLTLNSRVPADAVIVRCRNGTDQCTVNAWEKEANQMLDNLLCFTIKDSDIGWSF

SEQ ID NO: 133157 - protein, 99 aa, Heterodera glycines
  Coding regions on vcDNA: vcDNA=SeqID_59580; Strand=+; Position=1 -96,787-990
MANAMYAARARAAKAEKRQAQLRKAARARAGNARKREVVAIAWQTAEGWKERTTDHTMNDWPSVFIDVFVMDIHSFVVSYNHVRTHALFVSLTIIFVLN

SEQ ID NO: 133158 - protein, 34 aa, Heterodera glycines
  Coding regions on vcDNA: vcDNA=SeqID_59581; Strand=+; Position=1-104
MNKGTKMRKKQWKRKEKEDNYGEEKRKKRVNDKQ

SEQ ID NO: 133159 - protein, 30 aa, Heterodera glycines; identical to SEQ ID NO: 126607
  Coding regions on vcDNA: vcDNA=SeqID_59582; Strand=+; Position=1-91

SEQ ID NO: 133160 - protein, 93 aa, Heterodera glycines
  Coding regions on vcDNA: vcDNA=SeqID_59583; Strand=+; Position=1 -135,472-618
MNLRKSDFASWINRVGSMRRVGKEVEKRAAIFCFTKAKEKEEKKTGRCPVNRFLFSLCIFKWYSIVSTPFSLRPALLRQSHFSSVLNAQPKNG

SEQ ID NO: 133161 - protein, 16 aa, Heterodera glycines
  Coding regions on vcDNA: vcDNA=SeqID_59584; Strand=-; Position=1-49
EAIPEGFGLPINLGAS

SEQ ID NO: 133162 - protein, 58 aa, Heterodera glycines
  Coding regions on vcDNA: vcDNA=SeqID_59585; Strand=+; Position=1 -59,214-331
MHEKVMITTKIKSNQIKFISSFIKLIISKNIMRVFNIPIKISMTTPQHRLFKELCKGK

SEQ ID NO: 133163 - protein, 125 aa, Heterodera glycines
  Coding regions on vcDNA: vcDNA=SeqID_59586; Strand=-; Position=1 -197,253-432
MVQANERFQEEGEPTNNGTDTMPTEEQLQSEAEDEAETQQLRETCNRRPSEKIEVPEGLLAEESVSEFSTLSGWARLGLGLEIALLCGICLNTTVLSVLLHHTRHHLSTVTILFIFNILFSNVKM

SEQ ID NO: 133164 - protein, 78 aa, Heterodera glycines
  Coding regions on vcDNA: vcDNA=SeqID_59587; Strand=-; Position=1 -194,2158-2200
MRSGAWQNRTLKAKEKNARQKKAWDKKLARQKTAGDEAREKKAGDEKLAREKKAGDEKLARKRRKNNNNLINLFNYLI

SEQ ID NO: 133165 - protein, 149 aa, Heterodera glycines
  Coding regions on vcDNA: vcDNA=SeqID_59588; Strand=-; Position=1 -195,363-617
MDESKRENFSPQNDDDVITIGDNNNTQTLLDLQPGPSKRGRKPRLDKIHKEIASAMKKAKAMKLKYGVFTFMCKECRDDNFRQGNSRFKLINQNGEQQRLEFTQSFCQDCAKLNFDCTDLIMKHLKKDEPATTTTTMAKSFRWTKDEEK

SEQ ID NO: 133166 - protein, 122 aa, Heterodera glycines
  Coding regions on vcDNA: vcDNA=SeqID_59589; Strand=+; Position=1-369
MYNQHLRRYLKMRKEHKERPVLVQLSNGAQLLNKTVETGVQVRPGPDEPKDKSVMVTDEDEDEEIEVPKFLTPTSQTQGSNRSPRTNKKAAKQQKLIEKKDHLLAIIMSDPQRFGANENVSH

SEQ ID NO: 133167 - protein, 333 aa, Heterodera glycines
  Coding regions on vcDNA: vcDNA=SeqID_59590; Strand=+; Position=1 -600,653-1054
MDYPRIIESELAFLIPSGIIVSGPSSSGKTQLVLRLLRHANVLFDPPPKAIGVCKRVLCAVGCCYLVWAYGEYSTQIPDLERQGVVPHAGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQTCALPYGYLLTTRRESFLPPKMVKREQKIGERVVHNYDYLKKLGKTTSEKKRRHLLNSAGCEELLTLVEICLNVLNGSFCLSRKQKQRLAPFAKDIRQLARVRSERGARKLVQQSGGSLFAPLLAPILIEAARYLLSRSNNGQ

SEQ ID NO: 133168 - protein, 86 aa, Heterodera glycines
  Coding regions on vcDNA: vcDNA=SeqID_59591; Strand=+; Position=1-259
MKRARQSEKLGAFPEIEFAVNTMGVTVYCPRHLQTPRFVPWDQPGRCPSCRSGTVELDYIIQPEGVTIFSNRLKTDGENFVPFDAI

SEQ ID NO: 133169 - protein, 55 aa, Heterodera glycines; identical to SEQ ID NO: 127903
  Coding regions on vcDNA: vcDNA=SeqID_59592; Strand=+; Position=1 -25,642-784

SEQ ID NO: 133170 - protein, 115 aa, Heterodera glycines
  Coding regions on vcDNA: vcDNA=SeqID_59593; Strand=-; Position=1-347
MNVFLDELNASFEQHQNNPEIRQVISGLIDYAQSLIDEQPGADQIGLDFDSDQEDDLYDDESENNTDQEENNHDPTQSKYPFETQIQIVNMLNDGKTYKSIRHQFKKLKSDIEII

SEQ ID NO: 133171 - protein, 162 aa, Heterodera glycines
  Coding regions on vcDNA: vcDNA=SeqID_59594; Strand=-; Position=1 -288,337-534
TQFFVLAILRHAINQAKSQKAIGCPFNQRDAIALGIFSNALIKASTNDAMLSNICRYGDKVFGFVDGLCEIQNAEQQSLLDDIKFKEQLEKQLEIRVNELRAFCQRWKLYPKNNAQTSAGHESEQHLKAKMKNYIEKPQIDQTNKQSTSDSEHICVICLTEE

SEQ ID NO: 133172 - protein, 51 aa, Heterodera glycines
  Coding regions on vcDNA: vcDNA=SeqID_59595; Strand=+; Position=1-154
MGSLVAAHLSSSNEKAMPYSAYYYRQRKMNVIEAYSRITLKKQLWALYFFV

SEQ ID NO: 133173 - protein, 112 aa, Heterodera glycines
  Coding regions on vcDNA: vcDNA=SeqID_59596; Strand=+; Position=1-339
MGTNLELNLCSSDNDDDEEPIWDVLAREIWPIFAPSIRHLGFANFDALCRRISPTILADLHQLISIDFGHLFLHGIDDDDEPNATSPGQVLSEWLHTPKKDGQPKRLFHNLC

SEQ ID NO: 133174 - protein, 81 aa, Heterodera glycines
  Coding regions on vcDNA: vcDNA=SeqID_59597; Strand=+; Position=1 -26,88-304
MNQRRLKKIWICHDVWMDILPFFRRRKLGLNLALISDRFDVLVDAHFDGKSELTIWKAIRIHKDAFTEVPKLSVLIDNANP

SEQ ID NO: 133175 - protein, 93 aa, Heterodera glycines
  Coding regions on vcDNA: vcDNA=SeqID_59598; Strand=-; Position=1-282
MYSFQKYFEEALEKEDFFWQKNRAEVEALLIEASNYKIITHRDYESRYSDYIATYHRTPLFCFCMIERNLRFFYDTGNRDAYRKGYNCATCYR

SEQ ID NO: 133176 - protein, 114 aa, Heterodera glycines
  Coding regions on vcDNA: vcDNA=SeqID_59599; Strand=-; Position=1-345
MTREYADSEILEFVSAGPKQYALKLRRKKDGVIWHKTKIRGMTLDRRNEFKYELFKEMVLDHKEGVKKVFHYPEKIGPTNDFRVLSKDVQKEYTPVQKKGIIDDHFNVLPFGHY

SEQ ID NO: 133177 - protein, 388 aa, Heterodera glycines
  Coding regions on vcDNA: vcDNA=SeqID_59600; Strand=-; Position=1-1167
  Homolog annotation: Hit_ID=NP_941979.1; Match level="QueryCoverage =49%, HitCoverage=20%, E-value=3e-10, Identity=26%"; Hit description =membrane glycoprotein polyprotein [Uukuniemi virus] sp|P09613|VGLM _UUK M polyprotein precursor [Contains:
MPNGQTVTRPISRLCPLETENQALEPESDATEPNPTNQSRRDSKNAELVGQDMTPVPSLPEEPMTRGHDGMVTRRKSRLLGIPPTTTMIMAILVTFLGVQASPAQGIWPFASDHPEPPPTSHCIGNHVNCTRRGVRVSSTPAVQKVTICCANSCLDRLGAATIEYELSADLLVNNYGCSATFSLSSTRSCAAETVCSAIDECELIDCSVCIDQLANWRCNPRLSVFLFLIIGSLISCLIGWVVCFCSSARVVLNFGYQITAFLLSWPLRLAFSLAGRPWTREDRERVAERLEVGIQRVRRQPRHHGRRAQRAATRLIGILLATPVIFGNAETISVTTRTESCLKSHSGLTCRVNTATTLTLLPAGQQSSLILRDDTGNTIGTVQMHLH

SEQ ID NO: 133178 - protein, 77 aa, Heterodera glycines
  Coding regions on vcDNA: vcDNA=SeqID_59601; Strand=-; Position=1 -101,173-305
RATLGSSRCSVYEGPGFCHLVRTYGASAYRASAPPFWSSCGTVLNSAKYLGCPCGTYKTWERCGFLYMGYRYLCYAC

SEQ ID NO: 133179 - protein, 104 aa, Heterodera glycines
  Coding regions on vcDNA: vcDNA=SeqID_59602; Strand=-; Position=1 -261,326-379
MALTILAIFCLAFVHLGISGKYDKSDEHDGKYGAGPPGGYSHENNNNNNYGGDSSGEKYETMEHMWSCATKWQWEKPGVSMKWEITDTLTEAAVDTDCPSRKSK

SEQ ID NO: 133180 - protein, 86 aa, Heterodera glycines
  Coding regions on vcDNA: vcDNA=SeqID_59603; Strand=-; Position=1-261
MILQNEEELNYGIKEEKSGENPSKTEIQTNIAKLRKEFERKMKNLCENANEKAKAEKAKLEKTIENAEDYLIKTPWELPARFGLFC

SEQ ID NO: 133181 - protein, 121 aa, Heterodera glycines
  Coding regions on vcDNA: vcDNA=SeqID_59604; Strand=-; Position=1 -236,295-424
MKFTLLAILFLALVHIGISGKYDKSDEHDGKYGARPPASGGYHHDNNNYGGGNHYGGGGNHYGGGGSSYDKYRPTEHQSTYWSSCGSLLATARSLGCRCGTYKTSETCGFLYLGRRYLCYC

SEQ ID NO: 133182 - protein, 41 aa, Heterodera glycines
  Coding regions on vcDNA: vcDNA=SeqID_59605; Strand=-; Position=1-123
MGDFVPKFERNLDNKPLGPRPLPTAGAIPVKDEKGRIVMKK

SEQ ID NO: 133183 - protein, 181 aa, Heterodera glycines
  Coding regions on vcDNA: vcDNA=SeqID_59606; Strand=-; Position=1-543
MDSPKAPEVVPFDDEQLSAEEKRLLNEFEMMKMKLEETNKRKIELEKRNKEKEKLKQVDEVILEDDEEEEEEEQIPKMSKKPGLDPVVAKYVVEKVINEEWDGNDLVVIDPRGKRSMEEQNDEESRRKEDLVRIGRRNDHNEPWREFLATTTSLDREKEERLKVMGKIGLGQSSRRMAKKS

SEQ ID NO: 133184 - protein, 95 aa, Heterodera glycines; identical to SEQ ID NO: 130684
  Coding regions on vcDNA: vcDNA=SeqID_59607; Strand=-; Position=1-664

SEQ ID NO: 133185 - protein, 16 aa, Heterodera glycines
  Coding regions on vcDNA: vcDNA=SeqID_59608; Strand=+; Position=1 -28,451-473
MRVWAYILPIHRFALP

SEQ ID NO: 133186 - protein, 36 aa, Heterodera glycines
  Coding regions on vcDNA: vcDNA=SeqID_59609; Strand=-; Position=1-195
IYGKINNTLKLKYKIKFKIPALCHALAHVPLMSSKF

SEQ ID NO: 133187 - protein, 376 aa, Heterodera glycines
  Coding regions on vcDNA: vcDNA=SeqID_59610; Strand=-; Position=1 -237,288-438,481-667,709-966,1011-1210,1486-1581
  Homolog annotation: Hit_ID=XP_415979.1; Match level="QueryCoverage =87%, HitCoverage=35%, E-value=2e-29, Identity=27%"; Hit description =PREDICTED: similar to Zinc finger BED domain containing protein 4 [Gallus gallus]
AFKEVDENGSAILPFLNANCAAHLLNLVVKEGLSADLDIEKLFVKCRKIVGHFKKSNKALGKLHEIQEFLEIPEHCLLQEVSTRWNSGLMMIERLYEQKKAINEYAYQNCDFGLTLTSEEWSILEELIAILKPAEVMTKGLSKSPISVVIPYAGVMHDELYEMKLFSKKVDQVRTIMYNSLKRRFFGLQNQKVYAVSTFLDPRFKDRVLLAEMTSNVFRANVIAWIKAMSEPLQPEIFDFDDQHFTMPPDQSLSPPPKRNDSFFDRLKNIVKSNIDRRTPTEQHENIELEFQEYLECGLEETNSTPIDCRRKLSNQFPKLAKLANKFLSTPATSVPSERTFKTARPGLDPGLEEPGFFLDLDFCPGNPGPGPTWNP

SEQ ID NO: 133188 - protein, 499 aa, Heterodera glycines
  misc_feature (305)..(305): Xaa can be any naturally occurring amino acid
  Coding regions on vcDNA: vcDNA=SeqID_59611; Strand=+; Position=1 -165,428-462,550-589,731-804,851-905,996-1034,1183-1679,2024 -2061,2110-2146,2474-2608,2952-3058,3134-3194,3452-3505,3582-3644
  Homolog annotation: Hit_ID=AAH83363.1; Match level="QueryCoverage =98%, HitCoverage=98%, E-value=1e-111, Identity=45%"; Hit description= Mothers against decapentaplegic homolog 8 protein, sma8 protein [Danio rerio]
FTGHSKKMNLFTSLDPSVKKLLGWKMGDEEEKWALKAVESLVKKMQKRKHHGYGKEYALSHPGSSSNCVTIPRSLCVTIPRSLDGRLQVSHRKGLPHVIYCRVWRWPNLQSHHELRSTTDCELRSTTDCMFPYDGRSEQICINPYHYHRIEMPVPPPPSSSSVVPSSSFSPSSASIGTFSTPSPSAAASFPSASPSASSVSSASPSVPSFRHVHSYPQTTNNSSCPPMSSPISPLSPPPPAALFTQSPSALSDDDDFMAQQQQRHNAALQQQLCHHSQPCCWCSVCYYELNSRVGEPFKARFVDXFVILSSTHKRICLGLLSNVNRNVTIENTRRHIGMAVTIENTRRHIGMAARFYWFSRYVYFPCSAVEPSEAAVFVQSRNANFKYSLQPTAVKKCPPFCHLSIFVHLSFCQMLEKAKENGYQHVYEIVKMCFVRLSFVKGWGADYPRSDVTSTPCWLEIQLHQPMAWTDAALSQLWTDAALSQLDPPDHNGVTSVS

SEQ ID NO: 133189 - protein, 148 aa, Heterodera glycines
  Coding regions on vcDNA: vcDNA=SeqID_59612; Strand=+; Position=1-445
MAADITVFVRLIEAVPRGAKFDKIWKEKKENQIIDLYDSFFEMDYSNEYRTQMHFTWKLFDAVRSELADLSFLINEKKLRQKWDGMEKRAQRDAADQTASDDGTVPTAPILVAKLHAQTLQKLAFENAETAKRKTAEMAKHFREKLKT

SEQ ID NO: 133190 - protein, 22 aa, Heterodera glycines
  Coding regions on vcDNA: vcDNA=SeqID_59613; Strand=-; Position=1-72
MIVTDSAQILSPVVCASEVASS

SEQ ID NO: 133191 - protein, 704 aa, Heterodera glycines
  Coding regions on vcDNA: vcDNA=SeqID_59614; Strand=+; Position=1 -1873,1961-2199
  Homolog annotation: Hit_ID=CAE56152.1; Match level="QueryCoverage =32%, HitCoverage=27%, E-value=1e-26, Identity=30%"; Hit description =Hypothetical protein CBG23765 [Caenorhabditis briggsae]
MMDVPNSSNTSPGFFENLAQSLLDLKIQDNRNYKNEEPRSGAMNALTHIKPKTTAMDCQVENELAKESSSESPACGPETKTNIPKTSNWERPSVRSKVASLMFITLMLIGMTLPFTTANMPHLPMHPLVCQTQNGGKIWQLPAVTGCSKLSIDHSKAPVVRTFDVFSPNLFEHSADAWACRKVRKSVRKYTSITNVPIQETLEPLMLQITPSECKQMAENGKCSLGLLINDSGLSHTDKKLDLSPRMWLIGSFSWSTVSTENCYLFKTKIMSQHGSTVMQSPLGSVNNCQFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREMLTLSFSQTIKSICDYMLETRRWAATALLSDPTTFARKLFQSGKLVAKVAGPELIKVWPCIELQAHDYEFAKIGNSADSEFECFDKIPIKFRVKDNKRMAFIDPRTMILSSDARLAPCSEYRKQLIFVRGSLYEVDQIDAQVKQVNANRIDGFSLNLSLAPTYARHSFLHLALVNVSDFIGQFYDANLARESELTFQIKSEDAIVTKTLSEQWEQVNFLIRFRLMIRDEYVGRGTTRRMTFGGNKTQKIVKSPAHLNMMDLNASVEFGNEIELSPVKLIEPAQTQAHKIAGKRKRP

SEQ ID NO: 133192 - protein, 204 aa, Heterodera glycines
  Coding regions on vcDNA: vcDNA=SeqID_59615; Strand=-; Position=1-655
  Homolog annotation: Hit_ID=CAE73289.1; Match level="QueryCoverage =91%, HitCoverage=22%, E-value=3e-20, Identity=28%"; Hit description =Hypothetical protein CBG20708 [Caenorhabditis briggsae]
MLQITPSECKQMAENGKCSLGLLINDSGLSHTDKKLDLSPRMWLIGSFSWSTVSTENCYLFKTKIMSQHGSTVMQSPLGSVNNCQFKAGQCEMEDKTLLMWDTNTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREM

SEQ ID NO: 133193 - protein, 769 aa, Heterodera glycines
  Coding regions on vcDNA: vcDNA=SeqID_59616; Strand=+; Position=1-2310
  Homolog annotation: Hit_ID=DAA04499.1; Match level="QueryCoverage =86%, HitCoverage=45%, E-value=3e-70, Identity=29%"; Hit description =TPA: pol polyprotein [Schistosoma mansoni]
MPVPLNVKEVKRVLGQAGFYRRHIENFAMVVEPLLKLTRQGNKFEWGREQQKSFDKIKELLTQAPSLIFPDYDKAFHIFTDASSTGQGGVLMQKDDVTGTFSAISYCSRTLSAAERKWPAVQIEMSAIIYALREFRPFIFMSDIELHTDHKPLAFLLKKSETNQQLARWLIELQNYQVKIVHVAGKSNTLADALSRAAEDKPLSEIYNVDELEDIIEFPVCLALAAHSRVVADPFLHTLTIRHEDGNTYEINLLEEQAGDPEAAAYIAFVRDGEFPADLDEKEKELFAIGTANYKLISGILYFEDKGLPPRIYVPISLRGLIFESFHSSLLGGGHLNYRKTIAKCKKYFWPKMYSDVLTWVKLCVTCQLRHNPTPAYREEMLMVPANTLFAKVGLDLAGPFPVTQKGNKHILNIVCWFTKYVISVPVPDTKAQTIAHAFLTNCYLKYGGCVELITDNASAFTSEFFREFCSMLYIDKKYACPHWSQGNASTERTFRTFHNILAKYISKTQPDFDEFLDAANFCYNTSVHASTGETPFFLMFGRDPIFCVDQIIDPKVRDPIAISDRNEFKQKLVVAIRHAWHAAADEYAKAQRKMKEQYDRKARPQQITIGDRVLIRNYDGRVGTSKKFQLPWRGIFRVIKIEGIYVTVISCTSPNSNPKRLHLNQIKKCFEILGPPCTMPTQPVEEEKCLENTDNADKAISKGYEIRNEMDPESREGENLEQIHARGPETRPEIEADEEKNVNKKTDTEPRKYDLRKRTRTWKDLVNY

SEQ ID NO: 133194 - protein, 93 aa, Heterodera glycines
  Coding regions on vcDNA: vcDNA=SeqID_59617; Strand=+; Position=1 -221,1209-1269
MPTQPVEEKKCLEKTQNVEEVSSERSGIRNEMDLESREGENLEEIHARGPETRPEIEADEEKNVNEKTDTEPRNPNHFSICPITGIESSVISR

SEQ ID NO: 133195 - protein, 156 aa, Heterodera glycines
  Coding regions on vcDNA: vcDNA=SeqID_59618; Strand=+; Position=1 -235,318-438,548-659
IYSDFLKDKCAKTCGHCLSEEDKVRLENDYGSDSSNSEDYDQPFESVRRIRNRPSAAPPAGGQKNSADNGTTVAQRAKEGSSKRSKSSGKFSERIIIEIGGGDQKEHIELRGKLGEALRISREILLENDEENDDEQAEKKKRKRQKKKQRNLSPLL

SEQ ID NO: 133196 - protein, 131 aa, Heterodera glycines
  Coding regions on vcDNA: vcDNA=SeqID_59619; Strand=+; Position=1 -133,695-957
MQRKTFKDIHLQFFLNFFTNYANNEFGLAMILRKNRAQFHAFAIYKMPKITSCILVIFWDIILIDPPKFQVWMCRFEHLLSLQLPAVRQEIEKIWLFFRCYYDIISDFEPPISTEIDWPLAAATKELILSN

SEQ ID NO: 133197 - protein, 109 aa, Heterodera glycines
  misc_feature (108)..(108): Xaa can be any naturally occurring amino acid
  Coding regions on vcDNA: vcDNA=SeqID_59620; Strand=+; Position=1 -53,477-558,628-774
  Homolog annotation: Hit_ID=XP_516455.1; Match level="QueryCoverage =98%, HitCoverage=18%, E-value=1e-22, Identity=37%"; Hit description =PREDICTED: similar to laminin, beta 2 precursor; laminin S [Pan troglodytes]
GEGGVKCSCPRHFCRPACNDIDGQCHCKQGRGGRTCADCQDFYWGNPFAGECMSCECDTDGNPFAGECMSCECDTDGSQTLQCDRQTGHCVCKPGSGGPKCNHCARGXT

SEQ ID NO: 133198 - protein, 33 aa, Heterodera glycines
  Coding regions on vcDNA: vcDNA=SeqID_59621; Strand=+; Position=1-99
EQLQNQEELQNDENVDPQLHQQRAAQQAQYERL

SEQ ID NO: 133199 - protein, 70 aa, Heterodera glycines
  Coding regions on vcDNA: vcDNA=SeqID_59622; Strand=+; Position=1-343
LTFHKVWVLMGSLSLVLVPPFNAYFGAVKSGRQAFLRVGPPIVFCISFLSLSLSHTFPRFCVLISLTKNI

SEQ ID NO: 133200 - protein, 31 aa, Heterodera glycines
  Coding regions on vcDNA: vcDNA=SeqID_59623; Strand=-; Position=1 -81,395-409
MSSAMPLIKAIKRDLFNYGTGKHLKINENIV

SEQ ID NO: 133201 - protein, 531 aa, Heterodera glycines
  Coding regions on vcDNA: vcDNA=SeqID_59624; Strand=-; Position=1 -67,148-242,289-1231,1512-2002
MKSIHFRKYAMIILYYFFISYTVLLCMGLSTKELKDLNTQIDKIKHKITETIGRENEGKETMDDKVIKKLEDIANAKIFIETLSTFAINMTAQDYANLMFFEKKFTIPEIQEEYNARKELQILKKKLDDKIEEAKKFWKKNGKGCKNQSQTEIIEMKVKLELMDVMKESNLLMTRQYENLAKECAKFGEMEKNEWGKKLVEMFLKSLKEKMDKLKEKLNENDWMRIDKLEKSLSKIIKGEKPPEEAAKSNSEELSKELRSTSEEASKAMEKHLKLDWKKIGIYTQEEMSNWRLAMHGYWALISFHKIGIVSNAKKIVELLTPKRKKNGDQQEQHQESNNDKEKYQKWLEENAKLYKTVYARLFPQNDDVLVVISRGNSFIFLLMAYAVFLKHCLNFLLFNPSDAKKGRRRRKRGFGGGSETSGCSRSRVNWSAWLQCISLILLIIILIWLIIAALIAICSCILATADNGGRRGGGDIFIFNSGGSSSRNSSSSDCCCCFGTSSSSSRGYSYGRPELTYFDSCAVVWWDLWN

SEQ ID NO: 133202 - protein, 372 aa, Heterodera glycines
  Coding regions on vcDNA: vcDNA=SeqID_59625; Strand=+; Position=1 -961,1191-1346
  Homolog annotation: Hit_ID=NP_702697.1; Match level="QueryCoverage =100%, HitCoverage=65%, E-value=6e-20, Identity=22%"; Hit description= hypothetical protein [Plasmodium falciparum 3D7] emb|CAD49135.1| hypothetical protein [Plasmodium falcip
MANGKNSNSTSPPYSIDKTTTVAKDDNVNNAEADDVNELQNSMSKTTSVEMDKDDDGNSAASDTDNVVQQISNSSPSYSMEKTNTVETDAVENDDDESNAAAETDDVVPYSMDKTTTVATDDNESYAEANDANEPPYSMNKTITVEMDKDDDGNSTASDTDNVVQQISNSSPPYSMEKTNTVETDDDENGQQENGGNANGGRKQNTSSISISSSRRITTHNEFDDELQNIQKSNGCDTNENGDNNDGIRYEKKSWMTTEKKSSNIGGTNDNDDDGNDGRKRKSKWTKKAWKWRNEDDDEEEEDDDENEQEEEEEIVQRKTEISEKNDGRKWKKSWQMSWEEENDEDEEEEEEEENYNGKKEEDDEEEMFEEN

SEQ ID NO: 133203 - protein, 95 aa, Heterodera glycines
  Coding regions on vcDNA: vcDNA=SeqID_59626; Strand=+; Position=1 -178,435-541
  Homolog annotation: Hit_ID=NP_495097.1; Match level="QueryCoverage =98%, HitCoverage=19%, E-value=6e-13, Identity=38%"; Hit description =a cluster of two very similar genes (2F923) [Caenorhabditis elegans] gb|AAK82897.1| Hypothetical protein
MASDFHFLLFLFTNHHVEFSVAELKSLVASVRKSDAQGAKEWAERSENWGTLLLLSQSGGIGGHSPTAPVSESDAGSWNCQHCTMLNPRQRNDCS

SEQ ID NO: 133204 - protein, 91 aa, Heterodera glycines
  Coding regions on vcDNA: vcDNA=SeqID_59627; Strand=-; Position=1 -52,481-591,1193-1285,1379-1398
  Homolog annotation: Hit_ID=NP_492020.1; Match level="QueryCoverage =100%, HitCoverage=9%, E-value=3e-45, Identity=84%"; Hit description =tissue factor pathway inhibitor precursor family member (100.0 kD) (1H712) [Caenorhabditis elegans] emb|C
SSPFISALSLQPMHCTPNVDGSCPGNFFCWFSTTTSSVNAFYCCRSPDSIDTGYCPPQLVPVPGEGAIPYRYCSPSAPINDGIQGCGINTH

SEQ ID NO: 133205 - protein, 118 aa, Heterodera glycines
  Coding regions on vcDNA: vcDNA=SeqID_59628; Strand=+; Position=1 -267,876-963
MARTMLLARHRRRSKRNRDEVAREEPKEEEKAEGEDEMTEFGQNLLLTDNEEEEGHTTTAKTKQKKTAQRTEEQPPQGGRTVLRSWHNWIIFECSNQGPFPGACGVDNIQLVNAYWPS

SEQ ID NO: 133206 - protein, 281 aa, Heterodera glycines
  Coding regions on vcDNA: vcDNA=SeqID_59629; Strand=+; Position=1 -65,123-269,320-401,693-949,1013-1159,1616-1705
  Homolog annotation: Hit_ID=NP_501970.1; Match level="QueryCoverage =99%, HitCoverage=49%, E-value=1e-103, Identity=34%"; Hit description= EGF motif related, Lin-12 and Glp-1 X-hybridizing, abnormal EPIthelia EPI-1 (407.8 kD) (epi-1) [Caenorha
CPCPHPIESNNFATSCVVSERGLQHCACREGYAGERCELCAPGFFGDPLVPNGECKRCDCNNNNDLSNPGACNPRTGDCALCEGNACNPRTGDCALCEGNTDGRHCEYCKAWYWGDAVHAKNCSLCACNQCGAAYCDGQNAHCECQPRVTGPLCDRCEENAWGFDSCKGCTPCQCGLAASNSQCDLKNGQCACMPGAAGQFCGQFCDQCAHGFWKYGAHGCQKCDCEADLSMGTVCDVQTGQCHCQEGATGPRCDKCLPGYLRVPNFGCRFCDECVYALVS

SEQ ID NO: 133207 - protein, 61 aa, Heterodera glycines
  Coding regions on vcDNA: vcDNA=SeqID_59630; Strand=+; Position=1-184
MLNNFIFCAFFLCFLHRFPLGSAANDEIDEAMPGFGEENAEEPKASGAIPTDKKAEKETFA

SEQ ID NO: 133208 - protein, 36 aa, Heterodera glycines
  Coding regions on vcDNA: vcDNA=SeqID_59631; Strand=+; Position=1-110
IFSENLFINDQNFQFFPRRRLSAPPRPQNSYFFLEN

SEQ ID NO: 133209 - protein, 90 aa, Heterodera glycines
  Coding regions on vcDNA: vcDNA=SeqID_59632; Strand=+; Position=1-273
MPLEEAREFRSRLETILVFSLLFYLIFFCSQFFGMANAPRNVFDQAVKLFVWKRSHYRWAAQRNGRVKIHRGLFDSFEDQVAICKEAYSC

SEQ ID NO: 133210 - protein, 140 aa, Heterodera glycines
  Coding regions on vcDNA: vcDNA=SeqID_59633; Strand=+; Position=1 -57,910-1163,1296-1406
  Homolog annotation: Hit_ID=NP_501005.1; Match level="QueryCoverage =89%, HitCoverage=27%, E-value=3e-36, Identity=57%"; Hit description =TraB determinant (4H346Co) [Caenorhabditis elegans]
MAMHLGETVPKARFSTETRNGLAQGLLQVLLLSLSAHITQQLGMAPGGEFRAAHAASKLVPGCGVILGDRPLNVTLQRALSALNIFQRMKFFFHLTVSLGMEIDEAEVERCKNMDMLEEMLQQMAGEFPQVSRILVDERD

SEQ ID NO: 133211 - protein, 246 aa, Heterodera glycines
  Coding regions on vcDNA: vcDNA=SeqID_59634; Strand=-; Position=1 -100,243-409,522-827,1736-1903
  Homolog annotation: Hit_ID=NP_504511.1; Match level="QueryCoverage =95%, HitCoverage=65%, E-value=3e-54, Identity=51%"; Hit description =phosphoglycolate phosphatase family member (38.8 kD) (5G242) [Caenorhabditis elegans] gb|AAB94163.1| Hypo
MPSFTLPMPRHLDANSFQQMLLHNIDTFIFDADGVLWLGEQSIPGSSDFVNFLAKNGKRIIVLTNNATKSRAVYARKLGQLGFGRCVNEHNIVNPAAVVADLLHRAGLGQGSDKKVYLIGGQGVKDEMDQLGIDYFGDGFDPVDEQPASKGSAFLYDLELEEKLERVGAVVVGYEKYFNYLKLMKASNYLRVDDIMESQMQGRDDLMPDFYANSLGALMLKSHGCATKKEAAAAKSACTPRATAFV

SEQ ID NO: 133212 - protein, 199 aa, Heterodera glycines
  Coding regions on vcDNA: vcDNA=SeqID_59635; Strand=-; Position=1 -300,347-507,641-776
MFLATDPILMDLQKANKKSEKRKLNDEEQDNTRQMKKLKKSGTKKTDCDQNAMSGKKMEHSVLTGHKSDNSNAQRPNGNTSNCNKSDKKSDATSNSVHPQVASDTKFPIPFTIPKVSASFSDASKSPLPSALTKEAKNELSNFEAETNSQRTLRDNEEFPLNDTNIPICNEAKHSETECSKNQGRRKRETNKLPKISER

SEQ ID NO: 133213 - protein, 43 aa, Heterodera glycines
  Coding regions on vcDNA: vcDNA=SeqID_59636; Strand=-; Position=1-131
HIETHSNGGASVLRCDWRRLKHDLSSQELKKFAEEFIDLGLSE

SEQ ID NO: 133214 - protein, 107 aa, Heterodera glycines
  Coding regions on vcDNA: vcDNA=SeqID_59637; Strand=-; Position=1 -120,417-620
MNLRILLFFAVFIPSARSFYLPGLAPVNFCEGKDKKPTCLINFKENKQCSYLCEKDYKSSDKSHQEKLRLLQRGMKLNYQHHWLFRRVFFLNWNSGSLTTNLSLSAS

SEQ ID NO: 133215 - protein, 63 aa, Heterodera glycines
  Coding regions on vcDNA: vcDNA=SeqID_59638; Strand=-; Position=1-191
MTDCPDTNLNENGNQLVTPSTNADECKRKSTKQTEASKCLKGEEDDTGGLGWDIKLNRFPRGI

SEQ ID NO: 133216 - protein, 86 aa, Heterodera glycines
  Coding regions on vcDNA: vcDNA=SeqID_59639; Strand=-; Position=1 -63,179-376
MFSDQNRIIFNLRSQLIDQMANHAGRGNFHLRYIPMAAATLLGQRFEERARRHRMAIGATASTSASNGANGVKGSVEGGAAINENG

SEQ ID NO: 133217 - protein, 139 aa, Heterodera glycines
  Coding regions on vcDNA: vcDNA=SeqID_59640; Strand=-; Position=1 -50,95-201,443-705
MLFTAIDRLIVIFFDEMQNKRKIRLYLTTITLICSIFCIDLCFTFYQNIELYGLPSVDQINYRTFRALSCIIIVNIGGYFISALYAMLIRPSISSPITAWFGQAITGIPLLIGAASNGGILYFTRCYKYLKKGLFLNKF

SEQ ID NO: 133218 - protein, 96 aa, Heterodera glycines
  Coding regions on vcDNA: vcDNA=SeqID_59641; Strand=-; Position=1 -219,703-773
ALAAQLSSSSSSSALAAAAVPLEEPCPPRRQSDMFDEDDDEADVFGSERRRNDEDDEEEEELDLLLEKGAKFSDSAMLDVGGSSRGGGSTPGPGYT

SEQ ID NO: 133219 - protein, 75 aa, Heterodera glycines
  Coding regions on vcDNA: vcDNA=SeqID_59642; Strand=-; Position=1 -106,722-843
MYKIVRRGTKVIRRGTTVIRRGTTVLRRGTTVIKRVTSGCVNRRLFSWEKALRALGASLPRSVMGCGVIVGPEDI

SEQ ID NO: 133220 - protein, 60 aa, Heterodera glycines
  Coding regions on vcDNA: vcDNA=SeqID_59643; Strand=+; Position=1 -25,645-802
MTMNVLDYYRHFENAWTWTWIPCWTWTLISWTKIQKNPCPGKIQAPRDLDPDLDPGKIQA

SEQ ID NO: 133221 - protein, 68 aa, Heterodera glycines
  Coding regions on vcDNA: vcDNA=SeqID_59644; Strand=-; Position=1 -204,249-251
MHKTFFRENRDEKSNSRLKNKKLNKFVVKRFLLLKGGKSDKKVFLAISTWLDKMSTENKTKCVDPMDK

SEQ ID NO: 133222 - protein, 81 aa, Heterodera glycines
  Coding regions on vcDNA: vcDNA=SeqID_59645; Strand=-; Position=1 -90,148-303
MYVEACVTFPISQLPNIFEAVQLTRLLDLENLPIVVWIILIQRWKLCSEQMIFCKLINNSCAKSLGRKNCKLMAKFHFGMP

SEQ ID NO: 133223 - protein, 95 aa, Heterodera glycines; identical to SEQ ID NO: 124528
  Coding regions on vcDNA: vcDNA=SeqID_59646; Strand=-; Position=1 -576,741-1132

SEQ ID NO: 133224 - protein, 343 aa, Heterodera glycines
  Coding regions on vcDNA: vcDNA=SeqID_59647; Strand=-; Position=1 -741,1155-1442
  Homolog annotation: Hit_ID=XP_314437.1; Match level="QueryCoverage =70%, HitCoverage=66%, E-value=2e-27, Identity=32%"; Hit description =ENSANGP00000025289 [Anopheles gambiae]
MKEDVKLLIDACDGCQRRKVQPGQSNFSPSVPIKAAEYPFQRVHCDLMGPPLKKTDRGNFYIFLTIDSFSKWITAKAISDQKAETVSEAFVETVIHKCSTPEIVVTDQGRQFTSEIFSNLSKIYGVEHTMSTAYHQQSNGQAEGSMRIVANIMSQIINEKGNNWDKLLTHALFAYNTAIHTVIKHTPFYIVYLRHSKLPVDRLLKLPNSENLESDISIYTKIHSEKASKAWKIVREEIEKGQEKFKKENCEKSTKKRKMYNGPVDLPLREADEPLNWEKFVNDPNLELEEKTDEESFDEEEKNTEIENLNKEKRDKKGVEFKKSLTEFGFESSEEEQESQIAF

SEQ ID NO: 133225 - protein, 33 aa, Heterodera glycines
  Coding regions on vcDNA: vcDNA=SeqID_59648; Strand=+; Position=1-145
NNFKIILVTFPFIYSLKSSKYINSMHWEPNLGP

SEQ ID NO: 133226 - protein, 83 aa, Heterodera glycines
  Coding regions on vcDNA: vcDNA=SeqID_59649; Strand=+; Position=1 -51,491-610,794-874
MEHDEQQMSMLPYDHGMLLSEDAEEFLLFDGDFLVRKTEEISDDGRIFVLSVNVAGRGQSLLSKSLSGGGKISQILNEICDEK

SEQ ID NO: 133227 - protein, 260 aa, Heterodera glycines
  Coding regions on vcDNA: vcDNA=SeqID_59650; Strand=-; Position=1 -124,176-747,795-881
  Homolog annotation: Hit_ID=AAO85455.1; Match level="QueryCoverage =17%, HitCoverage=46%, E-value=2e-18, Identity=86%"; Hit description =putative gland protein G17G06 [Heterodera glycines]
MPKRKLLSKINARNSTQIVNKKGRSGRTKMAKATKARLAKKTAPPPNPNPETPQQDAGPSTSAAPAEEAMEPPPPTPGPVLTPEMDEEILEFGFSLPSTSVTPIGDLVPFSTTQTAPMDTGETTPPPLAIDERSERIEQLEKKARHDGEQHPENPRPRRSNGGPFRDGMGQNNLPNNGTSGKSSNFHNFSGDEALHSLWKTMPDDEKMRQQLEHHFVSNWLLDTGRFDELKLREEEQREQAEGDKTNEESDQDAEVDIVD

SEQ ID NO: 133228 - protein, 69 aa, Heterodera glycines
  Coding regions on vcDNA: vcDNA=SeqID_59651; Strand=-; Position=1 -91,197-315
MTALIRAFLKIFVKNIISKRNRPNGATNSVANKQLMGYRMIPRNTNTHERVGRRREKAFRQYCATNSFW

SEQ ID NO: 133229 - protein, 29 aa, Heterodera glycines
  Coding regions on vcDNA: vcDNA=SeqID_59652; Strand=-; Position=1-89
MNPQQYSPSAQPQIFHQQYPQYSPYGGME

SEQ ID NO: 133230 - protein, 212 aa, Heterodera glycines
  Coding regions on vcDNA: vcDNA=SeqID_59653; Strand=+; Position=1 -99,152-691
MPNKSNSRQSNLFAFFQKKPKDEPIEKEEKQQKCVENECENFHTPQRKRTEATRNSVNKSQPMTPLNQQRNQSLVAEPRKDTTDNNTTNAAFTDSEEEGEDSSCGVGFMSCASLATPSSAECASAPKRRRVILSSDDEEEKMMGNGQRKDQKGDETENEPQRQATKRKRRDAAKEAKERTPPSVVRVPRDEIQTTPSAKCAHSFINSFVCHL

SEQ ID NO: 133231 - protein, 197 aa, Heterodera glycines
  Coding regions on vcDNA: vcDNA=SeqID_59654; Strand=+; Position=1 -427,698-864
  Homolog annotation: Hit_ID=NP_507780.1; Match level="QueryCoverage =55%, HitCoverage=8%, E-value=3e-12, Identity=36%"; Hit description =predicted CDS, DNA polymerase type B, organellar and viral family member (5T899) [Caenorhabditis elegans]
MVTWSAKDGLEPMSEFVNCVKGFSRFETVAFAHYGGRFDSHFVLAELSRKENETELMMADLKIYQIKAGRVCFRDFWMLSQNKLADLPKTLGLSIAAKLYFPHKYNKNENFGKRLPNLPPLGDYCPDSMKEEEAVKLESWYKGMCISRVPEVLSAVDDWTKWALHGRELQKDRDADGKLREKCMLRAAPFGFRVWST

SEQ ID NO: 133232 - protein, 906 aa, Heterodera glycines
  Coding regions on vcDNA: vcDNA=SeqID_59655; Strand=+; Position=1-2721
  Homolog annotation: Hit_ID=NP_491240.1; Match level="QueryCoverage =81%, HitCoverage=54%, E-value=1e-129, Identity=35%"; Hit description= zn-finger, CCHC type and RNA-directed DNA polymerase  and Integrase, catalytic domain containing protein
MAQPTAQELLKLIADQQTAMTQQQQQIAQLLALQQTQKADTVLTLPDVAIFEPSDDKSRISEWLKRAQFAIDCVSPNASDAVKVKAIMNKLSEAAFSEYTKFCLPEPVTSFSLDTTVKKLEKLFAKPQSIFIDRFECLIARKGEGEDFRSFVNRLKRLITDFKFSDLKEQQFYVLMLLTALKSHGDAMLRQRILSNLTADGDNITYDAVVEDCMNFMTTIAEAKVIESSSSGSQRSHAVNAVHPKREKPKYERPKSQQSTKTEQQKCWRCGQTNHHHAACPQKGYKCRKCSQNGHIESRCEAVQEWRKKNAKSWLKKNVGNVHIVTVNIGTTAKPTTKSTLLRVKVSFQGKVIEFVLDSGAEVNVINEMTYKLIGSPKIRPAKEKAVLYNGSTRSFIGKGTGTFEFNGMNVEHEFYVAGKDSLNLLSIQTMDAFGLLDELKEKISSKMVNMCKGGNKENAPSRPKGTEVNEYLTKLKEIFPNVFKEELGFCTKAKANLVLKPDAQPIFRKARPVPYNSREVVEKELERLESLGIITKVEHTDWAAPIIIVKKADGSARMCIDYSTGLNNALLDHQHPLPLPNDIFATLNGGLVFSQVDLKDAYLQIELTAEAKKLCTIATHRGYYQFNRLPFGVKTAPGIFQSIMDKLLAGLEFATAYLDDIIIVSKTKDEHFQNLEKVFDRIQSWGFRVKMDKCAFFKKQIKYLGQIIDKDGRRPDPSKIAAITNMPAPKDVPSLRTFLGMVNHYQQFVKNMRFVRQPLDDLLKKDKDWDWSKECQEAFIKIKEILSSDLLLMHYDPKLEIIVAADASDHGIGAVIYHRFPNGAIKAIEHASSSLTPAERNYSQIEKEGLALIFAVRKFHKMIYGRQFILQTDHKPLNRHFWQQKGNPPDEREPSSTMVTHAFGV

SEQ ID NO: 133233 - protein, 17 aa, Heterodera glycines
  Coding regions on vcDNA: vcDNA=SeqID_59656; Strand=+; Position=1-65
TFYEMYKNNFIILNIIL

SEQ ID NO: 133234 - protein, 194 aa, Heterodera glycines
  Coding regions on vcDNA: vcDNA=SeqID_59657; Strand=+; Position=1 -139,191-225,295-450,510-629,680-724
  Homolog annotation: Hit_ID=NP_499603.1; Match level="QueryCoverage =100%, HitCoverage=49%, E-value=3e-59, Identity=61%"; Hit description= Ser/Thr protein phosphatase, protein phosphatase (37.4 kD) (pph-4.1) [Caenorhabditis elegans] emb|CAA220
EVFDCLSLAAVLHPCIFCVHGGLSPSFETIDQIRTIDRKQEVPHEGAMCDMLWSAMCDMLWSDPEKECVGFAISPRGAGKECVGFAISPRGAGYLFGSDVVKLFCEKNGVEMIARAHQLVMEGYKWHFDNTVLVLTIWSAPNYCYRCGNVAAILEMDDVLKKEFLIFEAAPQVGRNTPMGRNTPMKGPMPEYFL

SEQ ID NO: 133235 - protein, 323 aa, Heterodera glycines
  Coding regions on vcDNA: vcDNA=SeqID_59658; Strand=+; Position=1 -948,1023-1055
  Homolog annotation: Hit_ID=NP_490937.1; Match level="QueryCoverage =90%, HitCoverage=61%, E-value=7e-52, Identity=36%"; Hit description =reverse transcriptase like family member (1C698) [Caenorhabditis elegans] gb|AAK27868.1| Hypothetical pro
IIWNILRRLPRPILASPDNIPYILLKIVLTTITKILADIFRLALDSGQIPERTSLVVPIFKKGEKTDPLNYRPVSLTSTVCRVFERILSSEILEFLNGIRFFDKEQFGFLKNRSTTTQILKMMDDIYNSIQMNQQIDIIYIDFVKAFDSVPIDLLLQKIKKIGIEGKIYKFLTNFLKNRSFKVKIGEVLSESFSIFSGVPQGSILGPLLFLIFINDLPSFIANDIKMYADDVKLYYAYENDDKTNHLDKAIEALEKWSKINGLEISTGKCFVLYLGKNNMKKRYFINSQRISESDNGRGLSIIIDSNLKNQGNLKNQGNKEPN

SEQ ID NO: 133236 - protein, 93 aa, Heterodera glycines
  Coding regions on vcDNA: vcDNA=SeqID_59659; Strand=-; Position=1-283
SFVYLLRCVPSAGTCQSRLGFGVRLRLIRLFGGHALQQPKMVTWPAENCPSVARRRSQHRKLKNGTTTFVLQFPIPQTPLPNGVVGFECIMIV

SEQ ID NO: 133237 - protein, 213 aa, Heterodera glycines
  misc_feature (195)..(196): Xaa can be any naturally occurring amino acid
  misc_feature (201)..(201): Xaa can be any naturally occurring amino acid
  Coding regions on vcDNA: vcDNA=SeqID_59660; Strand=-; Position=1 -74,3333-3617,3682-3841,5365-5486
  Homolog annotation: Hit_ID=NP_001002647.1; Match level="QueryCoverage= 83%, HitCoverage=40%, E-value=1e-55, Identity=58%"; Hit description =zgc:92020 [Danio rerio] gb|AAH76527.1| Zgc:92020 [Danio rerio]
IAASTVFSLPFKSPSITAVPPRPISPLMASRPFRPLSSFRNGRANGAPLFRALPQPALCLTLWPMQRRQRPQLRHSRNARTPVHERPHQCPVDNCDKRFSRSDELTRHIRIHTGHKPFQCKFCMRAFSRSDHLTTHMRTHTGEKPFCCDVCGRKFARSDERKRHTKVHAKQKEKKRPKKGTIGGKGRKKSENWNXXGGGGXLKAINFQMIDCF

SEQ ID NO: 133238 - protein, 120 aa, Heterodera glycines
  Coding regions on vcDNA: vcDNA=SeqID_59661; Strand=-; Position=1-361
MMDKLDNDEALKSGNDVEEARKKQLSAIEETNRTVRQIMENLSQFKKTGIPSGKGLKCISQQLFNRMAHHLGIEWHQVQPYRDMSNWRLAMRGFSALNAFLKMGIHFDSFAGKKNHKREE

SEQ ID NO: 133239 - protein, 38 aa, Heterodera glycines
  Coding regions on vcDNA: vcDNA=SeqID_59662; Strand=+; Position=1-117
IHTLGGDDDNKSRQRSNSSDDENSDEGRQGFFVGGSDH

SEQ ID NO: 133240 - protein, 142 aa, Heterodera glycines
  Coding regions on vcDNA: vcDNA=SeqID_59663; Strand=-; Position=1 -275,321-476
DPHKYRFLSLSRSLSLFSHSSSQLAIDTANEYPKKETLDGIIRDKFENILKDLFKKAEEKAKKDNPRRANEINDDINKILLGSKFNDSYTWLDEALLSVFVKGNVKFNKFLKRLKEYQAAAFYQDESDLCMRIGNVTKRGEI

SEQ ID NO: 133241 - protein, 167 aa, Heterodera glycines
  Coding regions on vcDNA: vcDNA=SeqID_59664; Strand=+; Position=1 -261,362-526,570-625
  Homolog annotation: Hit_ID=CAE67770.1; Match level="QueryCoverage =75%, HitCoverage=26%, E-value=2e-27, Identity=48%"; Hit description =Hypothetical protein CBG13345 [Caenorhabditis briggsae]
VGSDLLKNYRIGWPLFLKVLRLVVLFPGLLFVDCAHFQYNHCSLGLFLWAISFLEKGRLRAGAFFFVLALNHKQMELYHALPIAFYSYLTFFSVFNLFQLALVVLLTFVILWSPFLWPEPSLALQLLRRIFPFHRGLFEDKVANFWCCDKVANFWCCASVLVKFKQI

SEQ ID NO: 133242 - protein, 34 aa, Heterodera glycines
  Coding regions on vcDNA: vcDNA=SeqID_59665; Strand=-; Position=1 -52,443-495
MEKACKIWRDYIDFSALDFYSSPFLIVKASECLK

SEQ ID NO: 133243 - protein, 226 aa, Heterodera glycines
  misc_feature (13)..(13): Xaa can be any naturally occurring amino acid
  Coding regions on vcDNA: vcDNA=SeqID_59666; Strand=+; Position=1 -260,440-736,857-986
  Homolog annotation: Hit_ID=CAE62360.1; Match level="QueryCoverage =84%, HitCoverage=21%, E-value=2e-42, Identity=47%"; Hit description =Hypothetical protein CBG06440 [Caenorhabditis briggsae]
PPPPSPLNSLLPXIVPSPCVSPIYHPLFVQHSLEFRLHLRHEFLMLGILQVVEQLRSASPEGDGSSLGDHLDLFEMMRQEDEQEIRSCFSNDSLSDSGSTSPIDFESPSGMAEVLTQRLDNTLALPHLISLFQHLLMVPSDEKNLPLWRLFDLVLQQLTLQSAMGGLVCFSSQLIHHSNLVRFFGRLKTQEDCEQLEGKLRETEQELEMERRSQGRLENRLSDLQD

SEQ ID NO: 133244 - protein, 49 aa, Heterodera glycines
  Coding regions on vcDNA: vcDNA=SeqID_59667; Strand=-; Position=1-247
FRFSHFAFRIFWRFAFRFLARNATFTPLRIGLNSHKIFQNFTYKLANFQ

SEQ ID NO: 133245 - protein, 200 aa, Heterodera glycines
  Coding regions on vcDNA: vcDNA=SeqID_59668; Strand=-; Position=1-603
  Homolog annotation: Hit_ID=EAK87658.1; Match level="QueryCoverage =89%, HitCoverage=34%, E-value=3e-27, Identity=34%"; Hit description =Low complexity protein with large Glu repeat [Cryptosporidium parvum]
MHHGMIAEMERHLTRKRSIQYPDEGEIVDMEVVEEEEPEEAPLNPLKNRTKLDQLRLKHERDKKEREEEDKRRQQREEQQQRKQQEEQRKQREEQQRKQREEQRKQREEQQRKQREEQQRKQREEQQRKQREEQQQKQREKEQEKAKKSEAERLAKEKKTEKERLATEEEERLAKEKAEEERFEFGQVVLTLQFKKVVTF

SEQ ID NO: 133246 - protein, 137 aa, Heterodera glycines
  Coding regions on vcDNA: vcDNA=SeqID_59669; Strand=-; Position=1 -46,192-418,471-611
MAPRKQNEQFLDEIQNIDDDVILVDSQSSHAEERPALKKRGRKSRWEKLLEDVNNAKKSNPAEVEVTDVDERKAANVFDYPTIFWKLARPKYGVFTFMCNECRNENFKRGDKRFILNTGSGQEKLELPKRFAKTVPS

SEQ ID NO: 133247 - protein, 165 aa, Heterodera glycines
  Coding regions on vcDNA: vcDNA=SeqID_59670; Strand=+; Position=1 -385,433-545
MPPLTTALSKLLNCKAENLAEYLNNPEAVNKASAYLRGKKLKTTYSNKGGTTKEVEFGNFSLKSASETYAFEGFLGKCPFCKHSLTLESSEVKVHQYFYIKHRIRLLYPQLKCIVEYHSKGHCKYYPLELLAIEESAEITGEKPTDTNYLDYLGFRSVWQPTPVY

SEQ ID NO: 133248 - protein, 501 aa, Heterodera glycines
  Coding regions on vcDNA: vcDNA=SeqID_59671; Strand=+; Position=1 -315,374-707,829-1490,1658-1739,1786-1898
MMKKLPKPFLIVYDDLMGDIDAKKLADLYTKKSHHNNFSVIFLTQNLFDKAMRVPRSNAQYIFLMRAPSDMLSIRNLASQMFPREQGFLMDAYKQACADPYGYLLTTKKRLSLYPKMVKKQMVGQRVLDNYEYLKSLGRTTSHKKRRHLLSSAGCEELLTLVEICLNLLNGSFCLTRKQKQKLLPFADTIRRLARVRSEQSARKLILQQQQPQQEGAREGVGVAKGDDDVAGQTNLGFVKRQLETAKRKRTANVSERNVLYNQQLRRYLKLRKEVKDRPLKVQLSNGAQLLNKTVETGVQVRPGPDEPKDNSVLITGEDEEIEVPTPISKTPGNSRSPRTNKKAIKQKEMNEKKDHLLAIIMSDPQRFGATDRGKILNPKTGREFINSDLAWSIERLVDPRPENAPSPSGTKELMRKLAQNPLASSLLNRLFVGSGQRNTTYTLFKPKREKFRRLRTVPGGFMTGGLGRLPSPFAKEQRLSVPAVGGGCVVAAYVRLTRKE

SEQ ID NO: 133249 - protein, 213 aa, Heterodera glycines
  Coding regions on vcDNA: vcDNA=SeqID_59672; Strand=-; Position=1 -150,199-319,368-738
MHHGMIAEMERHLTRKRSIQYPDEGEIVDMEVVEEEEPEEERYDTRILYMDTDSIFYDFKTALGDPLKGGNQLGELADEYPSHTIDEFICAGPKAYALWLRNNATGEDEYKLKLRGITLDSNACTHINFEKMKEMVLEKWGTPGNHVRFDYPTKNFRITKQGDILTVPITKQFNPTVNNGVLRDRGLKIVPFGYSSYEYCKAHNPYDCLCKKE

SEQ ID NO: 133250 - protein, 158 aa, Heterodera glycines
  Coding regions on vcDNA: vcDNA=SeqID_59673; Strand=-; Position=1-4,58- 284,334-579
MDIDYDVILVDSQSSHAEERPALKKRGRKSRWEKLLEDVNNAKKSNPAEVEVTDVDERKAANVFDYPTIFWKLARPKYGVFTFMCNECRNENFKRGDKRFILNTGSGQEKLEFTQTFCQDCAKLNFDCTDLIMKHQKRMMDHRRTEDGTPFSRRKSDL

SEQ ID NO: 133251 - protein, 153 aa, Heterodera glycines
  Coding regions on vcDNA: vcDNA=SeqID_59674; Strand=+; Position=1 -352,2170-2279
MLCRHNFLNNLWASSIGEYGHLIVHIQLSSASSTQFDVSKSLLMQKSHDASLVNSLLKRRPNIVPPMREFFDSCRATMPSTITRLTKMITITMPLSMLTPITSSIFSLVFLGIMRCAPVQCAACDGGTPKQQQQKQQTEHNPTMALASEMVLI

SEQ ID NO: 133252 - protein, 146 aa, Heterodera glycines
  Coding regions on vcDNA: vcDNA=SeqID_59675; Strand=-; Position=1 -96,789-980,1443-1595
MARRCALVLVILCTQLSNNALVAGLTCYETVNGKTTIVQNESWTYCALVPATIVGNELVNGSQFGLGPDNDMMAAYNTAFAMSVDEYRILTVCIYERYDFSRFMTIKPDLAVEFAFRCVCNYDLCNSEPTFSAYLSAIKSESFARR

SEQ ID NO: 133253 - protein, 53 aa, Heterodera glycines
  Coding regions on vcDNA: vcDNA=SeqID_59676; Strand=-; Position=1 -88,746-819
MQVQSAESRPRRAWVFPGLDFCPGPTWKQENKKLSADRFTQFASDSNEISNFN

SEQ ID NO: 133254 - protein, 40 aa, Heterodera glycines
  Coding regions on vcDNA: vcDNA=SeqID_59677; Strand=+; Position=1-121
MTMPIDILEVNQVISIRLLTDKMLDNTITLKLWHSIQGKE

SEQ ID NO: 133255 - protein, 34 aa, Heterodera glycines
  Coding regions on vcDNA: vcDNA=SeqID_59678; Strand=-; Position=1 -81,408-431
MRVFSQLLVQTCVVDLFVLILAALVLPKIFLASA

SEQ ID NO: 133256 - protein, 31 aa, Heterodera glycines
  Coding regions on vcDNA: vcDNA=SeqID_59679; Strand=+; Position=1 -65,108-138
MIFGLSSCTFCQLPHLILAISLFLFVFINIA

SEQ ID NO: 133257 - protein, 64 aa, Heterodera glycines
  Coding regions on vcDNA: vcDNA=SeqID_59680; Strand=-; Position=1 -47,336-483
MAPKCVAKCNVSAVQCKCELAHGTEQTNCAVRPEKGALRVDIGMARANPTARPRAHQLQFVGAK

SEQ ID NO: 133258 - protein, 74 aa, Heterodera glycines
  Coding regions on vcDNA: vcDNA=SeqID_59681; Strand=-; Position=1-225
MWEKAAKLRPIGGTETDTQRCGKFRKTQEPINGPRESRLGTRARNFEKPGPGSVIGTRITRWNRTAFRTMKSLF

SEQ ID NO: 133259 - protein, 212 aa, Heterodera glycines
  Coding regions on vcDNA: vcDNA=SeqID_59682; Strand=-; Position=1 -106,294-358,408-502,1150-1232,1481-1608,1669-1797,1947-1979
  Homolog annotation: Hit_ID=CAE62174.1; Match level="QueryCoverage =91%, HitCoverage=82%, E-value=7e-60, Identity=57%"; Hit description =Hypothetical protein CBG06221 [Caenorhabditis briggsae]
MFGSLAVFLTLFLVLLLFSSFVTGGEYDLTAEVPPGKIQCFFQPVLEKHKSMEVYYQVIDGGDLNINFMLILDANVLKQDQMRTDGDHKIDIPAPADYQLCFDNSFSYQTRKVVFFEIYLYDANGTLEEEDVTKFAIKGSDAAMQEMLKQVGMTVQQFQESFTTIKSRLDRVEYYQGQFRASEARDRAVVGANNDRVQFWSLKKQVPDSMST

SEQ ID NO: 133260 - protein, 125 aa, Heterodera glycines
  Coding regions on vcDNA: vcDNA=SeqID_59683; Strand=+; Position=1 -207,576-743
MDFKELVNQAERNAKRQERKVHEAEREMKARQQSQMERLAYEKAREKLVLKRRAVATMQQQKEQQQQQQLQQSQKQSTTHERTDGTTKAMTKRERLGSDAVATDNKHRKGAGPGDAAQLCNGSNE

SEQ ID NO: 133261 - protein, 66 aa, Heterodera glycines
  Coding regions on vcDNA: vcDNA=SeqID_59684; Strand=+; Position=1-210
GGGGLKKSIFFVFGAVPPNRCAQIYGETESFGNRFPIACTLILRCIFAPHKCLSTPIRTLEKIDFF

SEQ ID NO: 133262 - protein, 47 aa, Heterodera glycines
  Coding regions on vcDNA: vcDNA=SeqID_59685; Strand=+; Position=1 -42,103-204
MEMELKLAKLELEIKVLEQKLKHQEMMVEQKALKEKVIKIEQKNEKK

SEQ ID NO: 133263 - protein, 42 aa, Heterodera glycines
  Coding regions on vcDNA: vcDNA=SeqID_59686; Strand=-; Position=1-128
EKSKKAYNTFDSQDVSVPSTKKAQRCLTCQIGRDGVLSTWYG

SEQ ID NO: 133264 - protein, 104 aa, Heterodera glycines
  Coding regions on vcDNA: vcDNA=SeqID_59687; Strand=+; Position=1 -108,274-293,342-453,503-577
  Homolog annotation: Hit_ID=CAE58402.1; Match level="QueryCoverage =87%, HitCoverage=12%, E-value=3e-24, Identity=50%"; Hit description =Hypothetical protein CBG01531 [Caenorhabditis briggsae]
MESSSLEYEVQQNCNLTQIGGVLGSKGYGIALQKSTTKWWRSKGASCHGVGSSVKQQRISLNLHNVSGLFVILSMGLLFSVFIVCVEFYARKRENQNNKRNGQK

SEQ ID NO: 133265 - protein, 106 aa, Heterodera glycines
  Coding regions on vcDNA: vcDNA=SeqID_59688; Strand=-; Position=1-633
  Homolog annotation: Hit_ID=CAE58402.1; Match level="QueryCoverage =98%, HitCoverage=11%, E-value=5e-39, Identity=72%"; Hit description =Hypothetical protein CBG01531 [Caenorhabditis briggsae]
MESSSLEYEVQQNCNLTQIGGVLGSKGYGIALQKNSEWTDRISRQILLYQKRGIIAMKKTKWWRSKGASCHGVGSSVKQQRISLNLHNVSGLFVILSMGLLFSVNF

SEQ ID NO: 133266 - protein, 310 aa, Heterodera glycines
  Coding regions on vcDNA: vcDNA=SeqID_59689; Strand=+; Position=1 -207,261-449,576-668,1146-1303,1384-1518,2676-2772,2833-2884
MVRCMRASRGSSKGKGIKHMSSRTQHAQSASKRQKLHNNEDDCQWEGCSNGTDSRRKMVGINDLPHPVLGLILANLNPAERLRAESVCHRWKFVGTHFSWTNQRELTVKEIVHPSTAVHSLFSMSKPLTNKHIEILLKRCGSSLRLLNIGSLSSVNRDSITYALEELNISYCYHIGIHGIRQIRATCANLRRLYMDQIGDSVSIRELDEMLRELKSLVYLKFCECYGSSDFNDLQLNHDQHLTGIGELTNLTELHANENRLKCPVPFAMDSLGRLPAQLGKLADIERCFHHCSSSEHSDDRHLNDREGRE

SEQ ID NO: 133267 - protein, 241 aa, Heterodera glycines
  Coding regions on vcDNA: vcDNA=SeqID_59690; Strand=+; Position=1 -161,279-374,507-974
MLDSKVLDNYVEIEKGRFSEGGQMVQTRYKAKHDRHTTAVRQQQIIFQREKERKEERRQRQMERNFDAQMWRPSEKFGQPSASGKSFSNYYESQQQQNHRFYAQQREHSPAMEMNGALDSNWYTNEDDDNNRNNNSDGIDNVDDREEVSDSDGASAKLAADYSNFFGASKWPSNLYNNTHCQAKPTAKEQQKQHKSPPKKVGGVSEWSSGSGDEQQQPSEEEEKPKPAQEQKLTKHQFVGI

SEQ ID NO: 133268 - protein, 131 aa, Heterodera glycines
  Coding regions on vcDNA: vcDNA=SeqID_59691; Strand=+; Position=1-396
MVCSAISTSKSGSNSQSESFRTGLEEEEEERANGMEEVVNETPHLDMMETSGTGTEVENASNSKGKIEQRKSAIAPICSITLRQRSSAMKFAPSEMKRTHSGHYHIKAGKKQEIDLGNLGFMDNILTCYFE

SEQ ID NO: 133269 - protein, 86 aa, Heterodera glycines
  Coding regions on vcDNA: vcDNA=SeqID_59692; Strand=+; Position=1 -137,185-265,317-359
MPIEPFELENKVTNEKLTLKLSEESIELEYNWLLKRCPIGETAPVRFDPRYGNNACANLNIVRFDLGGNHWIGPLSPPAVVEEELD

SEQ ID NO: 133270 - protein, 51 aa, Heterodera glycines
  Coding regions on vcDNA: vcDNA=SeqID_59693; Strand=-; Position=1 -89,143-208
RLAWEHEIYNIGRIHAVTISHFSTHSNPFRNSLMDIPTSLDFSMVENNAKL

SEQ ID NO: 133271 - protein, 40 aa, Heterodera glycines
  Coding regions on vcDNA: vcDNA=SeqID_59694; Strand=-; Position=1 -71,502-553
MPFYLWIKCLLSPVNDCVDWHNANQLVSIFYFFIKKKSII

SEQ ID NO: 133272 - protein, 48 aa, Heterodera glycines
  Coding regions on vcDNA: vcDNA=SeqID_59695; Strand=-; Position=1 -115,187-218
MPSTLPTLVKPPNTEDIARQRTHAFTHLWPRPSSPAVEGNLDKYFELD

SEQ ID NO: 133273 - protein, 237 aa, Heterodera glycines
  Coding regions on vcDNA: vcDNA=SeqID_59696; Strand=-; Position=1-714
  Homolog annotation: Hit_ID=XP_037523.9; Match level="QueryCoverage =68%, HitCoverage=8%, E-value=3e-10, Identity=30%"; Hit description =PREDICTED: KIAA1076 protein [Homo sapiens]
MSDSWGGRSYSDEGEGGAAATAPLCCWHSDLAFPCLGTTNSTSYTEPSADEVEVGFTLVQQCAMRGSDEEFTSSSSTSSGSYTSGTYTSSSSIDEDEEEEEEDEEVEEEEVSGDEHGSRPSSRAVSPSHRSRSVSSTSSSGESAESMCSEEEQQKPAEETELKAIVEDEEKPVATEETSPIAKKSPSPMFVQMAEESEQMLEGHATVEELDGEEMNMEELEQIEEEQSIDGSKEVAN

SEQ ID NO: 133274 - protein, 149 aa, Heterodera glycines
  Coding regions on vcDNA: vcDNA=SeqID_59697; Strand=+; Position=1 -108,160-500
RAVSPSHRSRSVSSTSSSGESAESMCSEEEQQKPAEETELKAIVEDEEKPVATEETSPIAKKSPSPMFVQMAEESEQMLEGHATVEELDGEEMNMEELEQIEEEQSIDGSKEVEICREETYVRVQELRDGRTEEATRPLTGQSKPRTDF

SEQ ID NO: 133275 - protein, 269 aa, Heterodera glycines
  Coding regions on vcDNA: vcDNA=SeqID_59698; Strand=+; Position=1 -91,220-407,1531-1658,1761-1985,2470-2554,2643-2735
  Homolog annotation: Hit_ID=NP_505618.1; Match level="QueryCoverage =51%, HitCoverage=25%, E-value=3e-14, Identity=35%"; Hit description =acid sphingomyelinase-like phosphodiesterase 3 (5K666) [Caenorhabditis elegans] pir||T28041 hypothetical
MLKEAKAKVPNPNLIIWTGDSLPHDKYDEKVLFDILQKVTNAISAQFPDAVLLPVLGNHDSAPGNSFTDHPAKQQIYEKMFIIWKQWIGQEGKNSDGKAVQRFFTAPALTPAFQKNNPAFRVADYNTDTWELEDMKTYYVELDELNKNGADGTRAKLEYSMRDAFGGLDAQTLDAHIQKAKRNGTVFDALIRHNHVMYEANNNWRLNATQRAVHLCALEFVDYKMFEQCLANDANTNDQIPAAIPLAIGGFAVPFLVTLSSILTLLLPF

SEQ ID NO: 133276 - protein, 67 aa, Heterodera glycines
  Coding regions on vcDNA: vcDNA=SeqID_59699; Strand=+; Position=1 -11,200-392
MNRRWICNDVWMDILPSFDRVQLGLKIALLSPRFDALVDKHFDGKMTELTIWRAIEFARTMDKNQCY

SEQ ID NO: 133277 - protein, 323 aa, Heterodera glycines
  Coding regions on vcDNA: vcDNA=SeqID_59700; Strand=-; Position=1 -776,868-1063
  Homolog annotation: Hit_ID=AAK82953.1; Match level="QueryCoverage =68%, HitCoverage=62%, E-value=3e-11, Identity=31%"; Hit description =Erp precursor [Mycobacterium smegmatis]
HFNHWDSILLHSNHWDLTSPGPSAFQSLGLNSPAFQSLGLNPPAFQSLGLNSLAFQSLGLNTPAFQSPGLNSPGLQSLGLSFYAFQSQGLKTPAFQSPGLNSPGLQSLGLYSPAFQSPGLSFYAFQSQGLKTPAFQSPGLILLHFNHWSILLHSNHWDLTSPGPSASQSSRLNSAKFQSPELNSATFQSLGLNSPSFQFPGLNPTSIPVTGTLFSCIPITGTQLSNIPVTGTQFSSIPITGTQLTIIPIAGTEPHLILRTSITGTLFSCVSITRTQFLCIPITVTHSPAFQSQGLKSPGLQSLGLYSPAFQSPGLSFYAFQSP

SEQ ID NO: 133278 - protein, 112 aa, Heterodera glycines
  Coding regions on vcDNA: vcDNA=SeqID_59701; Strand=-; Position=1 -173,769-844,901-990
MLRHKLAAKLRCTAGSLTIQSCVSVKSQQKSFFELKYLLFVFACQQTVQTDSDRKAIQSPKQYLGCFRGVDLEYDISASVIINGGGIELEEKMNGKERPLGPETLTSALHSL

SEQ ID NO: 133279 - protein, 258 aa, Heterodera glycines
  Coding regions on vcDNA: vcDNA=SeqID_59702; Strand=-; Position=1 -89,426-775,889-1223
MLIVIHHIYAFVMPKRSNAGIVAWINRSWSRPIEPVKSFRMISRLFDSVNNFKSYIDSKLAQTELARRSWPVPNFMENLYVFQKFSKKIAAKLKDSDNFSLFHIETRNFLGFEIYFRYLRIPRHLNITPYLSTILTFEYNSTFLFFDSFKSGEDLVDAASDLVNEANEGVISDDLAIDGMKKASVGVMCNDAIFELKMDHFGKLRNDLCKQLKSDGQNFEVFLANILNIFTNVLPAVLSNAINEIEKKALLNEQNVQN

SEQ ID NO: 133280 - protein, 44 aa, Heterodera glycines
  Coding regions on vcDNA: vcDNA=SeqID_59703; Strand=+; Position=1 -89,891-938
VKGGIRVSGYHQVFYQGHLIENIVTSFKFIFFVLDKKVKCLQYN

SEQ ID NO: 133281 - protein, 577 aa, Heterodera glycines
  Coding regions on vcDNA: vcDNA=SeqID_59704; Strand=-; Position=1 -180,1872-3422
  Homolog annotation: Hit_ID=AAG56007.1; Match level="QueryCoverage =63%, HitCoverage=37%, E-value=4e-12, Identity=21%"; Hit description =putative membrane protein of prophage CP-933X [Escherichia coli O157:H7] ref|NP_287395.1| putative membran
MLPDECLRHAWIRKNRERALAASRTASPAVCHPLAVDKFRKYVKNKRFRRLVFGVLFINQNLLVAAEQHQTNANNNNNGTTTTTTTIENGHGNSIDDSDSDRIGTTISGGGSANETAKGKVPKQQRRQEGQKMEEMAMDTSNNDNDHHHRQQKKVVIAVTPPGDSGDGGDAKKAGETTAASAKKKVVVVKRVPRGEKRSKSEARRAADQQRTRSSTEQTANKKQRQESGGAGGGEQCQQNQRAAVDSDCSVKSPLMARRLGQRETAAATGGGTSDNSSSSSKSPLMARRSVKFEEVPTMATTTAAAPKAATTSATGSPIMKRVSGGDSKVLRIAARLAEQNAGGGECSPSTSASTNGGGADKRLSAEAATMTKKKSLSSSSKVSALLKKLEQKGAGAAAAASSATTTPTSSRWSAVSASASPLSLAVTAIAPKTATLKKAEERASDHGEKQQQQQKVIKVVKKKKRVLRVRTVDDQPQQQTTEQRLGEAVATVTAARAPSASVVTAGEEKPGMKTKQQLRRQDKVAQKAIINEEKPVKKLNVPGRWSTMALAAQNGHRLAAEVNPKEKQQLNGGELT

SEQ ID NO: 133282 - protein, 35 aa, Heterodera glycines
  Coding regions on vcDNA: vcDNA=SeqID_59705; Strand=-; Position=1-105
MCVSQTSNQIKLIDFGLAQWYDGSKDLMFMAGTPE

SEQ ID NO: 133283 - protein, 95 aa, Heterodera glycines; identical to SEQ ID NO: 125597
  Coding regions on vcDNA: vcDNA=SeqID_59706; Strand=+; Position=1-660

SEQ ID NO: 133284 - protein, 97 aa, Heterodera glycines
  Coding regions on vcDNA: vcDNA=SeqID_59707; Strand=-; Position=1-294
MGFGATGLGRLLAMDACRLICVLRRGANDGGGIRCESVSAWDSLAGTSEAAAVVVSTVDGMDSVGDAALAFFSGRPPMMPLGFGTAHNGAAFSTPQI

SEQ ID NO: 133285 - protein, 47 aa, Heterodera glycines
  Coding regions on vcDNA: vcDNA=SeqID_59708; Strand=-; Position=1-651
KWREIARQREWRGRVAARDTGNGEFGWREGKGGQINKSINGISQFLT

SEQ ID NO: 133286 - protein, 38 aa, Heterodera glycines
  Coding regions on vcDNA: vcDNA=SeqID_59709; Strand=+; Position=1-114
MVRATTARTRASAARARTIKINRRNAKKARAAIGRAGH

SEQ ID NO: 133287 - protein, 233 aa, Heterodera glycines
  Coding regions on vcDNA: vcDNA=SeqID_59710; Strand=-; Position=1-699
  Homolog annotation: Hit_ID=XP_454605.1; Match level="QueryCoverage =98%, HitCoverage=51%, E-value=7e-40, Identity=41%"; Hit description =unnamed protein product [Kluyveromyces lactis] emb|CAG99692.1| unnamed protein product [Kluyveromyces lac
EDQESRRESGRGTESVRGTESGRESGRGTERGRETERGRETVRGTESVRGTESGRESGRETERGRGTESGRESGRGTESGRESGRGTERGRETERGRESVRGTESVRGTESGRESGRGTESGRESGRGTERGRGTESGRESGRGTERGRGTESGRESGRGTESGRESGRGTESGRESVRGTESGRESGRGTESGRESGRGTERGRGTESGRESGRGTERGRGTESGRESGRGT

SEQ ID NO: 133288 - protein, 130 aa, Heterodera glycines
  Coding regions on vcDNA: vcDNA=SeqID_59711; Strand=+; Position=1 -244,399-547
MIIFKLMQFGIDASSYIFFGDEQKVINWSLENGLLTNVRYCYGKRPTRHYKKEMRFDKNRGRAGSFICSTCRAEKALFVDSGMIENDSEDFRVVVCPDNVRSPDALLPIIQNTLQLVLKYTLTCGGLILD

SEQ ID NO: 133289 - protein, 37 aa, Heterodera glycines
  Coding regions on vcDNA: vcDNA=SeqID_59712; Strand=-; Position=1-117
KRGDPFVLQNFFKIKNDDNFLSGVLKVANHESDMYFD

SEQ ID NO: 133290 - protein, 185 aa, Heterodera glycines
  Coding regions on vcDNA: vcDNA=SeqID_59713; Strand=+; Position=1 -12,1043-1213,2084-2248,2530-2736
MKILKQPVLNSKAVAAAAVPFVPPSNQKSLPNTPIASSTQKSTPIPTQVYKQTTAMRLRNSQAPLNIKAIPFVPSKKYLVNTAIASSTQKPSQQNSQPTPTNKQQPSTTTPHKKKSREQPATNKKDVKKDTTKNLEQAQKTTNEMTITPNYKNGKAEEKAAVCTNLEEVQEKTNELSLKDKREKT

SEQ ID NO: 133291 - protein, 125 aa, Heterodera glycines
  Coding regions on vcDNA: vcDNA=SeqID_59714; Strand=+; Position=1 -59,1054-1117,1161-1367,1417-1464
MSVPFIDMSGKMMKDIRVVRCALSTQKISFRNPTDTWPPPFICANVAFHPHNFVGDYFYQQSRKESVDVGQLAERTTWILRMLETNRVVHARPKYIIVLRDGLSEAQFSMAIDEEMSALKMGCME

SEQ ID NO: 133292 - protein, 30 aa, Heterodera glycines
  Coding regions on vcDNA: vcDNA=SeqID_59715; Strand=-; Position=1 -12,148-228
MAPDVIIIDFKKATRSATGTDSAQSAEPSC

SEQ ID NO: 133293 - protein, 23 aa, Heterodera glycines
  Coding regions on vcDNA: vcDNA=SeqID_59716; Strand=-; Position=1-98
KPKLFGLFKKELKIFKNFIHLPF

SEQ ID NO: 133294 - protein, 264 aa, Heterodera glycines
  Coding regions on vcDNA: vcDNA=SeqID_59717; Strand=+; Position=1-795
MSLKIINKVHPSKKKKEVKCSNTKRYLLVPEEIYQSLASPPPSDGTPIGLVRNRIKQIKNDDGINEAERAIKYEQELKRLNKLTRDEDECPVGVKLENLSDVVDAMPKSVNVRRPIVVATRRHLKVGRARKENVEQLEDDDDADDHADHDHETPKPSSSNKRQPTQTEILKLIYKNAQSLGVSEEGQVLRAGGRPFITSSVYDIVSHLLNKDKRAQNKEPTAFKEFVERARQIPLLSRHLFPEGQSGKGIYKNTTLKFKPSLWI

SEQ ID NO: 133295 - protein, 46 aa, Heterodera glycines
  Coding regions on vcDNA: vcDNA=SeqID_59718; Strand=+; Position=1-142
IGIGIESGEWRMALCCTSVTLVYFRTPFAARKCSYYGEGITRIAFL

SEQ ID NO: 133296 - protein, 92 aa, Heterodera glycines
  Coding regions on vcDNA: vcDNA=SeqID_59719; Strand=-; Position=1-276
MQAEDAPEVDLEVLNGTWMPDLTLRYPPTFSKRDLIFGIDGGLLYNGKQPLESMERPKFEDIEVRDQVRIGGNRRGEGDDAALADARPDSER

SEQ ID NO: 133297 - protein, 84 aa, Heterodera glycines
  Coding regions on vcDNA: vcDNA=SeqID_59720; Strand=-; Position=1 -146,255-363
MRRGTKVIKRGTIVIKRGRTVIRRGTTVIKRGTKVMRRGTTVMRRGTTVGTKVIKDTKVIRRGTKVIRRGTKVIRRGTKWFKIK

SEQ ID NO: 133298 - protein, 102 aa, Heterodera glycines
  Coding regions on vcDNA: vcDNA=SeqID_59721; Strand=-; Position=1 -93,212-427
  Homolog annotation: Hit_ID=CAF93220.1; Match level="QueryCoverage =89%, HitCoverage=19%, E-value=5e-14, Identity=41%"; Hit description =unnamed protein product [Tetraodon nigroviridis]
MDHSLVAQHLAKHFPDVDCTAPLIKDTCIYTMTDDLQFIVDRHPRHQNVFIAGGFSGTGFKFALTIGNVLAQWVNGEDTPPHIDVSSFRLDRRIADTDRPKL

SEQ ID NO: 133299 - protein, 88 aa, Heterodera glycines
  Coding regions on vcDNA: vcDNA=SeqID_59722; Strand=-; Position=1 -96,135-305
MPKQNEIVIKYSFLDLTWFLDIEAVFYAISKTKKCLVVKTIFHISLHNFVSSARIETGIRPLERAARALQEGMERKNSYFWDFFRNQN

SEQ ID NO: 133300 - protein, 124 aa, Heterodera glycines
  Coding regions on vcDNA: vcDNA=SeqID_59723; Strand=+; Position=1-375
MSNRAGQKEFENENECENENGATKDGENADVKWWTNWIMRNEIENDDLNKKEKNGKKRRKGQIGGDFVISPIFCSVRPTNGNVPDHQWYHGFFFFGPETRGGAVNHAPGVAHRFSSSSSILRAL

SEQ ID NO: 133301 - protein, 113 aa, Heterodera glycines
  Coding regions on vcDNA: vcDNA=SeqID_59724; Strand=+; Position=1 -185,857-1013
MEEKRRQFVAIEEEKMRQEMPLRAEIMGQAEQVGAALLYTLIHMKMRRMFMDNNQTPSGSNSQARDDDNNNNNEKNNQQQGLADPAYFPFWLKRVEEAFRSHFEKGKEQFGIF

SEQ ID NO: 133302 - protein, 155 aa, Heterodera glycines
  Coding regions on vcDNA: vcDNA=SeqID_59725; Strand=+; Position=1 -33,2528-2658,3045-3172,3220-3357
  Homolog annotation: Hit_ID=CAG05338.1; Match level="QueryCoverage =98%, HitCoverage=33%, E-value=2e-30, Identity=46%"; Hit description =unnamed protein product [Tetraodon nigroviridis]
QFEVGFSALNSNSLNDNILSGIRILDFSRVVAAPFASMILSDLGAEVWKIERPGVGDDSRLFTPPEINGQSCYTLGLNRNKKSIAMNLAHPEAQNLAQKLATKADIVIEAQKLATKADIVIENFKTGYMKNFCLDYPQLAQLNPGLIYCSITGIF

SEQ ID NO: 133303 - protein, 98 aa, Heterodera glycines
  Coding regions on vcDNA: vcDNA=SeqID_59726; Strand=+; Position=1 -95,189-355,531-565
  Homolog annotation: Hit_ID=NP_650894.1; Match level="QueryCoverage =88%, HitCoverage=19%, E-value=1e-11, Identity=40%"; Hit description =CG10877-PA [Drosophila melanogaster] gb|AAF55777.1| CG10877-PA [Drosophila melanogaster] gb|AAM50878.1| L
MDLPELCNSSDYKTNADRVRNREKLIGIFSKKFLEHDLEHWNVLLKHSKFPAGPVNTIREAFRHEQTQHIGIVKPITHQQYGTVKVVEEGQLKSSEIY

SEQ ID NO: 133304 - protein, 34 aa, Heterodera glycines
  Coding regions on vcDNA: vcDNA=SeqID_59727; Strand=+; Position=1-104
ECHGTGNFCQNRDRDLPGPEKPGPGPRFFFRDRD

SEQ ID NO: 133305 - protein, 16 aa, Heterodera glycines
  Coding regions on vcDNA: vcDNA=SeqID_59728; Strand=-; Position=1-49
EAIPEGFGLPINLGAS

SEQ ID NO: 133306 - protein, 35 aa, Heterodera glycines
  Coding regions on vcDNA: vcDNA=SeqID_59729; Strand=+; Position=1 -3,517-621
METHEYTKQKIENNLISVEGLNQGKEEGKVKETSH

SEQ ID NO: 133307 - protein, 121 aa, Heterodera glycines
  Coding regions on vcDNA: vcDNA=SeqID_59730; Strand=+; Position=1 -153,991-1203
MRDNKSLKKMIDSIHWIKSDNSTIFILYIPFNYFFYKFDEKTKIKRIKKLYNFKFFYEMENRQQQRRKSEMIRRTLSEDYPGLDYLGFHNVLNAKYFWYRVLWFSVVTVCLLIGLFTIFRH

SEQ ID NO: 133308 - protein, 322 aa, Heterodera glycines
  Coding regions on vcDNA: vcDNA=SeqID_59731; Strand=-; Position=1 -930,1116-1162
  Homolog annotation: Hit_ID=NP_502797.1; Match level="QueryCoverage =80%, HitCoverage=72%, E-value=1e-42, Identity=39%"; Hit description =HASI (4P602) [Caenorhabditis elegans] emb|CAB16520.1| Hypothetical protein Y57G11C.19 [Caenorhabditis ele
GISEDLKAKRHDWLYKERRTVKGILENRPQKVVIENHVPGPNVAPYLGLNNQSKPQETEEPRKIIIPGKDLKSELQCDLCIFDQLKKHNDGYKYLLLCISTWSRMIFSAPAKSKKNEDMIEAFDRVFEKSKIIPMKYSDSGLEFQAGKIKNILRKNFIKNVMYSPDLHAGVVERANRTIKERLYRYFTKMDTLRWVDVIDRIIININNSVNRKLGAKPVSVTFENARALWEKLYKAKEFKISKKNKFKIGDIVRITKEKGKFAKGYLPNFTEELFKIVIVNSTTPDSYRIEDLEGNLIKGIFYNQELTKSKNKVGSEKPRLK

SEQ ID NO: 133309 - protein, 95 aa, Heterodera glycines; identical to SEQ ID NO: 125597
  Coding regions on vcDNA: vcDNA=SeqID_59732; Strand=+; Position=1-660

SEQ ID NO: 133310 - protein, 53 aa, Heterodera glycines
  Coding regions on vcDNA: vcDNA=SeqID_59733; Strand=-; Position=1-174
STGYREAIPEGFGLPINLGASVRGDCPENKKKNFFKCPFGVLKQLWGAKIQRR

SEQ ID NO: 133311 - protein, 49 aa, Heterodera glycines
  Coding regions on vcDNA: vcDNA=SeqID_59734; Strand=+; Position=1 -21,434-562
MSTRQDLISECILSFEKLRDYVVNELHHLPALQKSAARATYGCKFEEFI

SEQ ID NO: 133312 - protein, 27 aa, Heterodera glycines
  Coding regions on vcDNA: vcDNA=SeqID_59735; Strand=+; Position=1-82
MIKANELVRTCAFREEASMDMLGHFDT

SEQ ID NO: 133313 - protein, 103 aa, Heterodera glycines
  Coding regions on vcDNA: vcDNA=SeqID_59736; Strand=-; Position=1 -434,485-704
  Homolog annotation: Hit_ID=NP_499343.2; Match level="QueryCoverage =85%, HitCoverage=31%, E-value=5e-15, Identity=46%"; Hit description =MtN3 and saliva related transmembrane protein family member (3L716) [Caenorhabditis elegans] emb|CAA21014
PFPATIASPLLDVGQVLRTKSTESLPFLLCLANLAVVDFPSVFKCLSTPVLFQVCVQWLLYGVLVDDFYMKVPNGIGTFISTMQLSLFIVYPRTYKQLTVGNV

SEQ ID NO: 133314 - protein, 131 aa, Heterodera glycines
  Coding regions on vcDNA: vcDNA=SeqID_59737; Strand=+; Position=1-396
MQRRRLAQPKNATTTTRMTKKCHDDDSYDQKMQRRRLAQPKNATTTTRMTKKCHDDDSYDQKMQRRRLAQPKNATTTTRMTKKCHDDDSYDQKMQRRRLAQPKNATTTTRMTKKCHDDDSYDQKMPRRRLV

SEQ ID NO: 133315 - protein, 25 aa, Heterodera glycines
  Coding regions on vcDNA: vcDNA=SeqID_59738; Strand=-; Position=1-77
SKSSLTTAQKNMFFVRFRPRGSQEK

SEQ ID NO: 133316 - protein, 133 aa, Heterodera glycines
  Coding regions on vcDNA: vcDNA=SeqID_59739; Strand=+; Position=1 -165,468-587,718-834
  Homolog annotation: Hit_ID=CAE67634.1; Match level="QueryCoverage =92%, HitCoverage=15%, E-value=1e-23, Identity=45%"; Hit description =Hypothetical protein CBG13191 [Caenorhabditis briggsae]
MADAGQLVALTGDGGVDKTALLNTLLDHNLKTLSVEGQVLINAHSLGRFITYVIGYVQQDDLFMGTPTVKEHLMAQAQLWMVGHTQRTMRRRVNELEEAISDGEARRLPFAFEPRHNPQIIFALKPTKVPIFF

SEQ ID NO: 133317 - protein, 128 aa, Heterodera glycines
  Coding regions on vcDNA: vcDNA=SeqID_59740; Strand=-; Position=1 -105,729-797,848-934,1017-1142
  Homolog annotation: Hit_ID=NP_001753.1; Match level="QueryCoverage =72%, HitCoverage=17%, E-value=6e-23, Identity=56%"; Hit description =chaperonin containing TCP1, subunit 6A (zeta 1) [Homo sapiens] gb|AAK61354.1| heat shock protein [Homo sa
MERLQLACGGEAVNSVDDLTPDVLGWAGSVYEHVLAFAEALLVIPKTVAVNAGFDAQEAIVKLVETFSAAGELVGLDLESGEPCVSQSVWDNVCVKQASLNACQNIASNLLEVDEVMRAGMRDLKGGQ

SEQ ID NO: 133318 - protein, 288 aa, Heterodera glycines
  misc_feature (27)..(27): Xaa can be any naturally occurring amino acid
  misc_feature (117)..(117): Xaa can be any naturally occurring amino acid
  misc_feature (132)..(132): Xaa can be any naturally occurring amino acid
  misc_feature (146)..(146): Xaa can be any naturally occurring amino acid
  misc_feature (160)..(160): Xaa can be any naturally occurring amino acid
  misc_feature (249)..(249): Xaa can be any naturally occurring amino acid
  Coding regions on vcDNA: vcDNA=SeqID_59741; Strand=+; Position=1-877
  Homolog annotation: Hit_ID=EAA16792.1; Match level="QueryCoverage =99%, HitCoverage=18%, E-value=9e-42, Identity=38%"; Hit description =ookinete protein-related [Plasmodium yoelii yoelii]
QGEWHGNRGGLNGGQPMGNGTGTEEGXMGDKGNGTGAEEGKWGTTNGEWHGSRGGLNGGQPMGNGTGTEEGKWGTTNGEWHGSRGGLNGGQGEWHGSRGGLNGGQPMGNGTGTEEGXGGQPMGNGTGTEEGXMGDKGNGTGAEEGXMGDKGNGTGAEEGXWGTTMGNGTGTEEGKWGTTNGEWHGNRGGLNGGQGEWHGSRGGLNGGQGEWHGNRGGLNGGQPMGNGGNRGGLNGGQPMRNGTGAEEGXMGDNNGEWHGNRGGLNGGQPMRNGTGTEEGKWGTPMGNG

SEQ ID NO: 133319 - protein, 29 aa, Heterodera glycines
  Coding regions on vcDNA: vcDNA=SeqID_59742; Strand=-; Position=1-98
FTPHFPFRHSTDILLFNYYNCPFLNTEFP

SEQ ID NO: 133320 - protein, 192 aa, Heterodera glycines
  Coding regions on vcDNA: vcDNA=SeqID_59743; Strand=-; Position=1-579
  Homolog annotation: Hit_ID=XP_318550.1; Match level="QueryCoverage =93%, HitCoverage=19%, E-value=7e-39, Identity=43%"; Hit description =ENSANGP00000020240 [Anopheles gambiae]
MANYDFEIRYINTASFGQADVLSRLIANYPRPEEDILIANICTETECYNSTILQTKTEQLPVTADEIAEATPKDEILAKILAFTQSNWPKKCSDPDIAPYFPKRDILEIEGCLLYQNRVVVPQSLRNRMLKSLHMAHPGIVRMKALARQHVYWPGMDSEIERIVRQCEKCQKAQKAPIKAHGVNSRSRSRKP

SEQ ID NO: 133321 - protein, 744 aa, Heterodera glycines
  misc_feature (194)..(194): Xaa can be any naturally occurring amino acid
  Coding regions on vcDNA: vcDNA=SeqID_59744; Strand=-; Position=1 -129,169-646,722-1363,1427-2340
  Homolog annotation: Hit_ID=XP_318187.1; Match level="QueryCoverage =99%, HitCoverage=91%, E-value=1e-138, Identity=37%"; Hit description= ENSANGP00000016242 [Anopheles gambiae]
LMGQAPQNAASASLNHANLASSIDGRISKFNYDAETGNTFEQWDLPESTKVRLLLGKLGDEEDLPESTKVRLLLGKLGDEEYGKYRDSISPTQPDKVTWVDSITKLKGLYAETRSLFVRRYECFKIRQQPSQDISSLVAHINASCENANLSPTKEKCIILVIALNDEHHDLRQKCLKMLEDAKKTADITLQKVXEELKAIQIVKESALSLLTQPVSTSAIHEPAPKSPHHVHEPAPKSPHHVPSPKQKSDNKANRHPPHPCASCGSTDHWRSDCKFANAFCNKCNRQGHIAIVCRCSSNTAHKSQNRSFHTVVVKSHCMVIGTTQGRWWKIPVIINGINLKMNGDSGAQATVISFKTWIKLGQPKLSPTDIETRNCNDTAFSPEGKFHCTVLLRSAIQKLIAYVSSDLKHDLFGLPWIEEFELIPREILFPKSTKGKPNASIAVLQKDFEEVFKNGLGHCAIKAHLILKPEARPIFCKARPVPHGAIEAVDTELDRLLQIGAIKPVEFSHWAAPILAVKKKNGKTRVCIDFSTGLNDSIELNRHPLPRPDVIYAALNGAAFFSNLDLRDAYLQMELDEKSKPLCTINTYRGLFQCQRLPFGVKSAPSIFQHLMDQICAGIPGVFSYLDDCLIASKTLEDHVNALQTLFKRINDFGLRIQLEKCKFLQKELLFLGQVVSSNGIRPDPARSEAIEMSAPHDKTTLRSFLGALYGRFVKPMREIRAPLDQLLRKDESSWGGEQQSAF

SEQ ID NO: 133322 - protein, 87 aa, Heterodera glycines
  Coding regions on vcDNA: vcDNA=SeqID_59745; Strand=+; Position=1 -137,630-756
MGHISLTFAIYVKPMENEYQPSADENNENPPDDEDIRTMVRRILFRIKITKKKWRTEKKIRKECAICLESFEDDKLTMKLHEDYKVN

SEQ ID NO: 133323 - protein, 66 aa, Heterodera glycines
  Coding regions on vcDNA: vcDNA=SeqID_59746; Strand=+; Position=1 -31,545-714
MCFTRNASLNAEQKLFEIGPDGVKSHPIVEELKNQISDILSNGRQNSEEIIAKAEQMNFLINRITI

SEQ ID NO: 133324 - protein, 159 aa, Heterodera glycines
  Coding regions on vcDNA: vcDNA=SeqID_59747; Strand=-; Position=1 -178,233-411,548-667
  Homolog annotation: Hit_ID=CAE62113.1; Match level="QueryCoverage =86%, HitCoverage=22%, E-value=2e-37, Identity=58%"; Hit description =Hypothetical protein CBG06151 [Caenorhabditis briggsae]
LKHSASDALTMDYGLGRIRRRRSNYGAMSPTKSVQEVQPVALSWHGLTAVHAKSGRKILDNVSGMADAGQLVALMGASGAGKTTLLNTLLNRNLKSLSVEGQVLVNGHSLGRSITYVSGYVQQDDLFMGTLTVKEHLMAQAQLRMVGHSKRTMRRRVNE

SEQ ID NO: 133325 - protein, 131 aa, Heterodera glycines
  Coding regions on vcDNA: vcDNA=SeqID_59748; Strand=+; Position=1 -165,641-871
MRSNNLDENKRIEQRKIVGIKIGDHREEQLQKRSAEIWTNYMEETLEKIKAHMEMDPIYQQLAEQKYAIDNFPGLDDIFRKTRFFLVNSQPEVDFDNYRSVKGMEKVKFIGGFNLMPKARELDEVSKKIVK

SEQ ID NO: 133326 - protein, 33 aa, Heterodera glycines
  Coding regions on vcDNA: vcDNA=SeqID_59749; Strand=+; Position=1 -92,400-409
MYNTKLDIAFFRSQLEMSADHLSTVALFTIRCL

SEQ ID NO: 133327 - protein, 16 aa, Heterodera glycines
  Coding regions on vcDNA: vcDNA=SeqID_59750; Strand=-; Position=1-50
MDTLCSYLMVNKATVD

SEQ ID NO: 133328 - protein, 16 aa, Heterodera glycines
  Coding regions on vcDNA: vcDNA=SeqID_59751; Strand=-; Position=1-53
SALKRIKLMYELNKAL

SEQ ID NO: 133329 - protein, 53 aa, Heterodera glycines
  Coding regions on vcDNA: vcDNA=SeqID_59752; Strand=-; Position=1-163
FNFLNFFEFLKIPGWSRFPVPKKNRGPGPGFSGPGKSRSRFCPKFPVPLYSTL

SEQ ID NO: 133330 - protein, 62 aa, Heterodera glycines
  misc_feature (47)..(47): Xaa can be any naturally occurring amino acid
  Coding regions on vcDNA: vcDNA=SeqID_59753; Strand=-; Position=1-237
YEYPKRTLEKIDFFVFGAVPPNRCAQIYGETESFRNSFPIACTLILXWIFAPHNCLSTPNDT

SEQ ID NO: 133331 - protein, 771 aa, Heterodera glycines
  Coding regions on vcDNA: vcDNA=SeqID_59754; Strand=+; Position=1 -135,193-600,837-1514,1692-2379,2422-2619,2663-2871
  Homolog annotation: Hit_ID=EAL49477.1; Match level="QueryCoverage =49%, HitCoverage=27%, E-value=1e-10, Identity=22%"; Hit description =hypothetical protein 42.t00003 [Entamoeba histolytica HM-1:IMSS]
MVHQDFPDDQFGNFTATQGPGQQRQVIDPVVIWYNGTNHFQTVVLPSRPSASRFAVEIVTSPQFPPSIHLFGEEVEAMEIAAPAAAPSAPIPSTSSGIEEKRSTTVTAPSIVTEEEDVFLEESLPKMESCKCCNSAVVPPALEDANVHLKQQFAYYGYISTPCCGDFHLRCFEKWSHLFFEEPTEPESQQLTEAVDLALNINEELYTPIKVEYDNTSIAYFAVYNAMIRAKNNCYRNRPTPPPEMLAELRACSEKEKSLYWDFSASTKRHQYATEQMLKMQDYLKATAQPKHRQCVKEQLCDSLKEATNNKAPIIREQHCLLIQALEEQLYDIIKQFLMLWHSMQQISPSTASLESMQEWLLSSEDNGMELARLADSWVEHLALINENIKSCVKKCNKAKRRTSFMSLEAAIRKQEEAQNTTDGGQRPRANSIGKKRRIDDKSVTRESPVKRREKAADAAEHRMQRPVLMTAEQAKTLEAERIEAQKRMAADRRAQERLRQADQFLKQHLAQQKRLKQRNLVWGRQAAYERYINERLEKLKAEVNALRKSARESMNFTEIDICQLKIIILSNSVKYLVLPTRQAVEAYCADIIRYANHHAEEDVQKAIKEHQQILERRQRALDEERQRQKLLSTWRDEDRQWAYREDPVLAAELEKIRQQKEQIDVEYAEEQARLRNIRRAEEDARSRARNELLGLYDSPESEGWSDEDLFYNVRQADRMPIMQEVGVAQMPREAIRAREVIDRRLNFQEADYVGEMTPANKGDDNRGSRK

SEQ ID NO: 133332 - protein, 70 aa, Heterodera glycines
  Coding regions on vcDNA: vcDNA=SeqID_59755; Strand=+; Position=1 -52,155-231,295-378
MSISTNSTNGDFTPTEGEVNCESISLDNDGQSDGKATDPQQQKEFVEKCAKMEMDFKISTLELEKVGFHR

SEQ ID NO: 133333 - protein, 161 aa, Heterodera glycines
  Coding regions on vcDNA: vcDNA=SeqID_59756; Strand=+; Position=1 -40,113-558
MNRGRNNQNYLIHGISKYWQVVGALGLCVVMVCITYQLFLHVDEKHKSFKLMIDGHFKDFKQIHNDFTAWSKNFTSHLNERFEQQQARSRARFKQQLAKSKERFDEQHANFVKIRLDFDRQFQKTMHRFAEVELETVLNKRLDCLFFGKQRIFASPPHPFV

SEQ ID NO: 133334 - protein, 53 aa, Heterodera glycines
  Coding regions on vcDNA: vcDNA=SeqID_59757; Strand=+; Position=1 -79,132-213
NHPILLYQKVLELFGDLQHKGTKKAKKEFVNFSGVICHFPTRYELCQCRIEDS

SEQ ID NO: 133335 - protein, 77 aa, Heterodera glycines
  Coding regions on vcDNA: vcDNA=SeqID_59758; Strand=+; Position=1-359
LTNDQFLLFSAHSPRPIRPRSVPAPPALLRLVHHFREGLALGAADFDRALSAPQLAHQTARLRLRAVHAHKVDTLRL

SEQ ID NO: 133336 - protein, 238 aa, Heterodera glycines
  Coding regions on vcDNA: vcDNA=SeqID_59759; Strand=-; Position=1 -82,129-335,421-614,657-730
  Homolog annotation: Hit_ID=AAP30774.1; Match level="QueryCoverage =89%, HitCoverage=100%, E-value=9e-94, Identity=84%"; Hit description= putative gland protein G30E03 [Heterodera glycines]
MASSFCSSIISIVAIVCLLCKCCFSAPHPCCPGSQHVVSMMKDHTGTFSAPHPCCPGSQHVVSMMKDHTGTFSASMPKSSLCLSAERVAAAVENQLKTIWCPGNGGQTLINEINAAQSSSDECAECARSLGFIRAMFEIAASAASHAGANAELANLAVQFREQVGTIDTNCAALDISVGQISLGTPKGDHPQVHDSETVLSNPGNSGFHKRLKGDHPQVHDSETVLSNPGNSGFHKRL

SEQ ID NO: 133337 - protein, 63 aa, Heterodera glycines
  Coding regions on vcDNA: vcDNA=SeqID_59760; Strand=+; Position=1 -71,776-896
MRCFLPILRCESITLKSTTKHVLLNLNDRLSPMPMNSLNAVMDTEEMLNEANLEIKGTISAKV

SEQ ID NO: 133338 - protein, 199 aa, Heterodera glycines
  Coding regions on vcDNA: vcDNA=SeqID_59761; Strand=-; Position=1 -136,251-414,476-679,1021-1116
  Homolog annotation: Hit_ID=NP_740945.1; Match level="QueryCoverage =92%, HitCoverage=32%, E-value=1e-19, Identity=36%"; Hit description =DNA methyltransferase protein 1 (55.8 kD) (1P67) [Caenorhabditis elegans] emb|CAD21666.1| Hypothetical pr
MDSHIRWPEFKTPGPHWRSQEMKLPSNIGQKKLSNIGLVVTTRKIVSIGLEYPHAYEEIVKQYNDFRSHIVLLQDLKTALHNTELELDQLAAQMPADKLSECPIIEPRFRVSSTFYEELERSPVRVLNTPMTEGGKGKGKGKQQLKPAPVTGRAITKMIEVNTAPTTVTRKRRMHYPEGTPPTRSQTAIHLQQQQLQQN

SEQ ID NO: 133339 - protein, 46 aa, Heterodera glycines; identical to SEQ ID NO: 127686
  Coding regions on vcDNA: vcDNA=SeqID_59762; Strand=+; Position=1-356

SEQ ID NO: 133340 - protein, 52 aa, Heterodera glycines
  Coding regions on vcDNA: vcDNA=SeqID_59763; Strand=-; Position=1-157
ISKIVKNERMLIKPNLCQVARDPSGLVFRILIFKKVHFSIFGLGPKRPRGPK

SEQ ID NO: 133341 - protein, 134 aa, Heterodera glycines
  Coding regions on vcDNA: vcDNA=SeqID_59764; Strand=-; Position=1-405
MEAILTKRNRTKLQHNGYSYTFHKPSADGEARFWACEHHHAKDISCKGRLHTDLDNRILREVGNHQCEPSAARMEALSSDHWNQTQGGTNHGTTSDNSLFGTAECGHASPCATPNQTGDKTSDSFLCFLKYLYI

SEQ ID NO: 133342 - protein, 41 aa, Heterodera glycines
  Coding regions on vcDNA: vcDNA=SeqID_59765; Strand=+; Position=1-128
LLTLLFVILLAVGGKTEIINVDLLGSYDPNATIGGATDCNS

SEQ ID NO: 133343 - protein, 51 aa, Heterodera glycines
  Coding regions on vcDNA: vcDNA=SeqID_59766; Strand=+; Position=1 -34,75-196
MFKTYLRPKLSVLLTLLFVILLAVGGKTEIINVDLLGSYDPNATIGGATDW

SEQ ID NO: 133344 - protein, 27 aa, Heterodera glycines
  Coding regions on vcDNA: vcDNA=SeqID_59767; Strand=+; Position=1 -30,340-393
MRRMNYCPRKARRKHLELSNDIKKIKI

SEQ ID NO: 133345 - protein, 89 aa, Heterodera glycines
  Coding regions on vcDNA: vcDNA=SeqID_59768; Strand=+; Position=1 -33,286-520
  Homolog annotation: Hit_ID=NP_499240.1; Match level="QueryCoverage =71%, HitCoverage=14%, E-value=3e-16, Identity=65%"; Hit description =speckle-type POZ protein (51.1 kD) (3L182) [Caenorhabditis elegans] emb|CAA83138.2| Hypothetical protein
MNQRNVYYSWTSIHSLPVGLEFGFLSLRFSVGPNDMFKWRLRINPKGRDEESKDYLSLYLLLVQSNNTQVHAKFKFGILNANGDEGRVL

SEQ ID NO: 133346 - protein, 23 aa, Heterodera glycines
  Coding regions on vcDNA: vcDNA=SeqID_59769; Strand=+; Position=1-69
MPIAKICGDVFMTLAQSRLFEES

SEQ ID NO: 133347 - protein, 31 aa, Heterodera glycines
  Coding regions on vcDNA: vcDNA=SeqID_59770; Strand=+; Position=1 -77,445-463
MAAAAASAFPSRRHSCTSAGADCSECIFIII

SEQ ID NO: 133348 - protein, 132 aa, Heterodera glycines
  Coding regions on vcDNA: vcDNA=SeqID_59771; Strand=+; Position=1-399
MLGVGQLGNHCQVRNLDSGPAKLEKHNGRNEPKKAQKRQPMTEQTTGENQREGKSDTDGAENAKVEIGNGKMPSQPMICHDFRRPKRRKMPGRRDKSLSIPTNGVDTASVTWRKMAKCFCPSTFAVFPWNIH

SEQ ID NO: 133349 - protein, 306 aa, Heterodera glycines
  misc_feature (23)..(23): Xaa can be any naturally occurring amino acid
  misc_feature (31)..(31): Xaa can be any naturally occurring amino acid
  Coding regions on vcDNA: vcDNA=SeqID_59772; Strand=-; Position=1 -109,236-369,455-560,608-795,850-978,1046-1204
  Homolog annotation: Hit_ID=NP_508799.1; Match level="QueryCoverage =98%, HitCoverage=53%, E-value=2e-59, Identity=44%"; Hit description =sugar transport protein like (56.8 kD) (XF291) [Caenorhabditis elegans] gb|AAA98007.1| Hypothetical prote
FSDKRKSAALPSRGCERSERKRXRRRNRREXGRTKFLAYSTGHFYNDLCASMWFTYLLIFLEKVVLLLSWQAGLLMFIGQVTDAVTDAVSTPLVGMLSDLSLLPGILRRFGRRKSWHIIGTVCVTLSFPLIFSTVCVTLSFPLIFSGCLLCHLPFLRLLWFIPPIMLFQFGWAAVQISHLAMIPELSNSEHTRMSMTSYRYGFTVSMTSYRYGFTVAANLFVFACLFLFLAQDKDTSKIKPSDLANFRNLGLVNLGLVAVALGTAVTALFYGGVSEPNSGQRRMSRLNSESGDAHRLGRMSWQENI

SEQ ID NO: 133350 - protein, 57 aa, Heterodera glycines
  Coding regions on vcDNA: vcDNA=SeqID_59773; Strand=+; Position=1 -60,158-271
MDENDGKLFNSNYIDFEALTVAPPDLPDLMGDSELSNYNAKKDVKFIQKEKVCLILR

SEQ ID NO: 133351 - protein, 16 aa, Heterodera glycines
  Coding regions on vcDNA: vcDNA=SeqID_59774; Strand=-; Position=1-49
EAIPEGFGLPINLGAS

SEQ ID NO: 133352 - protein, 18 aa, Heterodera glycines
  Coding regions on vcDNA: vcDNA=SeqID_59775; Strand=+; Position=1-56
YREAIPEGFGLPINLGAS

SEQ ID NO: 133353 - protein, 18 aa, Heterodera glycines
  Coding regions on vcDNA: vcDNA=SeqID_59776; Strand=+; Position=1-56
YREAIPEGFGLPINLGAS

SEQ ID NO: 133354 - protein, 70 aa, Heterodera glycines
  Coding regions on vcDNA: vcDNA=SeqID_59777; Strand=+; Position=1-213
MERWMEWGEIINRVGRPVKYRRNITGRFRKKEEFIREHKVSNMVLSWWPTSAAKDKTVRVQGAGLQGGRV

SEQ ID NO: 133355 - protein, 114 aa, Heterodera glycines
  Coding regions on vcDNA: vcDNA=SeqID_59778; Strand=+; Position=1-345
MTREYADSEILEFVSAGPKQYALKHRRKKDGVIWHKTKIRGMTLDRRNEFKYELFKEMVLDYKEGVKKVFHYPEKIGPTNDFRVLSKNVQKEYTPVQKKGIIDDHFNVLPFGYY

SEQ ID NO: 133356 - protein, 171 aa, Heterodera glycines
  Coding regions on vcDNA: vcDNA=SeqID_59779; Strand=+; Position=1 -165,1075-1179,1220-1364,1407-1507
MSREAEPGWKIEKISVDLYCSALSDPVIIPARPFQQSNPDIVFNEFMHRQQSFGEKMQTIAEIKNFEIIEGGRVFIVRARIENVVHAEYRACVLCRKGACSCGVEKALTPYLKVSVADDTGILENVAIFWCMWEEKRNGGVERIVWGRVHYENRREGERIRREEGDLLLFD

SEQ ID NO: 133357 - protein, 151 aa, Heterodera glycines
  Coding regions on vcDNA: vcDNA=SeqID_59780; Strand=+; Position=1 -183,1480-1752
MSDSIWEIFTILDKINLESEKAESTWRDFERCKTFDQATKLEEQSQNSLMEARRLHFESRRMYAQQNDMQISAQGDDVLPLTAADFAAMDEAHRQWETERRQREEQRQREQKSARNGSGLMNGWCAKESGKKKKKKKKKTPKMENGKGPAI

SEQ ID NO: 133358 - protein, 255 aa, Heterodera glycines
  Coding regions on vcDNA: vcDNA=SeqID_59781; Strand=+; Position=1 -37,132-859
  Homolog annotation: Hit_ID=AAO53177.1; Match level="QueryCoverage =89%, HitCoverage=21%, E-value=4e-19, Identity=27%"; Hit description =similar to Dictyostelium discoideum (Slime mold). Adenylyl cyclase
MVERMSDWPKLIKEVSAVPELLRMYINHANKLENYSLDKDLVAQLAKFEESQKKTKAHHHHHHPNSQQQQKNSKELLTAKSDKKEDENTNNEMRTDEGLERKQAVSSPSHDTSQQPEPIQRDENSPPKTQPEQILQHQNPASQNQQQTPPQVQQNPSTDDQKETDSIQQTPSQSQPNQQQTPPQVQPNQQQTPPQVQPNQQQTPPQVQPNQQQTPPQVQPNQQQTPPQVQPNPSTDNQKQSDSIHLQTEGLPKSE

SEQ ID NO: 133359 - protein, 116 aa, Heterodera glycines
  Coding regions on vcDNA: vcDNA=SeqID_59782; Strand=+; Position=1 -145,353-558
MFSEGFERMFNSEGFREQRTQEVELKTVSPDVFREFLYIIYPSHKRPHVPNTRGLLELARMYFIPTVTAMCEQCLLQATETDMVVGERLKLADEYGLLRLKVQHVPTDLLFNTKLP

SEQ ID NO: 133360 - protein, 38 aa, Heterodera glycines
  Coding regions on vcDNA: vcDNA=SeqID_59783; Strand=+; Position=1-119
IFRHLLPTVRRTATAALAFDAAVHGLSNPIFIFFLSLL

SEQ ID NO: 133361 - protein, 169 aa, Heterodera glycines
  Coding regions on vcDNA: vcDNA=SeqID_59784; Strand=+; Position=1 -109,989-1389
MVRFMSTCVRCLRTPNMRFTSLLMGQVAKNCATLAELPRFAPEEWSVHQRTLDGGDRTNNYAEAFHRKLQQAFDCTHPSVFHFINTIRCEQKSIDADISRCVAGELPPLKKPKYRAADARILRLLQGYNTINNNPANQNDHNYHANVNVNPDNINHLLVGVSRNYEMRP

SEQ ID NO: 133362 - protein, 105 aa, Heterodera glycines
  Coding regions on vcDNA: vcDNA=SeqID_59785; Strand=+; Position=1 -74,237-480
MDKGNLWVVPGFTLLVFAILWTTKLSKIALEESTCRGASIYDFAGTQLDEDAKRHCQTAKRYYVGPDEAFSLDHNWRKQREVKNPEVGTKCNNINIIIYLFLCKY

SEQ ID NO: 133363 - protein, 252 aa, Heterodera glycines
  Coding regions on vcDNA: vcDNA=SeqID_59786; Strand=+; Position=1 -160,203-450,501-669,714-896
DIKLTIVIADAVRNVNGKSVWTLVGSDGYDFINITMWGSNYEKMAREFGQEFKQKTYVFNTWGVQKVIPNFNYGNVDYELIAKEGSTITLITAEQYQILSIKTTNYFTFLREKFALDNDGFFPTPIKKIRAGEQFVEIECELFELKPVRTVMAKGNEARVIDAMINEGNNKTQLTAWNILADFLEYILQDKKGYVLKLQGLLTKKGFPVQNISFVFINTSRIGFAEKQRPQKIPLKLAELTEGLCECNFKKF

SEQ ID NO: 133364 - protein, 16 aa, Heterodera glycines
  Coding regions on vcDNA: vcDNA=SeqID_59787; Strand=-; Position=1-49
EAIPEGFGLPINLGAS

SEQ ID NO: 133365 - protein, 82 aa, Heterodera glycines
  Coding regions on vcDNA: vcDNA=SeqID_59788; Strand=+; Position=1 -15,161-271,325-447
  Homolog annotation: Hit_ID=NP_508394.1; Match level="QueryCoverage =84%, HitCoverage=8%, E-value=2e-22, Identity=72%"; Hit description =21 member solute carrier family 1 (XC742) [Caenorhabditis elegans] gb|AAB52651.1| Hypothetical protein F53
MQQPRVLYHPQGMIVNGLFPSSISTIERRFQFSTSTLGRIMQFYDFGYVLFCIPVSYFGGRHSKSTGLGAGLLLMSVSAKNS

SEQ ID NO: 133366 - protein, 45 aa, Heterodera glycines
  Coding regions on vcDNA: vcDNA=SeqID_59789; Strand=-; Position=142 -195,516-599
MGFLLYMFVAAVAFGGGAYCGMIYNAKGAKASAGGGSKKDKKQKA

SEQ ID NO: 133367 - protein, 148 aa, Heterodera glycines
  misc_feature (3)..(3): Xaa can be any naturally occurring amino acid
  misc_feature (61)..(61): Xaa can be any naturally occurring amino acid
  misc_feature (75)..(75): Xaa can be any naturally occurring amino acid
  Coding regions on vcDNA: vcDNA=SeqID_59790; Strand=-; Position=1 -30,1457-1506,1579-1864,1992-2072
  Homolog annotation: Hit_ID=AAC48326.1; Match level="QueryCoverage =94%, HitCoverage=41%, E-value=2e-33, Identity=51%"; Hit description =beta-1,4-endoglucanase-2 precursor [Heterodera glycines]
IYXSFPIMSEDVDVAAANPITGYSNLMYTFHFYAGTHTVSGLGAKLKTAYTKSGSGVIIFXKTICTNCQVCPFFXDGTIATSSMNEWWSFLDGYKISYCNWSVCNKGESCSALTTSASASNVGSSSYWTTSGKLIQAYYKEQSNGKFF

SEQ ID NO: 133368 - protein, 110 aa, Heterodera glycines
  Coding regions on vcDNA: vcDNA=SeqID_59791; Strand=+; Position=1-335
WAFHKKSSVWAFHKKLSVGVPQKAQCGRSTKKAQCGRSTKSSVWAFHKKLSVGVPQKAQCGRSTKSSVWAFHKKLSVGVPQKAQCGRSTKKLSVGVPQKKLSVGVPQKAQ

SEQ ID NO: 133369 - protein, 153 aa, Heterodera glycines
  Coding regions on vcDNA: vcDNA=SeqID_59792; Strand=-; Position=1 -454,612-619
MQLKGIDLSFCTLRRYVSRLTIVSAHTNKNDASNSNASSHEMPKHELRFEKCFSKTLRKNVFIIGNESAWRKYVQTNENNEDIYISCSKCRYFREQEKNVNVKSIVASAVLRQGIQLVMLQSNHNANCKPEKLEKLETEQVDREQRRENYKFL

SEQ ID NO: 133370 - protein, 68 aa, Heterodera glycines
  Coding regions on vcDNA: vcDNA=SeqID_59793; Strand=+; Position=1 -98,562-655,1153-1167
MAGWDPRLIWGGGGGRELAGNGTKNVRDSLMAQHSLLTSADGGRPTTSTAWQWAEETLRQRDGQQKGK

SEQ ID NO: 133371 - protein, 33 aa, Heterodera glycines
  Coding regions on vcDNA: vcDNA=SeqID_59794; Strand=+; Position=1-102
ALPAFGREILFLQTKLLVNITYIVILTGYSAKN

SEQ ID NO: 133372 - protein, 88 aa, Heterodera glycines
  Coding regions on vcDNA: vcDNA=SeqID_59795; Strand=-; Position=1 -104,444-606
MTDSAGDSRSTERDKTMVNGCKVRDNEPWLRQAVSAEGPWGWGGLATKSVFPLLAPDDGLIRHVNDVQRDGEHKACFTGVDQIYTCRC

SEQ ID NO: 133373 - protein, 88 aa, Heterodera glycines
  Coding regions on vcDNA: vcDNA=SeqID_59796; Strand=-; Position=1 -96,135-305
MPKQNEIVLKYSFLDLTWFLDIEAVFYAISKTKKCLVVKTIFHISLHNFVSSARIETGIRPLERAARALQERMERKNSYFWDFFRNQN

SEQ ID NO: 133374 - protein, 88 aa, Heterodera glycines; identical to SEQ ID NO: 133373
  Coding regions on vcDNA: vcDNA=SeqID_59797; Strand=-; Position=1 -96,135-305

SEQ ID NO: 133375 - protein, 75 aa, Heterodera glycines
  Coding regions on vcDNA: vcDNA=SeqID_59798; Strand=-; Position=1 -57,203-373
MPGGSKTNYKIHVQTIPWKICDSDNPKPPITYFHDFLNKNSSKKVAHHLEFDLERFYTQKRQCCCQWALAKMKKL

SEQ ID NO: 133376 - protein, 222 aa, Heterodera glycines
  Coding regions on vcDNA: vcDNA=SeqID_59799; Strand=+; Position=1 -92,136-157,208-248,298-339,387-518,597-640,693-794
  Homolog annotation: Hit_ID=NP_497426.1; Match level="QueryCoverage =98%, HitCoverage=98%, E-value=1e-42, Identity=47%"; Hit description =predicted CDS, putative cytoplasmic protein (3C697) [Caenorhabditis elegans] gb|AAK84595.1| Hypothetical
FPLLSTVTCETHSPFTPDTELDGLDTKLPRGWYRIGTTKLPRGWYRIGTLSIRHDRAWFNLYRLSIRHDRAWFNLYRRRATGLGRRATGLGYWDFYTQIPERNCIGSGPLYIPERNCIGSGPLYFSASQFGLHAGENIAGSVAVKDKRCFDRLVVQIERLVVQIERKSTTEKFDVLQCRKCVFNSCWLFDVLQCRKCVFNSCWLGSRTLHDQRTYLTNLRSY

SEQ ID NO: 133377 - protein, 219 aa, Heterodera glycines
  Coding regions on vcDNA: vcDNA=SeqID_59800; Strand=+; Position=1-662
  Homolog annotation: Hit_ID=NP_702063.1; Match level="QueryCoverage =100%, HitCoverage=6%, E-value=2e-22, Identity=19%"; Hit description =hypothetical protein PF14_0175 [Plasmodium falciparum 3D7] gb|AAN36787.1| hypothetical protein [Plasmodiu
LNPPAFQSLALNSPAFQSLGLNSPAFQSLGLNSPAFQSLGLNPPAFQSLGLNPPAFQSLGLNPPAFQSLGLNSPAFQSLGLNPTAFQSLGLNPPAFQSLGLNPTAFQSLGLNSPAFQSLGLNPPAFQSLGLNSPAFQSLGLNPTAFQSLGLNPPAFQSLALNSPAFQSLGLNSPAFQSLGLNSPAFQSLGLNPPAFQSLGLNPPAFQSLGLNSPAFQSL

SEQ ID NO: 133378 - protein, 60 aa, Heterodera glycines
  Coding regions on vcDNA: vcDNA=SeqID_59801; Strand=-; Position=1 -33,146-295
MSSINTSSDNALYLAYRSVGPSVDLIVPAVALYLVALVGIVLNGTVLVVTAKSRQMPWHF

SEQ ID NO: 133379 - protein, 99 aa, Heterodera glycines
  Coding regions on vcDNA: vcDNA=SeqID_59802; Strand=+; Position=1 -116,557-740
MLEQQYPDQSWNPGGPGMKTEFILFSFYGEKLTFLIENLSSLDSGLEEPGFFWTWIFGPGLTWNPVQVHAFFKIPISTNNSLSALWFIIQLFVIISFIP

SEQ ID NO: 133380 - protein, 211 aa, Heterodera glycines
  Coding regions on vcDNA: vcDNA=SeqID_59803; Strand=+; Position=1 -297,2027-2141,2204-2426
MPIRFLSMLCPLLVLLTNVPSTLPWMLERDGVLLAYDPNNYNAETWADWGKKVGASAVAGGVAGSAVPGIGTVAGAILGFFGGAAVAAGEFAINKVYCQKFSSLKCKRGRKTTKDYNIGGNGCPYESLYCYFMFCYDVRFEKGHFAEWGCHPADERVDHSKNYPQGDWACEQSYRLHPDYDKQTLGYDMSNEQDTFEEAYEDLRKKYSKKT

SEQ ID NO: 133381 - protein, 53 aa, Heterodera glycines
  Coding regions on vcDNA: vcDNA=SeqID_59804; Strand=+; Position=1 -6,296-451
MKDYNNITSDKYKQIWELVDDPIVIWHDGDEHFNSICLVKRSKCQMQPKNTYF

SEQ ID NO: 133382 - protein, 21 aa, Heterodera glycines
  Coding regions on vcDNA: vcDNA=SeqID_59805; Strand=-; Position=1 -48,297-314
MKSWFLVLVLLLAFCLKFMLF

SEQ ID NO: 133383 - protein, 70 aa, Heterodera glycines
  Coding regions on vcDNA: vcDNA=SeqID_59806; Strand=-; Position=1 -70,191-333
MPSSPMPFSLFVVLFLFVPFLPGCGEPSVAHYFECCGDNGAGRHTKLAHDKCFVALFGFFVPLNMNMAFI

SEQ ID NO: 133384 - protein, 86 aa, Heterodera glycines
  Coding regions on vcDNA: vcDNA=SeqID_59807; Strand=-; Position=1-262
LTNSVLVLKWAPQLEILAHPNVRAFVTHGGNKRCRISSTVIYSNYCINCRLISVREGICAGVPLIVMPVYAEQVKKGCHLHKRTQI

SEQ ID NO: 133385 - protein, 109 aa, Heterodera glycines
  Coding regions on vcDNA: vcDNA=SeqID_59808; Strand=-; Position=1 -133,298-402,449-558
  Homolog annotation: Hit_ID=NP_504369.1; Match level="QueryCoverage =91%, HitCoverage=19%, E-value=9e-17, Identity=45%"; Hit description =udp-glucuronosyltransferase 1A5 family member (5F584) [Caenorhabditis elegans] gb|AAF98598.1| Hypothetica
MPNIAKFGVPNFSFTEFYSRSQLFLHDSIDRLGLPVTTAADIFGVGAHCKTPKDSSALSAKIKQFLEDPSSKGTIYIAFGSHIDWKFAPRKFLDDFVTVFRKLPQYRFI

SEQ ID NO: 133386 - protein, 52 aa, Heterodera glycines
  Coding regions on vcDNA: vcDNA=SeqID_59809; Strand=+; Position=1 -37,436-557
MSISILVSARALEIAYEKGTDSYLNGKHVFGKAVLMWENVKSVPSHLLTLKA

SEQ ID NO: 133387 - protein, 53 aa, Heterodera glycines
  Coding regions on vcDNA: vcDNA=SeqID_59810; Strand=-; Position=1 -62,660-759
MSISSYEKFYVLQKRSSVRRRVAGHNQTFTGTYPGFGLGGGTDPKSQLLGVYF

SEQ ID NO: 133388 - protein, 23 aa, Heterodera glycines
  Coding regions on vcDNA: vcDNA=SeqID_59811; Strand=-; Position=1-96
TKLLITPNSVFGVNFCALIQNLH

SEQ ID NO: 133389 - protein, 173 aa, Heterodera glycines
  Coding regions on vcDNA: vcDNA=SeqID_59812; Strand=+; Position=1 -142,184-563
EYICSDETEYNFVKNAWIEINQNDPALSQLLEALFATVISANKALEYDDANKISAQLNELKQSLAYAVFFMAKRGQIPLESPREEKEREPKEILIGLIDIYNECQLDADKVLKSCGECGKKGKEEKWQKGKEKYGKKERRFLEFVAHSLEMKWDANAFSAGGQQQQDDDDGNY

SEQ ID NO: 133390 - protein, 292 aa, Heterodera glycines
  Coding regions on vcDNA: vcDNA=SeqID_59813; Strand=+; Position=1-877
  Homolog annotation: Hit_ID=E86336; Match level="QueryCoverage=50%, HitCoverage=31%, E-value=1e-24, Identity=44%"; Hit description =hypothetical protein F14O10.11 - Arabidopsis thaliana gb|AAF88160.1| Contains weak similarity to an unknown pr
MANFSPTLRQNEFHANATRKFALHLSAPLNACLSVPSRSRARKVNGQLFDSDEQKWADGRRKAKDSGTLALTKAIRHNLERANPPPVGATPPLSALSVLAHSPVSASPPKEYSPQKEFCARRPLFPKSKFLRKAQKLRKEWNWVANGSGRETTPTRTKAKEEEEEEKEEGKRKNRKNKAMMEEEEEEEERKRKNRKNKAMMEEEEEKERKNDNTKGGSREEQKRIIHLLIVNGAAAEKVKEEERDDESERDEEEEEEEDEEEDEEEEEDEEEDDEEEEEEEQGEGTEESDGT

SEQ ID NO: 133391 - protein, 35 aa, Heterodera glycines
  Coding regions on vcDNA: vcDNA=SeqID_59814; Strand=+; Position=1-105
DAAELLYDVLFESGNAVPVLIACNKQDIGHAKSHS

SEQ ID NO: 133392 - protein, 115 aa, Heterodera glycines
  Coding regions on vcDNA: vcDNA=SeqID_59815; Strand=+; Position=1-348
MRKAKCETPKNANNAKGEMRKAKPRPIPGVGGGRRLFADKEIVSNEVGNRETICSPFPAIWLLTMTPRNKEQSGTHRQMLDSYFCEFLWRHSVKRRDVDAFEYHLQNIVAYMPPN

SEQ ID NO: 133393 - protein, 246 aa, Heterodera glycines
  Coding regions on vcDNA: vcDNA=SeqID_59816; Strand=-; Position=1 -140,199-799
  Homolog annotation: Hit_ID=AAM77581.1; Match level="QueryCoverage =88%, HitCoverage=70%, E-value=2e-18, Identity=34%"; Hit description =HMW-glutenin [Aegilops tauschii]
YNSVQGQYGGQGTNGGSSTAQHYSQQQPQQYYSYNSNTNNGYGGGTGGYQQQQSPQYAQGNYYYSNGNYPQSQYSGSYPQSSQYSSSSAQSSPYAYGQQTVVVPSSSQGAGGQYGTPQQQPIPIVQSGGQTQQQQQLTQFSGNGGQQQQLQGTQYGGTAGTSHGTQQYNGGQGQNGQGQGQQGYYSQSTAQRQQGQHIASAAGQNGQGQGGQQQYTTRQVSGDSVLSATNVNSPSFARRTSQRRLR

SEQ ID NO: 133394 - protein, 378 aa, Heterodera glycines
  Coding regions on vcDNA: vcDNA=SeqID_59817; Strand=-; Position=1 -70,112-230,589-744,786-915,958-1105,1146-1239,1280-1427,1467-1738
  Homolog annotation: Hit_ID=NP_001004509.1; Match level="QueryCoverage= 83%, HitCoverage=21%, E-value=2e-46, Identity=34%"; Hit description =si:busm1-180o5.3 [Danio rerio] emb|CAD60788.1| novel protein similar to DNA polymerases [Danio rerio]
MGEEEYEKLKKWYYMNYNNGFILEEKLDEYCSNDTDILMKALIKLRKIFIDITIDNETPNGIDGCAFHGCKKCYKGFMIQANGLTAEQNYDRTQQKMERLRIAGKKMGYTVEEVWECDVRKKLNRKSEIYDENMAKFFNNLPEIGPIIPRNGFAGGRTGPLCLFAEASENMEISIYDIVSLYPWVNYSTPYPVGNPKIVIPKQYIVKWTSPDDIPYEGLLKVRVIPPKNQFLPVLPFHTDDLLLFTNCSSCAKKTKTDFVYSKNTKKCRHSAEQRALTGEFCTLELKKALELGAVIDRFYRSYHYENFDGNLFKNYVRKFLKLKVEASGWPQDVQNEEEKLEFVKTYREIYQIELEATKMNFNPGLRHIAKLAFNSVW

SEQ ID NO: 133395 - protein, 264 aa, Heterodera glycines
  Coding regions on vcDNA: vcDNA=SeqID_59818; Strand=+; Position=1-795
  Homolog annotation: Hit_ID=ZP_00197532.1; Match level="QueryCoverage =98%, HitCoverage=95%, E-value=1e-82, Identity=63%"; Hit description =COG1028: Dehydrogenases with different specificities (related to short-chain alcohol dehydrogenases) [M
MGRRLEGKTALITGGARGIGRAFAEGFVKEGAKVALADIIVDVATKAAGEIGAGTIAVELDVTNQKSIDGCVHKVLAQFGHIDILVNCAAVFDMAPVGEISRESYDRVFAANVSGTLFMTQANHQLAWLISLIKQAVARHMIERGKGGKVINMASQAGRQGDALVTVYCASKAAVISLTQSTGLALIKHSINVNGIAPGYVDTEMWRQVDKLFAKYEKIEVGEKTRQTANLLPIGRMGVAEDLVGAAVFLASEESDYVVGQTLM

SEQ ID NO: 133396 - protein, 85 aa, Heterodera glycines
  Coding regions on vcDNA: vcDNA=SeqID_59819; Strand=+; Position=1 -105,151-303
MNSNYEKDGQKKEENQMGKVPNERPKENGGKDEEKKKEEAEEEDEKQKGGENGKRQLKESGEEFRLLVDEEEKEKEEESTNCAHK

SEQ ID NO: 133397 - protein, 104 aa, Heterodera glycines
  Coding regions on vcDNA: vcDNA=SeqID_59820; Strand=+; Position=1 -126,231-261,322-374,517-611
  Homolog annotation: Hit_ID=CAG10441.1; Match level="QueryCoverage =100%, HitCoverage=13%, E-value=3e-30, Identity=59%"; Hit description= unnamed protein product [Tetraodon nigroviridis]
LLRALFKRNPANPLGGGAQGAAALRDHRFFASVNWQRLAQRQVTPPFRPAFGTLDLDVAHYFDTEFTKRTPKDSPAVPPSAAAHELFRGFSFVSPSILEEDEEE

SEQ ID NO: 133398 - protein, 28 aa, Heterodera glycines
  Coding regions on vcDNA: vcDNA=SeqID_59821; Strand=-; Position=1-84
MTWTIEYLGNDAAEGAPTKCPSHEMSKR

SEQ ID NO: 133399 - protein, 247 aa, Heterodera glycines
  Coding regions on vcDNA: vcDNA=SeqID_59822; Strand=-; Position=1 -37,99-436,493-861
MAPPMETPTTSKTTPTGRPKMNVDHLQRTSRRKLADEIAAVIKRDRSRSASRASLERISREVRHKFAHYTPQKKKQQLSRQKKSVDPEDALLILGLVGTQKAYRRLKSTIRLINAKFDVFPPLEKVLDIKRRICGSLQYAPIETSAGVGFVCTDVEAALEARLSSAKDNLIRFGDEIYIKLSGDHGQSCTKITVSFSQAARSNSPSNNFVCAVFPTKDSRENLERYGSTLWEQIDGIGTLAGNRVKW

SEQ ID NO: 133400 - protein, 193 aa, Heterodera glycines
  Coding regions on vcDNA: vcDNA=SeqID_59823; Strand=-; Position=1 -227,995-1057,1314-1388,1458-1523,1821-1982
  Homolog annotation: Hit_ID=NP_491709.1; Match level="QueryCoverage =96%, HitCoverage=23%, E-value=2e-37, Identity=46%"; Hit description =tyrosinase family member (82.2 kD) (1G477) [Caenorhabditis elegans] gb|AAB52481.1| Hypothetical protein C
FCLRVASLIGQPQIENVLAFTSRVILFNQYLCFSSTFLGTERRLYATDANVLEFIHNGVHAWVGGDMPLTTSPQDPVFFLHHSFIDYIWEQWRLLHQNRQQRETQFPPDSQICAGSQNCAGSQNYLLSATMPFSRPRRAPGLSNSYTDSLYTYAPRPTCRAAGDCRSGRKHSFRLNFTFAAPLPSNIQKCNFL

SEQ ID NO: 133401 - protein, 37 aa, Heterodera glycines
  Coding regions on vcDNA: vcDNA=SeqID_59824; Strand=-; Position=1 -30,198-281
MPQALHSLDELLTAALYLVNGCLSNANLKDGVRVYGI

SEQ ID NO: 133402 - protein, 53 aa, Heterodera glycines
  Coding regions on vcDNA: vcDNA=SeqID_59825; Strand=+; Position=1-160
MANYNAKGVDLSMVASGSGTKRQKEGEDELLIDLGGAADGIGTKGIADKMAQI

SEQ ID NO: 133403 - protein, 197 aa, Heterodera glycines
  Coding regions on vcDNA: vcDNA=SeqID_59826; Strand=-; Position=1 -72,122-343,525-659,786-950
  Homolog annotation: Hit_ID=AAL28025.1; Match level="QueryCoverage =91%, HitCoverage=36%, E-value=5e-14, Identity=32%"; Hit description =CUX-7 [Caenorhabditis elegans]
MAFLGGKMLVQKCASGSLREAKIKVDFDRSAHLSIRKITQRRLRRICIEYERDKTEQRAQAEERRLEEMISEERARREHEERERVMRRLLRAERRQRLREQRNFEQILRRKLKRKLDHRLESSWRERRRQAKALLRYIAELYRAQQQHAVESKQSIHELASEYARDRGLPEEEELRQRILQKREQKMRTRVGSNEYD

SEQ ID NO: 133404 - protein, 81 aa, Heterodera glycines
  Coding regions on vcDNA: vcDNA=SeqID_59827; Strand=-; Position=1 -9,530-766
  Homolog annotation: Hit_ID=NP_498651.2; Match level="QueryCoverage =97%, HitCoverage=15%, E-value=3e-16, Identity=53%"; Hit description =clk-2 Upstream, human gene XE7 related CUX-7, CUX-7 (59.1 kD) (cux -7) [Caenorhabditis elegans] gb|AAK8544
MKKVISLLNGPSFRAIGFADPLTVKADEAKLDFPTRVDWDQFFTSAAGKCPMDEREPGERPDTVYVGGLPFDWFQVGANGK

SEQ ID NO: 133405 - protein, 31 aa, Heterodera glycines
  Coding regions on vcDNA: vcDNA=SeqID_59828; Strand=-; Position=1-93
LRKRNMKARVFSILRLLIMSTFLRLCDISPL

SEQ ID NO: 133406 - protein, 248 aa, Heterodera glycines
  Coding regions on vcDNA: vcDNA=SeqID_59829; Strand=-; Position=1 -232,282-469,1040-1141,1358-1524,1569-1626
MENEMAAASSSAANATNTNDQLKSNETKGNESQTKRNVMAPLALTGGTPSGGGGKCACISRLLQQICALIKHRPNALDDDLPSVSVVGPFEQRWSTLFREFVLDPANCSWEKCVAHSDDMLWYVPIVRMANGGACAVGSERVYPSPSRRRMDAKGECEEVTYPKIFFPIDSFDECDQQPPLPRCSPTWSCPRANASALSWSSGTVTETQRPSFSLAPFVSMCSKSSMIRGKLPLPALGIGPNALSARQ

SEQ ID NO: 133407 - protein, 184 aa, Heterodera glycines
  Coding regions on vcDNA: vcDNA=SeqID_59830; Strand=+; Position=1 -129,179-494,1237-1346
MKISAFYLHGIELDGQKSYGQNGTEQNKVAEKNSQPTLKQYSRLVSDLLFNVPLFRMARLRRRCAVPTFLYFNDYFNKCQFEPWTPFRGATHGDATRHTSLFTMSPLCQAMSTPTSTVSSPWANSNSPRRTDNTVPLWSKCCPLSFAMDDKLKKTGIPNPNSPLMFKSLEKPTNKRAARTNQKL

SEQ ID NO: 133408 - protein, 356 aa, Heterodera glycines
  Coding regions on vcDNA: vcDNA=SeqID_59831; Strand=-; Position=1 -95,409-597,674-764,813-968,1025-1163,1249-1649
  Homolog annotation: Hit_ID=NP_506247.1; Match level="QueryCoverage =77%, HitCoverage=72%, E-value=3e-36, Identity=34%"; Hit description =Pinin/SDK/memA protein (42.5 kD) (5N453) [Caenorhabditis elegans] emb|CAC42335.1| Hypothetical protein R1
MAVDVNSALTKAYDELRSIDMNISMLSGVSESDRNAKRGRYAADEGPPGDYSPPSSARTHRTLQSSVVMPTIETKSRTAVINEMKKNENKEDQVRNRRLFGNLLVATLRKFQNEEKTVGSKGQVQIDKQREVERRLEETEKENRNRMMREREALMAKKREKEMEIQSLRRQKAIEQSAEEKTKHFRRLQCFIQTQTKPPLFFLPSKHTLRTLELLKESSKKIETLIELRRDEMTRELRRLDTYTTASFGGTIGQAKNNVADESDDQDEEETNVRGGLKSAIVVKMEGMTGETVAEAEEEKRDEEEGEEETGQKDGEGEDEAEPKDGEEGEEETGPKEGEEQAEQQQNGRADSEGPD

SEQ ID NO: 133409 - protein, 208 aa, Heterodera glycines
  Coding regions on vcDNA: vcDNA=SeqID_59832; Strand=-; Position=1 -97,141-243,293-348,394-434,605-656,900-1178
  Homolog annotation: Hit_ID=CAE67945.1; Match level="QueryCoverage =89%, HitCoverage=52%, E-value=7e-20, Identity=31%"; Hit description =Hypothetical protein CBG13545 [Caenorhabditis briggsae]
AFGWSPPHFAHLPLITLDGKRKLSKRFEAGYADFYLKNGHLPIAVLNFLLRNGSGIRDHQPQTVYSLEELIERFDERLITRGSFTMDTNELNNYGKLGMNFVAPSTILCFPSLIFVITALCQWFLSSDTAHTFDNFKLLATDLAIPYQLLAKIFRLSMIDNVRGPPIKELIEFFGVAECYARLNAMGQMFEDGAKDEETAPKTTVTSL

SEQ ID NO: 133410 - protein, 286 aa, Heterodera glycines
  Coding regions on vcDNA: vcDNA=SeqID_59833; Strand=-; Position=1 -22,65-108,164-252,300-394,454-577,624-661,781-856,917-1011
  Homolog annotation: Hit_ID=CAE72049.1; Match level="QueryCoverage =81%, HitCoverage=28%, E-value=4e-56, Identity=52%"; Hit description =Hypothetical protein CBG19133 [Caenorhabditis briggsae]
LCSEIGRDVLLEGGNSVDSMIACSEIGRDVLLEGGNSVDSMIASLLCIGVSLLCIGVVNPQSSGLGGGFIMTLYNTSTQRCTTIDARETAPLGTNSTMYVGTQRCTTIDARETAPLGTNSTMYVGTPRDSVIGYRSIAVPGELHGFSIAVPGELHGFWTAFTKFGSGRVTWKRLFEPAIKLARFGFPVSSNLAMVLQQKDVSSNLAMVLQQKDIFVDKKTGRVFEEGDIMTRERLAELLDELAVAPNPIELFYKGLDELAVAPNPIELFYKGTKINERINFICQNS

SEQ ID NO: 133411 - protein, 59 aa, Heterodera glycines
  Coding regions on vcDNA: vcDNA=SeqID_59834; Strand=+; Position=1-182
IRRGTKVIRSGTTVIRRGSTVIRSGTTVIRRVIRRGSTVIRRGTKVIRRGATVIEEVQQ

SEQ ID NO: 133412 - protein, 225 aa, Heterodera glycines
  Coding regions on vcDNA: vcDNA=SeqID_59835; Strand=-; Position=1 -51,117-245,297-416,472-531,589-693,738-872,1058-1134
SPYEEIDQDKAGVSPEELRAAFFRCGGVNAHSWRILVVAAEGDNETTKFIGKLLDFLTAEGTSAPPTNCPPAAAPPNSQLANPPLQHQAGTSQVSYDGALASQFPFSAAIHSQSGLTCRQEVVGGIAGPETPPEHIYDTISSSSSADDSHSQHKKLSIPPGHIYHTVMSTSSDGSKRSSVFYDVPPTPPPPVLQHTVLFRHRGEKNRKKNETPSPASKCSDAKKR

SEQ ID NO: 133413 - protein, 56 aa, Heterodera glycines
  Coding regions on vcDNA: vcDNA=SeqID_59836; Strand=-; Position=1-170
MSVRVPFLLLPLLFLCPLLLPVSVRAVQSVFSCPLSAASVAGVPGTLPAFAGALGE

SEQ ID NO: 133414 - protein, 125 aa, Heterodera glycines
  Coding regions on vcDNA: vcDNA=SeqID_59837; Strand=+; Position=1-375
MCKRMYEMEVRAHMDSVAVRASPAAVTLLTKVNAKLAEQQQGKVGPNKFIHFQILKIKQNQPNEENDRPALREYPNYWEEKRIDRSVYWWFRPMKSTSGTDAINMTELSDDLREAAELKRKFSEK

SEQ ID NO: 133415 - protein, 343 aa, Heterodera glycines
  Coding regions on vcDNA: vcDNA=SeqID_59838; Strand=+; Position=1 -46,1508-2491
  Homolog annotation: Hit_ID=NP_508646.1; Match level="QueryCoverage =98%, HitCoverage=16%, E-value=2e-56, Identity=38%"; Hit description =predicted CDS, RNA-directed DNA polymerase  and Integrase, catalytic domain containing protein family mem
NSFQNPIKILSSTSKSDDLILTQFEEKIEFFNDRYQVQLPFRSDPKTIALPSNFGLCMGRLRSVFNTLSKNPTLLKKYNDIIQEQKTLGIIEPVPISSKFSPPLHYLAHHPVINEIKGKVRIVYDGSAHVGKEPSLNDCLYPGPILIPDLVGLLLRFRIPKFVITCDIEKAFLQVLVHPNHRDCTRFLWLKNIQLPPSSINLQMFRFTRVSFGLTCSPFLLAATIRFHLHINPSPLSDEIISNIYVDNILLSSETETEGVDKAVAAISLFEKAGMPLREFVSNSNEIISKIPENFVLHGPDQKFLGINWNPLSDRLVFKLANLPNSPLSKRSILSFVASNYDP

SEQ ID NO: 133416 - protein, 30 aa, Heterodera glycines
  Coding regions on vcDNA: vcDNA=SeqID_59839; Strand=-; Position=1 -44,132-180
MEKQFHFDYFRYQIRSKLSIKIIFVLGVLE

SEQ ID NO: 133417 - protein, 30 aa, Heterodera glycines
  Coding regions on vcDNA: vcDNA=SeqID_59840; Strand=-; Position=1 -44,132-180
MEKQFHFDYFRYQIRSKLSIKIKFVLGVLE

SEQ ID NO: 133418 - protein, 77 aa, Heterodera glycines
  Coding regions on vcDNA: vcDNA=SeqID_59841; Strand=-; Position=1 -70,245-408
MISSDNGDGLMCKWNRIVAAKRKGIRKRNKRPTRSGIRMGPGYRQSLSEGSLPTWAEPSYTILTFPFISLITGWWAR

SEQ ID NO: 133419 - protein, 127 aa, Heterodera glycines
  Coding regions on vcDNA: vcDNA=SeqID_59842; Strand=+; Position=1-384
MCVFNVVQNRWPKIGEFVLVYQENAPRSIWLTATILNVFYNELNFPNSAKVKTINGHTTIRSVHHLYPLETQEELASKTPKISWAPYPPNYQPPVIERNFPSKVHIKQNRRWNWADKPPTNTALSQL

SEQ ID NO: 133420 - protein, 157 aa, Heterodera glycines
  Coding regions on vcDNA: vcDNA=SeqID_59843; Strand=-; Position=1 -51,956-1157,1441-1660
  Homolog annotation: Hit_ID=NP_638970.1; Match level="QueryCoverage =98%, HitCoverage=46%, E-value=5e-42, Identity=47%"; Hit description =arabinogalactan endo-1,4-beta-galactosidase [Xanthomonas campestris pv. campestris str. ATCC 33913] gb|AA
IRFMSLYFLINLIQNGKKIYFANFQVVIHLANGYKTADFTWFFDGLKKAGGSFDVVGISHYPTSSNWQTLNGQAETTLKTMISRYGKKVVVAEIGLSWNEPSASKSMLDDMFKRVKALGNNGIGIFYWEPQASPGWNHYQWGALDNSGKFTAAMESF

SEQ ID NO: 133421 - protein, 257 aa, Heterodera glycines
  Coding regions on vcDNA: vcDNA=SeqID_59844; Strand=-; Position=1-775
  Homolog annotation: Hit_ID=NP_702063.1; Match level="QueryCoverage =99%, HitCoverage=6%, E-value=3e-13, Identity=21%"; Hit description =hypothetical protein PF14_0175 [Plasmodium falciparum 3D7] gb|AAN36787.1| hypothetical protein [Plasmodium
SIHQHFNHWGLNPLTFKSLGLNPPTFRSTGLNPPAFQSVGLNPPTFQSTGLNPPAFQSTGLNPPAFNHWDSILLHFNYWDSILLRFNHWDSTLKHFNRRDSIHQHSDQRDSIHQHFNHWDSTHQHSNQRDSIHQHSITGTQSTSISITGTQSTNIPINGTQSTSIQSLGLNSPAFQSLGLNPPTFQSTGLNPPAFQSLGLNPPTFQSLGLNPPAFQSVGLNPPTFQSTGLNPPAFQSLGLNPPTFQSLGLNPPSFNH

SEQ ID NO: 133422 - protein, 121 aa, Heterodera glycines
  Coding regions on vcDNA: vcDNA=SeqID_59845; Strand=+; Position=1-367
  Homolog annotation: Hit_ID=EAK89729.1; Match level="QueryCoverage =97%, HitCoverage=44%, E-value=9e-14, Identity=28%"; Hit description =uncharacterized glycine-rich low complexity protein [Cryptosporidium parvum]
IQTLGLNPPTFQSLGLNPTAFQTLGLNPPAFQSLGLNPTAFQSLGLNPPTFQSLGLNPPTFQSLGLNPTAFQSLGLNPPTFQSLGLKPPTFQSLGLNPTAFQSLGLNPTAFQSLGLNSFLH

SEQ ID NO: 133423 - protein, 68 aa, Heterodera glycines
  Coding regions on vcDNA: vcDNA=SeqID_59846; Strand=-; Position=1 -181,264-289
MNCALASSFSPFGKHFAAVVADKKGMRADLYVNGEELVERLGSCVKNTQIELQNFFVKVEATLRDFIR

SEQ ID NO: 133424 - protein, 93 aa, Heterodera glycines
  Coding regions on vcDNA: vcDNA=SeqID_59847; Strand=-; Position=1-282
MVKWGPAVPLGSPGKFFEKFYSICQGNCFAADISHSPRGGIARIYILAQWEWTLDMMRGNDGINTKEIRDKWMTYARGEWDKEVMITLEMRGI

SEQ ID NO: 133425 - protein, 376 aa, Heterodera glycines
  Coding regions on vcDNA: vcDNA=SeqID_59848; Strand=+; Position=1-1131
  Homolog annotation: Hit_ID=ZP_00225060.1; Match level="QueryCoverage =40%, HitCoverage=92%, E-value=9e-17, Identity=40%"; Hit description =COG3236: Uncharacterized protein conserved in bacteria [Burkholderia cepacia R1808]
MENYLIPGIPFLLDGQIAIKFFTLRYFTSNHHPAPFEMDFDDWGVRHMHSSEQGYFALRAVEFGDQQQFEYVLNLASARDVKNRGKRVRGYNYGHWQTVKREHMLRVVLEKFRQNEPLCEALLRTGFVRLVEASTDRYWAAGLLITDEAIRSSNNWMGLNELGWVLMHVRDQLRPLPQQVHLIHKHYIVCQAAAPDYVVALAAEPHVQPYAVRINNETVNAARQLQIGDTLVIESVEWREGFEQLGAEGMNDRPCWVHQARLNWQATASAVYSVCMHQWVPARAKILRCVRGGPRHNRAVCSIRIQLDGIEFVVTQRNVNGNIGLARQGQWIDVWAIVVAEHWHADWGFILPPDAVFRGRHQIVSDGRVRIPVFVG

SEQ ID NO: 133426 - protein, 280 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (217)..(217): Xaa can be any naturally occurring amino acid
  misc_feature (274)..(274): Xaa can be any naturally occurring amino acid
  Coding regions on vcDNA: vcDNA=SeqID_59849; Strand=+; Position=1-854
  Homolog annotation: Hit_ID=BAB33421.1; Match level="QueryCoverage =96%, HitCoverage=96%, E-value=4e-91, Identity=68%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 133427 - protein, 72 aa, Heterodera glycines
  Coding regions on vcDNA: vcDNA=SeqID_59850; Strand=+; Position=1-219
MAEQNSFNSQKGENVEGPIGSDFDPILFTPEENQNLNNVLTRMRTFESAICRQFRKLEREFAELKIVAHPIR

SEQ ID NO: 133428 - protein, 96 aa, Heterodera glycines
  Coding regions on vcDNA: vcDNA=SeqID_59851; Strand=-; Position=1 -127,173-231,305-409
MEYFYEAIEQKLLAKVWAFHSSYNFALKGMETLALRDVICNVTPRFHFTRKWSFRHENGLEEVRAGPSLLQHFCQLDKIRGSRIVGRGKSVCEGAN

SEQ ID NO: 133429 - protein, 81 aa, Heterodera glycines
  Coding regions on vcDNA: vcDNA=SeqID_59852; Strand=-; Position=1 -207,501-539
MFPPPMTLPRHGSVCEMFDGPIECHPSDTAAAKGGGKADQKQSNSGEQMADGGGKAVAKDGVSEQNEQFRFPKWKNEIALG

SEQ ID NO: 133430 - protein, 193 aa, Heterodera glycines
  Coding regions on vcDNA: vcDNA=SeqID_59853; Strand=+; Position=1-582
MEEEYVPGKVVGYIEDPREEKEGEWDMAKALQNRSKEDEVRIKKREQREEGWKELISGERKAKGRERPKLVEKFVKNVLGPAENDVSRNPGPPPEGSRRGPTPIPCWNRYKKRPRFVSPIRNISPVRTRQSTVGTQTTNAWPSCIGDVVEQMQLMKTKLDELIAALKKKEEEKNNGNNEQIGEKEEQQKENGK

SEQ ID NO: 133431 - protein, 695 aa, Heterodera glycines
  Coding regions on vcDNA: vcDNA=SeqID_59854; Strand=-; Position=1-2085
  Homolog annotation: Hit_ID=XP_320889.1; Match level="QueryCoverage =94%, HitCoverage=76%, E-value=6e-97, Identity=34%"; Hit description =ENSANGP00000012033 [Anopheles gambiae] ref|XP_313651.1| ENSANGP00000013044 [Anopheles gambiae] ref|XP_314
MSADQIKQLLEAMRVQSDAIQQLMGQAPQNATSLNHANLASSIDGRISKFNYDAETGNTFEQWFKRFGVLIEEDGKDLPESTKVRLLLGKLGDEEYGKYRDSISPTQPDKVNWVDSITKLKGLYAETRSLFVRRYECFKIRQQPSQDISSLVAHINASCENANLSPTKEQLKCIILVIALNDEHHDLRQKCLKMLEDAEKTGTDITLQKVEEELKAIQIVKESALSLLTQPVSTSAIQLRPQQWRETSKGKHKAKPAPKWPHHEPAPKSPHHAPSPKQKSDDKANRGHPSHPCASCGSNDHWRSDCKFANAFCNKCNRQGHIAIVCRQRSSNTAHKSQNRSFHTVVVKSHCMVIGTTQGRWWKIPVMINGINLKMNGDSGAQATVISFKTWIKLGQPELSPTDIETRNCNDTAFSTEGKFHCTVSCFDRPSKTLIAYVSSDLKHDLFGLPWIEEFELISKEILYPQSTKGKTNASINANVVKAPNPAIGITDESSLTAVLQNDFEEVFKSGLGHCAIKAHLILKPDARPIFCKARPVPHGAIEAVDTELDRLLQIGAIKPVEFSHWAAPILAVKKKNGKTRVCIDFSTGLNDSIELNRHPLPRPDVIYAALNGAEFFSNLDLRDAYLQMELDEKSKPLCTINTHRGLFQCQRLPFGVKSAPSIFQHLMDQICAGIPGVFSYLDDCLIASKTLEDH

SEQ ID NO: 133432 - protein, 60 aa, Heterodera glycines
  Coding regions on vcDNA: vcDNA=SeqID_59855; Strand=+; Position=1 -123,218-277
MGEPIKTGSGSREFSRDPAGLNTRTRPRDPTRFSKVFGTYEPKERLIPKVDENSCLMMLK

SEQ ID NO: 133433 - protein, 147 aa, Heterodera glycines
  misc_feature (92)..(92): Xaa can be any naturally occurring amino acid
  misc_feature (132)..(132): Xaa can be any naturally occurring amino acid
  Coding regions on vcDNA: vcDNA=SeqID_59856; Strand=+; Position=1 -68,212-313,400-517,745-892
  Homolog annotation: Hit_ID=CAE68348.1; Match level="QueryCoverage =99%, HitCoverage=17%, E-value=2e-36, Identity=53%"; Hit description =Hypothetical protein CBG14081 [Caenorhabditis briggsae]
FMSKYLERQFGVLPSKATLFMGAVMVPMAGFGTMFSGLIIHHFRLSCVRTLQYCIALVLLVLCSLLLSPMYFIYCDHDQLVGIERHYPVDEXVILEQLAKTDTFVYPFGRRCNAQCHCSPTEYHPVCAEHIXRSQMAYYSPCYAGCP

SEQ ID NO: 133434 - protein, 109 aa, Heterodera glycines
  Coding regions on vcDNA: vcDNA=SeqID_59857; Strand=-; Position=1 -169,213-373
MKNSFYEQKKKEFIEKIDEFKSLYGQGKQKEFVKELGIFKETFRRWKSELLPKYNKKQSKYSNEDKLQKMKQYFKIKERNPKINDRKIAKKLGIGKTTLKKWKKKFPQF

SEQ ID NO: 133435 - protein, 235 aa, Heterodera glycines
  Coding regions on vcDNA: vcDNA=SeqID_59858; Strand=-; Position=1 -580,624-751
MNLWHIIFLIFCFIYKIESCKIRPNFDEIFGKEWDKNENEENREEMGTESIDKMSEYSNQNVIKSDQNSKMEPNDQQKSEIIQKFEAIKEKLKQKGKYQGKKSVKIEAKIGKLLGANRDKIYKWKKELNLNIKQIKIMKNSFYEQKKKEFIEKIDEFKSLYGQGKQKEFVKELGISKETFRRWKNELLPKYNKKQSKYSNEDKLQKMKQYFKIKERNPKINDRKIAKKLGIGKTT

SEQ ID NO: 133436 - protein, 158 aa, Heterodera glycines
  Coding regions on vcDNA: vcDNA=SeqID_59859; Strand=-; Position=1 -98,183-247,297-353,398-473,739-816,1315-1416
  Homolog annotation: Hit_ID=AAH80373.1; Match level="QueryCoverage =99%, HitCoverage=35%, E-value=4e-52, Identity=57%"; Hit description =Oxct1-prov protein [Xenopus tropicalis] ref|NP_001007927.1| oxct1 -prov protein [Xenopus tropicalis]
NLGIGIPTLCPSYISDKSIKVCIHAENGMLGVGQYPIAGEQDPDYVNAGKESITYNPGASVFSSDESFAMIRGGHIDLTMLGGLQVSMRGDLANWMIPGKMLKGMGGAMDLVSAPGSRVVVLMEAVFDVCRKEGLTLIEIHENYSIEDIKKATGCNFK

SEQ ID NO: 133437 - protein, 100 aa, Heterodera glycines
  Coding regions on vcDNA: vcDNA=SeqID_59860; Strand=-; Position=1 -96,368-574
MENNQIITKRNNKKLEHEGCLYVFHMFNADRDVYKEQVEGAPTPINLNVQFGTNARELIFDMDDSIAVVKEKIHRAWPVTPVPAQMLLYFARMVDFINCF

SEQ ID NO: 133438 - protein, 44 aa, Heterodera glycines
  Coding regions on vcDNA: vcDNA=SeqID_59861; Strand=+; Position=1-134
MGKGCNAHQPPSSSAFEFIALMFTAPKFYVTVSIEHMEDIEASF

SEQ ID NO: 133439 - protein, 109 aa, Heterodera glycines
  Coding regions on vcDNA: vcDNA=SeqID_59862; Strand=+; Position=1-330
MRKENNKSSAASADSDANANSGGDASLTAPTEEEGEEISANEQQKEQRKSLDALYAAAREEFDLDMSPLDSAMKTLREGREIQKLSVLRNLWSSWWRASRTRRYTACCP

SEQ ID NO: 133440 - protein, 196 aa, Heterodera glycines
  Coding regions on vcDNA: vcDNA=SeqID_59863; Strand=-; Position=86-676
MQIFNDRFFEFGDPEREEEEERVPIRREPRAHRQSESLSSWIERSYGPHWYETTRDRRAVDEDLCRVLREGATLIGEHFGRAVDIHFDGLTCYGPEGLYLSPGLTVFDHFVRLGLQVDPLIPCTQEYVGFSPHEGGMLVDLYPIELISIRHRVRAAWRAPEEDELHPPARYRAQSPDGHLENRPQRVVQRRPMNRW

SEQ ID NO: 133441 - protein, 37 aa, Heterodera glycines
  Coding regions on vcDNA: vcDNA=SeqID_59864; Strand=-; Position=1 -14,65-161
MVIVRIMTVKAACPRPCLAVTTAAQQKQRHGVGMPPG

SEQ ID NO: 133442 - protein, 472 aa, Heterodera glycines
  Coding regions on vcDNA: vcDNA=SeqID_59865; Strand=-; Position=1 -254,492-1656
  Homolog annotation: Hit_ID=AAK61476.1; Match level="QueryCoverage =64%, HitCoverage=93%, E-value=3e-16, Identity=27%"; Hit description =glycoprotein gp2 [Equine herpesvirus 1]
MRHAVAQLNGKMDRLAQQMARVEAAVVVGRKTNNGAGMVVVPTAEEAEERTEQQQQETKGIPTRTNGQFSKRMGVKEMPTMPTPSYTSSATWNGAAITTNGDGGAKSSPSPRGITVKEEIVVASNDGGIIGSNDHYYHQQQRHNISGDNGGGSGGAINTVAAGTFASSTGTGGTTMPTTSATTTAVGSRKRKPARTANNSNNSLPWTTTATSTTTHGGYRVEASPPALSTTTVTTTDELLLANLFGIVPTAVSSSSVHAAAPSTCSAASSASSSAASSVAAATAASTQQAAALYSILLQHQLNNNNAAATPTTETTTAMDIGGIGTIAADGGVTGVGAELNGSGATNCDGVSSNSTDATTSPNLLSAAAAESQHIITATAVAQQPLLLKNGSNANDGGGIVMIGCGGANATSPPDGGGGIFFGDDFQLFKHTNNNNNNNSIKLDASDHHNAMVMEASPPGSRENQQVGTKKE

SEQ ID NO: 133443 - protein, 163 aa, Heterodera glycines
  Coding regions on vcDNA: vcDNA=SeqID_59866; Strand=-; Position=1-491
  Homolog annotation: Hit_ID=NP_491189.1; Match level="QueryCoverage =66%, HitCoverage=34%, E-value=5e-32, Identity=55%"; Hit description =carbonic anhydrase (cah-6) [Caenorhabditis elegans] gb|AAB53054.1| Carbonic anhydrase protein 6 [Caenorha
MNGSEHTVGGVGYAGELHFVHRSVKWPNIGEALKQPDGVLAVAVFFNENLEDNATLAPLDDALARVTFRGAECPMHSLRLSQLMPVEKSKEFWLYDGSETAEPFRETVGKSGKVPMKMPTDDRSNGSCADRRCPFRRHNWKGCANCERVGRRTKLRKQCSPSV

SEQ ID NO: 133444 - protein, 146 aa, Heterodera glycines
  Coding regions on vcDNA: vcDNA=SeqID_59867; Strand=-; Position=1 -252,683-871
  Homolog annotation: Hit_ID=CAD38524.1; Match level="QueryCoverage =97%, HitCoverage=80%, E-value=3e-63, Identity=83%"; Hit description =putative glutathione peroxidase [Globodera rostochiensis]
MSSSSSAAPSDPQQKSIYEFSAKDIDGNETSFGKYRGKVLLVVNVASNCGFTDSNYSQLKQLLDKYKSKGLEIAAFPCNQFNNQESGCAIDIKDFVTKKYNFEPDLYDKIDVNGPNEHPIYAYLKSVQGGILGFDAIKWNFTKATQ

SEQ ID NO: 133445 - protein, 287 aa, Heterodera glycines
  Coding regions on vcDNA: vcDNA=SeqID_59868; Strand=+; Position=1 -72,239-523,678-770,954-1365
MPPLGQVEQLVQPMFINSAHQQMPAALSHRCSIGPPSAPTNASWLTPGDQCCAAQWRRSACRSLGLEATGQCSGVFEHREHLLVHQLHCAGPIPATGLLVPIGVDGKNAIVVPHTAAPQAPHVQTGGGRTVNDARAPPAADPIEEDENNNVTRPIEDCFVIERTTPMRNTLRNTRGELCEIRFLPLEDAERPDLLLETLIQHLLDRVLEGHPPPMLVGLQLHPPGFDRPYVIRLRPPEQNNAAALAAAIERLNEQSAAGIDLLAGTTVAKVLAVWPLEPIRADAQRG

SEQ ID NO: 133446 - protein, 158 aa, Heterodera glycines
  Coding regions on vcDNA: vcDNA=SeqID_59869; Strand=+; Position=1 -157,297-377,461-670,982-1000
  Homolog annotation: Hit_ID=AAC46513.1; Match level="QueryCoverage =96%, HitCoverage=41%, E-value=5e-63, Identity=76%"; Hit description =cAMP-dependent protein kinase catalytic subunit
SSTANASLIDFERIRMIGTGSFGQVLLVKHRRTGKYYAMKMLEKQKVLKLKQVEHTISEKRILQATEFPFLVKMHYSFKDTADTANLYMVLEFVSGGEMFSHLRRIGRFSECHSRFYATQIVLAFEYLHSLDVVYRDLKPENLLIDVNGYLKLIDFTF

SEQ ID NO: 133447 - protein, 61 aa, Heterodera glycines
  Coding regions on vcDNA: vcDNA=SeqID_59870; Strand=-; Position=1 -45,505-645
MKEMVRDKRREKGEKTWNKIFHNAEFDSMIFCRLVILKMGKFENVNRWIRQWKITKQSNGN

SEQ ID NO: 133448 - protein, 51 aa, Heterodera glycines
  Coding regions on vcDNA: vcDNA=SeqID_59871; Strand=+; Position=1 -93,186-248
MNGEARLSRTNDSRHQPTNWRWNFIGYFELKKLLKQVSEELEKLKKLNLPE

SEQ ID NO: 133449 - protein, 154 aa, Heterodera glycines
  Coding regions on vcDNA: vcDNA=SeqID_59872; Strand=+; Position=1 -270,548-742
  Homolog annotation: Hit_ID=CAE59391.1; Match level="QueryCoverage =69%, HitCoverage=40%, E-value=2e-09, Identity=33%"; Hit description =Hypothetical protein CBG02749 [Caenorhabditis briggsae]
MAIFITSARMAENSRDSRPKRVASRLSNSTNNHFHCREAVQRLHNERNTVLDELRVLAGEGKLIEQAEKTKKELEEERRMHAEAIQQINKDKDELEPVLAEVRQKRRRTETELGQRYAKVPFLWDQLSKRARELEVPCALMTPEGLLPKTLLSE

SEQ ID NO: 133450 - protein, 276 aa, Heterodera glycines
  Coding regions on vcDNA: vcDNA=SeqID_59873; Strand=+; Position=1-831
  Homolog annotation: Hit_ID=EAL49477.1; Match level="QueryCoverage =99%, HitCoverage=52%, E-value=1e-22, Identity=27%"; Hit description =hypothetical protein 42.t00003 [Entamoeba histolytica HM-1:IMSS]
MKKQLEGKTKECDSLKGSVNELQKQLMTMGTTTMPRELNELKNERKDLMKKNKEKDEMIAKLKKKMDEDSRKMANLLGQEKKKEEEHRKTVNALKDEYQRKIEEVTKKKDQSIEKQRTENDRLKAELSKNEKTIQEQKQQLVKDQQQKTDRVGREEALREQKRQLTEQHRTETEKLKTEMRKTEEEAITQQRNQMMEEQREKNDKLRTELFRKKEEALLRQKEQFEEESQQKMDELEAKLRNEYKLKLEQSEKQLRSEFEAEIGQLKRHCNQGGRD

SEQ ID NO: 133451 - protein, 177 aa, Heterodera glycines
  Coding regions on vcDNA: vcDNA=SeqID_59874; Strand=+; Position=1 -121,189-287,818-972,1061-1219
  Homolog annotation: Hit_ID=AAH59683.1; Match level="QueryCoverage =71%, HitCoverage=65%, E-value=1e-33, Identity=40%"; Hit description =Unknown (protein for MGC:73374) [Danio rerio] ref|NP_956400.1| Unknown (protein for MGC:73374) [Danio reri
MLSDLELAGCTNLTDAGFVQLSKSCHELERIDLEECLLITDSTLTNFNGCPNLYSLSLSHCENLTDTGLAELCVAHRERLQVLELDNCPNITDHTLESMKHLKVLERVDLYDCQLVTKDGIKKFKSSTFCKKPGPGPEFHVWIWPGFLEKIPGKFRPRKNPGLFAWIQPGLDMDFFL

SEQ ID NO: 133452 - protein, 64 aa, Heterodera glycines
  Coding regions on vcDNA: vcDNA=SeqID_59875; Strand=-; Position=1 -162,385-417
MPLKPMVNANAMIEDIGIATTTIDRWDREILMETLDENHFDEMIYYHEPIPHWQFRKNAFLVFI

SEQ ID NO: 133453 - protein, 69 aa, Heterodera glycines
  Coding regions on vcDNA: vcDNA=SeqID_59876; Strand=-; Position=1-210
MALAMLCATIFLVQLILQQQHPNWAAAGDDRELKTMIETCEFITERLAPEGILENLAVITLGTAIEAQF

SEQ ID NO: 133454 - protein, 23 aa, Heterodera glycines
  Coding regions on vcDNA: vcDNA=SeqID_59877; Strand=+; Position=1-71
MRIMRKAKCEKRNLGTSLVYMVA

SEQ ID NO: 133455 - protein, 152 aa, Heterodera glycines
  Coding regions on vcDNA: vcDNA=SeqID_59878; Strand=-; Position=1 -65,268-661
MQISLYLYRSPRGTCLGTAGPRLAAAAVFGAKQLFVVVVDGADVVGVVLLLMLLLVDFVAVEDGAVLAQVVDAVVRIVVVVVVVVADDGPNQIEMLVAMAKSVTFIIIVVVVDNIAMAECFVSPMARIPHVVDVVVAAGCSCGREKQRFDFL

SEQ ID NO: 133456 - protein, 80 aa, Heterodera glycines
  Coding regions on vcDNA: vcDNA=SeqID_59879; Strand=+; Position=1 -60,186-368
MPQKLLIKENRKKNIWCVRIEKPKVARERHPWHVMDDVQIGEEHLPMNKGDDDAHLRMEKKLTRETIGEQPKFWTESSDY

SEQ ID NO: 133457 - protein, 58 aa, Heterodera glycines
  Coding regions on vcDNA: vcDNA=SeqID_59880; Strand=-; Position=1 -127,359-408
MGKENEINGSEGNSGTNGSEGQNGMEEGKEKVKEEEEETTSEESCQKAAQSQQQSAKI

SEQ ID NO: 133458 - protein, 91 aa, Heterodera glycines
  Coding regions on vcDNA: vcDNA=SeqID_59881; Strand=-; Position=1 -84,137-337
  Homolog annotation: Hit_ID=NP_957041.1; Match level="QueryCoverage =85%, HitCoverage=34%, E-value=1e-20, Identity=55%"; Hit description =NADH dehydrogenase flavoprotein 2 [Danio rerio] gb|AAH59546.1| NADH dehydrogenase flavoprotein 2 [Danio r
MFAKHLRNFPFGCSFAARPLRRYSAHGLQVHRDNERNNPNTPFQFTEANLAKITVLLNNFPEGHKGAALIPVLDLAQRKHGWLPISAMHEV

SEQ ID NO: 133459 - protein, 86 aa, Heterodera glycines
  Coding regions on vcDNA: vcDNA=SeqID_59882; Strand=-; Position=1 -30,72-302
MTIPNFSDNDCNEWTQWMRTPGNWLHNIEIIQKELIVWRTMMNDQIGNENNNYPKKDPHWLQFLHLPLLLTFDYSGKMKIDHFLKL

SEQ ID NO: 133460 - protein, 113 aa, Heterodera glycines
  Coding regions on vcDNA: vcDNA=SeqID_59883; Strand=-; Position=1 -12,467-625,747-917
MENDLERIIDHRINAYGNDEWHVCWSGYNQTTWEPCQNFIGQDAVQMLADFEHARKKTVLHLKLGTFFKYETVPGKFMVKRQTATSNEPQYLFAGQTAWTTNGVIKLIVFVWL

SEQ ID NO: 133461 - protein, 131 aa, Heterodera glycines
  Coding regions on vcDNA: vcDNA=SeqID_59884; Strand=+; Position=1 -49,827-946,998-1083,1193-1333
  Homolog annotation: Hit_ID=CAE63216.1; Match level="QueryCoverage =73%, HitCoverage=15%, E-value=2e-10, Identity=37%"; Hit description =Hypothetical protein CBG07573 [Caenorhabditis briggsae]
MVKGQNGIAIADDELGDSCKGHEDKCQNGGYLNPNDCTKCHCPDGNGGQYCAALEENLNCEDLSGIPRELVANQSAVLLKTKAKYPEAGKKVRIQFKSLSNLFECTHNCSSAYVEVKYRADKRAQGKKTNN

SEQ ID NO: 133462 - protein, 95 aa, Heterodera glycines
  Coding regions on vcDNA: vcDNA=SeqID_59885; Strand=-; Position=1-286
MGTLNYIIIFPLTPFDLRDLLNGKVLARHSLKELLGDQSWFAFVFVFHLFSQDKHLLASAFSLRKNEKETNSTSIFLELLFSDFNSFAFSSNSAD

SEQ ID NO: 133463 - protein, 95 aa, Heterodera glycines; identical to SEQ ID NO: 130684
  Coding regions on vcDNA: vcDNA=SeqID_59886; Strand=-; Position=1-677

SEQ ID NO: 133464 - protein, 103 aa, Heterodera glycines
  Coding regions on vcDNA: vcDNA=SeqID_59887; Strand=+; Position=1 -186,288-413
VCGIYERGKKSVKFPPREEDRCSKKQLEDPEVQNKIQQYVDEALKRVQDDFQREEVTNVIKAVKEIIRAWILMYMFFTVLLWPNTHEKRVFNLVAFITWLEDF

SEQ ID NO: 133465 - protein, 158 aa, Heterodera glycines
  Coding regions on vcDNA: vcDNA=SeqID_59888; Strand=+; Position=1 -81,376-491,905-1181
  Homolog annotation: Hit_ID=NP_503129.1; Match level="QueryCoverage =53%, HitCoverage=21%, E-value=4e-12, Identity=39%"; Hit description =predicted CDS, putative protein family member, with at least 4 transmembrane domains (5A526) [Caenorhabdi
MPHPFSGIYVSWFFNPHMGYQEDLDKITFIQVVLISSINAFAAGIYVYMQYFKISKALIVIGQLSWLFAHGIPSLIYLCLNKTIRKDCLKMTTGLISQITGKSIMQTNTTRMLNTINVLTIGGGRINMATASRHGGMSRVVPTNSTMNTTPTNNGERQ

SEQ ID NO: 133466 - protein, 71 aa, Heterodera glycines
  Coding regions on vcDNA: vcDNA=SeqID_59889; Strand=+; Position=1 -202,286-299
MMSKTRRRPEIVRKTNCEFQLEIFVSVPSNPIVVIDIEAITFKKMLRFIYTNDLSSIDGDGIDILYAAEYI

SEQ ID NO: 133467 - protein, 73 aa, Heterodera glycines
  Coding regions on vcDNA: vcDNA=SeqID_59890; Strand=+; Position=1-477
FGPPFLGPGVVWAPVFGPRGRLGPNPKIEKCAFLKIKILKTKPEGSLATWHKLGLINIRSFFTILLIPNPIIF

SEQ ID NO: 133468 - protein, 302 aa, Heterodera glycines
  misc_feature (84)..(84): Xaa can be any naturally occurring amino acid
  misc_feature (111)..(111): Xaa can be any naturally occurring amino acid
  Coding regions on vcDNA: vcDNA=SeqID_59891; Strand=-; Position=1 -25,1222-1462,1502-1636,1667-2025
  Homolog annotation: Hit_ID=NP_001005317.1; Match level="QueryCoverage= 99%, HitCoverage=79%, E-value=4e-35, Identity=33%"; Hit description =si:busm1-173m20.16 [Danio rerio] emb|CAD59047.1| SI:dZ173M20.16 (novel transposase) [Danio rerio]
ICLIFHKKCKLVGKISAKLVKRTHKKTKSNYVRLSWNNWNFPFQIVVGLIDCTHIPILMPSEPNMEEYYNRKGWASINVQGNCXPKRRFLNINCKWPGSTHDSINVQGNCXPKRRFLNINCKWPGSTHDSFILRHSSVWEDFENRRIRGVLLGDSGYPCRKWLLTPFANPSTNVQQHYNVLLGDSGYPCRKWLLTPFANPSTNVQQHYNNAHTKTRVLIEQTFGRWKKRFHALQTPIRIKFENIGMFIVAAAVLHNIAIMRGVPEFDEEDLVDEQPETEIMLEENAGDGFAARASVTQNYFS

SEQ ID NO: 133469 - protein, 43 aa, Heterodera glycines
  Coding regions on vcDNA: vcDNA=SeqID_59892; Strand=-; Position=1-132
SVLPTIKQKFEEVKEWVHEKTTTVSVEGPQEKEKYKVIELDEK

SEQ ID NO: 133470 - protein, 63 aa, Heterodera glycines
  Coding regions on vcDNA: vcDNA=SeqID_59893; Strand=+; Position=1-193
VLSIYSKWIIIIAIFRLFSYFSSNSITLYFSFSCGPSTETVVVFSWTHSFTSSNFCLIVGSTD

SEQ ID NO: 133471 - protein, 53 aa, Heterodera glycines
  Coding regions on vcDNA: vcDNA=SeqID_59894; Strand=+; Position=1 -42,916-1035
MAEIDWIDEYLGKKLFGSRHAAAATARDLTKCAALALLCSIHKQYKKQSNSNG

SEQ ID NO: 133472 - protein, 45 aa, Heterodera glycines
  Coding regions on vcDNA: vcDNA=SeqID_59895; Strand=-; Position=1-153
MFRPFVILAFCLFFLCAVDRSNAGGMFEDLLEGISDKFSEGLKSM

SEQ ID NO: 133473 - protein, 346 aa, Heterodera glycines
  Coding regions on vcDNA: vcDNA=SeqID_59896; Strand=+; Position=1 -22,105-238,352-435,524-649,753-955,1022-1097,1170-1565
MVGMRPEEVQTKRSQKRKASVNTALSEAEIQTNAKKKKQQKIGTKIENEKQMKKNLALAKDEPIASVLSSQQSLITLVKSGDQCLVKKLDICQLCEIFEQEKALFEECLLNDATVDGERLFMQCQISLDDRQQIVLSWLILESAFCTLNCGGIQTNRAYLPEKGFVELHVDGLTEFYKSKFALEAKSLASFALPIGKFFLESLCRSLQMSHFKGREKDAIFALLLLNAQPNFASTSDPKVVSCREQLKRQIFKEVLLDETVSQNGGISSGQTVQNEQKKKMKTEKEAKKLTEKTQKQNGEGKRRRDGTGGEEEAEIGKGKKEKEKQMEEQKEKVGAISNCEKKDHH

SEQ ID NO: 133474 - protein, 70 aa, Heterodera glycines
  Coding regions on vcDNA: vcDNA=SeqID_59897; Strand=+; Position=1 -70,184-326
MASSLTIEKRCKLFNTKQMECQFDGTEAGKCAFCVKLPCKFGAVNCAEEVSISCVNPQELEKCCKGNLHV

SEQ ID NO: 133475 - protein, 34 aa, Heterodera glycines
  Coding regions on vcDNA: vcDNA=SeqID_59898; Strand=+; Position=1-105
FLVDRNGNVVQRYSPNTEPRDIEADIEKLVAAAA

SEQ ID NO: 133476 - protein, 22 aa, Heterodera glycines
  Coding regions on vcDNA: vcDNA=SeqID_59899; Strand=-; Position=1-67
MSTSSSLFLVVVVLASLLISAN

SEQ ID NO: 133477 - protein, 191 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  Coding regions on vcDNA: vcDNA=SeqID_59900; Strand=-; Position=1-580
  Homolog annotation: Hit_ID=BAB33421.1; Match level="QueryCoverage =93%, HitCoverage=63%, E-value=4e-69, Identity=75%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDEPPQSNSPPDTVIG

SEQ ID NO: 133478 - protein, 56 aa, Heterodera glycines
  Coding regions on vcDNA: vcDNA=SeqID_59901; Strand=-; Position=1 -61,106-215
  Homolog annotation: Hit_ID=CAF97483.1; Match level="QueryCoverage =78%, HitCoverage=9%, E-value=4e-09, Identity=63%"; Hit description =unnamed protein product [Tetraodon nigroviridis]
METNNMLYLVTEYAPNGEIYDLISKQKKLSEEMAKQKFWQLFRAWISAQLNMCTGI

SEQ ID NO: 133479 - protein, 118 aa, Heterodera glycines
  Coding regions on vcDNA: vcDNA=SeqID_59902; Strand=-; Position=1-358
  Homolog annotation: Hit_ID=NP_507880.1; Match level="QueryCoverage =56%, HitCoverage=16%, E-value=8e-15, Identity=53%"; Hit description =sulfotransferase ST1B2 (5U596) [Caenorhabditis elegans] emb|CAB60475.1| Hypothetical protein Y113G7A.11 [
NGESFVRKGTSRDWKNYMSKEQSDRMGRAFRQKLAGTVAENWWRTEMRWNEAEEEEEEEKKEEKENEQEQREAKKKEEDDSGMESGDDLLERSAKVSDDSLRLNGSPAPQGPTTTDSK

SEQ ID NO: 133480 - protein, 103 aa, Heterodera glycines
  Coding regions on vcDNA: vcDNA=SeqID_59903; Strand=-; Position=1 -154,357-465,665-713
MHKNRKICTKKHENYGSLIIIINLLHISWINKFHKFHVKCFVTDSAVIITLYDDEVVEETQTTTASGAESIVGQPKAIEQMAGNPLANYHWWISTRLAMDKLK

SEQ ID NO: 133481 - protein, 49 aa, Heterodera glycines
  Coding regions on vcDNA: vcDNA=SeqID_59904; Strand=+; Position=1 -82,591-658
MIGEQTLCELMEWTKLEMHTNGKKKKRHFGGLIPWGIGISDDGLPMPST

SEQ ID NO: 133482 - protein, 50 aa, Heterodera glycines
  Coding regions on vcDNA: vcDNA=SeqID_59905; Strand=+; Position=1-151
SLSDFITAFTRDIDKQLDIGRAEHLQKSRKRPQRYIIKEQNVVRILDEAD

SEQ ID NO: 133483 - protein, 113 aa, Heterodera glycines
  Coding regions on vcDNA: vcDNA=SeqID_59906; Strand=-; Position=1 -54,470-757
MSQLCCLNCRKPTSTNMTKTVKLFVPLFRVSEQGRAAQILLQRPHQAGVRKFHAQGRGNGHRCERDRQSVHKDEAPAAMYVSADREFSKPQRGHEIPEKSGILGPYVRPVTGF

SEQ ID NO: 133484 - protein, 16 aa, Heterodera glycines
  Coding regions on vcDNA: vcDNA=SeqID_59907; Strand=-; Position=1-49
EAIPEGFGLPINLGAS

SEQ ID NO: 133485 - protein, 75 aa, Heterodera glycines
  Coding regions on vcDNA: vcDNA=SeqID_59908; Strand=-; Position=1 -132,616-711
MSENEIYYRKCRNTEITTPKMSKTGIPTPKKYVFVRVRHQQQNWQTPKVNNRAVHQSLMPKEYMDQQQKLMKSVK

SEQ ID NO: 133486 - protein, 15 aa, Heterodera glycines
  Coding regions on vcDNA: vcDNA=SeqID_59909; Strand=+; Position=1-47
MGHSVTLWTQMEMAM

SEQ ID NO: 133487 - protein, 229 aa, Heterodera glycines
  Coding regions on vcDNA: vcDNA=SeqID_59910; Strand=-; Position=1-687
MPSKDNKGTNRGLLSTGGGTATQTQKGVGTSSNNPAGPTRSFFGINMLSNSLSINSNLELFGEESVYAFDDWAERFKDYLSVSGKNLTEGEKVTRLKLALKDTPRTLFKELEADQIVTLTSALDALRAKLDSPQRRELAKRTIALCRQREDETVGQFLRRMTPLVESSNPSLSGDQRKEKVCEEFLDRLKPNMSFLIRLVGLTQAKNLELVKAQAEELEALFLASKGDD

SEQ ID NO: 133488 - protein, 30 aa, Heterodera glycines
  Coding regions on vcDNA: vcDNA=SeqID_59911; Strand=+; Position=1-154
LIVQNDKIIDNPSVNRSISIFYVRNLFIYK

SEQ ID NO: 133489 - protein, 293 aa, Heterodera glycines
  misc_feature (107)..(107): Xaa can be any naturally occurring amino acid
  Coding regions on vcDNA: vcDNA=SeqID_59912; Strand=+; Position=1 -322,1145-1705
  Homolog annotation: Hit_ID=NP_957707.1; Match level="QueryCoverage =94%, HitCoverage=97%, E-value=3e-58, Identity=48%"; Hit description =keratin complex 1, acidic, gene 9 [Mus musculus] gb|AAR89518.1| cytokeratin 9 [Mus musculus]
RGGGMGGGMGSGMGMGSGMGMSGMPGGGMGGMSGGSYGSSGYGGNSGYGGSSGYGGTSGGSYGGNSGYGGSSGGSYGGNSGYGGSSGGSYGGNSGYGGSSGGSYGGXAGGYGGGSYGSGSYGSGVYGATNFGSGFGSNGGVYGTSGSYGGKSYGSGSYGSSGYGGRNYGSGGYGSSSYGGRSYGSGSYGSSGYGGRNYGSGGYGSSSYGGRSYGSGSYGSGGYGGRNYGSGGGSSSYGGRSYGSGSYGSSGYGGRSYGSGGYGGRNFGNVGFTAGRGTMAMVAVTVVADMANS

SEQ ID NO: 133490 - protein, 54 aa, Heterodera glycines
  Coding regions on vcDNA: vcDNA=SeqID_59913; Strand=+; Position=1-162
TQFIFLLALLPFLLVPICCEQCSWDDVNNICVGDCSSLCVLKDFDNCNCNRLPK

SEQ ID NO: 133491 - protein, 25 aa, Heterodera glycines
  Coding regions on vcDNA: vcDNA=SeqID_59914; Strand=+; Position=1-76
SKSSLTTAQKNMFFVRFRPRGSQEK

SEQ ID NO: 133492 - protein, 62 aa, Heterodera glycines
  Coding regions on vcDNA: vcDNA=SeqID_59915; Strand=+; Position=1 -82,191-297
MTTFRRGRTDSKKGKATTKSSSNQCSKCGPMGEGVLTGPIDLAELISDIDMAYNITCLLVKT

SEQ ID NO: 133493 - protein, 22 aa, Heterodera glycines
  Coding regions on vcDNA: vcDNA=SeqID_59916; Strand=-; Position=1-66
MAISFFEKFSMQQTLSNMKRSA

SEQ ID NO: 133494 - protein, 29 aa, Heterodera glycines
  Coding regions on vcDNA: vcDNA=SeqID_59917; Strand=-; Position=1 -66,123-146
MAISFFEKFSMQQTLSNMKRSAKNGYLFF

SEQ ID NO: 133495 - protein, 29 aa, Heterodera glycines
  Coding regions on vcDNA: vcDNA=SeqID_59918; Strand=-; Position=1 -66,123-146
MAISFFEKFSMQQTLSNMKRSAKNGYLFF

SEQ ID NO: 133496 - protein, 29 aa, Heterodera glycines
  Coding regions on vcDNA: vcDNA=SeqID_59919; Strand=-; Position=1 -66,123-146
MAISFFEKFSMQQTLSNMKRSAKNGYLFF

SEQ ID NO: 133497 - protein, 16 aa, Heterodera glycines
  Coding regions on vcDNA: vcDNA=SeqID_59920; Strand=+; Position=1-50
LTHGMQEHTVIVYTKV

SEQ ID NO: 133498 - protein, 92 aa, Heterodera glycines
  Coding regions on vcDNA: vcDNA=SeqID_59921; Strand=-; Position=1 -26,84-221,278-438
APPAENALRHIAVIAHPPAEKRKAQDRSQFALLRHAFPPLRPPPLHSHIPHKNPQSVYQRDENSQHFYDYWSAAPPPNVCCVKNNSLHFCGQ

SEQ ID NO: 133499 - protein, 76 aa, Heterodera glycines
  Coding regions on vcDNA: vcDNA=SeqID_59922; Strand=+; Position=1 -124,216-277,560-604
MADFVRPFGPYFGQIAFGFTHFGLSAEQLKGHRSRSNWKSQKTKKLTNFAREQNQKMRRKRKTDREHLGLSNDIKN

SEQ ID NO: 133500 - protein, 36 aa, Heterodera glycines
  Coding regions on vcDNA: vcDNA=SeqID_59923; Strand=-; Position=1-109
MAQKDGQNQPSVQRHDNDHQNVADQKLNSVQQHIKG

SEQ ID NO: 133501 - protein, 105 aa, Heterodera glycines
  Coding regions on vcDNA: vcDNA=SeqID_59924; Strand=+; Position=1 -163,748-844,901-958
SASSATRGLPPASVNRCGPKTLNQAPNLNIAEHLNGFRGTTQIGSNSKAYRQMTLFVCRCQKWHFALRVEYGPCQFDESAGGHSLLMFALIILSFICDLENLIGY

SEQ ID NO: 133502 - protein, 591 aa, Heterodera glycines
  Coding regions on vcDNA: vcDNA=SeqID_59925; Strand=-; Position=1 -59,103-658,705-881,1251-1526,1573-1772,1816-2208,2259-2373
  Homolog annotation: Hit_ID=NP_001004509.1; Match level="QueryCoverage= 99%, HitCoverage=48%, E-value=3e-35, Identity=29%"; Hit description =si:busm1-180o5.3 [Danio rerio] emb|CAD60788.1| novel protein similar to DNA polymerases [Danio rerio]
MEDYAPGSMNKEKYAKFEKWYNENKETPFYLNDELMNYCRNDTEILLLSIIEFRRILINDITKGFDPLPRSCTNAGVAMNIFKAMFLLNEQLSIVPDKGYERCDRASVVAIKYLEWRSQRDGVEIRHAGNGREVKVGKYKLDGFIVNEGTMDKCIEVMGCYIHGCLNCYDPAAELIGGRTAQELNDETQERLAELWKTLDVEEVWGCQIEKELKKDEEMRDFFADRGNEKGPIDPRMAYAGGRTGPMKLFAKSDEKKKISVYDIAKALECGYTVDRFYRAWHYEEEANDLFKGYVRLFLKLKEEASGFPKGVETGEQKDMWREEYKEKYGIDIELAKVKKNPGLRYISKLMLNSLWGKFSMRNCLNKNAVIDRASEFYKIACDHKIELCDIVEYSDEAIRLIYRDKEDFVMEHKSSNIVISLWTTSMARLKLLEFMREAEGNGGEILYTDTDSIFVRHDRDVEPITTGKYLGEMSEEYGGYEIEEYCCGGAKQYALKMRNKQTGDIEYVMKIRGITFDVDNRKTLHYDTFREMVLNYGKGEVDPAFFVYKNDFGPTRDSKVVTREKHKMYRPVCQKGIIDEELNVMPFGFC

SEQ ID NO: 133503 - protein, 530 aa, Heterodera glycines
  Coding regions on vcDNA: vcDNA=SeqID_59926; Strand=-; Position=1 -74,130-600,992-1199,1242-1802,1866-2127,2178-2194
  Homolog annotation: Hit_ID=NP_507780.1; Match level="QueryCoverage =45%, HitCoverage=20%, E-value=2e-09, Identity=22%"; Hit description =predicted CDS, DNA polymerase type B, organellar and viral family member (5T899) [Caenorhabditis elegans]
MAAKRNGTSQQSGPSTKKWDFRSIGNNFIEEMETFKLMDYRSTICEKFGFTKNIAEFTINPDVGRPDEAIKDAVDNMIKVAFKTTEEKMNRKVRMFGVVITGAGLAFPVWVPYRAFPQNNADVILEEINKLGQSGDGDENKKMLLLSEQITMKITCVTMPGGEGPRNVHKFDFGFKEHQRIRISNGDKFCLFYALASSMNYLVMDKYSFIRFMKNVVRQKETAYELLRNCEINGNEMNYGVEHLSSVQNYWDEIYPSKYRVVAFEKSADPRKSIRVLWKGPMGRENVVPIFLENGHWDGLKNYVCFFNRGRKFCIDCECFYSRDVYHTLECRARCYYCNRVGGMPCEKESGVKIECPKCRRYFYNWECYNYHHGHQTCNLWRRCVMCDKTYLFNPKKGHECGETYCQLCSVCHDPKRGCYIMPIEEKEEKDVYRIVVWDSETSQDTMYKGDQKEHIIKYISVRVTCTECCDDKNRTNCKICGDERTKDWSEAEGHEPTKDFVEWILMAFTNYDTYIFAHSAGRFDGHFCI

SEQ ID NO: 133504 - protein, 695 aa, Heterodera glycines
  misc_feature (3)..(3): Xaa can be any naturally occurring amino acid
  misc_feature (223)..(223): Xaa can be any naturally occurring amino acid
  misc_feature (283)..(283): Xaa can be any naturally occurring amino acid
  misc_feature (532)..(532): Xaa can be any naturally occurring amino acid
  Coding regions on vcDNA: vcDNA=SeqID_59927; Strand=+; Position=1 -934,1021-2145,3683-3722
  Homolog annotation: Hit_ID=NP_496808.1; Match level="QueryCoverage =98%, HitCoverage=30%, E-value=4e-88, Identity=31%"; Hit description =integrase, catalytic domain containing protein family member (2N547) [Caenorhabditis elegans] emb|CAB0249
DPXGVLGPCIFPTNRLFQELWKEGHSWDDALSEEDSIRWNSIQSQWKEEEIRIPRRAMLNDTQSIELHAFVDASVHTFATAIYVRCAMNEKIQALIFSKNRLKPKSASTLTIPRMELLAILVGTRALKFAQRQLRRPIASLHLWSDSQIALSWVKTHETQPQFVERRLKEIRECGCTFHFVRTADNPADLATRGATPSELRNHHLWWKGPTWLTQESHLWPNXLCFQVTESDQQISENVGPSGAFLAYTHSKQPNEQVLIDPSRFSSWKRLMRTTMFVDSSPXCLKGARKRLLHLRSTERKFARFPSHFKTVIGDDGILRLKTRLEMSEKPYSFSHPILLAKHSALAKLIILDRHQKRHHLGVDTTLTEFLSEFWMPSARLNVKRALRDCLFCRRMNAQQFALPTMPPLPGERVRRHAPFQSIGIDYLGPTTISLAGEKIKAWILIITCLATRAVYLEATLDLTSESFINVLRRFISRRGKPDIIWSDNATTFKLAQKTLELLSAPGPDQEVQNFLTHNRIQWRFIAQISPXAGGFYERLVKLVKDCFKRTLGRRILSFDQLNTFVAEVEATLNYRPITAVSDAVDGPIPLRPINLLQPEIQINWETTTDPIDSEEQFSSTHERLASRIQALREANDVFWAKWHSEYLTLLRERAQWDHKGPRLQNFGEPKEGMVVLISQDLLLPGRVLKWHNIS

SEQ ID NO: 133505 - protein, 27 aa, Heterodera glycines
  Coding regions on vcDNA: vcDNA=SeqID_59928; Strand=-; Position=1-83
SHFRLIKRAPFSLYAHFHISIHSFLLL

SEQ ID NO: 133506 - protein, 450 aa, Heterodera glycines
  Coding regions on vcDNA: vcDNA=SeqID_59929; Strand=+; Position=1-1353
MAENNGRQAPLQRGERAMDYGRPNSPDGSFENRPRRAVPNRPMRRWQNGLFIVAVALCLGNLAEGKEFPSPRTCHQPLEAADMARENQWGFSPMPFPWPFSHDQKANLIKGPRPLNGSQPYIKAGIFHVPTSFHTPTMPKPIKMPSSSPSAYSSSSSLASSPDRQSPPPPRKKAVELFNIAAATPERDAKSGRNFSVRDFIDAEAKEESSSKRMPTCSACQLSGHRRGAKACPLYVPPQKERTAAASRPGTSNTRRDSPEEGEITADKAGRDRPPVRAPSKGWRAEPSISPPRKTGDTNKQRGRSRTLRHFPMDTILKAMGPIAPIKKIPAQDNTGTVANTQPPKAAADIVAILGELSALRASVAYLTAEQARLAQFIRHRLGTPPNMSGGNAMPCGPGRRRHHQRQPSSEDDEHPTQKRAKHHHHRRSPSPDTQHKPKKERRHHREEFR

SEQ ID NO: 133507 - protein, 111 aa, Heterodera glycines
  Coding regions on vcDNA: vcDNA=SeqID_59930; Strand=+; Position=1 -81,545-711,1219-1306
MAKDWGQIEEDEKIGDEYDQSADEDGQFLYTFNGIACVRDPDRVSFLNTDFGIPLRFSVFKKLYLSESRIFNLGGTRTENKHCSTSLNPEFSIPAGPGQKISTGKNGDYSN

SEQ ID NO: 133508 - protein, 477 aa, Heterodera glycines
  Coding regions on vcDNA: vcDNA=SeqID_59931; Strand=-; Position=1 -270,1069-1112,1226-1378,1579-1722,1777-1842,2171-2405,2710-2866,3332- 3567,4408-4538
  Homolog annotation: Hit_ID=AAB40605.1; Match level="QueryCoverage =46%, HitCoverage=51%, E-value=9e-17, Identity=32%"; Hit description =cathepsin B-like cysteine proteinase [Ascaris suum]
NKAKSREYHAKHQLFLEDFKHLFYNKEHGIWYDFNLESGTSNEAYYGSAAMPLFTRCYDVSDLGTAERMFARMERLDTATNRKLISHPFADAATPGRGGEYNVQVFGVADHESGILLGQFRILDPTSKHVFMTFGNIKNFSKKEEGQSTVLPNVQFNFGWTIGTVLDLLVTYSDELALSTDTTTVYCLEQKIEEEPNEFPNNFSEYRAERLTAAQKEVDMMNTSWAVVNERFALMKDEDFLNFFGTPVDETVEEDKNENNNIHLRSELKAADGEEDKNDLPTEFDAREAWKDCAEIIQSGYAQGDCGSCWAVTAARTLTDRICIARLKKGKKTNSSDPRAYVSAQFTMECTPDTKGCGGGNPFYAWKYYRNLTVSGTNHTMNTGCKPYKMPSKSNCVFSCNKEWLQQQYPNKAKTPKTPGGIPLFGTTWEVFLAEATRMPVITGLTQHRNTQNFVRHSESVNFLYTKLTFISFIVRC

SEQ ID NO: 133509 - protein, 32 aa, Heterodera glycines
  Coding regions on vcDNA: vcDNA=SeqID_59932; Strand=-; Position=1-96
MVAWKTLLNVFEKCEETLGESLYEVGPMDGTS

SEQ ID NO: 133510 - protein, 263 aa, Heterodera glycines
  Coding regions on vcDNA: vcDNA=SeqID_59933; Strand=-; Position=1 -244,289-420,463-878
  Homolog annotation: Hit_ID=NP_001004509.1; Match level="QueryCoverage= 98%, HitCoverage=17%, E-value=5e-16, Identity=23%"; Hit description =si:busm1-180o5.3 [Danio rerio] emb|CAD60788.1| novel protein similar to DNA polymerases [Danio rerio]
MEHNKAKRTIAKLCNNSLWGRFSLRNGLSKTKITDSPAMLRSLLDDPKIEVSSVDLLNEETVLITYSAVTEFIEEHGCSNIVLSLWTTSAARLHLLSLMQRVVRAQNSLLIYTDTDSVVLAYKETDGCPLTTGPHLGDLSDEYPGHELLEFVSGGCKQYALRMRSKRTGEEDTVLKVRKITLCADACRLLHFSAFKQTVLRYDTAEEEEDAFEEIIIDYPNQLGPNIREGAVQSVSILKRYRPVVTKGIVSENFTVRDFGFKL

SEQ ID NO: 133511 - protein, 23 aa, Heterodera glycines
  Coding regions on vcDNA: vcDNA=SeqID_59934; Strand=-; Position=1 -25,616-662
MLVRLQYDVKKIFGNTFKIMLMN

SEQ ID NO: 133512 - protein, 372 aa, Heterodera glycines
  misc_feature (254)..(254): Xaa can be any naturally occurring amino acid
  Coding regions on vcDNA: vcDNA=SeqID_59935; Strand=+; Position=1 -174,427-599,716-906,939-1094,1409-1547,1755-1992
  Homolog annotation: Hit_ID=CAE64925.1; Match level="QueryCoverage =85%, HitCoverage=85%, E-value=1e-57, Identity=38%"; Hit description =Hypothetical protein CBG09746 [Caenorhabditis briggsae]
VPFPSHFATVSPHFSLFFGSLIAFVTFVGVLANAFVVVAVAGDKKMRRSPMNLLLLNLAVADLLYLLAFTPFWASMSVHGDGGWHFPESFCPIGRYLSNCLLIVSIFTYVAICVERFVAIVHPMHAQVWCTRSRALLAVLGLWTFVMAYQLPYLALFQTQPAPWNGFELLIKYVYQSHPCSRLAGKSSLWRAYKWSRLAGKSSLWRAYKWSEFVLTYALPVLLSASLYARICRVLWAKSAILQNNGRIGISFNXYFKSIANDKARRNVVKMLMVCVTLFFLCYTPMVVYFLWGALFGRPLPLPFEFVFLTSTFVQFQSAFNPFLYTLFATKFREKLAKLVKRKQKQRKDNLRDKNEQKAEGREEKGEKMEQN

SEQ ID NO: 133513 - protein, 267 aa, Heterodera glycines
  Coding regions on vcDNA: vcDNA=SeqID_59936; Strand=+; Position=1-804
  Homolog annotation: Hit_ID=XP_550305.1; Match level="QueryCoverage =89%, HitCoverage=16%, E-value=3e-32, Identity=37%"; Hit description =helicase-like protein [Oryza sativa (japonica cultivar-group)] dbj|BAD68127.1| helicase-like protein [Ory
MCRQIGLGETGEHFWIPPQFLVKSRDELIDFVYPDFQKLLGNDKELLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGIKYERLQFPIKPAFAMTILKGQGQTISTVGIDLERDVFSHGQLYTAFSRATDGNNVRVYAPRRETDGQGQTKVLNIVAKNMLKLQ

SEQ ID NO: 133514 - protein, 60 aa, Heterodera glycines
  Coding regions on vcDNA: vcDNA=SeqID_59937; Strand=+; Position=1 -103,213-292
MAIALARDAGTDQMRANRGRQPMVALCALLAGRAGHSHSSTDDAVGRRRPDSSWEMILQI

SEQ ID NO: 133515 - protein, 67 aa, Heterodera glycines
  Coding regions on vcDNA: vcDNA=SeqID_59938; Strand=-; Position=1 -124,243-322
MAISFFSFFYRKIGTNSIGFLAIIGIGDLIGIGFCLARHIPDPNWSCECSATPRILYTKEWNGGLYA

SEQ ID NO: 133516 - protein, 152 aa, Heterodera glycines
  Coding regions on vcDNA: vcDNA=SeqID_59939; Strand=+; Position=1-464
LIFLPQNWYQQLPSFVWPYQTILRYLKRKQKKFLTKKWLSLFSHFFTANLVPTVAFSCLALSNNLTIFETQTKKILDQKWLSLFSHFFTAKFVPTVAFSCLALSNNLTIFETQTKKILDQKMAISFFSFFYRKLGTNSCLLLSGPIKQSYDI

SEQ ID NO: 133517 - protein, 255 aa, Heterodera glycines
  Coding regions on vcDNA: vcDNA=SeqID_59940; Strand=-; Position=1 -4,123-394,452-742,901-1023,1097-1171
  Homolog annotation: Hit_ID=NP_494441.1; Match level="QueryCoverage =97%, HitCoverage=29%, E-value=1e-77, Identity=57%"; Hit description =coatomer protein complex 1 (107.5 kD) (2D377) [Caenorhabditis elegans] gb|AAD12836.1| Hypothetical protei
MGVPSTVNKLASGALLLIASIIHLGKSGLCKQPITEDDLDRLSTTVRLIVDQWPKAVDVFLRECRASLESMLKAKGDVDRHERDTKAPKKKIPDKTIMFTQLSTRVSENVTDTNLFDLSLSQALGTAPKTTKYTFASSKLGKVIQLAGFSDPVYAEAYVNVNQYDIVLDVLVVNQTSDTLQNLSLELSTATVKVSSTENGVIFSTIAYDVRGSTSDRNCVYLEDIHIDIMDYIVPGTCTDTEFRKMWAEFEWEKQ

SEQ ID NO: 133518 - protein, 245 aa, Heterodera glycines
  Coding regions on vcDNA: vcDNA=SeqID_59941; Strand=-; Position=1 -75,552-769,812-1008,1374-1460,2728-2888
MGQMGEGSDWMELYGPVEPDRHLRWVVRRSMSKIWNYFKKEIGIAFCKNCDYKTNFPPKTPTTTLATHLKHKHSELYKEFTEKTGAAKEQQQTFGIKRAFSSSAGALTSTSLDLTVDEEIEEITLAKKLDEQPKIDRIWTRSPWEMGGERASSVHKRKTSHTPARGFFITNLLSILSNKIQDNKKLATNGSEENFPVFEVKKANLSVGGRSIRGFFGKTPKYAHKICTKCQNMHKYAKYAYRNPF

SEQ ID NO: 133519 - protein, 27 aa, Heterodera glycines
  Coding regions on vcDNA: vcDNA=SeqID_59942; Strand=-; Position=1-84
QKLINQWTTKNFGPLIDGREKCALNAL

SEQ ID NO: 133520 - protein, 45 aa, Heterodera glycines
  Coding regions on vcDNA: vcDNA=SeqID_59943; Strand=+; Position=1 -48,407-496
MAKLMEHFKKGTKCQKYQKNVMKKIAEHGISHQNLYFHEFLFKFI

SEQ ID NO: 133521 - protein, 108 aa, Heterodera glycines
  Coding regions on vcDNA: vcDNA=SeqID_59944; Strand=-; Position=1 -101,165-389
MAQPVEKKKKYSSVDRHLISSAIGERQQQFFRKIWICNDVWMDILPSFDRPQLGLKLALLSDRFDVLVDKHFDAKSELTIWRAIEIRKDKGPSGDDNGPKAKLLALYG

SEQ ID NO: 133522 - protein, 55 aa, Heterodera glycines
  Coding regions on vcDNA: vcDNA=SeqID_59945; Strand=-; Position=1 -68,392-488
MLGNIRRVMREELERVGGARGIGADYVHKSVHLAIMKALLHKNMGLERKLREMDS

SEQ ID NO: 133523 - protein, 96 aa, Heterodera glycines
  Coding regions on vcDNA: vcDNA=SeqID_59946; Strand=-; Position=1-291
MFSNKRKCSFNPDWEKQYNFVKRSRKGNGFFYCSFCQKDFNVESMGVSAIKSHTENRVHKQTDEERRKNTTIESFSRSKLALNSIDRQVATAEGHF

SEQ ID NO: 133524 - protein, 146 aa, Heterodera glycines
  Coding regions on vcDNA: vcDNA=SeqID_59947; Strand=-; Position=1 -70,179-441,616-708,1446-1460
  Homolog annotation: Hit_ID=XP_531619.1; Match level="QueryCoverage =80%, HitCoverage=53%, E-value=5e-12, Identity=38%"; Hit description =PREDICTED: hypothetical protein XP_531619 [Pan troglodytes]
MIKEEPEEEEEGEFGYPEQENLPDEAAENGLVPQHGPAALAPFVAQNWDAMPPQPQQQMAMAFAQPFLPPMGMPPPMGMPPPMGFPPPVPFVPLFANPPLPMPYPPPPIPQPIPIPPARPLYGAFNAPQMRPPPLINMPFAPIKNG

SEQ ID NO: 133525 - protein, 68 aa, Heterodera glycines; identical to SEQ ID NO: 132170
  Coding regions on vcDNA: vcDNA=SeqID_59948; Strand=+; Position=1 -94,185-297

SEQ ID NO: 133526 - protein, 183 aa, Heterodera glycines
  Coding regions on vcDNA: vcDNA=SeqID_59949; Strand=-; Position=1 -24,70-197,248-411,472-538,585-753
MADLNNGTFYLAYKNAKPSWALISCAFIFGIIAAFGIIFNVSVIFVTIRTKQFRGTVNYLLALCSFFELLHQQGHFLFVYTTFSGQNFIPYRLATKIELISMLGICGIYPTMLFTGIDRLIGVIFDEKHRKTKIRLYLATITIVWVAFCFDLCKSLYQSIELIGDQMVTGCLIDIIKVSKFFY

SEQ ID NO: 133527 - protein, 26 aa, Heterodera glycines
  Coding regions on vcDNA: vcDNA=SeqID_59950; Strand=-; Position=1 -37,366-409
MEHQTFMKWSGQENEKHHTGSRITAQ

SEQ ID NO: 133528 - protein, 117 aa, Heterodera glycines
  Coding regions on vcDNA: vcDNA=SeqID_59951; Strand=+; Position=1 -74,1067-1131,1793-2007
MVKKYEKYSIPWGTEPKRKIMKVRSHPIWQIGLFKRIKEDSVDCLECLFFYNKIAKCPALRPLLVVMEEKGKVNAPQVQLRSSRSTNLNGIRFEALPSRRAAVRPPFWALSIQLIGF

SEQ ID NO: 133529 - protein, 186 aa, Heterodera glycines
  Coding regions on vcDNA: vcDNA=SeqID_59952; Strand=+; Position=1 -107,249-384,652-966
  Homolog annotation: Hit_ID=NP_490962.1; Match level="QueryCoverage =99%, HitCoverage=22%, E-value=4e-57, Identity=55%"; Hit description =DNA replication licensing factor Mini Chromosome Maintenance, abnormal cell LINeage LIN-6, LEThal LET-358
INQLVTTQGMVTRISPLIPQMVEGYFQCSFCNYPVVRKVDMGVVEEPINCINCNNQGCFQLIHNRSTFMDKQVIKLQEIPGDMPAGQTQHTVTLFVHGALVESVHPGDRITVTGIYRASPVRLNPVQRAVHAIFRTSMDVIHFRKMCQDRLHDVGDGTFLTEERVAKIKALAQCEDVIERLMQAIE

SEQ ID NO: 133530 - protein, 45 aa, Heterodera glycines
  Coding regions on vcDNA: vcDNA=SeqID_59953; Strand=-; Position=1 -52,315-400
MSITQNKVHIRDQRPKLRITFFILIVEMHNKNHKILPIFLHFLII

SEQ ID NO: 133531 - protein, 233 aa, Heterodera glycines
  Coding regions on vcDNA: vcDNA=SeqID_59954; Strand=-; Position=1 -121,170-252,301-432,687-776,841-1002,1047-1157
  Homolog annotation: Hit_ID=XP_308227.1; Match level="QueryCoverage =98%, HitCoverage=75%, E-value=1e-73, Identity=46%"; Hit description =ENSANGP00000021523 [Anopheles gambiae]
MSISDVAKRPSPVRMEGSLIEPGCFTGRTMAVFTSGGDSCGMNSAVRSVVRTGLYFGCRVFFIKEGYQGMVDGGENIVEAHWNSVSDIIQSGGTIIGSARCKEFREHDGRLKIVGLVGSIDNDFCGTDMTIGTDSALQRIVEAVDAVVSTAQSHQRAFVIEVMGRHCGYLALVAALACEADYCFIPEWPQPKKWEEVLCAKLTNSRELNQRLNIIIVAEGAIDEEGKVITSEM

SEQ ID NO: 133532 - protein, 48 aa, Heterodera glycines
  Coding regions on vcDNA: vcDNA=SeqID_59955; Strand=+; Position=1 -46,288-388
MTFYASLVGYTGRNNKILSVKSAFGILMSKSGTVNDILCFSCWIHGKK

SEQ ID NO: 133533 - protein, 40 aa, Heterodera glycines
  Coding regions on vcDNA: vcDNA=SeqID_59956; Strand=+; Position=1 -46,200-276
MTFYASLVGYTGRNNKILSVQSAFGILKSKSGTVNDILCF

SEQ ID NO: 133534 - protein, 80 aa, Heterodera glycines
  Coding regions on vcDNA: vcDNA=SeqID_59957; Strand=-; Position=1 -92,151-301
MLRFGQFSDENKFHAIKEEIKKKDKYSAKVSWKKEFNLMKRKKNRMNYYEKKKREFVERIDELRICPKKENIKNLPKNWA

SEQ ID NO: 133535 - protein, 49 aa, Heterodera glycines
  Coding regions on vcDNA: vcDNA=SeqID_59958; Strand=-; Position=1 -65,122-206
MPFLIFVFVLSFIIIQLKKLYHQKWDKEKIEFENEIDQNANYRKSDKMN

SEQ ID NO: 133536 - protein, 204 aa, Heterodera glycines
  Coding regions on vcDNA: vcDNA=SeqID_59959; Strand=-; Position=1 -58,477-1033
  Homolog annotation: Hit_ID=XP_146481.3; Match level="QueryCoverage =68%, HitCoverage=8%, E-value=7e-09, Identity=27%"; Hit description =PREDICTED: similar to carboxylesterase 2; carboxylesterase ML3; acylcarnitine hydrolase M1 [Mus musculus]
MNGWEEKGTNWAKKWQIERDSESIQETIFMEENDTDRYEDDYDNDDDGNDDELDYEYEDIAVTDKTAFFGHFDSIKSDNETFEETEEEQQNESVEEREEQFEGQRWKLRERKEKEEAGKDGEKQEKEEGKCEKGWLNYRNELCFYGRRTEKDFYAGVEECAQMKVNGGWKAAAGMPICVILLFRQISLPSTVWTSSPSSLSTGT

SEQ ID NO: 133537 - protein, 30 aa, Heterodera glycines
  Coding regions on vcDNA: vcDNA=SeqID_59960; Strand=+; Position=1-97
LQNFFKIKNHDNFLSGVLKVANHESDMYFD

SEQ ID NO: 133538 - protein, 173 aa, Heterodera glycines
  Coding regions on vcDNA: vcDNA=SeqID_59961; Strand=-; Position=1 -123,363-496,752-869,1591-1734
  Homolog annotation: Hit_ID=BAA04539.1; Match level="QueryCoverage =77%, HitCoverage=18%, E-value=6e-09, Identity=32%"; Hit description =caldesmon [Gallus gallus] sp|P12957|CALD_CHICK Caldesmon (CDM) pir||A33430 h-caldesmon - chicken gb|AAA488
RWKRELDKRMAQRKAAEKRAAETLAEQEKRKKEEKRADAEKTFEHWKRTEAQRVRRQRERAQSAVQQREADERRRKEANRTKADSALTKCAPKREGANGARARGTDGTRAEGGDGKAEERSGARGAEERRYTQSLAYRILDFERKASQRWCSAPWLPTSPSTTTKICRPPPGK

SEQ ID NO: 133539 - protein, 252 aa, Heterodera glycines
  Coding regions on vcDNA: vcDNA=SeqID_59962; Strand=+; Position=1 -285,379-501,547-644,751-1003
MQTVSEEKPKTVTFAMQTDQTDLVNSEMQTETAEKPKITNKLITTEAQTEPEEKPKTFAFGLQTDQTGLIDSEMQTLSEEKPKMTNDEVLELNVSKLPMDADSSFLSNQGRSSPLLDESLRRKYNEKCEEMAELRYAYEFQQSIISNQLDEIARLKQQQQLRNGVQKNGSPSSTRHPTITAASPSSVFPSGALPTISGRPRAARRTYCEHCEMFDAHDSSECPKEEAKRAERRDHEALSPQKWDERERTFWH

SEQ ID NO: 133540 - protein, 42 aa, Heterodera glycines
  misc_feature (37)..(37): Xaa can be any naturally occurring amino acid
  Coding regions on vcDNA: vcDNA=SeqID_59963; Strand=+; Position=1-133
ISKMNGSLTNGNKVDRGVTILLGAQWGDEGKGKVLDXLIGHH

SEQ ID NO: 133541 - protein, 162 aa, Heterodera glycines
  Coding regions on vcDNA: vcDNA=SeqID_59964; Strand=+; Position=1 -128,274-440,983-1116,1395-1455
  Homolog annotation: Hit_ID=NP_499155.1; Match level="QueryCoverage =100%, HitCoverage=68%, E-value=4e-38, Identity=48%"; Hit description= Dephospho-CoA kinase (27.4 kD) (3K840) [Caenorhabditis elegans] emb|CAA81598.2| Hypothetical protein T05
VEPGKKAYNRLRAEFGDSFFDDENGGVLRRDKLAELVFTNVEKRKRLNAITHGEVIKEMIKRILWEAVHLRKFIFLDIPLLYETKMDRFVQKTIVVACNDDTQLWRVALRDELATDEAEKRIRAQMPMEEKARKASFVIDNNGSLEETEQQLDAVVELLESS

SEQ ID NO: 133542 - protein, 139 aa, Heterodera glycines
  Coding regions on vcDNA: vcDNA=SeqID_59965; Strand=+; Position=1-420
MEVDEEDDDKTFDWDVLCAEDQDDHEFCAVLRVSELVPALGNAELGTMAVKTPLHALLAVFLLKAGTVKSMTAARSLVKAIIEGEPKEEIRLFVAKKGDFVATGQYPTEKDQKKALECFFEKCLVARRALEKANLRRLA

SEQ ID NO: 133543 - protein, 103 aa, Heterodera glycines
  Coding regions on vcDNA: vcDNA=SeqID_59966; Strand=+; Position=1-312
MGVRTIEGKNRAQASKLMAHPRIIIGDQSAHQLAEILDQTAVIGPKNGTLAETVRTLKPVVLSSKVKAALIIAGRDSLLRVETVEMMMEQYEMIANLCAVLHM

SEQ ID NO: 133544 - protein, 121 aa, Heterodera glycines
  Coding regions on vcDNA: vcDNA=SeqID_59967; Strand=-; Position=1 -71,142-436
MVKSQLITTSPSQQKRRPCRSIERRRGCLHCCTGGGDLGGLFLRTCGVDGHPDQSSPNHGDADHDNRSNQWCGADGPPDQSSPNSKCSAVGGHPDQPKQRRELPTELSEFSIFDHPGSLTE

SEQ ID NO: 133545 - protein, 111 aa, Heterodera glycines
  Coding regions on vcDNA: vcDNA=SeqID_59968; Strand=-; Position=1-336
MKLHLLLVLIIFLIIEIDQIKTEKKKLQQKSFDEIFGEKREEKEEERRNELKKREIIAKFYKIKEKIKQKGRKYSTKEWEKIELKIAKKLGTNRTTIYKWIKELGLKKKLF

SEQ ID NO: 133546 - protein, 316 aa, Heterodera glycines
  Coding regions on vcDNA: vcDNA=SeqID_59969; Strand=-; Position=1 -259,584-1275
  Homolog annotation: Hit_ID=NP_701067.1; Match level="QueryCoverage =94%, HitCoverage=35%, E-value=5e-12, Identity=24%"; Hit description =hypothetical protein PF11_0207 [Plasmodium falciparum 3D7] gb|AAN35791.1| hypothetical protein [Plasmodiu
MGTYRKNIYEWIKELGLQKQIKKSYKSKTDEEKLEIVQKFIEMANELKEKRKYSTKEWKQNYAEICKKIGVSQRIIEKWKKQFAIRKFKKKMKLHLLLVLIIFLIIEIDQIKTEKKKLQQKSFEEIFGEKWEEKEEEKRNELKKREIIAKFYKIKEKIKQKGRKYPRKEWNKIERKIAKKMGTYRKNIYEWIKELGLQKQIKKSYKSKTDEEKLEIVQKFIEMANELKEKRKYSTKEWKQNYAEICKKIGVSQRIIEKWKKQFAIRSIKLTEKEKMEKMKIYWEIKRENPKMSDKEIAKMMKIDRKNISKWKKLFG

SEQ ID NO: 133547 - protein, 47 aa, Heterodera glycines; identical to SEQ ID NO: 127360
  Coding regions on vcDNA: vcDNA=SeqID_59970; Strand=-; Position=1 -610,913-1064

SEQ ID NO: 133548 - protein, 215 aa, Heterodera glycines
  Coding regions on vcDNA: vcDNA=SeqID_59971; Strand=+; Position=1 -424,1055-1207,1260-1330
MCYTVSTQNSFSITDFSTIKADTEHPAAAAVVDNFETLTLRFFDLINDGNIQQLRVLIDSLDADELNILLWWTVDPVERDNTRSRSALWTAFLRQHIQIVDLLVVNEQFYPSALIFVCHFQLEKGADPDEPVADQVNNINTRYFPLIDAAVGGSLEVCRLLVEEWAADVNQQTIQERYTPVICAASKGHLAIVNFLVEHGADLQHVDVDGHNALM

SEQ ID NO: 133549 - protein, 18 aa, Heterodera glycines
  Coding regions on vcDNA: vcDNA=SeqID_59972; Strand=+; Position=1-55
MDKDSEVSGIGKGQMDKD

SEQ ID NO: 133550 - protein, 248 aa, Heterodera glycines
  Coding regions on vcDNA: vcDNA=SeqID_59973; Strand=+; Position=1 -153,201-545,596-843
  Homolog annotation: Hit_ID=NP_001004509.1; Match level="QueryCoverage= 96%, HitCoverage=15%, E-value=6e-17, Identity=26%"; Hit description =si:busm1-180o5.3 [Danio rerio] emb|CAD60788.1| novel protein similar to DNA polymerases [Danio rerio]
MQTIFLLSSCFDGHRPQMCNLIKRCDECNRTFQVDRKNPHKCYSNYCARCKVYHEKEGACFIKPIVVPDEKPKYRMVCWDTETRLEQLQQAGQQRHKVNYLSARITCTECCDSENGMRLNCKICLTTYGAMERTKDWSESEGHEPISAFVEWILKAWDNKYQTFIWAHNASRFDGHFVLKYLGETKRRPEVIMNGLKIFEFRLQHSRRHSKLTWRDSCLLMPIRLEEMPKTFNLNCADKPFFPYAFNR

SEQ ID NO: 133551 - protein, 95 aa, Heterodera glycines; identical to SEQ ID NO: 124528
  Coding regions on vcDNA: vcDNA=SeqID_59974; Strand=-; Position=1-703

SEQ ID NO: 133552 - protein, 191 aa, Heterodera glycines
  Coding regions on vcDNA: vcDNA=SeqID_59975; Strand=+; Position=1 -381,1741-1935
MEPKFASILSELHSLNKSVEELKRTVATVHTPPQRRGLISVPGMVGSTGSSGSSTTKQTMLNGCQNYAKAPVSTGGSATPTKIAFRPYPMNNGSLRYQQHNNAKAPAENTVNLEIGRQTAQQQQQHQLLTSKLFASSYSELPANLLLAENGQYDEDDEEMEEENGENGERAEGEDGQSPVEEDEEAEELNL

SEQ ID NO: 133553 - protein, 269 aa, Heterodera glycines
  misc_feature (257)..(257): Xaa can be any naturally occurring amino acid
  Coding regions on vcDNA: vcDNA=SeqID_59976; Strand=-; Position=1 -26,1505-1666,1922-1971,2027-2113,2178-2208,2266-2299,2420-2473,2627 -2712,2766-2820,2877-2953
  Homolog annotation: Hit_ID=CAE67612.1; Match level="QueryCoverage =95%, HitCoverage=52%, E-value=5e-90, Identity=65%"; Hit description =Hypothetical protein CBG13159 [Caenorhabditis briggsae]
KHLNKSIISDIRSTRRSKRRDKRNGVSRAAKLWPNARIPYVISTHYSPHERALLAKAVKQYHDRTCVRFLPRSASDNDYLFIGKVDYLFIGKVDGCFSEVGRTSGVQVLSLDNGCMDYSTIIHECMDYSTIIHEIMHVVGFYHIMHVVGFYHEHERWDRDFYIDIIWQNIDKSALDQFGKIDLTKTSYYGQPYDYKSILHYDSLAFSKNGFPTMLPKKGADSLAFSKNGFPTMLPKKGAATIGNATIGNAKDFSEMXDFVAELLRSEPK

SEQ ID NO: 133554 - protein, 106 aa, Heterodera glycines
  Coding regions on vcDNA: vcDNA=SeqID_59977; Strand=-; Position=1-321
MHFPPTIHNAQIRHGPLKPPNMSRSPTQPDTSLGKVYLECVASFSEPTKAKWLFGESELSKTDGRFEFSQEQQDTNRDKFICEIKVSGRDEVSDGLATDFRIWTNR

SEQ ID NO: 133555 - protein, 55 aa, Heterodera glycines
  Coding regions on vcDNA: vcDNA=SeqID_59978; Strand=-; Position=1 -65,112-322
ANVWQFQQQKVKWMCLIMSKLALPFALFSLSFRHFAFVIRQFDSECLSLFKFRRI

SEQ ID NO: 133556 - protein, 69 aa, Heterodera glycines
  Coding regions on vcDNA: vcDNA=SeqID_59979; Strand=+; Position=1 -40,386-555
MALAVSWHFAKSFLVTADKKCSAIDTIGIHRMSSRMSNKHRWSSRMITNVVGEMENVIQKVHGDQYGNK

SEQ ID NO: 133557 - protein, 28 aa, Heterodera glycines
  Coding regions on vcDNA: vcDNA=SeqID_59980; Strand=-; Position=1-87
KIELPKLYNKSAGHFSLRSNADAVLAWY

SEQ ID NO: 133558 - protein, 27 aa, Heterodera glycines
  Coding regions on vcDNA: vcDNA=SeqID_59981; Strand=-; Position=1-85
RPYFANFLPLFRSLNWNFSPLKIHTLL

SEQ ID NO: 133559 - protein, 90 aa, Heterodera glycines
  Coding regions on vcDNA: vcDNA=SeqID_59982; Strand=-; Position=1 -51,421-642
MILLLNKSKFESKKKAKLIGLYVIVSLSDESSVIHMENFVPGMVPAILMNDTKYPIRYRQTGHGQWQIVKANQMAPFAWTDSLNGAVSVL

SEQ ID NO: 133560 - protein, 20 aa, Heterodera glycines
  Coding regions on vcDNA: vcDNA=SeqID_59983; Strand=+; Position=1-62
KCHGTRKLLLGRVKCDGTRK

SEQ ID NO: 133561 - protein, 149 aa, Heterodera glycines
  Coding regions on vcDNA: vcDNA=SeqID_59984; Strand=-; Position=1 -256,2413-2605
  Homolog annotation: Hit_ID=NP_637435.1; Match level="QueryCoverage =27%, HitCoverage=10%, E-value=4e-10, Identity=68%"; Hit description =adsorption protein [Xanthomonas campestris pv. campestris str. ATCC 33913] ref|NP_637428.1| adsorption pr
MHGIFEAAEGGGHDEEGGDDEEGGGDGAGGGDGAGEGGGDGAGDGGGDGAVANDQCPSVGTVAGQMPCLFGVHTKSTGRTRRIHRKNVAPFNPAALVPIRSSLRPIPPSAGASPALAFRRQPSVASSAWSKPTKRVSAPGHFRLNCLTP

SEQ ID NO: 133562 - protein, 119 aa, Heterodera glycines
  Coding regions on vcDNA: vcDNA=SeqID_59985; Strand=-; Position=1-357
MEQQQKQPKEMPSPSGASAAAPPLPKLSVHSGNGKLRGGGVRAVREQSVSSVPLDATRATIYLFPAEGAAATILAVGASLGPGDGPLHGHHFVRVGHQRTVPRQVRATMVQLIGTIEQE

SEQ ID NO: 133563 - protein, 139 aa, Heterodera glycines
  Coding regions on vcDNA: vcDNA=SeqID_59986; Strand=-; Position=1-420
MANFSPPSDNTAPKKFLSDLDQLQIPKEIDSDNSIPDYAKLLIKQLHSLLSTASVLIHSQAAAVDAVEEERRLRTVVVTNMPESKSDKAAERAREDRAVVDEILNATDVDQAPIVFRVGKRMDGRPRPLKMEFPTKHAA

SEQ ID NO: 133564 - protein, 63 aa, Heterodera glycines
  Coding regions on vcDNA: vcDNA=SeqID_59987; Strand=-; Position=1-503
LTSKNNSLPKSFLQPLIANLISCRLKPSIACRFSAQQSTNTVFDSLQKIIHYPKVFYNHLLPI

SEQ ID NO: 133565 - protein, 225 aa, Heterodera glycines
  Coding regions on vcDNA: vcDNA=SeqID_59988; Strand=+; Position=1-675
MSAKIIRVPKIACDLSLAKNGVSKNRNYAQKAPQTILALPIPSTIAFIHPIMSAKIIRVPKIACDLSLAKNGVSKNRNYAQKAPQTILALPIPSTIAFIHPIMNAKIIRVPKIACDLSLAKNGVSKNRNYAQKASQTILAHPIHSTIAFIHPIMSAKIIRVPKIACDLSLAKNGVSKNRNYAQKAPQTILALPIPSTIAFIHPIMSAKIIRVPKIACDLSLEKNG

SEQ ID NO: 133566 - protein, 246 aa, Heterodera glycines
  Coding regions on vcDNA: vcDNA=SeqID_59989; Strand=-; Position=1 -345,606-684,988-1041,1098-1141,1397-1437,1498-1675
  Homolog annotation: Hit_ID=NP_741042.1; Match level="QueryCoverage =29%, HitCoverage=16%, E-value=2e-24, Identity=69%"; Hit description =human PTB hnRNP homolog PTB-1, human PTB hnRNP homolog (49.6 kD) (ptb-1) [Caenorhabditis elegans] emb|CAD
LNYAPSSAAALVAAATAATPETNCNNSGTQKLHQQMALSAPLCAAQQNHVTTALEVTPTATELLSTNGTTTPSTNGVGHGSSNGNGTTALAPKELCGTDFLRFAEPHLHHQQQQQFDSNGAVALQCFDGSSLSQSYQDLSADLFQALIQLSEASSAQNARNSLDGLNIYNGCCTLHIEYSKLNTLNVKWNNDKSRDYTNPNLPAGDLTYEQKLQLSESSTGCRFLKFNYLMYFLWFPLTNSPMVGI

SEQ ID NO: 133567 - protein, 267 aa, Heterodera glycines
  Coding regions on vcDNA: vcDNA=SeqID_59990; Strand=-; Position=1-804
MPVLRTPPLTRTRALNQGIIVDRDGNAFRAENFGVSGGRPISPLANNENQRLDDNHENVLAETDIRRRLLYGGMEQSAPEEQLEYDEMENGDEQNVNGMVQQNLENGVEAGDRGSFGNDALDAHGLRAFSTPLNEQNLSALQRDLRMQLPENLSVIENQIRVMNFMQNQMPNQVGQNFPALNHPQAVNPIACPRPNGQLYENAPVNFERQREQQIRLTQQPVVEGQQPHVGGFLRHMPMHRDTTVTRTKDLSFTKDSNAQISTKTCL

SEQ ID NO: 133568 - protein, 108 aa, Heterodera glycines
  Coding regions on vcDNA: vcDNA=SeqID_59991; Strand=-; Position=1 -159,303-467
MMKKTLPINDEMISERIEAERERLQQDKLRKRYAYEAICALTDTVNESELQRHLSVLDPTSWCEVVEERFLGRLCGFPLCAKTITVDFRKKHTIVRRLNESTRKEHKM

SEQ ID NO: 133569 - protein, 236 aa, Heterodera glycines
  Coding regions on vcDNA: vcDNA=SeqID_59992; Strand=+; Position=1 -93,138-293,1219-1429,1770-2019
  Homolog annotation: Hit_ID=NP_506645.1; Match level="QueryCoverage =64%, HitCoverage=18%, E-value=1e-42, Identity=56%"; Hit description =HAlF transporter, PGP related (haf-7) [Caenorhabditis elegans] emb|CAB60586.1| Hypothetical protein Y50E8
MVESSWQLSLITLLLIPILAVFIKVYSVYYDNIAERSQMSKANANRIAEETISSMRSVRAFAAERRERQRFEAELDATLRVDRVSLVPQEPILYSCSIRDNILYGFDNPSAEDEDGGDAAVNAAKMANIQEYVAHETEKGFATKCGEKGIQLSGGQKQRIAIARALVRQPKVLLLDEATSALDARNEQLIRESLSACAKGRTVLMIAHRLSTVRRADRILVMEHGQIVQVRNRKRL

SEQ ID NO: 133570 - protein, 119 aa, Heterodera glycines
  Coding regions on vcDNA: vcDNA=SeqID_59993; Strand=+; Position=1 -160,275-474
MFVFSWSVLLSAVPCSPVWAAPGRGRFWHWSAQSVSDSICRLLSVFVVENLNKVCHLQLQARITKSRMELQAGPIEALFEKNFGICIILSLTIFFPSIRKSYNDWKQSRPYAEVFASAL

SEQ ID NO: 133571 - protein, 113 aa, Heterodera glycines
  Coding regions on vcDNA: vcDNA=SeqID_59994; Strand=-; Position=1 -54,101-161,215-309,809-938
MSTGIIIIICHNDEDQPKNIAVYCDYPLLIYSSGIFGGVAMFTKPILFSGVYLSWFFNPYVGYTDDFGQITFLQVIIISLIHSITAVIYALMQYVRIGEIYIIVGTYAWLFTN

SEQ ID NO: 133572 - protein, 106 aa, Heterodera glycines
  Coding regions on vcDNA: vcDNA=SeqID_59995; Strand=-; Position=1 -299,774-795
MYEMKVRKQKKRNPNVIFRDSFNLMPCSLAALVPSYGLDVEDKPFFPHLANRPENYGIEIHPTPDEYLANGMMPGKRRQFDEWYAEHRHEPFRLDEALARLHLAWL

SEQ ID NO: 133573 - protein, 74 aa, Heterodera glycines
  Coding regions on vcDNA: vcDNA=SeqID_59996; Strand=+; Position=1 -150,238-261,395-415,563-592
MYFFENADYYENRRLSCVWSEGWEANECCGKNYQLVIMDKKYVKNVKILKDLRNIKPEESWIPHSVLRTPYSVR

SEQ ID NO: 133574 - protein, 70 aa, Heterodera glycines
  Coding regions on vcDNA: vcDNA=SeqID_59997; Strand=+; Position=1 -61,111-443
  Homolog annotation: Hit_ID=NP_501301.1; Match level="QueryCoverage =94%, HitCoverage=15%, E-value=1e-19, Identity=68%"; Hit description =aminoacylase family member (4I592) [Caenorhabditis elegans]
KCAFSKEIFIGGTDARFLREKGIPAIGFSPMNNTPILLHDHNEFLNEGVFLRGVKIYTKMIPRLANLPSF

SEQ ID NO: 133575 - protein, 95 aa, Heterodera glycines
  Coding regions on vcDNA: vcDNA=SeqID_59998; Strand=-; Position=1 -91,253-863
LFEYPKRTLEKIDFFVFGAVPPNRCAQIYGETESFGNSFPIACTLILRWIFAPHNCLSTPNGHLKKSIFLFSGQSPRTDAPRFMGRPNPSGVASL

SEQ ID NO: 133576 - protein, 204 aa, Heterodera glycines
  Coding regions on vcDNA: vcDNA=SeqID_59999; Strand=+; Position=1 -58,112-227,486-898,996-1023
  Homolog annotation: Hit_ID=XP_392800.1; Match level="QueryCoverage =77%, HitCoverage=17%, E-value=2e-13, Identity=27%"; Hit description =similar to ENSANGP00000021534 [Apis mellifera]
MTSSSSRNGIKKIAIRKFQRRNDPSVSNFDTNWSVLEDSVKKIQERESVTVTCVELYNMVEHLCQMNYAGEIYARLQLLIGKFAEAESASLLDNSLNVSNEAFLAALNRLWEAFCQQLVRFWTEKLLIVLFYPSQTLTRSVFLYLDRTYRVQSTSSVSIWLVSAFANFLHPKGSGMQDWMHFGGIFWRGVAFVPGQQITNCLHL

SEQ ID NO: 133577 - protein, 102 aa, Heterodera glycines
  Coding regions on vcDNA: vcDNA=SeqID_60000; Strand=+; Position=1-309
MLDCFARSVGRALSNASSSNEFFNVSPDDCLRFCSTERACNTVVYHKHFSTCQLYSGAEEGDTAREVSAKGHDLYVKKECEENRREQERDEAENTAPKGGKL

SEQ ID NO: 133578 - protein, 340 aa, Heterodera glycines
  Coding regions on vcDNA: vcDNA=SeqID_60001; Strand=-; Position=1-1020
  Homolog annotation: Hit_ID=NP_921821.1; Match level="QueryCoverage =65%, HitCoverage=12%, E-value=5e-13, Identity=26%"; Hit description =putative helicase [Oryza sativa (japonica cultivar-group)] gb|AAP54108.1| putative helicase [Oryza sativa
MSRYNNLLQFASVSAGNKPCPAGGPMAVILNGEFHRRISSMQAGTTQIPGFGQLYILDPVEAMEQRRKNPTFTGEKITNDEEFVQGHQLNEATLEILEQVIQENHPAASAYKQAREQLQELLKQQRTEELRFFRMTLLDERSAPGGMKDPKLHPHQIITPSTGEGMFAIHADPTGAPAPKGIWVENKQGQLNEIAPFSPWTDSLTYPLIKPKGDDGYKIGIPYAKPAQRKRKSDNSDDMFDTEAMSDDDMCETKSIALSDTGSETSTQSVTSRYDKSKRFVSLRDYCKYHLAIRDENLEWQYHHILSCGGGLGQRWVLDQASKIDWQIATFLRRPDMDLR

SEQ ID NO: 133579 - protein, 29 aa, Heterodera glycines
  misc_feature (23)..(23): Xaa can be any naturally occurring amino acid
  Coding regions on vcDNA: vcDNA=SeqID_60002; Strand=-; Position=1-88
FLINFIHIQMLSSMIGGRCAIDXLFLREF

SEQ ID NO: 133580 - protein, 79 aa, Heterodera glycines
  Coding regions on vcDNA: vcDNA=SeqID_60003; Strand=+; Position=1 -21,212-344,394-479
MRYEWGPSIFYPNFGISWKYFFLETTLNLRKVFVQCVIIHLISIISIPFYQYVFFNTSYLFVTCLFYLAIVIRLAWIKG

SEQ ID NO: 133581 - protein, 90 aa, Heterodera glycines
  Coding regions on vcDNA: vcDNA=SeqID_60004; Strand=+; Position=1 -111,633-794
MPPLMRRRHKILWTRKVRESLCYALLSKSMAYVLCYLLFLLAVCMDMRVQFAQMIRKMFVPFRRRGTQTMTVQTVQANFNSRMRHNANAN

SEQ ID NO: 133582 - protein, 187 aa, Heterodera glycines
  Coding regions on vcDNA: vcDNA=SeqID_60005; Strand=-; Position=1 -369,416-610
MYRMQHQIDAKRNRSTLQHDGHLYKFAKTSTDGTIKFWRCEFKDSGVDKCKGRIWTSLRDEFIRMATTHTCERNTSHVVAQKVTTAIKRRSVEKAPSVIRAVSTQSISSPALSEVPSKKATNLMINRTRHLVDAPPAVPLNLEQLQIPQSYQFYEKTMYKNVFYSAKLTFDADQKSLLQQLDQITPL

SEQ ID NO: 133583 - protein, 111 aa, Heterodera glycines
  Coding regions on vcDNA: vcDNA=SeqID_60006; Strand=-; Position=1 -145,317-507
MAGQTKGGAGISPAALEDERRRRHAAEQQLRMEQLRADETEQQLRDMEERAHGEKRALLVENAELQRRLDELTPKLAEQEAKMMALEEQRDEANVRLKATLKQMNALQAIN

SEQ ID NO: 133584 - protein, 28 aa, Heterodera glycines
  Coding regions on vcDNA: vcDNA=SeqID_60007; Strand=-; Position=1 -14,161-233
MYSKKSILKGVFFVFIAFLLTNFGKTPK

SEQ ID NO: 133585 - protein, 123 aa, Heterodera glycines
  Coding regions on vcDNA: vcDNA=SeqID_60008; Strand=+; Position=1 -56,109-284,328-588
FDAHFLAGSFRWRSAVLQRVQRQQQHAHLLPLFGPTAIGPRRQAETEDQLRRPSGAENHRPMATAKPIFPKFPDFDAEFGIRQDSESAQQQQLQAVHHLRRKRANLIFEHFFPQTKVPTLGDS

SEQ ID NO: 133586 - protein, 48 aa, Heterodera glycines; identical to SEQ ID NO: 127256
  Coding regions on vcDNA: vcDNA=SeqID_60009; Strand=+; Position=1-145

SEQ ID NO: 133587 - protein, 299 aa, Heterodera glycines
  Coding regions on vcDNA: vcDNA=SeqID_60010; Strand=-; Position=1-897
MMVEVSTKTTDQRINSEQLHVGQFTAAKGQTNNRIEGDTSLLRKSTLKEKAKGEKKQSNDQNNEREVIADKKMGAIKQPSDRISDWTRSNRNEEASSGKKMPNGRILWTKILPVQTSARNKSLPNSADKENILPTTDGRSLRNLSGDRPSSSKQLPTDEQKKSDGQKKDGPGGQQRTSDMRTKAGNSELSQRILQLLKNLRIAKEAVANYGTERRRRRKRSAEKIADQKQGRRITENGQEMISDQKSDQSLADQGQAPLPGQQKAAITGQDFRERPGEEKPPDEKKAEEKGIEEEAKFV

SEQ ID NO: 133588 - protein, 20 aa, Heterodera glycines
  Coding regions on vcDNA: vcDNA=SeqID_60011; Strand=-; Position=1-59
YICYIGFEFRFKKQNLPAEG

SEQ ID NO: 133589 - protein, 174 aa, Heterodera glycines
  Coding regions on vcDNA: vcDNA=SeqID_60012; Strand=-; Position=1-522
MIVPLLITFVQILITVVPLLITVVPLLITVVPLLITCTSSNHWCTSSNHCCTSSNHCCTSSNHCCTSSNHFVPLLITVVPLLITFVTLLSLLYLFIKFVPLLITVVTLLITVAPLLITFVRFLITFVRFLITFVPLLSLLYLFIKFVPLLITVVTLLITVAPLLITVVPLLITF

SEQ ID NO: 133590 - protein, 1233 aa, Heterodera glycines
  Coding regions on vcDNA: vcDNA=SeqID_60013; Strand=-; Position=1-3702
  Homolog annotation: Hit_ID=NP_916487.1; Match level="QueryCoverage =58%, HitCoverage=42%, E-value=6e-45, Identity=24%"; Hit description =helicase-like protein [Oryza sativa (japonica cultivar-group)]
MDPLNKNFQHDRCQLIKNVISMVVGVDIDVINIADKNVSQQPDFNSCGYYICLFAESWIFNDHSLILEPIHIISEKKRILWHVNALCSSDNVEFRSRYNQVNNEILMSDLSRGSSLSKPLNYSDCSDSDSSKCSGNRRGRPKKRSGGPGRLKKPDSINLSMNVGNMNSNTENINQAQENQSIISNELLTLLNSGSIDIPGSQPIAPGRVCIQSINKDLIKEAWSIPNEMFSDDLVYCFQRYLSSKIVDKIVTVVNPQYTDLQNFHVGPHAFPYNVMDNCFNYSENYDILLMTIFFNGHFALIIFDRCDRDNLICLFIDSLPHYDRLFDPQYPGYDVRRIEIIKNGICELTPGLSHDDVVIRTLSPSEFTPQHDGINCGVFVLLYSEAYLNHCSLKFPNLNINLERRRILWHLAHLINNDDVEYIGRNLTNGPQNPQRLPLYNVESNIEQTCPRDGDGAFICVEPDIDRTPDVILRPPSTSNLSTATRRSLRLQKSVSNEVSSDDNIDTIPKMPHNDITRRCHTKHQGIPCADVRARHTTDYYDSGNLGDKICAYCNALLLNSEAEKKNGKFSSSHCCNHGSVVLPPYEEYPPTLKRYLSGQDPEAKEFLSNENVYNSLLAFASVSVGYRESSLDGNVCYLLNGEFTRQIGSTLPGKFSPSFSQLYILDPVTAFMQRTQNIAYGGDRVNETTIKKLDFIIRKYNPLAQELVNFHKQYQNTLKEKGPEAVLNFRLTLVEARDAPASVRDVSIHSRQANLPDEGNSLFAVWAESEQPPFLKGIWITNDEGKLKKFPPHHPLTDSLCYPLMFPHGDDGFHLKIPYNPLNKPEKNEAMEIDVESDENTGDSDADASDDDNESVASSVDSVDKRGPRQFLSIRSYIRYRMALRKHKNIHNIWSSGGGLSQKFTLDYAARIDTNVANYLRRPELNLRSTLPENALRWLSRNAGLSSTEDLGSIVMFRRSEPGTRAYFQHKFYDATTIMSRFKKPGNASFFLTFTTNPRWREISRNFLHKGQKTVDRPDLICRIYEDKLSHLHYLIDQKNILGKMIGQECREFQKKYGGPHAHRVYHTSLLAIPENVDNIIWAHIPEEPAKNDKSDWANFIRKVRELLPKFQFHDCGPHCLNNKGKCKKGFPKPFSKFTILHDDRPAIYFRPSPEDGGQTLSVKRGKAQVIYNNSRISSYNPYILVHFETHHNLEYAYGQSTNLKYLYKYPFKGPSFSYVKTNESNGKDKY

SEQ ID NO: 133591 - protein, 589 aa, Heterodera glycines
  Coding regions on vcDNA: vcDNA=SeqID_60014; Strand=-; Position=1-1770
MPSKQWNEKNKRKKRSVERPLSSLWTSDHSEASSPVSDFVLSTPQNSNSRKRGRPPKNIHTPLANSFEKVHLNTPQSSWKKQNICPDSPVPKKDKSFGCPLNESLEEIDFANLTSLEFIQRIDESAKIARWANLNVPDVNSGQNVIEKAFYNLDSWLNHELTFAYLCLIAIKSTRRTVVVDSVLTDPDIHVKRNKRTLKRACFNFDPNIPTEIIVFPLFFQNHWALAIYDQEIGTYFIDSLKQDPSRMDPLNKNFQHDRCQLIKNVISMVVGVDIDVINIADKNVSQQPDFNSCGYYICLFAESWIFNDHSLILEPIHIISEKKRILWHVNALCSSDNVEFRSRYNQVNNEILMSDLSRGSSLSKPLNYSDCSDSVSDSSKCSGNRRGRPKKRSGGPGRLKKPDSINLSMNVGNMNSNTENINQAQENQSIISNELLTLLNSGSIDIPGSQPIAPGRVCIQSVNKDLIKETWSCPTDMFSDDLVYCFQRYLASKIVDKIVTVVNPQYTDLQNFHVGPHAFPYNVMDNCFNYSENYDILLMTIFFNGHFALIIFDRCDRDNLICLFIDSLPHYDRLFDPQYPGYDVRRIE

SEQ ID NO: 133592 - protein, 64 aa, Heterodera glycines
  Coding regions on vcDNA: vcDNA=SeqID_60015; Strand=+; Position=1 -51,214-357
MIRMSRDDSDAVEQLRKETRKLEDQVGQYKAKVRELKSKMKVQEEEFNRRYNEKALFGLLALCR

SEQ ID NO: 133593 - protein, 280 aa, Heterodera glycines
  Coding regions on vcDNA: vcDNA=SeqID_60016; Strand=+; Position=1 -175,350-428,495-549,871-951,1002-1454
  Homolog annotation: Hit_ID=CAE61849.1; Match level="QueryCoverage =48%, HitCoverage=58%, E-value=3e-14, Identity=36%"; Hit description =Hypothetical protein CBG05824 [Caenorhabditis briggsae]
MSFSTIGSSTSSAAIAPMIDEKGELLNRHEVQLISKTLNWSVENDQKFEFNLLIKIGLTCLIYYSALKELDFGNEIVVRLLNDKRSLFKSLLARCAKQAHDIEVFDPKSLARFCPRAVRVGDGVTRFFENLAIELEKGHAIADLEQKVAELCRANGQLHYRMKVWFQAENWLCVKRSVVDTVIVAHTKQFDTFCGGGDLYNENSHYFIIMMYIKMAKSNVSECQKVVVINSNTNCPPTSQNHSLIIPIFSFTITEMQINNWQLLWELNPIDHTIRGKLYH

SEQ ID NO: 133594 - protein, 24 aa, Heterodera glycines
  Coding regions on vcDNA: vcDNA=SeqID_60017; Strand=-; Position=1-71
TAKLVPTVAFSCLALSNNLTIFET

SEQ ID NO: 133595 - protein, 154 aa, Heterodera glycines
  Coding regions on vcDNA: vcDNA=SeqID_60018; Strand=-; Position=1-465
FSHFFTAKLVPTVAFSCLALSNNLTIFETQTKKILDQKWLSLFSHFFTANLVPTVAFSCLLSNNLTIFETQTKKKFLTKKWLSLFSHFFTAKLVPTVAFSCLALSNNLTIFETQTKKILDQKWLSLFSHFLPQNWYQQLPFSCLGLSNNLTILK

SEQ ID NO: 133596 - protein, 134 aa, Heterodera glycines
  Coding regions on vcDNA: vcDNA=SeqID_60019; Strand=-; Position=1 -128,276-445,793-897
  Homolog annotation: Hit_ID=AAH82658.1; Match level="QueryCoverage =100%, HitCoverage=6%, E-value=6e-35, Identity=53%"; Hit description =Unknown (protein for MGC:82480) [Xenopus laevis]
MNGQRLGDVWILDLESMNWSNPLPQGFGPLPRSLHTANLIENRMFIFGGWVPNDSDDNSERPNKGWKCTNTLAVLNLSTLRWEHSLGPPTPVTATTYSTDFWPTARAGHCSAVINKRIYIWSGRDGYKKLQNSQ

SEQ ID NO: 133597 - protein, 114 aa, Heterodera glycines
  Coding regions on vcDNA: vcDNA=SeqID_60020; Strand=+; Position=1 -122,173-306,479-567
MSMELNNLSALYSAKCLENSKLDEEMQKMLREREQKSTNTNNLDAINKRLQRELRQKEQSIDDLRQQIAWLEKKLKMSGIEVSEQELCDFFKRLVAITHYNSSNTFHAFAFIII

SEQ ID NO: 133598 - protein, 77 aa, Heterodera glycines
  Coding regions on vcDNA: vcDNA=SeqID_60021; Strand=-; Position=1 -89,578-722
MQDNGVIVPIEHRYLLKSAPPRALALLSKGRFRPVFFSRLEGAWKTYAEEQEERVISDLEAFDLFYICRKEAEHNQK

SEQ ID NO: 133599 - protein, 56 aa, Heterodera glycines
  Coding regions on vcDNA: vcDNA=SeqID_60022; Strand=-; Position=1 -55,247-330,545-576
MGDAKPKAAQSNGIFYYVTDEFYEGTVKLILEYGASVWEHLDLLDEAEHTPRENVH

SEQ ID NO: 133600 - protein, 121 aa, Heterodera glycines
  Coding regions on vcDNA: vcDNA=SeqID_60023; Strand=-; Position=1 -217,291-864,1151-1183
  Homolog annotation: Hit_ID=NP_506003.1; Match level="QueryCoverage =95%, HitCoverage=95%, E-value=5e-13, Identity=37%"; Hit description =macrophage Migration Inhibitory Factor related (12.8 kD) (mif-2) [Caenorhabditis elegans] emb|CAB01412.1|
MPFINLWTNLPELKLDNEFRRTFLATVANSMQKPVESTALIVQSGPNCCQIGSDPAEPAMILQIKSIGCVSADENVIHCKNISEFVQSRLGIPPDRVMIHFQSLEKHEVGKGGTTVEKMCQ

SEQ ID NO: 133601 - protein, 17 aa, Heterodera glycines
  Coding regions on vcDNA: vcDNA=SeqID_60024; Strand=+; Position=1-54
PVNSCIGCKCRRCCTPN

SEQ ID NO: 133602 - protein, 48 aa, Heterodera glycines
  Coding regions on vcDNA: vcDNA=SeqID_60025; Strand=+; Position=1 -46,200-300
MTFYASLVGYTGRNNKILSVISAFGILMSKSVTVNEILCFSCWIHGKK

SEQ ID NO: 133603 - protein, 32 aa, Heterodera glycines; identical to SEQ ID NO: 127531
  Coding regions on vcDNA: vcDNA=SeqID_60026; Strand=-; Position=1-186

SEQ ID NO: 133604 - protein, 106 aa, Heterodera glycines
  Coding regions on vcDNA: vcDNA=SeqID_60027; Strand=-; Position=1 -93,137-232,276-406
SSIDQLDEKHILITYLHKKDWVHEHACSNIVISLWTTSAARLVLLKAMQKVVRTDRCELLYTDTDSLILVHPEERCPLKTGPHLGQFTDEYPDHDIVEYCSGGSKQ

SEQ ID NO: 133605 - protein, 175 aa, Heterodera glycines
  Coding regions on vcDNA: vcDNA=SeqID_60028; Strand=+; Position=1 -457,601-671
  Homolog annotation: Hit_ID=AAK30610.1; Match level="QueryCoverage =80%, HitCoverage=28%, E-value=6e-09, Identity=36%"; Hit description =fibroin 1 [Plectreurys tristis]
MPSVAANSLQMLQQQAAAAQQYSAATGTPSFISSVSGGKCGAEYQTVSVSASGTQPQASGNNASGDPATASGAGYPSGASVGIVGGSGANGTSGVTPYAQLLAMGGGGTGAMVDPATAATATLMAQQQAAAAAAIMAQQQQHQQQQQNQQINSIIVLIGNFKQFHDLLGLFQNLI

SEQ ID NO: 133606 - protein, 129 aa, Heterodera glycines
  Coding regions on vcDNA: vcDNA=SeqID_60029; Strand=-; Position=1-390
MPSIFDNFAKANGGRGPLMMGEASSNWVSTPLIDENGLPVANDTASNSTSGTFWEEMEQELRSQPTGRAEPMAFEMAPSDGMSGGAQQMTMSKEEKCQRLKTIQEELLFTLASRFNGYANLDDIKRDFK

SEQ ID NO: 133607 - protein, 83 aa, Heterodera glycines
  Coding regions on vcDNA: vcDNA=SeqID_60030; Strand=-; Position=1-253
LYIISFGFAVKQQIKLDGLIQNEKGIYSYESDGKIWTNGKEKGTIAKYSYGVGDTVGIGVHLSTRQLFFTKNGFRLGWQIKNN

SEQ ID NO: 133608 - protein, 127 aa, Heterodera glycines
  Coding regions on vcDNA: vcDNA=SeqID_60031; Strand=-; Position=1 -361,417-439
MAIEDTENDALFDQLWGNLKTNQQKSGGFEQIKIKEEQERDGDQQQKRVKNNEQIGNNQSENENYEGKFGKIFIKIEGEKSEEMKKEICENPIKNEQQNEEELQQSDEQTIGNSNHLINKVIYEKVN

SEQ ID NO: 133609 - protein, 243 aa, Heterodera glycines
  Coding regions on vcDNA: vcDNA=SeqID_60032; Strand=-; Position=1 -96,138-225,521-639,689-808,861-1092
  Homolog annotation: Hit_ID=CAE59576.1; Match level="QueryCoverage =97%, HitCoverage=66%, E-value=2e-46, Identity=44%"; Hit description =Hypothetical protein CBG02976 [Caenorhabditis briggsae]
SAMSVFEKSIRKVFVDTYKGIDDGFLVEARRQKPTLKDGTTAKPTLKDGTTATTIFLLDKTLYCANIGDSKIVCRHKSEKSTNIPLQITVDHNPLVFDERMRIQKSGGTVKDGRVFGDGRVFGILEVSRSIGDGQMKAHGVICTPDIKKLSLTPDDLFIILACDGLFIILACDGLWKAFSPDAAIDFVIGQYKMLAKTAEFNEEKDSVGLWTKIADEMSAAAVRKGCGDNVTVLVVIVANIAK

SEQ ID NO: 133610 - protein, 48 aa, Heterodera glycines
  Coding regions on vcDNA: vcDNA=SeqID_60033; Strand=-; Position=1 -34,80-192
MSQQPNAPPPYDDAQKYPAYPNPNVPTDQGKELDQSSQWQFMLMPDSV

SEQ ID NO: 133611 - protein, 140 aa, Heterodera glycines
  Coding regions on vcDNA: vcDNA=SeqID_60034; Strand=-; Position=1 -45,194-361,416-466,843-1001
MKINPKTGVNFEVFYYGKRQDSDYKAYAFKANQPYEIHIAVFETEYQVKLNGQSFENFPNKMPIWTINFMRVQGNVSLLAEPEINVPKVSQKGQFSFALSSLFNYDEQITFFFTVNNAANSFQINFMHESSEIHPMSQFV

SEQ ID NO: 133612 - protein, 84 aa, Heterodera glycines
  Coding regions on vcDNA: vcDNA=SeqID_60035; Strand=-; Position=1 -122,209-341
MQMLSTISKTSGPTAMNTCINGWHGQAKKPIFAMASLTVYISFTEIPLDKFGDCLCSVRPLSRSSRLSEVRRSAECCKGQPDKL

SEQ ID NO: 133613 - protein, 382 aa, Heterodera glycines
  Coding regions on vcDNA: vcDNA=SeqID_60036; Strand=+; Position=1 -151,213-369,447-593,652-697,758-841,925-1041,1094-1202,1245-1333
  Homolog annotation: Hit_ID=NP_493779.1; Match level="QueryCoverage =92%, HitCoverage=99%, E-value=7e-75, Identity=45%"; Hit description =putative protein family member, with at least 5 transmembrane domains, of bilaterial origin (2A943) [Caen
LLVLLVYSHLQQRFHSISVYLMALAVSDFLMICTAMFLFVLEAWRHHGPMGLAYAYGIGALAYAYGIGAPFFFPLASIFQTTSVYFCVGAAIDVFVSVALKGPISESYCTVRIAQKFVVVTTCIAQKFVVVTTCLAVLYNIPHFFELRSIDCLDGLNINSLQICPTEFRMSHMSHVYYSIYYTYMYTVFMAVGPLVFMAVGPLVLLIVLNICIVVNVLRRPRDTFRSDSDIVSLITFRSDSDIVSLILVVCMFIFCNFTALLVNFLELTFAEQLVIVYLVDLSNLLVVINVIVYLVDLSNLLVVINCSANFFVYLIFGHSFQLYPSREMANGGARANLLVMVESEEKSNGRSREMANGGARANLLVMVESEEKSNGRSNNNA

SEQ ID NO: 133614 - protein, 75 aa, Heterodera glycines
  Coding regions on vcDNA: vcDNA=SeqID_60037; Strand=-; Position=1 -55,407-579
GCSPPAEIFHIRAGNRHFEARAIASAWLALMLVYLLFSGWIYSVIYRAYATQKEEEEQGIKADEIHGHQNYAGGV

SEQ ID NO: 133615 - protein, 1635 aa, Heterodera glycines
  Coding regions on vcDNA: vcDNA=SeqID_60038; Strand=-; Position=1 -967,1653-5590
  Homolog annotation: Hit_ID=NP_498959.1; Match level="QueryCoverage =65%, HitCoverage=49%, E-value=1e-158, Identity=33%"; Hit description= zn-finger, CCHC type and RNA-directed DNA polymerase  and Integrase, catalytic domain containing protein
MICIEIRVENFAPSQPASPRNFLQPPHTSTPSVNIENRQRFGPFPIIVGQAERMRQIAMQQPVANTVFRPIPLRPPQINQIAANAQRSINMEFFSSGGHRIDPPNAPIQAGSRFIRKIPAEAELWQGAEENINFVYPQNQQPRQPNAFPFQGNEQIFQKPIMNPCEKQFVMHTQPNSTVLSNLEFNLILERIPDLNGNEGIEIVRRFFKKFDAYTDEWPNSKRILALESKVFNKAERALEAAKATQPYRYELIRREMLQQLEETDSKNLNAFDELMMGVRRKLNEPIDDLAGRISALVKRAYPGLTNNLSDEYSIKFLIRAMDPVSIFLHITNAPIGFGLLIGTNALQDLGFKLYDERNKAMVEFEKTESGKRDFLTVIYRTTIEPNSVKNLELSIDSQFEGAEIVATPDENSVAAIRVEPTVGLAQKGKIIVPVTNFSMSAITLFENSKVGKVELAKSVEEAENFLNSQIICSKKNDPIAAFRLDAMKFLEILQTRTGDLPEEHMEKLQKFGKKFPEIFALSDEDLKQTNLVEHEIETEGKAPIKTKTRPVPYAYREKIAEMIQNYLGRGLIRPSMSPWASPIVIVPKRDGTLRFCVDYRGLNSITRKDCFPLPNIDNTLLMLGGRKFFSTLDFMSGYWQIKMEENSIEKTAFTTEYGLYEFMVMPFGLTNAVATFQRFMSRLFDGMINQFLFVYIDDILIASESFEEHLIHIELVFSRIKTAGLKLKLEKCHFCATELPFLGHILTREGIKMDADKLKPVIELPTPTTKKELHSLLGFLTYYRKFIHSFGTIAAPLFKLLSEKVEFKMGEKEKEALEELKSKIIRDVVLYFPDFKAAENDPSRQFIIMTDASKIGIAAVLCQPDPEKRIRPIYFASRQCNHHESRYSATELEALAVKFGVKKFAQFIIMIPTRVITDHKALIWMFQSKNETGNSRVDRWLLELSSRFILKVEFQPGKKNVIADILSRSKAADQILEPKDNQEIALIGKVRTNEVPDSIQDFTDHKEKWEEETKSSEMQPIYEFLAKKVVPNDPQIRQSVMDKSHRYTIFEKLLYLCEDDGRMRLFVPKSFRENLVKERHEGKCSGHMSGKKLYKQLSELYFWPNMLSDCIRFHLACRICAHTRNARSNEPPLKVVHSSEPLELVCMDILDIGPSQSNFKYICVIIDHFTKYLVAEPIPNKSADSVAKIFVEKFLVIFGTPKKIHSDRGKEFVNATLKGISKILGTEMSFTAGYDPQGNGLVERVNGIIIGMLKRSTASNWTWDERLPFTVFAYNITPTESTGFSPFLLMFGRPAIIASDKITQINFNPIYTIDHENYFQLFLENLLNIQDKAKQNLEEYRKKSKEWYDAKPRVKANKFEISERVMVAFPGMHRNSRHKKLLWTHFGPYFIVKITDSSAEVVPVDKKTANPITVPLERLIKVPKSIPNISTLPRGKNPYKNILNAMILSVSVQMECQRREESLAENKQFGTIAIKGDEEGKEEKNGGKDSGINKSFSIKGTEFPLKISGQMNSDAGISWNSICNPKEEGHEFCSVLKLGELDPVLGQTGIGATIVQTPLQALLAIFLLRSGTVSSNTAARIFVELIIKNGPKNEMAAFSEKRGDYVETGKFPQEEDQSKALEKWLESCCAAREA

SEQ ID NO: 133616 - protein, 224 aa, Heterodera glycines
  Coding regions on vcDNA: vcDNA=SeqID_60039; Strand=+; Position=1 -173,214-388,430-662,1009-1102
MEKAEVSQCFSKFDNKFLFIIGHGDEYRKFKQTNERNGAIYIYCLKCESYRKQNSDGFIIASAIIREGQLDRTHKIIHNQHCNGVPLEQLTAEQIDRSQRRDLAQCSTDPKSIWREGSDRSREHDIAEDIGIEDTTGISFNYPNWQTVRSAYNRRRKNNLGDSLDPFNVPERFQLSKRGAIKLLLRKNISEEDITQASYEAVLSQLNEIWGEEIFEGIDRIHTD

SEQ ID NO: 133617 - protein, 167 aa, Heterodera glycines
  Coding regions on vcDNA: vcDNA=SeqID_60040; Strand=+; Position=1-504
MTFQSLKIRPPAFQYWDSTHQLSLGFQSLGLNPPAFQALRLNSQAFQSLGLNPPTFQSLGLKSPAFQTLGLNPPTFIGIPISGNQATSIPISGLNPPAFQSLGLNSPAFQTMKSPAFQTLGLNPPAFQSLGLNSQAFQSLELKSLAFQTLGLKSPAFQTLGLKSAAF

SEQ ID NO: 133618 - protein, 210 aa, Heterodera glycines
  misc_feature (14)..(14): Xaa can be any naturally occurring amino acid
  misc_feature (205)..(205): Xaa can be any naturally occurring amino acid
  Coding regions on vcDNA: vcDNA=SeqID_60041; Strand=-; Position=1 -164,226-414,539-802
  Homolog annotation: Hit_ID=CAE64674.1; Match level="QueryCoverage =92%, HitCoverage=35%, E-value=3e-62, Identity=58%"; Hit description =Hypothetical protein CBG09450 [Caenorhabditis briggsae]
EYVVRPPPPVGREXNSCFAILKSRSGKRVHIYNTDAEGRMAMADPLAEAKEKAMKAKNPAMKAKNPHLFTIATLTGHLILTYGHCSAAMDNGPARAANYAEQLRKTGDEFGQPVEVSRLFSEDFDFHSAKCEAADLMQSNALPSVRTPRGHMGPAAFLMRVSRIDEAGLDSAQPLKYTHLDIGVSMGEYPNTSFPSPLLALIAQXIDNSQ

SEQ ID NO: 133619 - protein, 23 aa, Heterodera glycines
  Coding regions on vcDNA: vcDNA=SeqID_60042; Strand=-; Position=1 -30,658-699
MENLALMGQMRRQISSFCSKFKL

SEQ ID NO: 133620 - protein, 41 aa, Heterodera glycines
  Coding regions on vcDNA: vcDNA=SeqID_60043; Strand=-; Position=1-440
IFYRFLNIWIFFWLTKTSSNLALSILIQIAPNFFYSLTRPN

SEQ ID NO: 133621 - protein, 40 aa, Heterodera glycines
  Coding regions on vcDNA: vcDNA=SeqID_60044; Strand=+; Position=1 -12,987-1097
MVPKGPVLIANSTISHNRGHGIVIESTLDGRALGTKVELR

SEQ ID NO: 133622 - protein, 27 aa, Heterodera glycines
  Coding regions on vcDNA: vcDNA=SeqID_60045; Strand=+; Position=1-84
YKSVPFSPFILVNLPQSFRSVPSPPIY

SEQ ID NO: 133623 - protein, 30 aa, Heterodera glycines
  Coding regions on vcDNA: vcDNA=SeqID_60046; Strand=+; Position=1 -42,184-234
MIKQHKKVIFTTCAKNLRSCPSSYKTEKET

SEQ ID NO: 133624 - protein, 21 aa, Heterodera glycines
  Coding regions on vcDNA: vcDNA=SeqID_60047; Strand=+; Position=1 -54,382-393
MRTRPIWQVMQRLLTSQKKML

SEQ ID NO: 133625 - protein, 76 aa, Heterodera glycines
  Coding regions on vcDNA: vcDNA=SeqID_60048; Strand=-; Position=1-523
YQKGRWRKNFLKIFPYILVISFCFWWGAWNSGIMRTRPIWQVMQRLLTSQKVRCRDETNQHCLPRGTRHGPPKEWI

SEQ ID NO: 133626 - protein, 63 aa, Heterodera glycines
  Coding regions on vcDNA: vcDNA=SeqID_60049; Strand=+; Position=1-273
FLNYFLHLITQRSRLIESSPNLQGKLLRTLQMLINFLRIFCLEEHSSSHLPHQYYFFLIIFCI

SEQ ID NO: 133627 - protein, 154 aa, Heterodera glycines
  Coding regions on vcDNA: vcDNA=SeqID_60050; Strand=-; Position=1 -72,123-209,725-1030
  Homolog annotation: Hit_ID=NP_502449.1; Match level="QueryCoverage =77%, HitCoverage=16%, E-value=1e-30, Identity=40%"; Hit description =guanylyl cyclase (gcy-18) [Caenorhabditis elegans] emb|CAB05325.1| Hypothetical protein ZK896.8 [Caenorha
MVQMTAYRVQNCDGLINKSGCYDLKLADVMTGFWPSENGSLPPDEPICGFRGQLSLASGNTKLSNMSTGGNRKHAILGVNTHATYRRFVQKQPLKFLREDLVLLTAVKDAVHDNINPFLGELAFANLIGLFGRESRRIEVETLGHLNITISTDV

SEQ ID NO: 133628 - protein, 196 aa, Heterodera glycines
  Coding regions on vcDNA: vcDNA=SeqID_60051; Strand=+; Position=1 -88,147-436,1013-1225
  Homolog annotation: Hit_ID=NP_491312.1; Match level="QueryCoverage =33%, HitCoverage=25%, E-value=5e-11, Identity=41%"; Hit description =putative protein of metazoan origin (1E726) [Caenorhabditis elegans]
MLLPLLSALLLLLLPPFHRFPLAQFASKPPPLSPNPKPKSPLAAGPLLLKACCGDNCEEFQRPEEVQKDDNRQLPYPFAIQMYGITWWVLFTLTFFTRARKIAVLKLRQRTKQPIRGNLLRQCAEKGKNPPEYQQFSSRTHQCCDKPIERFGTIKCCYLKDSQGRFFPKSYDSSKQCCAYPYNKITAKNAKGKCTD

SEQ ID NO: 133629 - protein, 184 aa, Heterodera glycines
  misc_feature (16)..(16): Xaa can be any naturally occurring amino acid
  Coding regions on vcDNA: vcDNA=SeqID_60052; Strand=-; Position=1 -95,225-336,378-414,469-650,746-772
  Homolog annotation: Hit_ID=NP_502449.1; Match level="QueryCoverage =95%, HitCoverage=13%, E-value=9e-28, Identity=41%"; Hit description =guanylyl cyclase (gcy-18) [Caenorhabditis elegans] emb|CAB05325.1| Hypothetical protein ZK896.8 [Caenorha
KDRPWVVKIKIFFQIXMSPQTLFSICFTMRNLLPSPPFSLTSSYSIQSVAACGDSYEGVAVAAAMYHKEKVRAFLGPYKVRAFLGPYCASEFEAVAKMCSFWNIPAISYFEAVAKMCSFWNIPAISYMPTTTAVSDRNIYKTLARTSSKNSNSIARALIRLVEHYNWKKLAIVTNLAIVTNTGK

SEQ ID NO: 133630 - protein, 92 aa, Heterodera glycines
  Coding regions on vcDNA: vcDNA=SeqID_60053; Strand=+; Position=1 -233,275-320
MTIPDETIIAPFDVFNKKTGRRLLLDDSHDQNLLLISCPIKRDKKAWIKWREEALQGSENYTWNLIDLTAGDADIGEWNWAQFPDLMANMQK

SEQ ID NO: 133631 - protein, 47 aa, Heterodera glycines
  Coding regions on vcDNA: vcDNA=SeqID_60054; Strand=-; Position=1-657
PEKMPTLVVFKIFRNSDFFITYLFFAKLIHKYFFRKCSETHQMLIKS

SEQ ID NO: 133632 - protein, 23 aa, Heterodera glycines
  misc_feature (7)..(7): Xaa can be any naturally occurring amino acid
  Coding regions on vcDNA: vcDNA=SeqID_60055; Strand=-; Position=1-122
KFLKYLXSSPFCYKKHQRALFNF

SEQ ID NO: 133633 - protein, 52 aa, Heterodera glycines
  Coding regions on vcDNA: vcDNA=SeqID_60056; Strand=+; Position=1-158
MQKPIIVNIIALANLGTGIKLNSLTITECEFKYNPRKFNAAVIKCTTPIKAT

SEQ ID NO: 133634 - protein, 24 aa, Heterodera glycines
  Coding regions on vcDNA: vcDNA=SeqID_60057; Strand=+; Position=1 -12,60-122
MRHTILTANLITQYKFQQMFLMVF

SEQ ID NO: 133635 - protein, 60 aa, Heterodera glycines
  Coding regions on vcDNA: vcDNA=SeqID_60058; Strand=-; Position=1 -153,698-727
MSTIFYSLAVCYFGLLFLGAGHALMLGVKDHRMYCILLQANITGIVQYTDELDYMGYEDY

SEQ ID NO: 133636 - protein, 111 aa, Heterodera glycines
  Coding regions on vcDNA: vcDNA=SeqID_60059; Strand=+; Position=1 -175,693-851
  Homolog annotation: Hit_ID=CAE68238.1; Match level="QueryCoverage =100%, HitCoverage=42%, E-value=2e-27, Identity=52%"; Hit description= Hypothetical protein CBG13912 [Caenorhabditis briggsae]
VMYLLLRADLLDVLRWPLGAVFTQIAHAATACIWTFREDPEVAAYMTDMDNMHKVTLKVPDEKTLLEHAKRLADEGIGHRVWHEDGMAVCIAVKPMPKQKLKPFLGNLPLY

SEQ ID NO: 133637 - protein, 141 aa, Heterodera glycines
  Coding regions on vcDNA: vcDNA=SeqID_60060; Strand=+; Position=1 -130,869-1164
MRRKRLNSLNELVKRQKEFVKELVISKDTFIKWKKELVPKYCKNPQYCIPSDGAFLDPFPASKALFQAYASQLPNPVWHFLSNTLICKSRAVLLMIMLEIFPQFSFFGRHVISSSRSSRKVSYFATDHAARVMTNRCQVCK

SEQ ID NO: 133638 - protein, 118 aa, Heterodera glycines
  Coding regions on vcDNA: vcDNA=SeqID_60061; Strand=+; Position=1-582
LFEYPKRTLEKIDFFVFGAVPPNRCAQIYGETESFGNSFPIACTLILRWIFAPHNCLSTPNGHLKKSIFFVFGAVPPNRCAQIYGETESFRNSFPIACTLILRWNFAPHNCLSTPTDT

SEQ ID NO: 133639 - protein, 331 aa, Heterodera glycines
  Coding regions on vcDNA: vcDNA=SeqID_60062; Strand=+; Position=1-996
  Homolog annotation: Hit_ID=NP_703434.1; Match level="QueryCoverage =92%, HitCoverage=11%, E-value=6e-11, Identity=22%"; Hit description =hypothetical protein [Plasmodium falciparum 3D7] emb|CAD51454.1| hypothetical protein [Plasmodium falcipa
MKNLTEARKLIEAAKNAFEVILNYSLEIKQLNNKMHELNDKFTVAVKEKEEEAKEGAAINIQQEKKLEKEIPQVLKELEREKSQHDINTTAENTETEFPSSEYEIDDSSEKQPERTEQQAEVSYVLKKKEGKLEEEKIETKDDTTINEFPTTEYGIEESETEETEKWSPDQAKQKILKGNEEPFEQPDDQKDEETILVIGTDKKGEEFPSNQYEIEDNYPSSSSSSSFIAQNEASVTTKDEEGLLTVQIKKLPMTGDNEQKTIQMVPSDFPSYNDDDSRDTTVNELSEEQLAYTVPEEDMPKSEPYDVDEFPDLPDPQTSLPRGEEVIKKE

SEQ ID NO: 133640 - protein, 38 aa, Heterodera glycines
  Coding regions on vcDNA: vcDNA=SeqID_60063; Strand=+; Position=1-117
RGQADEARTAVPCRALSPGGRAPTNAPNIAQTSPIGTP

SEQ ID NO: 133641 - protein, 155 aa, Heterodera glycines
  Coding regions on vcDNA: vcDNA=SeqID_60064; Strand=-; Position=1 -81,160-546
MSINENAMNAEMPIAMDARLRNGVNTWPAPYLENAIPNDGLNKRIMFGNFFNLTIGPALETSDLFYHFRVFCDEDKMKNTILEIDEEGKTVEKWTVSEDYSDYKFKTFTKGTRPTKVVFNSEQIQCDRYHIKVWATHAEWMDMDQTAMTVGSVYK

SEQ ID NO: 133642 - protein, 46 aa, Heterodera glycines; identical to SEQ ID NO: 129275
  Coding regions on vcDNA: vcDNA=SeqID_60065; Strand=+; Position=1 -10,59-189

SEQ ID NO: 133643 - protein, 26 aa, Heterodera glycines
  Coding regions on vcDNA: vcDNA=SeqID_60066; Strand=+; Position=1-77
IRPLRGLRTGASRPFSNFVGKLGRFS

SEQ ID NO: 133644 - protein, 216 aa, Heterodera glycines
  Coding regions on vcDNA: vcDNA=SeqID_60067; Strand=+; Position=1 -125,389-584,631-960
MSGATVTLVSNLSGLDDEREVMDGVGDIAAGFKALDCDLLIVEGLSHLKLFIPKSVHPRGTPFAFELGKDFAVKVQMYVKNDDKPALPLKFNQVAWQKSAESDQAQELQKVRRYETISDASAAAKTIRFDQIDQATDAAIAAFNQAAPAALPSGRFVEKEQITRAFRYGTTLVPFGEEVAKLVDYEREGKQLQLLQFVRKENVSFGEKPGNGKTVN

SEQ ID NO: 133645 - protein, 1469 aa, Heterodera glycines
  Coding regions on vcDNA: vcDNA=SeqID_60068; Strand=+; Position=1 -1977,2350-4782
  Homolog annotation: Hit_ID=XP_472505.1; Match level="QueryCoverage =45%, HitCoverage=42%, E-value=1e-100, Identity=33%"; Hit description= OSJNBb0049I21.6 [Oryza sativa (japonica cultivar-group)] emb|CAD39728.2| OSJNBb0049I21.6 [Oryza sativa (
MNVFEFSPMETHANSAHIIYRVTLLPQSSTLVELSMANGQEDKEVTVIGRNDLDEQLRIEPTLTSCKNGQIAVPITNFSSIPITLEANESVALVEHVDEWHELEHSFFPPFFVSSVTHENENIRTEQIKEILRTRIGRIGMSQQHEADKLERLIIGFEQIFALDDSELTQTEITQHFINTGDASPIRGRMRPLPFAHRKKVSSMLQDYLSRGLIRPSKSPWASPIVLVPKRDGSLRFCVDYRGINSVTVKDAYPLPNIDYILLALGGKKYFSTLDFLSGYWQIRMDEKSVEKTAFVTEFGLHEFTVLPFGLCNAVATYQRFMSRLFEDLINDFVFVYIDDILVASESFEQHLEHLEIVFERIKDSELKLKIEKCRFSASELPFLGHVLTRRGLKMNADKVRPVIELPLPSTKKQLHSFLGFMTYYRKFIYGFGEIAAPLFHLLKKNTPFVLGEKEILVVEKLKEKLLEDAVLYFPDFKSAMNDAERCFIILTDASKIGISAVLCQADENRRVRPIYFASRQCSRHESNYCPTELEALAVRFGAWKFAQFITGIPTKIITDHKALPPMFRSKKQTGNSRVDRWLMELNARFTLTVEYSPGKSNIVADVLSRSGALISEVTENFDMDSAFVCKLKENEGEKNLEVDEIGEKERIDWVEATKTSEPLELVCVDILSIGMSENGNRYVLVSIDHFTKYIVATPIPDKSKDTVSKAFVKDFVLLFGAPKRFHSDQGKEFVNETLKEIFAILGVEKTTTAGYDPQANGAAERANQTLLNMLKKSTSSHWSWDERLPFVVFSYNTTPSEVTGFSPFQLMFGKIANFPGEIDFKKYGNPFYTVDEETYLQAFKEHLQLILEYARKNAEISRTETKNRYDSRPNVTANKFAIGDKCMVIYPGSKSRIQHKKLHWNQFGPYKIVKMFESSADVVPVDKSSAEPITVPIERLVRVPVGVPDISTLPHGKNPYRNILATILLANLEIIYPKREQVNETPVSSEECQKRGITENSAENFDQNQLGTTDILGGRKMQQDESAELIWTMKCEGESHEFCGKLLCAELDPVLDAKTEPGNVEIGTPLQAILCLFILRSGATVSSAAAKSLVHLILGSEPGMELVVYEGVRKDNIRAGALPREEDVEKIWSMWCEKCAVTKKLLQSSGFEKIRVQNSDGEPKEKPETIQVEMPEAVPKLPESERDGWSTLFEQTGWILEKVRSMAIHRCRTLVETPRVLIGDSTAFQLLSEMRAQTQFIGTERGLLTEVIRPLSECVFSSKVRAAMIILGRDSLVKDETVDQIMEQCQRIQQLCSRFPSVSFIWLPPPYVRQYDLAYHEMIGRLSELLGDWFVFVTPFGRSLIEIWRYGDSFDRSRVNADGWMTENGIKALSAWISTQIPKWPNNRQLGIRTVRSSVSVTRRVYGLGLCDRPETAASSSARGGLGLCDRRPNSRSRSPFRRRDNRQSQPFVRGGHRRDDVTRDRRH

SEQ ID NO: 133646 - protein, 90 aa, Heterodera glycines
  Coding regions on vcDNA: vcDNA=SeqID_60069; Strand=-; Position=1 -94,246-387,646-682
MNSAGIEDPLSMVFCNADLHERHCSFLNCTNPFHREWGCITQATKMYCDQINKRFATKCECHFGRADENIPFIFPKLSKMPEDKLFYKGT

SEQ ID NO: 133647 - protein, 59 aa, Heterodera glycines
  Coding regions on vcDNA: vcDNA=SeqID_60070; Strand=-; Position=1-179
MAASFCSILYQKPRMIHCAASSAAVDDDVVLGGVDRLAMAPSSTDDGNCLSDRKGNKGL

SEQ ID NO: 133648 - protein, 29 aa, Heterodera glycines
  Coding regions on vcDNA: vcDNA=SeqID_60071; Strand=-; Position=1 -46,200-243
MTFYASLVGYTGRNNKILSVKSAFGIFNE

SEQ ID NO: 133649 - protein, 48 aa, Heterodera glycines
  Coding regions on vcDNA: vcDNA=SeqID_60072; Strand=-; Position=1 -46,200-300
MTFYASLVGYTGRNNKILSVISAFGILMSKSGTVNDILCFSCWIHGKK

SEQ ID NO: 133650 - protein, 30 aa, Heterodera glycines
  Coding regions on vcDNA: vcDNA=SeqID_60073; Strand=-; Position=1-91
MRIFFAILFLMCFKGNAEKIKVTKAEKYHQ

SEQ ID NO: 133651 - protein, 108 aa, Heterodera glycines
  Coding regions on vcDNA: vcDNA=SeqID_60074; Strand=+; Position=1 -47,133-412
MSDRRKEAEEKMGKAIFISADCWLKVFDLLPPSQLGLGIALISRRFDFYMDEHFKTRRWALKSIQIQRKIGKNGTKEMEIANYDGKPMPTPQIQLPRKVSGFERINIT

SEQ ID NO: 133652 - protein, 72 aa, Heterodera glycines
  Coding regions on vcDNA: vcDNA=SeqID_60075; Strand=-; Position=1 -140,2140-2218
MDKMPKGERRVKTAYETRKYLNREGKKKQAEKNMQTKHNGQNDELDNCFAFDCSKNGEFVTRQIQQRLVDYD

SEQ ID NO: 133653 - protein, 155 aa, Heterodera glycines
  Coding regions on vcDNA: vcDNA=SeqID_60076; Strand=+; Position=1 -209,1760-2018
MPFPFRHCFSSLLLHLPLFLLLFHTIALHRCSSMTPFPFSAPSVAVCPITFHAQAISTRQLSSVEFFLTKVITVLKEERIAADKLRQYELDPTQGIRIRERKKTYRENDLAIRNLVEGFDAIENPNEDEILAHLRSLQYRLMRNDFENWDDQNGD

SEQ ID NO: 133654 - protein, 138 aa, Heterodera glycines
  Coding regions on vcDNA: vcDNA=SeqID_60077; Strand=+; Position=1 -156,321-581
MPSQLNTFCQIKEKVPTLSGKTRQLADQQQFPLPEFLSLHDGRHLLDKAQRQFLPDGGGGKLSEANKSAGDQKDGFLGAVRQLHQMQQKLEMLLMNAVNREEKVMPQRTVQWKANGIGVQAENGDGKVEKLKMLGGAD

SEQ ID NO: 133655 - protein, 142 aa, Heterodera glycines
  Coding regions on vcDNA: vcDNA=SeqID_60078; Strand=-; Position=1 -139,184-330,385-479
  Homolog annotation: Hit_ID=NP_492616.1; Match level="QueryCoverage =97%, HitCoverage=33%, E-value=1e-30, Identity=45%"; Hit description =enzyme hatching EHE1 family member (1K463) [Caenorhabditis elegans] emb|CAB05814.2| Hypothetical protein
SAFGCVKHATIVHELLHKVGLWHEHMRFDRDDHIKVHFENIPPGQHAQFRKIGQYESHAQFRKIGQYESTTYNVPYDYLSVMHYEESGARRNGLTTMETMDKRYQNLIGTNLIGTVKDASPSDYRKICAIYKCTKCMGRGFK

SEQ ID NO: 133656 - protein, 17 aa, Heterodera glycines
  Coding regions on vcDNA: vcDNA=SeqID_60079; Strand=-; Position=1 -39,295-309
MEKACKIWRDYIDNYWS

SEQ ID NO: 133657 - protein, 87 aa, Heterodera glycines; identical to SEQ ID NO: 129152
  Coding regions on vcDNA: vcDNA=SeqID_60080; Strand=-; Position=1-812

SEQ ID NO: 133658 - protein, 55 aa, Heterodera glycines
  Coding regions on vcDNA: vcDNA=SeqID_60081; Strand=+; Position=1 -50,109-226
MFFTGTDRLFVIIFDEMKDKRKILLYLTTITIVCFACSLDLCFVFYQNMFCLVIR

SEQ ID NO: 133659 - protein, 133 aa, Heterodera glycines
  Coding regions on vcDNA: vcDNA=SeqID_60082; Strand=-; Position=1 -256,340-485
MHWSVQFPLDCNAVESDDFIWQRYFRYWQRFLIGIDNFHFFHAIFSNFASNFHLSQCPFAGFEVFVHTALKSGTDKCNFESVLRRHHIGAVLLNMPLKQYQNACTTPGTQRKKLCKWGQNLHNTKIELPYFLK

SEQ ID NO: 133660 - protein, 116 aa, Heterodera glycines
  Coding regions on vcDNA: vcDNA=SeqID_60083; Strand=+; Position=1-351
MDGSISLWFLRTHWPMLQDNIGGLSFANFGIGRFRLMHEHIFVDLPIDERPSFANCPSLRVVQVPFGHHFFPDFPPDNSSSANDGQSLAHWLLSPRPDNSPKLSSVLIYLNMEDKK

SEQ ID NO: 133661 - protein, 28 aa, Heterodera glycines
  Coding regions on vcDNA: vcDNA=SeqID_60084; Strand=+; Position=1-87
ILKVSKTCREQEEKQEDTAGRDEPHPQE

SEQ ID NO: 133662 - protein, 36 aa, Heterodera glycines
  Coding regions on vcDNA: vcDNA=SeqID_60085; Strand=-; Position=1-108
MIGRAVRNLPFIFEGIFKFILYPRKMAISFFEKFYT

SEQ ID NO: 133663 - protein, 85 aa, Heterodera glycines
  Coding regions on vcDNA: vcDNA=SeqID_60086; Strand=-; Position=1 -130,294-421
MRLCPFVGQISPVGGLCPSPPEHFKGKANKNGSTGGTSSHKARNNSQFASAQMGAQKVGRIWQQNDHRINYGNTTKKLPSLFQWK

SEQ ID NO: 133664 - protein, 58 aa, Heterodera glycines
  Coding regions on vcDNA: vcDNA=SeqID_60087; Strand=+; Position=1 -132,226-270
MYYLAKFYILVLAWFCLPWPTFDKAKQTATMNKKVILTTNRRQMEKFVSFLYNPKAMK

SEQ ID NO: 133665 - protein, 240 aa, Heterodera glycines
  Coding regions on vcDNA: vcDNA=SeqID_60088; Strand=-; Position=1 -316,436-503,546-884
MVAKSRGRASWKFRRYVHSQHGQQGCLQRDALQLMQQIGARPGLNAYDAEIVVPRVVDHWNNSQQRHRFSVFIFGSTGQYKPLYKYINNYYDTRISLYLNNAHFDESKQCKECGVIWNVRDNNRNGRKGHQCHETYCQLCNTYHNPERGCFIQPIEPKEQDPYSIVAFDLETMQHQALDPQQPEKKEHQPNFIAAPGCMPRLHSKRQMEEGNCRMSNMWATSGPLCSVNTDSWTHKWTSK

SEQ ID NO: 133666 - protein, 24 aa, Heterodera glycines
  Coding regions on vcDNA: vcDNA=SeqID_60089; Strand=-; Position=1-80
RTLSTAVRQRSSKIYSMPQILWAG

SEQ ID NO: 133667 - protein, 24 aa, Heterodera glycines
  Coding regions on vcDNA: vcDNA=SeqID_60090; Strand=-; Position=1-80
RTLSTAVRQRSSKIYSMPQILWAG

SEQ ID NO: 133668 - protein, 181 aa, Heterodera glycines
  Coding regions on vcDNA: vcDNA=SeqID_60091; Strand=-; Position=1 -96,135-252,468-628,667-837
MPNKNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQECMERKNSYFWDFFRNQN

SEQ ID NO: 133669 - protein, 497 aa, Heterodera glycines
  Coding regions on vcDNA: vcDNA=SeqID_60092; Strand=+; Position=1-1491
  Homolog annotation: Hit_ID=CAA82797.1; Match level="QueryCoverage =88%, HitCoverage=63%, E-value=2e-26, Identity=26%"; Hit description =gag protein [Ascaris lumbricoides]
MSGPIRSKIGPCAARTKAYIEAATVNLGKDTTDESIQADLTAERRGLRRAIRLLEDCNDKWQSLLLKFNGADRQQEEQRYDDFKPSGKHFMEWADKARGAVDTIDGVIGPEDDDEITGSIISQPANPPQIQHVQPHPPRHEVNLPPISLPKFAGEPREWPMFWRLFRSSVDNLPIDDFKKHIYLLGCLPHNSPARRAVDLYPPSDENYPRVVDILKKRFGDSKTITESLQAELLHLPKPGESVLSLRNFAESVERICFQLMDFGESEDNMFMASTIKSKLPFSILTHVVEKELSSGKTFSCLDIRKALQTIVEVKEEVQRCAHVLRGDERPRSSAFNSPPQQRGAWDQRGDHRHSNNRRSQPPRPFNRGGTPQPEYRAFSAINKNPERAKTPARKWGRSCSLCSGTDHLPSECPAFPTPGARRKRLKEQQRCLNCLVQGHNTEECTSPYRCRNCGNKHHFLICFKREESHSRSNGNRSASSPKSGREPGGRKFHQRQ

SEQ ID NO: 133670 - protein, 1249 aa, Heterodera glycines
  Coding regions on vcDNA: vcDNA=SeqID_60093; Strand=+; Position=1 -99,940-4588
  Homolog annotation: Hit_ID=NP_508324.1; Match level="QueryCoverage =90%, HitCoverage=45%, E-value=1e-108, Identity=28%"; Hit description= predicted CDS, peptidase family A16 and RNA-directed DNA polymerase and Integrase, catalytic domain and
MSGPIRSKIGPCAARTKAYIEAATVNLGKDTTDVKEEVQRCAHVLRGDERPRSSAFNSPPQQRGAWDQRGDNRHSNNRQSQPSRPFNRGGTPQPEYRAFSAINKNPDRAKTPARKWGRSCSLCSGTDHLPSECPDFPSPGARRKRLTEQQRCHNCLMQGHRTDECTSPQRCRNCGNKHHFLICFKREESHSRSNGNRSGPSPKSGRRPGGQRFPQRQVESQNHLITAGFQPNDQSTPPTTEGQIVQSIGMSTVDTSKGRANKAPKCKKPHAYLMTRRLLAKSNRDSRNIIKVAVLFDPGSQTTYGADPLIEKLRPHKLTSEEMEVHGFGGKREPLRFHSPIYSVLLQREDGKWEEILLNRTEKISTHFSMVEWTADESVTNHHEVCEAMCFTNEEPMILLSARHFWQFFQGKREVSPGLFVINTSFGPLINGESNIGPPNSNQKALSMTAIHRTNVEQMPTINEVEHFFNLESLGIQDDPAQDDDQTALKLFNESIRQEADGRYSVKWPWKESNPDLSSNFKIAHSRLSSVLTKLRHSPEILEKYDATIRDQLQQGIIEKAQRAPGQLEHFLPHHGVLTKKLRVVYDASAHTRGTPSLNSCLFRGPVLLPDLAGMLLRFRCPTFPLLADIQAAFLQISLEPEDREVTKFLWLKDTSKGLTPDNLAIFRFCRVAFGVVSSPFILAATLRHHLQQFDSPLSREISESIYVDNVLLECETVQEALEKYKFSKDILQQGCFNLREFISNSNEVMKQIPQEDQLDKPKAKVLGLPWDTEKDEIVFKFPTTDPLRPVTRRLVLSHLASLFDPLGVLGPCILPAKRLFQELWKEGHSWDDALSEEDSIRWNSIQSQWKDEEIRIPRRAMLNDTQSIELHAFVDASVHTFATAIYVRCAMNEKIQAWLIFSKNRLKPKSASKALTIPRMELLAILVGTRALKFAQRQLRRPIASLHLWSDSQIALSWVKTHETQPQFVERRLKEIRECLGCTFHFVRTGDNPADLATRGGTPSELRNHHLWWKGPPWLAQASHHWPSELCFQVTESDQQPYSTENVGPSGAFLAHTHSNQPNEQVLIDPSRFSSWKRLMRTTMFVLRFLALMFKRGEETVALLAKHRKEIRQISKSGDFKAEDFALAERVLIRLDQMDDAEEFQHFKTVIGDDGILRLKTRLEMSEKPYSFSHPILLAKHSTLAKLIILDRHQKRHHLGVDTTLTEFLSEFWMPSARLNVKRTLRDCLHCRRMNAQQFALPTMPPLP

SEQ ID NO: 133671 - protein, 138 aa, Heterodera glycines
  Coding regions on vcDNA: vcDNA=SeqID_60094; Strand=-; Position=1 -294,457-534,4075-4116
  Homolog annotation: Hit_ID=NP_501697.1; Match level="QueryCoverage =89%, HitCoverage=5%, E-value=2e-18, Identity=38%"; Hit description =predicted CDS, integrase, catalytic domain containing protein family member (4K310) [Caenorhabditis elegan
CSLPHFHSFIFSFCPSLNSCLFRGPVLLPDLAGMLLRFRCVVSSPFILAATLRHHLQQFDSPLSREISESIYVDNVLLECETVQEALEKYKFSKDILQQGCFNLREFISNSNEVMKQIPQEDQLDKPKAKVLGLPWDT

SEQ ID NO: 133672 - protein, 312 aa, Heterodera glycines
  Coding regions on vcDNA: vcDNA=SeqID_60095; Strand=+; Position=1-939
MPIPFRERPPFFSAPTISRPTNEVVINDRLVIDIIGQYEAENGQRANNAPQPGADNAPPPGAEDQRGPWWFDQDWGPQLPMVPENNGQNRQMDDQRDDWGAHAPPRREPSPREHTERLNSWVERHHGQQWYETATIRREAEEHLRRELRTGATLFAAHLGPFANVRFDGFSRFGPANTQMFPGRTVREHFRRRGFQVDPNLPCLQEYGGFSNSQQGIHVDYFPIDMVNVRFQIGAYQREAEPPRLPRIRAYLALEEAPNDQEGPNRGPPSRRFFEAIGLRRGNPNVGEMAENNGRQAPLQRGERAMDYGRPN

SEQ ID NO: 133673 - protein, 29 aa, Heterodera glycines
  Coding regions on vcDNA: vcDNA=SeqID_60096; Strand=-; Position=1-87
RPSHFRPIKRAPFSLNAHFHISIHSFLLL

SEQ ID NO: 133674 - protein, 67 aa, Heterodera glycines
  Coding regions on vcDNA: vcDNA=SeqID_60097; Strand=+; Position=1 -71,710-842
MLSFRMLPTMLDWLTRKKVIVEKRTFLMNQCNYYIHLEKDCHRQRRGGNFWRKGIMTAQNTNGRRGK

SEQ ID NO: 133675 - protein, 301 aa, Heterodera glycines
  Coding regions on vcDNA: vcDNA=SeqID_60098; Strand=+; Position=1 -131,270-717,1646-1972
  Homolog annotation: Hit_ID=EAA21597.1; Match level="QueryCoverage =32%, HitCoverage=16%, E-value=4e-11, Identity=40%"; Hit description =hypothetical protein [Plasmodium yoelii yoelii]
MALLSPRFNALVDKHFDGKSELTIWRTIVIRRKDKGPEPKLTVCYIDHSVIAFLRSNHQIFEKRGTNLYLSIPSSHSTNGQRIWDVFVREIWPIFSTNIHRLRITGRDHLDNLLRRTSPTILTDLNQLASIDSYDLLPAAIGDDFDVPNSTISAGQALSKWLHTPRKDGQPKRLHCKDIQEQTNFDWINNFKEYELEQYELEQYELEQYELEQYELEQYELEQYELEQYELEQYALEQYELEQYELEQYALEQYELEQYALEQYALEQYELEQYELGVVRFRHPTVQEKKYGFPYNSQPKS

SEQ ID NO: 133676 - protein, 99 aa, Heterodera glycines
  Coding regions on vcDNA: vcDNA=SeqID_60099; Strand=-; Position=1 -11,76-364
MNRRWICNDVWMDIFPSFDHAQLGLKLALLSPRFNALVDKHFDGKSELTIWRPIEIRRKDKGPETKLSVRMDDKSNKFVEFPLPDRPLPSKIRFKSLEI

SEQ ID NO: 133677 - protein, 242 aa, Heterodera glycines
  Coding regions on vcDNA: vcDNA=SeqID_60100; Strand=-; Position=1 -279,332-779
  Homolog annotation: Hit_ID=AAL78214.1; Match level="QueryCoverage =76%, HitCoverage=94%, E-value=8e-13, Identity=29%"; Hit description =putative esophageal gland cell protein Hgg-20 [Heterodera glycines]
WICNDVWMDILPCFDRPQLGLKLALLSPRFDALVDKHFDGKSELTIWRPIEIRRKDKGPETKLFVWFDYKFVPFPLPDRLLPSKIRFKRLRIEYIDHSVIAFLRSNHQIFDKRGIDLHLCIPYSNTTDGHRIWDIFGREIWPIFSTNIRCLRFTGGDHLDNLLRRTSPTILTDLDQLTSIHSGALLPAAIGDCFNVPNETISAGQALSKWLHTPRKDGQPKRLHCKDIKEQTNFDWINNFKE

SEQ ID NO: 133678 - protein, 92 aa, Heterodera glycines; identical to SEQ ID NO: 125147
  Coding regions on vcDNA: vcDNA=SeqID_60101; Strand=+; Position=1-304

SEQ ID NO: 133679 - protein, 92 aa, Heterodera glycines; identical to SEQ ID NO: 129648
  Coding regions on vcDNA: vcDNA=SeqID_60102; Strand=+; Position=1-304

SEQ ID NO: 133680 - protein, 113 aa, Heterodera glycines
  Coding regions on vcDNA: vcDNA=SeqID_60103; Strand=+; Position=1 -108,277-360,415-564
MCFSSEFEDTRTKSRFMFEQPCHCPTNQLEAIKFSKRNTVTGRWKCCTNVRRVTKKRTELMSASLTSIITAAVVTTARTVITILASALATVLERTVRGDSTRQMSQKWHCWGG

SEQ ID NO: 133681 - protein, 211 aa, Heterodera glycines
  Coding regions on vcDNA: vcDNA=SeqID_60104; Strand=-; Position=1-636
MIGFIKERRTVKGILENRPQKVVIENHVPGPNVAPYLGLNNQSKPQETEEPRKIIIPRKRLKEQTPDPESDNDTLEELTPEPQTTSTLKTPVPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKKPFKPLIWARL

SEQ ID NO: 133682 - protein, 277 aa, Heterodera glycines
  Coding regions on vcDNA: vcDNA=SeqID_60105; Strand=+; Position=1 -21,262-344,398-501,563-595,660-789,829-1000,1041-1103
  Homolog annotation: Hit_ID=CAE61976.1; Match level="QueryCoverage =96%, HitCoverage=35%, E-value=4e-61, Identity=48%"; Hit description =Hypothetical protein CBG05980 [Caenorhabditis briggsae]
SVLHIYSPGQIHREENMAIRYRLFNRLDPGGSHLFQRMPSHVIPAIFFSILPFDFQRMPSHVIPAIFFSILPFDDFKDVEGKQSSLVTIFSIWFSIWNTMMGTSLLTIPWAIHQSGLLTIPWAIHQSGFLLGLFLMLLMAALAFYTAFRVVESPNSLGDLALDRTGADFSDVCRFLALDRTGADFSDVCRFFWGRRGEYFSVFFSILVLVGGVILYFVLMSNFLFYTGNIVNEALQPNSSIIPIMVNGTLSCDVNEALQPNSSIIPIMVNGTLSCDV

SEQ ID NO: 133683 - protein, 15 aa, Heterodera glycines
  Coding regions on vcDNA: vcDNA=SeqID_60106; Strand=+; Position=1-49
LKAIHCLPVLGTAKH

SEQ ID NO: 133684 - protein, 184 aa, Heterodera glycines
  misc_feature (11)..(11): Xaa can be any naturally occurring amino acid
  Coding regions on vcDNA: vcDNA=SeqID_60107; Strand=+; Position=1 -363,431-519,926-997
  Homolog annotation: Hit_ID=NP_509946.1; Match level="QueryCoverage =98%, HitCoverage=42%, E-value=5e-44, Identity=48%"; Hit description =predicted CDS, cuticlin protein family member (XM268) [Caenorhabditis elegans] emb|CAA91480.1| Hypothetic
KMKLFLLMYNXFLIIFDGAFELDNALLGQPTISCHPDTIEMRFRTQRPFTGKIYVQGHYANPDCRVDFSEAGGADHDGRGGIRLHHGSCDMDRKRMVGPEGGTGMEFSTVLVISFHPLFVTKTDRAFHINCLFVTKTDRAFHINCLYKEADRNVGVDINVGDVTPANIQNDMPIPQCKYTIRKD

SEQ ID NO: 133685 - protein, 168 aa, Heterodera glycines
  misc_feature (36)..(36): Xaa can be any naturally occurring amino acid
  misc_feature (86)..(86): Xaa can be any naturally occurring amino acid
  Coding regions on vcDNA: vcDNA=SeqID_60108; Strand=-; Position=1 -246,526-711,867-940
  Homolog annotation: Hit_ID=NP_495301.1; Match level="QueryCoverage =73%, HitCoverage=13%, E-value=2e-36, Identity=59%"; Hit description =diacylglycerol kinase zeta (2G748) [Caenorhabditis elegans] gb|AAC24300.2| Hypothetical protein K06A1.6 [
FFYPFSSIFFSFLFTSLSHFVSQFSSNKFNFIKIKXKNDFSFFVFRRALAKSPVVKRAAAIQEQEQKRVSKHRTSRYWLDEQGPVXLSPSEHIWLPSSASSASSSAVDTECYLGEKDCQKMGEKRRCSGCHIVAHTACFPLLAKMNLSCKMTFRDSTKCQCQKSVVNG

SEQ ID NO: 133686 - protein, 21 aa, Heterodera glycines
  Coding regions on vcDNA: vcDNA=SeqID_60109; Strand=+; Position=1-63
MRKKMFDRARQEKATVCTKFA

SEQ ID NO: 133687 - protein, 256 aa, Heterodera glycines
  Coding regions on vcDNA: vcDNA=SeqID_60110; Strand=-; Position=1 -286,612-697,1276-1434,2051-2290
  Homolog annotation: Hit_ID=NP_650467.1; Match level="QueryCoverage =68%, HitCoverage=19%, E-value=5e-09, Identity=28%"; Hit description =CG6118-PA [Drosophila melanogaster] gb|AAF55197.2| CG6118-PA [Drosophila melanogaster]
MAIALASCQPSPILNGGANVIVVVANEQPKICKSNNNWALSSTSASASSSARRKSFNPVRIKEEPMQTENDGQEHVAGAETTAAVEQQQQKQHSQAFNKRHDEGEEGADDEQMGPINRQQMNNKVVGDFSTTSSSSSASNGSSVDNNRDHVDEQYAQQCQQQQHQNAVQQQQFQAVQARLWTAALALAATRQQQQQQQQHQLLPDQQQPQFVPAAAGTCRPPASQPPFSLASSMVVPSCTMRGGGGMAQLPNSVNN

SEQ ID NO: 133688 - protein, 95 aa, Heterodera glycines; identical to SEQ ID NO: 125597
  Coding regions on vcDNA: vcDNA=SeqID_60111; Strand=+; Position=1 -579,908-1363

SEQ ID NO: 133689 - protein, 46 aa, Heterodera glycines
  Coding regions on vcDNA: vcDNA=SeqID_60112; Strand=+; Position=1-147
ATQFGKSVFLNALKKIQSIAWSVSKKTLLIFIFIIFWFKNIFEYFF

SEQ ID NO: 133690 - protein, 98 aa, Heterodera glycines
  Coding regions on vcDNA: vcDNA=SeqID_60113; Strand=-; Position=1 -508,670-983
LFEYPKRTLEKIDFFVFGAVPPNRCAQIYGETESFGNSFPIACTLILRWIFAPHNCLSTPNGHLKKSIFLFHKYFFSESALKCTQIFIYNLIFSTLML

SEQ ID NO: 133691 - protein, 16 aa, Heterodera glycines
  Coding regions on vcDNA: vcDNA=SeqID_60114; Strand=+; Position=1-51
CPFGYSNNMGSKIQPE

SEQ ID NO: 133692 - protein, 254 aa, Heterodera glycines
  Coding regions on vcDNA: vcDNA=SeqID_60115; Strand=-; Position=1 -253,301-379,431-507,553-715,1627-1646
  Homolog annotation: Hit_ID=AAK69172.1; Match level="QueryCoverage =99%, HitCoverage=86%, E-value=2e-42, Identity=30%"; Hit description =transmembrane matrix receptor MUP-4 [Caenorhabditis elegans]
RSAFAKTNKTCQVNYCMDRSLNDCDVIAFCEELADGYNCTCPTYSIDQSPMPEKPGRKCKLLKNECLNPAENNCSRFADCIDKTEGYECVCRPGFRDENPANPGTDKTEGYECVCRPGFRDENPANPGTSCRQLINECKFSAINDCSPHANCINECKFSAINDCSPHANCIDLPDGYTCVCKPPYVDEGPKETGTCVCKPPYVDEGPKETGRMCCFDECANQKDNDCDKENAICEDLEEGFTCKCVPPFLFGVS

SEQ ID NO: 133693 - protein, 115 aa, Heterodera glycines
  Coding regions on vcDNA: vcDNA=SeqID_60116; Strand=+; Position=1-345
MVSVYIVCMKCQDLPGSHRGTQDGTHTHSLPSEALFSFIVFIILLPRLVNTIRESAAIVLRGVQTFVLQQFALSSRLFRHRRLIDGISRTCAIVPVGQFLAKCDHITVIQRTVHT

SEQ ID NO: 133694 - protein, 186 aa, Heterodera glycines
  misc_feature (41)..(41): Xaa can be any naturally occurring amino acid
  misc_feature (57)..(57): Xaa can be any naturally occurring amino acid
  misc_feature (123)..(123): Xaa can be any naturally occurring amino acid
  misc_feature (180)..(180): Xaa can be any naturally occurring amino acid
  Coding regions on vcDNA: vcDNA=SeqID_60117; Strand=-; Position=1-571
  Homolog annotation: Hit_ID=BAB33421.1; Match level="QueryCoverage =100%, HitCoverage=66%, E-value=4e-52, Identity=64%"; Hit description= putative senescence-associated protein [Pisum sativum]
ADIEGSKSDVAIVAWPPQASYPCGNFSDTSCWKLYTLKDRXATLSRSVFVLKIRIKXAFAFLLYERFPSSLSALGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 133695 - protein, 245 aa, Heterodera glycines
  misc_feature (20)..(20): Xaa can be any naturally occurring amino acid
  Coding regions on vcDNA: vcDNA=SeqID_60118; Strand=-; Position=1 -107,192-280,329-540,638-724,776-864,1155-1226
  Homolog annotation: Hit_ID=NP_495592.2; Match level="QueryCoverage =97%, HitCoverage=22%, E-value=1e-47, Identity=49%"; Hit description =SYnapse Defective SYD-1, axon identity specification protein (104.4 kD) (syd-1) [Caenorhabditis elegans]
GELPEGVYRQLREVQQTSTXRLRGVQGFSARVLNSGTCEGTCEIRVVQLVEIIKPGQSLGLYLREGNGIDQFTGVFVSRFGEKSELIDQFTGVFVSRFGEKSELQKCGDILRPGDQILVVNNVLVREMAIDDVVLMLSIPRRLLLRTRQAKNGKTEIRGPTERSEQRPVVVFQKMPDRRDSESNSGILAKPASNSGILAKPASTAASWLGKKVRQQQQLKKHAATASASSVSSSTTTTANDGNYH

SEQ ID NO: 133696 - protein, 18 aa, Heterodera glycines
  Coding regions on vcDNA: vcDNA=SeqID_60119; Strand=+; Position=1-56
YREAIPEGFGLPINLGAS

SEQ ID NO: 133697 - protein, 61 aa, Heterodera glycines
  Coding regions on vcDNA: vcDNA=SeqID_60120; Strand=-; Position=1 -64,109-230
MELFLFTFLYILAVCAFLALFETVLPVVWVDDQHFVEQQRREAIFNATKNCDPLSSLAITI

SEQ ID NO: 133698 - protein, 88 aa, Heterodera glycines
  Coding regions on vcDNA: vcDNA=SeqID_60121; Strand=-; Position=1 -3,163-426
MSKNTNQFRDQDVCRYWVLYRNVKKIYETFVKLEQMDKTVVAVGTEHFGIFLELKRCDQLKLIQKSVIFYKGDRKRPKTHGNGKLIIL

SEQ ID NO: 133699 - protein, 141 aa, Heterodera glycines
  Coding regions on vcDNA: vcDNA=SeqID_60122; Strand=-; Position=1-1100
IIFIQKIFFWVFGAVPLNRCAQIYGETESFRNSFTIACTLILRWIFAPHNCLSTPNGHLKKSIFFVFGAVPPNRCAQIYGETESFGNSFPIACTLILRWIFAPHNCLSTPNGHLKKSIFCFRGIPPEPMRPDLWGDRIPRE

SEQ ID NO: 133700 - protein, 231 aa, Heterodera glycines
  Coding regions on vcDNA: vcDNA=SeqID_60123; Strand=-; Position=1 -369,413-739
GYSPRIVPIINPLENTTQTQLLEFIFAFTGHSYGIKLNGKFVQSNYLKEGEEFFPINWTEPKEMKKQFERMTSFQVLLALESLDNRENLFGNYKFGFFKISAAALLVNDPPPWMPFVTIDTNYESPMIPLPFFMAIPSVEIDTEINFKISLTDINKYNFTVSLLHDRPESHLKSTVQIRRKYGIIPTKSLEVFNSSSVLIRIHARTKILMSKIISLICHTYPKKDQKLVKT

SEQ ID NO: 133701 - protein, 70 aa, Heterodera glycines
  Coding regions on vcDNA: vcDNA=SeqID_60124; Strand=-; Position=1 -153,1304-1363
  Homolog annotation: Hit_ID=NP_491533.2; Match level="QueryCoverage =87%, HitCoverage=12%, E-value=1e-20, Identity=78%"; Hit description =UNCoordinated locomotion UNC-63, LEVamisole resistant LEV-7, nicotinic acetylcholine receptor alpha subun
MVVHPSRGNQDAAQLFEELLADYNKLVRPVDENNATLVVKFKLKLSQLLDVHEKQQIMTTNVWLQQKEEI

SEQ ID NO: 133702 - protein, 31 aa, Heterodera glycines
  Coding regions on vcDNA: vcDNA=SeqID_60125; Strand=-; Position=1-139
TMGTPQCQTKLLITPNSAFGVNFCPLFQNLH

SEQ ID NO: 133703 - protein, 64 aa, Heterodera glycines
  Coding regions on vcDNA: vcDNA=SeqID_60126; Strand=-; Position=1 -171,1696-1719
MILIAFFLPLPPLFGVEIFAAWLLRGDNANVLIICRCCCCAEQSISVVGLSVMIVHECCEESKN

SEQ ID NO: 133704 - protein, 139 aa, Heterodera glycines
  Coding regions on vcDNA: vcDNA=SeqID_60127; Strand=+; Position=1 -69,353-485,582-799
MPMRIPSIQFSNFMFPVPGLPSWKMTIGEEMKQQKVMAQHILLLQEKVAKMEQEKEQQKKKKENEKYVDQFIKMQNDHFAILERISELEKQQLKEQKQQDENGKGKYGNAYGNSVKINIIYLFNIKIIFSFRSIHKVTR

SEQ ID NO: 133705 - protein, 99 aa, Heterodera glycines
  Coding regions on vcDNA: vcDNA=SeqID_60128; Strand=+; Position=1 -138,432-593
MAFCGKTVPSPLALTVNVHTVLAIRSDVALIWPLGKFSSPKMAFVWIASICAFIFPFRLMLANCSHSFHCVTLMTKLRRTLAPISWPSLRRRLTKCGRP

SEQ ID NO: 133706 - protein, 391 aa, Heterodera glycines
  Coding regions on vcDNA: vcDNA=SeqID_60129; Strand=-; Position=1-1175
  Homolog annotation: Hit_ID=CAE64509.1; Match level="QueryCoverage =99%, HitCoverage=89%, E-value=1e-107, Identity=42%"; Hit description= Hypothetical protein CBG09244 [Caenorhabditis briggsae]
DAETKVKKDADEKAKKEAEVKAKKDAEEKAKTDAEVKAKKDAEEKAQKDAEAKAKKDAEEKAKTDAETKAKKDAEEKAKTDAEAKAKKDAEEKAKKEAEAKAKKDAEEKAKKDAETKAKKDAEEKAKTDAEAKAKKDAEEKAKTDAEVKAKKDAEEKAKTDAEVKAKKDAEAKKKEEEMKKQKAKPEEKPEAPAEGVAVVPEAKKAEETKERLKQEEKPVEVPPSPAEKKRKEAEEKKAQKDAEAKAKKDAEEKAKTDAETKAKKDAEEKAQKDAEAKAKKDAEEKAKKEAEVKAKKDAEEKAKKDAETKAKKDAEEKAKTDAETKAKKDAEEKAKKDAETKAQKDAEEKAQKDTEAKAKKDAEKKAKTDAETKPKKMQKKRLQRMPRLKP

SEQ ID NO: 133707 - protein, 109 aa, Heterodera glycines
  Coding regions on vcDNA: vcDNA=SeqID_60130; Strand=-; Position=1-329
PGLKCPAQAKIFFYFREKIEIFPKKIPVDRARKTMFWKWSPFFCENSLKNHKIKKPENRFLGLTRKILKIFEILKSGKIELIELYNKSAGHLRSGQTLMSYSPGTEVGK

SEQ ID NO: 133708 - protein, 39 aa, Heterodera glycines
  Coding regions on vcDNA: vcDNA=SeqID_60131; Strand=+; Position=1-117
MLLRLHCLVVPMAGNNGGGGGGAVGVTVQPIVAAVQRCL

SEQ ID NO: 133709 - protein, 174 aa, Heterodera glycines
  Coding regions on vcDNA: vcDNA=SeqID_60132; Strand=+; Position=1-522
MPTIIAFLNKCLPNSVKKIGTTQINLDENGIKIGFEATAGAVANSLETSTATAIDEFSTVANLSQMLGETDNTESANKNNSNNDIPPTSGGQAEVASISNSNLTSSADDGQNATGGGPLTKLEKRDKPENRRILVDNERDEPIKAEEEDEKKDREESAKAERDQQTLRKIVPDR

SEQ ID NO: 133710 - protein, 398 aa, Heterodera glycines
  misc_feature (104)..(104): Xaa can be any naturally occurring amino acid
  misc_feature (203)..(203): Xaa can be any naturally occurring amino acid
  misc_feature (233)..(233): Xaa can be any naturally occurring amino acid
  misc_feature (238)..(238): Xaa can be any naturally occurring amino acid
  misc_feature (253)..(253): Xaa can be any naturally occurring amino acid
  Coding regions on vcDNA: vcDNA=SeqID_60133; Strand=-; Position=1 -51,2733-2912,3388-3555,3619-3720,4038-4195,4249-4455,4549-4819
  Homolog annotation: Hit_ID=CAE59412.1; Match level="QueryCoverage =100%, HitCoverage=53%, E-value=8e-58, Identity=35%"; Hit description= Hypothetical protein CBG02776 [Caenorhabditis briggsae]
PFLIKYLPTEQLKYNEANFLSPSLFSLHTKGHGLERQMSLPNLMKKGVHLVDRDQNEWLNLIMEASGVNEQVDTVKREFDGLYLTKENVRSKWAKWTIVHSLIXKVREMYGHEQRKSDTWEKLVQNLSKEQLAEMNRTGVVSMSAELAEMNRTGVVSMSAEQLRLIYGPSSPFNDSQTLRLSPSVFKPGIKAKVGKIIIKKNXLAKLHRIGNSLVLSPLVFSPTILSPTIMGXPAILXPAILSPRFFSPPSRXFIHLLIMFNCLIILILSPRIMTPLVLSPFIFSSIILTPIIMQPFILSPGRLNAQIAQILSPFILNPQIMSSHFFHPAILSPLVLTPALLNPSMMSPIVLSPLVLTPQIFSPKFLSGLFLSPYALSPVLMSPVFAYLVILSPSWLS

SEQ ID NO: 133711 - protein, 50 aa, Heterodera glycines
  Coding regions on vcDNA: vcDNA=SeqID_60134; Strand=-; Position=1 -113,689-728
MYAVFVCRILCVKVRVSVRSMQSNSSVHSFYDEEAPIRDKLIVAPFLFIF

SEQ ID NO: 133712 - protein, 47 aa, Heterodera glycines
  Coding regions on vcDNA: vcDNA=SeqID_60135; Strand=-; Position=1-142
LNCRGGGSRFPAPILNRRRGRGNGGEEKRNHRLLPGVTSATFLPPCA

SEQ ID NO: 133713 - protein, 88 aa, Heterodera glycines
  Coding regions on vcDNA: vcDNA=SeqID_60136; Strand=+; Position=1-268
ADIKKNNFLTNFFGFYYFYGACVKFVKFFFLIIKNHYFILFIFILNSGTNFNRIWRHLTASAAIVSQYQQQQKQKHGTNNNSKTHSNN

SEQ ID NO: 133714 - protein, 95 aa, Heterodera glycines; identical to SEQ ID NO: 133575
  Coding regions on vcDNA: vcDNA=SeqID_60137; Strand=-; Position=1-638

SEQ ID NO: 133715 - protein, 31 aa, Heterodera glycines
  Coding regions on vcDNA: vcDNA=SeqID_60138; Strand=-; Position=1 -44,80-131
MAFQMLERQSLNLFRAQNFEKVGIWIGIRPR

SEQ ID NO: 133716 - protein, 399 aa, Heterodera glycines
  Coding regions on vcDNA: vcDNA=SeqID_60139; Strand=+; Position=1-1200
MPSNSFYVVLPSNTNIEGNRTNSFRVRLPRKLQFNSEWEVGLAVIVYPHSWPSIGTVEQQFVQIEWQTGNTVRIEVPPSNVTNPHELSKNLYRLLGEGSDPLAKKVRSTQNSFMLLINKARRWAREEYIKRKTKEKRSVRDEELLLQALLTDTGTLVDLNSVAQGFLTREKRAETSNIALRIPADDNDSYQQKLDEYFSKLSEKNLSILDELGMTKLTAEIKNLSEEERAILEATKEMGTEAWIQAYREIRLVCQFNYDVHRNRFVLNTDPRYVKKVKVSPQLAYILGFNNTEFIQSENEARFMPDMSGGVSSFHVYTPDLIEPMMIGDVTAPVLLIVTIRGNPDQVVEEQFFAIQYHKLLLKEFSEILIEIRTNSGILMPFQYGTCTLTLHFRKMSYF

SEQ ID NO: 133717 - protein, 91 aa, Heterodera glycines
  Coding regions on vcDNA: vcDNA=SeqID_60140; Strand=+; Position=1 -165,219-329
MSPNEFSDRPFQQPDNVQTVQLPHQQPDPEAELRAQIEDAEEDLLLNWWREDPTIIRFLFGHRRAPTIEAALLQRAEREAEILRQYAENHQ

SEQ ID NO: 133718 - protein, 190 aa, Heterodera glycines
  Coding regions on vcDNA: vcDNA=SeqID_60141; Strand=+; Position=1 -124,176-624
  Homolog annotation: Hit_ID=EAL19820.1; Match level="QueryCoverage =91%, HitCoverage=8%, E-value=2e-09, Identity=29%"; Hit description =hypothetical protein CNBG1130 [Cryptococcus neoformans var. neoformans B-3501A]
MDNIKQNLRTKNARQQRWDKAKREERKAQTQRATEARLAKKTAPLPNPNAEVPQQDEAGPSTSAAPTEEAMEPPPPTPGPVPTPEMDEEILEFDDPPPSTPATPIGDLVPFPSTPTAPMDTGETTPPPLAIDERSERIEQLEKQLKDRDDTIQFLREQVRNREALISDLRRQLDEHIVPPMAPPTTSKSE

SEQ ID NO: 133719 - protein, 151 aa, Heterodera glycines
  Coding regions on vcDNA: vcDNA=SeqID_60142; Strand=-; Position=1 -42,96-231,662-939
MTKIPGLGLGSRFSKLINKFINIKYRNKTFFIHSKERDRKAAPKKRERSFFEQVRARLAGPVRLLPGRDGKRAKSYDDNENRPMEEVAASMPTSRDQSQARQMRQRKGSNNNQFEPVYNQQIFVSTTTTTAAAGGGHTHSIINRDFNFHVK

SEQ ID NO: 133720 - protein, 16 aa, Heterodera glycines
  Coding regions on vcDNA: vcDNA=SeqID_60143; Strand=-; Position=1-49
EAIPEGFGLPINLGAS

SEQ ID NO: 133721 - protein, 95 aa, Heterodera glycines
  Coding regions on vcDNA: vcDNA=SeqID_60144; Strand=-; Position=1 -168,606-723
MPPIPNTKVPLMLMCRCTVLFLGYCVLCYGADGSKYPNEIIDTPIVSCEQENIVVKIHPLFVTDSDRSYCAQCVYMDANLVDDLERVDDTVIGQY

SEQ ID NO: 133722 - protein, 129 aa, Heterodera glycines
  Coding regions on vcDNA: vcDNA=SeqID_60145; Strand=-; Position=1-390
MERHKQQQQQQQVRVGQLIKENAHWLCALARTKSAKKCKKLIRMASTEQLLSLVEICLNLVASRFRLTTRQKKRLMPHVNTVRRMSRARSERGARRVLVQKGAGFGGLFAALLTPVLVELAKNVVSKNA

SEQ ID NO: 133723 - protein, 80 aa, Heterodera glycines
  Coding regions on vcDNA: vcDNA=SeqID_60146; Strand=-; Position=1 -90,309-461
  Homolog annotation: Hit_ID=AAV31418.1; Match level="QueryCoverage =88%, HitCoverage=22%, E-value=2e-11, Identity=47%"; Hit description =ubiquitin c-terminal hydrolase UCH37-like protein [Toxoptera citricida]
MDSEEVTKELNELHMMISGEEEKLRNYKIEVNRRRHNYMPFLVKLLKCLAREGKLVPLVTEAVQKKKIEESKKKDSAESA

SEQ ID NO: 133724 - protein, 43 aa, Heterodera glycines
  Coding regions on vcDNA: vcDNA=SeqID_60147; Strand=-; Position=1-130
CCDHICIPLFGYAYVFVQWNVCSYMYSVCTVCIILVSKILSLF

SEQ ID NO: 133725 - protein, 357 aa, Heterodera glycines
  Coding regions on vcDNA: vcDNA=SeqID_60148; Strand=-; Position=1 -648,704-943,1221-1407
LLLDSVYALLLMSQLNFKSDSFDAQIYEGRIMGPFLIKELQNYIKMLNEAPLLDTSTNVRNKLIKLIIEISNDFFANIKRENDFCFISQRTDVCRLIRTINYVEQLIKRMKDKKLARNLKMRTIDEWWPSECETENEIQKAFAQQKVRMRPVHFDYLKRILAEEVYVSSFNELKGAKARIRKLLSDESAKGTTAEERANADQIMAMFRTQRYFERAFFYAPVVEFYEVALFDGNAEKRCAEWLKLDIIFWVTIVETIILKEEKEREEEEKVQNEQQKEAGGENEVPIKQYFEETFRLGTEQLIKTFGNERTDEILRICKRENEAKEEQWVEEEKGKATKKKNRKKKIKQKKENEAGK

SEQ ID NO: 133726 - protein, 129 aa, Heterodera glycines
  Coding regions on vcDNA: vcDNA=SeqID_60149; Strand=-; Position=1 -231,500-656
MALVRFEEAKSNRGKILLSRLVFEYAYESDSRIEQGWEYWKCPKRPPYCPGRACVQMAWHVDANGSRYKMGRMSAGGELKPATLPDFSQYNHYASAANLRPILDGHNVLSAATTAVNCGLGQAINGHTL

SEQ ID NO: 133727 - protein, 92 aa, Heterodera glycines
  Coding regions on vcDNA: vcDNA=SeqID_60150; Strand=-; Position=1 -93,144-326
MGRKRKGRRSPNAAIAILILSALSFPSGSEKTNGRHKTGKPRPTSVEVRKTVNEAKSGERRSECERKDDERANGNKRANLALANECHFEWST

SEQ ID NO: 133728 - protein, 59 aa, Heterodera glycines
  Coding regions on vcDNA: vcDNA=SeqID_60151; Strand=-; Position=1 -162,321-338
MPLSNLAKVLGPTVVGTNSRLQTMQDKQQQQGTAYMTEATNQIQIMQALLNMDHLRNSP

SEQ ID NO: 133729 - protein, 52 aa, Heterodera glycines
  Coding regions on vcDNA: vcDNA=SeqID_60152; Strand=+; Position=1-300
IIYIYEYAFLCSICHFICIDFVNMHVLRMCLSSVYIYEDALLCIYHPISVYL

SEQ ID NO: 133730 - protein, 127 aa, Heterodera glycines
  Coding regions on vcDNA: vcDNA=SeqID_60153; Strand=+; Position=1-384
MTCAYAKLLGPCFKTGRTDDRLLHRERTTESPSWTELVAGTCRTRPPPTPSSSQHGPETIAQFTQSKQHSPDPGTRPRKAGLKTELTQLLRASQRTPPANAPFATEQKEGQQTPVWRLAAQRTATNG

SEQ ID NO: 133731 - protein, 128 aa, Heterodera glycines
  misc_feature (37)..(37): Xaa can be any naturally occurring amino acid
  Coding regions on vcDNA: vcDNA=SeqID_60154; Strand=-; Position=1-826
  Homolog annotation: Hit_ID=NP_690845.1; Match level="QueryCoverage =57%, HitCoverage=58%, E-value=8e-10, Identity=49%"; Hit description =Mitochondrial protein of unknown function, overexpression suppresses an rpo41 mutation affecting mitochon
TERRTANPSLEASSPTYSNKRVNADQIRQLCPFPPHXFTSSLTLSSKCFATFPHGTCSLSDSWPYLVLDEVYHLIWAAIPNNPTPRHVKMGRHRQLDRSCTFSGAPVKGNLNKRANPSSRSIRYTSQP

SEQ ID NO: 133732 - protein, 23 aa, Heterodera glycines
  Coding regions on vcDNA: vcDNA=SeqID_60155; Strand=-; Position=1-70
RISSASRHRGARILLSCPSGILT

SEQ ID NO: 133733 - protein, 96 aa, Heterodera glycines
  Coding regions on vcDNA: vcDNA=SeqID_60156; Strand=-; Position=1 -55,305-540
MLKQYKNFIAETKMPPTGDLTPIRHQSGGVISSKKRKFSTASAAADYMSAERKEIVEIFPAASSTATARDLQIKVLEKESAKLDLEMEKLKLEIRG

SEQ ID NO: 133734 - protein, 90 aa, Heterodera glycines
  Coding regions on vcDNA: vcDNA=SeqID_60157; Strand=-; Position=1-270
MIILSTKLLTLPVLLSILLCIAKGQSVEELCEKHENEFNELFVEKKGGAVPEVLWEESLEKKEDKEEEKERLEEQKKTEKAKEKDANAKN

SEQ ID NO: 133735 - protein, 178 aa, Heterodera glycines
  Coding regions on vcDNA: vcDNA=SeqID_60158; Strand=-; Position=1 -198,792-1130
MDDVLDKYAAYVIDGVINNQSSVKGEQSTEINRNSVNKSMMNTMFMCFKMKLYAKLREDYGNERIKQCFSSFKVIRLHELQFVVLNNVFEGINEDNLLKFDIKGVFSLAYAVQYTRKQCRGEKGWQKCIYREFDFFGLSRGGVEVAAFFPEGIQLSAEAYGQLADRVKRDARVCTRNS

SEQ ID NO: 133736 - protein, 194 aa, Heterodera glycines
  Coding regions on vcDNA: vcDNA=SeqID_60159; Strand=+; Position=1 -37,89-529,608-714
MAKATKARLAKKTAPPPNPNAETPQQDEVGPSTSAAPAEEAMEPPPPTPGPVPTPEMDEEILEFGDSLPSTSATPIGDLVPFPSTPTAPMDTGEMTPPPVAIDERSPRIEQLEKQLKDRDDTIQFLREQVRNREALISDLRRQLEQCAAPPTATPTTSKTTPNRGRPRKAIDELQRSSRKQNSKLFKSVLSDFY

SEQ ID NO: 133737 - protein, 24 aa, Heterodera glycines
  Coding regions on vcDNA: vcDNA=SeqID_60160; Strand=-; Position=1-72
REKKIMFFSGTLYLLVHISFFETV

SEQ ID NO: 133738 - protein, 130 aa, Heterodera glycines
  Coding regions on vcDNA: vcDNA=SeqID_60161; Strand=+; Position=1 -156,265-501
MFATFASLLTESFMLFFGIAEWLIFARLWRFNEQRYKLSIAKSEHNLSERFQLSENIRTGKQLTPTLSFHFWMLFASVVTAFWSYFDFPRFDQIYLAINVANGVTGLIIETLMITWVSLKSWFGPPFHFA

SEQ ID NO: 133739 - protein, 286 aa, Heterodera glycines
  Coding regions on vcDNA: vcDNA=SeqID_60162; Strand=-; Position=1 -78,896-984,1037-1093,1188-1243,1296-1363,1471-1586,1734-1840,1923 -2072,2136-2219
  Homolog annotation: Hit_ID=NP_509294.1; Match level="QueryCoverage =97%, HitCoverage=61%, E-value=3e-58, Identity=44%"; Hit description =DeHydrogenase, Short chain (48.0 kD) (dhs-29) [Caenorhabditis elegans] gb|AAK68350.1| Dehydrogenases, sho
TFPFNSFLLFANLHIKIRSFFIDTMLDFIRLVRWWKKKVKGQTVVTGGGSGIVRKLLADPRTFGAKLLADPRTFGAKVAIIDINLSAKKVTEKICENGGVAKAWKCDWKCDISDANEIRRCAAEIQKNFGRVDIVLCSAALLYVVPILELNDADIQRSMDVNAMGTINTIRVFLPEMEARGKGHIVAMGSIASHFGEVFQMAYSPTKFAVRGAMECLRVELRERGLEDILCTTIYPFYVRTPMVTSKGLRPVARWLPFWLPFLTVEECAKSVVDAILKEKVNACIP

SEQ ID NO: 133740 - protein, 15 aa, Heterodera glycines
  Coding regions on vcDNA: vcDNA=SeqID_60163; Strand=-; Position=1-45
MAMALGESGIARDGG

SEQ ID NO: 133741 - protein, 56 aa, Heterodera glycines
  Coding regions on vcDNA: vcDNA=SeqID_60164; Strand=-; Position=1 -78,203-295
MALADECKGNGAVDGQWQSDGALDKKFVRPPQNRQIRPVPRLWIAKSHFHWRKCAN

SEQ ID NO: 133742 - protein, 35 aa, Heterodera glycines
  Coding regions on vcDNA: vcDNA=SeqID_60165; Strand=-; Position=1-105
MKAITTKAASTLMPECSKSTTNPEQLLMKKDTVDR

SEQ ID NO: 133743 - protein, 135 aa, Heterodera glycines
  Coding regions on vcDNA: vcDNA=SeqID_60166; Strand=-; Position=1 -90,167-484
MSIEHAEKVVAECKGAADEKLQEDKLKGLRESLRLYQEEKELIDNATADDSNGPTVITAENVKKFFDELCELPFFGADIRQMFETKQKARHELYTEYSEKKTGGITYKATRNGKGEAETAKIDWIFCFKKGTTFG

SEQ ID NO: 133744 - protein, 150 aa, Heterodera glycines
  Coding regions on vcDNA: vcDNA=SeqID_60167; Strand=-; Position=1 -159,403-692
  Homolog annotation: Hit_ID=CAE73343.1; Match level="QueryCoverage =96%, HitCoverage=28%, E-value=2e-52, Identity=68%"; Hit description =Hypothetical protein CBG20774 [Caenorhabditis briggsae]
ICCCVQAVAAARQKFPRWAFEYTAKERGAILRKWCELLGEREKQLAELLTREQGKPLAESRGEIQYAASYLDWYAAEARRCYGQVVPASKPFRSHVHLREPCGVCLLITPWNFPAAMIIRKAAAALAVGCTVVVKPAEDTPLTALALAQV

SEQ ID NO: 133745 - protein, 532 aa, Heterodera glycines
  Coding regions on vcDNA: vcDNA=SeqID_60168; Strand=-; Position=1 -352,439-1083,1138-1739
  Homolog annotation: Hit_ID=NP_608540.1; Match level="QueryCoverage =88%, HitCoverage=64%, E-value=7e-29, Identity=27%"; Hit description =CG2839-PA [Drosophila melanogaster] gb|AAF51469.2| CG2839-PA [Drosophila melanogaster]
MRVENLVMMLPIYEKLFERLRNFLVAQRNAANANVLKDGWQKAKRKAESDAAKSFDTERKMIRITVPEWVRDRHERKFRQMLGMAETPTEDGGKSELETMGKQQQTDQKQFRETLRMGLKKSTDARLRLWYFLRMETVKEIFKSIEMEFNEKEFQFNEKKQKSEAEGMEKKEKRKERNRKKNRGEGKGGKRAKDSEEKEEKKEKEEEKEEKKEKEEKKGNGEEKRRDEEEKEEEEEKREKGEEKEEKINNIKMDTEIGENYDTGENERKEEEEKEKNQRKERGNNEVKKESKEGTKRKAKREKGGKEQKTKGKGKSEEKKEEMREKREIGIKELQSDEFISQKYLEFVSKSVGEWPTNSKILLELSVYANEIWQRIEALKEIGKEFQFEFGKKVENLANKWEKAEEEKVGIDQQKENWKKIGKMRAFLKQLMANLGNGENVEEKINETGEKEQLMQLQRNKFAKSMTKNGKTAEIWHILSKERQINTLSAIFWMEEANKRCKEGKRKEFAKYLAQWETAVAQLEMGEKGVAF

SEQ ID NO: 133746 - protein, 172 aa, Heterodera glycines
  misc_feature (47)..(47): Xaa can be any naturally occurring amino acid
  misc_feature (80)..(80): Xaa can be any naturally occurring amino acid
  Coding regions on vcDNA: vcDNA=SeqID_60169; Strand=+; Position=1-531
  Homolog annotation: Hit_ID=NP_671477.1; Match level="QueryCoverage =83%, HitCoverage=50%, E-value=5e-26, Identity=53%"; Hit description =rRNA promoter binding protein [Rattus norvegicus] gb|AAK21974.1| rRNA promoter binding protein [Rattus no
SAPQAALTTSPRTIPERTARSHGQKPPHATARLTRPEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 133747 - protein, 59 aa, Heterodera glycines
  Coding regions on vcDNA: vcDNA=SeqID_60170; Strand=-; Position=1-190
FPHGTCSLSDSWPYLVLDEVYHLIWAAIPNNPTPRHVKMGRHRQLDRSCTIAGAPVKGN

SEQ ID NO: 133748 - protein, 292 aa, Heterodera glycines
  Coding regions on vcDNA: vcDNA=SeqID_60171; Strand=-; Position=1 -116,456-655,775-1277,1342-1401
  Homolog annotation: Hit_ID=XP_422667.1; Match level="QueryCoverage =68%, HitCoverage=15%, E-value=2e-14, Identity=28%"; Hit description =PREDICTED: similar to KIAA0794 protein [Gallus gallus]
NRERLWNPVFEQYRQDHQQPSSSSAAASFLSRRANGANALQAARQKGVWLLVNVQEASEFACAVLNRDIWSVETVREVVRSNFLFWQVANASAFWVPLQPLSPLSLSSFPAIFIVDPRTGEEVSGRLKASDSVSFLDSRKLSRFTSYPHICSNHFLQSLRSSTRTRPLRRAIVSSENKHRYKMPIPIQSFNCSTPKKSTLPPEFVRTTSPPSPKNRTETPTKKRKKPVDDEEKDIETEEEGQQEKVKTKRESKEERMMNIQAKKIKRVMTISDHEDLSTRRPFASSQFAASN

SEQ ID NO: 133749 - protein, 73 aa, Heterodera glycines
  Coding regions on vcDNA: vcDNA=SeqID_60172; Strand=-; Position=1 -146,260-335
MKRSAATLSAAAAAADPNQYENKTEPIPTHLEAEPDHEKKGSPPPESARRLEPIVPPSAEGEAPGRRPLFCEL

SEQ ID NO: 133750 - protein, 113 aa, Heterodera glycines
  Coding regions on vcDNA: vcDNA=SeqID_60173; Strand=+; Position=1-342
MDVSLASVAKDLGFDGHDLTDMLAKLPVEEGFEGDMDPDEDTLLSNCPQHWVAFQSKVSPCLADINKEDSDEAPPGTTLGHSWADVEQFLLEQEEGLHQPTSHIYSNPIDTQK

SEQ ID NO: 133751 - protein, 91 aa, Heterodera glycines
  Coding regions on vcDNA: vcDNA=SeqID_60174; Strand=+; Position=1 -70,129-334
MAIDKSAHQKKFVGTISVEPSVNAQRLRREQQQHQLLDGQNTGELIQQIFDELNAQHSSTGRILERNGRALFRIADHPGTETPCHVPKGQQ

SEQ ID NO: 133752 - protein, 223 aa, Heterodera glycines
  Coding regions on vcDNA: vcDNA=SeqID_60175; Strand=-; Position=1-671
MSSPIDAILGPKENADPEAGAKASKTKGSNKPKVSPANMAEIQMELGNAKEEILSAVAKYIGEAMSTVNRGMEGFTAAINQMANVLDENRAREEMEQMSLDDPELEAVSVEARETGKEPESPTEGENGQGETHPGPKGISLPQEQSARERGRGTGQGRAFIRGRGGHGRGTATGAAAHARHYFNMRQGHRAHHQHHNHRHPAPGHCRCHDCQPPNHHFGRRFR

SEQ ID NO: 133753 - protein, 119 aa, Heterodera glycines
  Coding regions on vcDNA: vcDNA=SeqID_60176; Strand=-; Position=1-360
MFTKPPYLRANKFNLDMERKEEAASASAVGDHLKILRAEFDKKLEEFAQKAIELVNDKAMAMKEGFFEVQWQGHPFFKHEKLSKNGSQGIIANANNNNNNKEMAEEEKPNEEPSKKGID

SEQ ID NO: 133754 - protein, 153 aa, Heterodera glycines
  Coding regions on vcDNA: vcDNA=SeqID_60177; Strand=-; Position=1 -264,315-511
MPSTNSAAARYERAIRRSQCANRQADICLSKAIAVEARIKRRSATQLRKKALARLKMDLGLARAAINSGNFFLKRKKGISLWLLPNGRGPLRAAIVVHHGPPLPPPPPPPPPPPCDLMAALQIVAPLAAPGGKKGQLALCFRCHVELFDKQPE

SEQ ID NO: 133755 - protein, 31 aa, Heterodera glycines
  Coding regions on vcDNA: vcDNA=SeqID_60178; Strand=-; Position=1-93
MGSKNPTHNYSTGYREAIPEGFGLPINLGAS

SEQ ID NO: 133756 - protein, 103 aa, Heterodera glycines
  Coding regions on vcDNA: vcDNA=SeqID_60179; Strand=+; Position=1 -181,370-497
MDDLLNDIDEDQQQSESGSSSLPPQSVNTMAWLEQNKQNQARAFSENLLKDLSAVSETGKSAEFNVKDEMEGEAGDEEENQFIQNCQRIRSYQVASEKNCNHE

SEQ ID NO: 133757 - protein, 126 aa, Heterodera glycines
  Coding regions on vcDNA: vcDNA=SeqID_60180; Strand=+; Position=1-381
  Homolog annotation: Hit_ID=XP_522969.1; Match level="QueryCoverage =99%, HitCoverage=84%, E-value=2e-15, Identity=34%"; Hit description =PREDICTED: similar to putative protein family member (XC187) [Pan troglodytes]
MVIRRGTMVIRRGTTVIRRGTTVIRRGTTVIRRGTTVIRRGTTVIRRGTKVIRRGTKVIRRGTKVIRRGTKVIRRGTTVIRRGTTVIRRGTTVIKRGTTVIKRGTTVIRRGATVIRRGTTTVENVQ

SEQ ID NO: 133758 - protein, 20 aa, Heterodera glycines
  Coding regions on vcDNA: vcDNA=SeqID_60181; Strand=+; Position=1-61
KTSWRRNGSAETGAPKRVGP

SEQ ID NO: 133759 - protein, 39 aa, Heterodera glycines
  Coding regions on vcDNA: vcDNA=SeqID_60182; Strand=-; Position=1-117
MAADSCSQSPEELILKTRKRKIILISKAQSNTITIREGK

SEQ ID NO: 133760 - protein, 221 aa, Heterodera glycines
  Coding regions on vcDNA: vcDNA=SeqID_60183; Strand=+; Position=1 -58,294-453,499-629,675-900
  Homolog annotation: Hit_ID=NP_499596.1; Match level="QueryCoverage =95%, HitCoverage=8%, E-value=5e-41, Identity=40%"; Hit description =type 3 phosphatidylinositol (3N342) [Caenorhabditis elegans] emb|CAA22108.1| Hypothetical protein Y75B8A.2
FMGTRRTRVGEKIPKFTAKKSAGAGNLGVLIPKIASLLCKMEPIRMPSVKLRNYFRDFWFYCVTLGFAFPLGCPWPEEWYNAICKIAPWPEEWYNAICKIASKSPALLPHENFKTEMVENAAIKVDGIATTEHQQVRNIISNEFKQTEHQQVRNIISNEFKQNAEVIAIVSRMDIGYCLFLLAVCRLEKLRVVYSRHSTVVQTLFTYLENRSNCFDLNNQF

SEQ ID NO: 133761 - protein, 215 aa, Heterodera glycines
  Coding regions on vcDNA: vcDNA=SeqID_60184; Strand=-; Position=1 -200,247-691
MEEKFRPVNSLFAPTVDQSVFYEQSTSQNTAKPLPPNNANSSEKPSTLPNDGVGRTPSPPQMPSDRNCFSSSKTKFELPNDVNESNSDWTKNISKTAANEHSQRTPRVNWDGQSLAHYDGTGGGEGKEQTTNGSKNNGKTKENSSKKKVGKMEGEGREKNGEFIQYTSRNTGTYTDSEEEEADNEEEEDARSDVTLMDQNGRREGQNGTGGLQQK

SEQ ID NO: 133762 - protein, 54 aa, Heterodera glycines
  Coding regions on vcDNA: vcDNA=SeqID_60185; Strand=-; Position=1-162
MVISFLYQNPSSYDAAEEITNMTWAQFDHHCVRNGDNQVNAQRECSQLKGFGNG

SEQ ID NO: 133763 - protein, 306 aa, Heterodera glycines
  Coding regions on vcDNA: vcDNA=SeqID_60186; Strand=+; Position=1-918
MNFKTAGGLGNKINEAFSHHYKIKKQRGRREAKAEDTKDSKIDVAKRAAARAGRDVERHFNQINNISNSIQTQLNTLRETNPHILEEPDIKIWFDKMVEMGTEIQTSRNELKSFQEEVDKAKNITLEHVEKNDLKKAKKSADVAKGIARQAKTKYTSTLEGYNDKSEKGFSGIVNRLNEALGEHIKRKDIENRQVSEAEKGPQKRERLANEDVQFQYDSIDQKFIVYLSAAVSHIDLSKHLAYVLGFKNTRLFHAEEATYMPDLTGGVRQLYIYAPNLIENTIIGNQMAPLLRIVNVVDDPGSISE

SEQ ID NO: 133764 - protein, 67 aa, Heterodera glycines
  Coding regions on vcDNA: vcDNA=SeqID_60187; Strand=-; Position=1 -137,404-470
MLPIKIILLIFLICTPNSAENITENAKSRNERDLKQQLAYACNGLIGSLKYVLRVIDFIRGFWQSNN

SEQ ID NO: 133765 - protein, 24 aa, Heterodera glycines
  Coding regions on vcDNA: vcDNA=SeqID_60188; Strand=-; Position=1-72
MIADLRPSLEEKMAPPMETPTPAK

SEQ ID NO: 133766 - protein, 100 aa, Heterodera glycines
  Coding regions on vcDNA: vcDNA=SeqID_60189; Strand=-; Position=1 -29,96-190,267-445
MAAGACSKRRAKADVTVPTADGEGTSTQAAESGSSTSTLDLPTPVRHHVRVRPKTTDKATNMDFTTTDNATHMDLTTMDKATDVDLAYEDAATQTEQLDK

SEQ ID NO: 133767 - protein, 333 aa, Heterodera glycines
  Coding regions on vcDNA: vcDNA=SeqID_60190; Strand=-; Position=1-1002
MNGEDEVTVQEWTELKIGIMKEALKAKFSVPDLKDVLLSTGSAIICELSPDQFWGVGCRPGLIYDKWPTADIQQWNGSNTLGRLLMQLRDDVKEATPKGTTRAVQPNYGWPKNREENFQNIPVEEEVFDLKSFENLEITSTDEAKDKPKNSTKANSISELLMSHADEVAETEEKTNEKFALSERMNQWLKYAGINCQVLVFGSSLCQLARHGSDLDLFIYKFDQTSVRLADELGKVRQILRQKYPRTEMELRARGNTPVLKIKLEFHVDLTIGRSEKLNGVYNSVWLATLVRINDLFRSVCLLIKEWGTDINQPEFGSFNSLSLVIMVRRLLR

SEQ ID NO: 133768 - protein, 1924 aa, Heterodera glycines
  Coding regions on vcDNA: vcDNA=SeqID_60191; Strand=-; Position=1 -4366,4455-5861
  Homolog annotation: Hit_ID=NP_508324.1; Match level="QueryCoverage =67%, HitCoverage=48%, E-value=1e-135, Identity=28%"; Hit description= predicted CDS, peptidase family A16 and RNA-directed DNA polymerase and Integrase, catalytic domain and
MKLQLELERVCRQLEHYNQDLSSPQIYMSLEQKLSKKVLTRYVDLKNVKLSAMPHGSDWSTNLFRETFKAAVEQLKQINDIVQRANPEQTHHTSKREKHKSEEKESTLNLAIRYKDQEKKDNRQSSGAVKPKPWRGTSTSSEGSSLRSSSQSSRYGRSPGRKPGSPWPNQSRRRESNSSSPSPSQSRSPSRFPCQFCAEKHFALDCDKFSSVVNRRKQIEAKAMCYICLFNNHMARNCPRKLRKCFLCQRTGHHPALCERRKSVARGQVATTTTEKQENTSTNVFAIQSCMKNPKEIWSLLKCVWVIIRHPMFPKRKKRVLAFLDDGSEKTYIAKILVEELNLMKINEVHFQAKGLQGTKLGDFVTSVVELNLLGKNFNMNIQARQLDKVMPKLPHVKIKGAKIDKLLSNKLQVLPKFEEPLLLIGGDVYNHLAVKPVQQLANGFWISESKLGNILSGEGKVKLSTKELANTASTTSVEKIVEFSPKFGNKLQPDDDELTFMVEQHNKLETIGLGDANDRDDNAKWIQNFEQNLNFNGERYEVRLSWKEEVTSLPDNYYLALGRLKSNFKKLREKPCLLKQYHEIIHDQLEKGMIERVDSSINYWKLKGTKERDELNGVLYYLPHHFVERQDKQFTKIRVVFDASSKLRKEFPSLNECLNKGPNLYNDLAGILLRARLKPVLVTCDVEKAFLQISIHPDDRDALRFLWYENPEDENSPIVEYRFSRVTFGVICSPAHLSIVLKHHFAKYRQPQIRLMEKDTYVDNIVLGIDQDKTIGQTYRLLKAVFRDAGMNVREFVSNDWSEIEKLPETDQGKKEETKLLGVGWDLESDKLTVKLARFPKEGKITRRTILSQIAKSFDPLGIVSPVILKGKLLRQSVEQNGKLKWDTIVDKNLASVWIKLMNSWDAKTLSFTRKYFDATEVRNYELHGFSDASETGLGCAIYIRANTNEGAQTQLAFAKSLVVPTQLSKASRTIPSLELHAAKICCNNLLFVKRELEKAITIDSVHLWTDSTDVIDFLNSSKLKDRFIRNRTKFIQDKMIPVSHVDGKFNPADYASRGCSPEELMENKCWFYGPNWLYKDKSEWPKSIKEYDPTAPNENKHQDSFIEMSLVTKSSVMEQVELLLNYEQFSQFRRCRNTLAYVLRAVQNFKNSANKIIISAVKPSNEVKSFSKQINPLTIDEVERAEVHLWKEAQKAFPPSNETILNLNLFQENGIWRAKGRMQNSGMDHYAIHPIYLNKNCPIVDLIIMDIHRERKHTGMENMVASLRSKFWIPSVRSKVNSVLRINPNTRCWICARFHAKAYAYPEAPPLPSYRISGNLIWETIGLDYFGPMTVKSSDGQGKHKVWGAIFVCALTRMIHLELVTDMTAKRFLLAFTRFVRRWKIPQRIVSDNGTNFVLGNKALTEIVQQSIKEKEHWLKVLKDEKVQNFSNQQKIEWVFISPFAPWRGGQYEQVERIVNERPITYTSQSEVIQPLRPIDLILPNIGNNRLEINTRSVENTYNDYILENSNTANVVQRYQKAMNMAEKFWQNWKDSYLLGLRERHQGNKHTPGKAPKLGDVVIISEPQTPRNCWKLRKIEEILSQRTARVRISEKSIIERAIKHLYPLELAENANNSDSGIRKQEHSSVKQIHYNWAKEPPQNKALVKANSPNHYKWAKQPPRVINGITNVTCISEMARDFDAVSLDCEEMERDLEDEHKEEESKDERKGISQIPVEERRPWDGVGEKRVIINAPIAFVGDDEVEPIGRTFQDNGLRALVLVHSLRDIAWWHRLPEVVIINDVCQMVVVRTTEWAEHIRPFLSLLGRWAKPAVWIGSPIHVEGVAWLEPAQTVELDINRLVFMGAPRITQRGGSALYKKRCQQSFSDDHSSGATKSKRFRPVEDQPSHSEWTQAIRPIRPVEDLQQHQSSSNPRFHPPQQFP

SEQ ID NO: 133769 - protein, 145 aa, Heterodera glycines
  Coding regions on vcDNA: vcDNA=SeqID_60192; Strand=+; Position=1-436
HKEEESKDERKGISQIPVEERRPWDGVGEKRVIINAPIAFVGDDEVEPIGRTFQDNGLRALVLVHSLRDIAWWHRLPEVVIINDVCQMVVVRTTEWAEHIRPFLSLLGRWAKPAVWIGSPIHVEGVAWLEPAQTVELDINRLVFM

SEQ ID NO: 133770 - protein, 73 aa, Heterodera glycines
  Coding regions on vcDNA: vcDNA=SeqID_60193; Strand=+; Position=1 -211,663-673
MHETGVETPFLHRLEAQTALDCTIPLLLLFHPLAFGFRPQSLSTPFDHKSNCVSVGRSTPLEEGWARACRDQN

SEQ ID NO: 133771 - protein, 184 aa, Heterodera glycines
  Coding regions on vcDNA: vcDNA=SeqID_60194; Strand=+; Position=1-554
  Homolog annotation: Hit_ID=EAA09806.2; Match level="QueryCoverage =69%, HitCoverage=25%, E-value=2e-12, Identity=33%"; Hit description =ENSANGP00000016017 [Anopheles gambiae str. PEST]
RAVQNFKNSANKIIISAVKPSNEVKSFSKQINPLTIDEVERAEVHLWKEAQKAFPPSNETILNLNLFQENGIWRAKGRMQNSGMDHYAIHPIYLNKNCPIVDLIIMDIHRERKHTGMENMVASLRSKFWIPSVRSKVNSVLRINPNTRCWICARFHAKAYAYPEAPPLPSYRISGNLIWETIGL

SEQ ID NO: 133772 - protein, 397 aa, Heterodera glycines
  Coding regions on vcDNA: vcDNA=SeqID_60195; Strand=-; Position=1-1192
  Homolog annotation: Hit_ID=CAA82797.1; Match level="QueryCoverage =42%, HitCoverage=26%, E-value=3e-16, Identity=32%"; Hit description =gag protein [Ascaris lumbricoides]
MSDIYVERIETAKYAIELYLDKPLPILPLGVLTSQQRHNLICDQREWKEIADEIQTQVDEIKAARVLYNQELSALQGDAKTEFQRQFRASVNANDLQNFLRRANHKLADTRTLKGNIDRLLQDGPGGTARRNIALPKLSLKEFDGSNWDDFWPLFESTIHADADLDYVQKMSYLDSLLRGEAKKVIQGLLPFSRDNYDLSVSLLKDKYGKNENLIRDLHNQLARLSNSKSLGDDMKLQLELERVCRQLEHYNQDLSSPQIYMSLEQKLSKKVLTRYVDLKNVKLSAMPHGSDWSTDLFRDTFKAAIEQLKQINDIVQRANPEQTQHTYKREKHKSEVKESTLNLAVRYKDQGKTDDRQPSVAVKPKPWRGTSTSSEGSSSRSSSKSSRYGRAPGRKA

SEQ ID NO: 133773 - protein, 42 aa, Heterodera glycines
  Coding regions on vcDNA: vcDNA=SeqID_60196; Strand=-; Position=1-127
REFDFASSPLNTAYKLAGTEIVMRHKGHEVRKARASSNSESP

SEQ ID NO: 133774 - protein, 334 aa, Heterodera glycines
  Coding regions on vcDNA: vcDNA=SeqID_60197; Strand=+; Position=1 -276,329-779,831-1108
  Homolog annotation: Hit_ID=AAL78214.1; Match level="QueryCoverage =56%, HitCoverage=95%, E-value=2e-12, Identity=28%"; Hit description =putative esophageal gland cell protein Hgg-20 [Heterodera glycines]
WICNDVWMDIFPSFDRPQLGLKLALLSPRFDALVDKHFNGKSELTIWRQIKIRKDKGPGPKLSVRIDDKIVPFPLPDRPLPSKIRFKRLRMCYIDHSVIAFLRSNHQIFDKRGTNLYLSIPSSYSTNGQQLIWDIFVREIWPIFSANIRHLRITNGDDLDHLLRRTSPTILTDLNQLVSIHSFDLLPAAFGDGFDGPNSTISAGQALSKWLHSPRKDGQPKRLRCGNYNEQTDLDWINNFKEHFLRANAISSVSYEIHFYVHVPSIQMVPFDLVNECTKEKLTLAKANENELDNWIMKRCKIIGETAAVHWEDGNWDNNCNNVFFWLFGTTNCI

SEQ ID NO: 133775 - protein, 235 aa, Heterodera glycines
  Coding regions on vcDNA: vcDNA=SeqID_60198; Strand=+; Position=1 -63,309-953
MTGQMQWDRRVPHLSVFASVIERQIFLRQKRQQQPKGQDDECIVRQHGTGIDCGDRETDAGNEEEKEEGDGQQTDSYSDLSDLDVFSSCDEDTNGGHEKTPPVTREETATKEHGKKEGGETKTETEESVGEEGQQQKTESKAKATEEGDTNNNTKASNSGMKRKKMQSSASQRHRHGHCSERRQKHKQHLLDSLICGAFAHRDLTPPELALGYALRQHCRVSHFVRQILQKIFLL

SEQ ID NO: 133776 - protein, 28 aa, Heterodera glycines
  Coding regions on vcDNA: vcDNA=SeqID_60199; Strand=+; Position=1 -52,98-132
MASCHDYFESPHCEACVIIIFKIVRQSF

SEQ ID NO: 133777 - protein, 96 aa, Heterodera glycines
  Coding regions on vcDNA: vcDNA=SeqID_60200; Strand=-; Position=1 -151,716-855
MCHGNWRKDLNSTKCSMGQQSVANAAKMPGKFNFHFATQQSFSENKITYSTSPVTNKWHKEFFTNSMLGPFLEEYAELWLLAADIVPKLSQKRKTK

SEQ ID NO: 133778 - protein, 31 aa, Heterodera glycines
  Coding regions on vcDNA: vcDNA=SeqID_60201; Strand=-; Position=1 -23,58-130
MSKIKSLGSSSGYLFLFLRSDLLKFLHHYLI

SEQ ID NO: 133779 - protein, 42 aa, Heterodera glycines
  Coding regions on vcDNA: vcDNA=SeqID_60202; Strand=+; Position=1 -40,558-646
MNQNSNASYTAAPESALKRTKFCCHINKHSNAYILEKAYEFD

SEQ ID NO: 133780 - protein, 38 aa, Heterodera glycines
  Coding regions on vcDNA: vcDNA=SeqID_60203; Strand=-; Position=1 -49,100-164
KMYFTTEIFFNIKSYAFAVKKRALSRNKLKGIIAIESS

SEQ ID NO: 133781 - protein, 148 aa, Heterodera glycines
  Coding regions on vcDNA: vcDNA=SeqID_60204; Strand=+; Position=1 -237,512-718
DGVWYYRNAFIPINLECKQPPPAEIVKEWMDKYGSAAPKSTKQAKQKVATPLKKSSHKPKLSSADKDSEMLKRKRKHEQMLSNSSTSSSSTSKPLPVSAQKVVSSSALPTPGAPSPNIPKQKQPARPSSAPTPKTALSSNAINETPTK

SEQ ID NO: 133782 - protein, 66 aa, Heterodera glycines
  Coding regions on vcDNA: vcDNA=SeqID_60205; Strand=-; Position=1-199
MTDIRGIHTTEVWQASHGLIGKEYCTTQTIGERGPLSTYNYDGDKNTVNFCWKIASHPIRHHPFIH

SEQ ID NO: 133783 - protein, 24 aa, Heterodera glycines
  Coding regions on vcDNA: vcDNA=SeqID_60206; Strand=+; Position=1-72
MGRFITAPNLLATFNRCLTCQIGR

SEQ ID NO: 133784 - protein, 1088 aa, Heterodera glycines
  misc_feature (3)..(3): Xaa can be any naturally occurring amino acid
  misc_feature (762)..(762): Xaa can be any naturally occurring amino acid
  Coding regions on vcDNA: vcDNA=SeqID_60207; Strand=-; Position=1-3306
  Homolog annotation: Hit_ID=NP_920205.1; Match level="QueryCoverage =98%, HitCoverage=75%, E-value=0.0, Identity=38%"; Hit description =putative DNA helicase homolog [Oryza sativa (japonica cultivar -group)] gb|AAP52492.1| putative DNA helicase
TDXKNKENKKITLCDFTKYKLFFRNGKFLPHHYSNKLFQQWCVDQAARIEWDRLNFIKLHQKEICKELVKLTNFYAKATEVGAQVKKKIILPSSFSGGPRNMHESFMDAMAIVNEVGRPDLFLTFTCNPKDEDILKSMISGQQAFDRPDIVARVFHLKVSQFLREIIDGKIFGKVAGFCYTIEFQKRGLPHLHMLLTLDSANKWKNTNDIDQFISAEVPNENIDKELYDLVTALMVHGPCGPANAMCWCQKKKKCSKKFPKQFREKTEINENGYPLYKRPNDGKTFKKGLENREEQVDDNQDIVPYNRYLLKRFKSHINVEKVADIKAVKYIYKYIFKGYDAATLRCVTTNGNVKELFYDETGNYLDARYLSPVEACWKIFKFPLQAKSHSVQRLPVHLENEQIIFFDENDDDETIIEKRDKSKLMAYFDFTNENPGMSDILYTEMPKFCTWNSKQGKWLLRKNPEIRIGRMYPVNPTEGEKYYLRYLLLHVSGKGFEDLKTFNGIIYNTFAQACLARGLIKNDDEWKHCLNEASHFKIPTALRNLFASILVFGEPKHPENLWEQFKNNLAEDFFVNNTINAAYKLALSYINKHLIREGKSLADFKLPQDYSINDDEENIDYEEEKTAYNLYNLMNSEQKCIFDSVKQVILGQIKQKLIYIDGPGGTGKSFVLNAIFHLVRSHKKQINNMAFSGIAAILLKKGRTIHNRFKFPLNINANVVSGVVQGTKAAEEIIKSDFFIIDEAPMTPKFALDAIEKKTTXITKCNHLFGGKTIILAGDFRQTLPIKKFAIRSEIIDLTIRKSIFWSKFEQMKLTVNNRAKDEIFAEQMLDIGNGTLGDLIQLPSECILSDDSNLTKEIYGDIFAHNFNELKNRMILSPYNDLVDHHNALALENFPGEYVTYLSIDEVETTHNFPVTPEIMNSFNAPGFPLHKLKLKQNCKVMLLRNISIEDGLCNGTILQVLELKDNLLRCIILGDDKDGSEVYIHRISLITENFPVPLKRHQFPVKLAFAATFIKGQGATYEKIGIDWTRPSFSHGQTYVALSRVGSWQQIKIKLPADNKDGKIQYSLERNFINPNKLFKKLKVL

SEQ ID NO: 133785 - protein, 361 aa, Heterodera glycines
  Coding regions on vcDNA: vcDNA=SeqID_60208; Strand=-; Position=1 -439,890-1299,1440-1673
  Homolog annotation: Hit_ID=NP_494149.1; Match level="QueryCoverage =60%, HitCoverage=17%, E-value=2e-16, Identity=27%"; Hit description =predicted CDS, putative protein of ancient origin (2C297) [Caenorhabditis elegans] gb|AAF39854.1| Hypothe
MVRKKQKLITDDCAPSTSNDQRTNDGFKAPGQKSGQLIETVQSSVQKRSETIHNSIELQSKEKSTERRCLKRKRLQMEEVIDLDDLPDEFFSPSISNEKIKEYDRNRKISRFQMNEEQRKLERELNLTVVQARRELIKNQGLYLKADQAIDYRLNVFRDPGGDPKDQTVALIAYIENYLRENYIYSKSYEMMKDVYEEALEESKKTGDEIPDVQMLFDIREGTDLRRYNIPRSNEVCAIIWRDANDDIPAANIVVHAKGSKKLKRFFHLVQWLNPCVTRYFIPQWCVDQAARIEWDRLNFIKLHQKEICKESYSEIDKFLYAKATEVGAQVKKKIILPSSFSGGPRNMHESFMDAMAIVNE

SEQ ID NO: 133786 - protein, 78 aa, Heterodera glycines
  Coding regions on vcDNA: vcDNA=SeqID_60209; Strand=+; Position=1 -162,415-489
MDEKVKYRKYGLYRTYGQKKVVLEVSNMAKYGKNMDEKVKYGKYGLYRKYGQKKIFSLKMAKYGKNMNEKVKYGKYGL

SEQ ID NO: 133787 - protein, 242 aa, Heterodera glycines
  Coding regions on vcDNA: vcDNA=SeqID_60210; Strand=+; Position=1 -11,71-340,504-948
  Homolog annotation: Hit_ID=AAL78214.1; Match level="QueryCoverage =75%, HitCoverage=95%, E-value=2e-12, Identity=27%"; Hit description =putative esophageal gland cell protein Hgg-20 [Heterodera glycines]
MNRRWVCNDVWMDIFPSFDHAQLGLKMALLSPRFDALVDKHFDGKTQFTIWKAIKIRKDKDEMPKLFVEGKSEGFPLPDRPLPNKIIFKKLRIEYIDHFVIEFLRSNQQFWDKGTTLYITVWEKNEDNKPIWDVFVAEIWPLFATNICQLCFAGAEFLDYLRRLISPTILSDLNRLDSIISCHLFPDVLADDDDFDGPNTTSAGQALAKWLHNPRKDGQPKSLHCWELKASTNFEWLTNFKE

SEQ ID NO: 133788 - protein, 70 aa, Heterodera glycines
  Coding regions on vcDNA: vcDNA=SeqID_60211; Strand=-; Position=1 -125,305-383,431-439
MTIPSLEAPAFYFTKALSHRQKVMRLYKRAIRETQSWHAQDLCDWHNIFLLTDVANFGCTEMFPKQCDDG

SEQ ID NO: 133789 - protein, 201 aa, Heterodera glycines
  Coding regions on vcDNA: vcDNA=SeqID_60212; Strand=-; Position=1-603
  Homolog annotation: Hit_ID=CAE70655.1; Match level="QueryCoverage =25%, HitCoverage=5%, E-value=2e-14, Identity=72%"; Hit description =Hypothetical protein CBG17362 [Caenorhabditis briggsae]
MLFNEELKISRNFQVSFAKDVVKASDQNDLAADQIEFLNQTLGIGQLTKLILAFYTMTVYALIEFALNWANVIPLNAILIGLATFKGLFFLHSSNLRCHGFLCLQNCLVDSNWNVKLTNFVTEEIIGDKLRHNEMKHISASELIKEKKAKEAAKKMKSGGGGTAKGTAADAEGADEVDSEAAGAKRRKRQAAAERKRVENS

SEQ ID NO: 133790 - protein, 103 aa, Heterodera glycines
  Coding regions on vcDNA: vcDNA=SeqID_60213; Strand=-; Position=1 -34,141-245,303-475
MNISAKAYKFRGNETEIVWRAVDFHGELKQCVTKLVFEGGTSSDDATAGHSSNDKDIECPEWQIREVNVSAEFGGDPLTDEPPLIRAEYPPILAKNRRLLRQK

SEQ ID NO: 133791 - protein, 25 aa, Heterodera glycines
  Coding regions on vcDNA: vcDNA=SeqID_60214; Strand=+; Position=1 -46,929-960
MITNAAQLAQAKYWKDWKNRKKVLN

SEQ ID NO: 133792 - protein, 174 aa, Heterodera glycines
  Coding regions on vcDNA: vcDNA=SeqID_60215; Strand=-; Position=1 -184,785-1125
MCFNFAVCKHAFTFDNTIYKVNGEFAKVIEKWGITKDKPDIKCHGKAMEAKVGCQTYRCMDEYNNDVFVINGCATDRGNCSHTELDEFCKLKSKKLRTKCDFCYDEDTVCNANNTELLIKTYIDCKLSMDYSWLYTPSAELKKWLTNRNMEKNLRTCAKRIYKCQAFTCTDKGE

SEQ ID NO: 133793 - protein, 126 aa, Heterodera glycines
  Coding regions on vcDNA: vcDNA=SeqID_60216; Strand=-; Position=1 -67,126-242,838-1034
MSLFRRLAIFIVLLAFFPLFCGALKCVVGSHGLQKGHDKDFEHTECANPNHKRCTKIKCSAAPNESFLEMKCYPDDTNCDFYNKDVNEKVGYMASSKWNCTCEFGNLLNDDPFTSGHFVGWAAEFN

SEQ ID NO: 133794 - protein, 89 aa, Heterodera glycines
  Coding regions on vcDNA: vcDNA=SeqID_60217; Strand=+; Position=1 -45,160-271,486-598
MSFLAAPEVQCSRMEEFQQLAKFFEILNNRLLRSIQKNAADNESAACGTTGQKKERIYYSVRDLGMEVRGWVRGEYFQIQHHFMFKVKY

SEQ ID NO: 133795 - protein, 81 aa, Heterodera glycines
  Coding regions on vcDNA: vcDNA=SeqID_60218; Strand=+; Position=1-243
MRLFCLPNEAFENFHLPSLNPATVLYITLEKTSLEKDLFNPQYEWCVPKNATLALINKNYKKLAMATHPDKNNQCSGKLFT

SEQ ID NO: 133796 - protein, 22 aa, Heterodera glycines
  Coding regions on vcDNA: vcDNA=SeqID_60219; Strand=+; Position=1-67
MATTSQMALEPPIMVTQDTGMK

SEQ ID NO: 133797 - protein, 31 aa, Heterodera glycines
  Coding regions on vcDNA: vcDNA=SeqID_60220; Strand=+; Position=1-95
IVLKKGAQKTHFCVKIFSFGRHFSSLEITIL

SEQ ID NO: 133798 - protein, 195 aa, Heterodera glycines
  Coding regions on vcDNA: vcDNA=SeqID_60221; Strand=-; Position=1 -230,290-511,736-871
MFEAVAMPHSIFICSARRTTLNFRFIFVKKIFYLHKYHAGHRFVKPTILAIFGKNTAQLFALKQQSKFSFLAIEKWKQIKKKLGYRNQGCQILIPLSKIRPYFVEKIAKMSDFTKRLTWWIFGNGLALLKNDASKNVFRLSKSGLDRPRLPLASHPIKCQNTTGKLTFTFWLYNGARIEVLILEDREDEVKKNRF

SEQ ID NO: 133799 - protein, 241 aa, Heterodera glycines
  Coding regions on vcDNA: vcDNA=SeqID_60222; Strand=-; Position=1 -346,533-912
MNEIKSGNFDASSGIEWLNKHSFAVFCDGKIKEEINDENLEKLRKYFRESLLNGTLTTDDENVRDLVKKVQIDEKKAIIGKMAKDSILGKENKENFKNFLDKLIIGIEKTAAIIKAKNHQFSHQKNNRQLNIRAKRGVKDVLCRMCAAVIALIPYIMICGFLFYLSVMQLKENNTDHIFYYRLWNYLRYFDGITNYYMYLVGRCLPISRLIIWAVVIFWTGIFLVRVVFSYSNSFLFFCLV

SEQ ID NO: 133800 - protein, 73 aa, Heterodera glycines
  Coding regions on vcDNA: vcDNA=SeqID_60223; Strand=-; Position=1 -180,463-504
MQHHHHLSCAFWADQLSICKSDRDRRGARISNDKEKIDQRDDQSLQSIAENVLSVCLDKQNVPRWLFGGRISV

SEQ ID NO: 133801 - protein, 188 aa, Heterodera glycines
  Coding regions on vcDNA: vcDNA=SeqID_60224; Strand=+; Position=1 -241,305-630
  Homolog annotation: Hit_ID=NP_492997.1; Match level="QueryCoverage =47%, HitCoverage=4%, E-value=8e-21, Identity=54%"; Hit description =VAB-10A protein, Variable ABnormal morphology VAB-10 (vab-10) [Caenorhabditis elegans] pir||T27702 hypothe
MLDPDTGLFSHPDAQKQMTLKELIVKGYLNPYNTRIMDRASGTDMHLLDAIREHIVDDVAGTVRDTLTGRVHDFATATRQGLVKEDSGVFSVDRRTSRTSLGDAGSPRIVERKLQLTPYAQEPFQAASSTGSVGSVGGGTTHGQHASLFDAAAAGPVVSAAKSRDVWSSSNGHGTAIIRERVPMPEHA

SEQ ID NO: 133802 - protein, 155 aa, Heterodera glycines
  Coding regions on vcDNA: vcDNA=SeqID_60225; Strand=+; Position=1 -148,650-744,891-1115
MAPPKNGTPKENRFMRRLRKMLKAAKKLYRDWHINHLAPIGFIGIYMFVGIPLTLITLNELGKFLYKCINEIMAVVSNRWNAQKEYERKTTHFFKDQRIAQKDLIFDYDLKSMSEDKKFSESSAGGDNLTMDAEKGAFLTAEGQLRENEAKTAIG

SEQ ID NO: 133803 - protein, 39 aa, Heterodera glycines
  Coding regions on vcDNA: vcDNA=SeqID_60226; Strand=+; Position=1 -24,80-175
MTESQQKRAKDIVESLDWIKPAEESTNPIIAKMESMQVN

SEQ ID NO: 133804 - protein, 116 aa, Heterodera glycines
  Coding regions on vcDNA: vcDNA=SeqID_60227; Strand=+; Position=1-351
MEADVSHEVHGQSNGHQTKKCGEMKQRIFINRRCGHGNGVQVDAPIKEQSEHAQIDGQNAGGAGQNGADGRSEHHQNESHAEKGERNCKKMDKQKDIRYNKADSPVCIVTDGILSN

SEQ ID NO: 133805 - protein, 831 aa, Heterodera glycines
  misc_feature (794)..(794): Xaa can be any naturally occurring amino acid
  Coding regions on vcDNA: vcDNA=SeqID_60228; Strand=-; Position=1 -173,414-469,516-626,687-921,1040-1216,1282-1406,1470-1579,1627 -1785,1833-1933,1984-2145,2192-2241,2295-2457,2503-2695,2750 -2985,3164-3208
  Homolog annotation: Hit_ID=NP_496761.1; Match level="QueryCoverage =99%, HitCoverage=86%, E-value=0.0, Identity=48%"; Hit description =PaTched Related (90.8 kD) (ptr-18) [Caenorhabditis elegans] pir||T26683 hypothetical protein Y38F1A.3 - Cae
KVITINFHAIFPNSTMETVMKKWEHSVYNFAMNSRGDPLLKLHVTSEGLVSEEVRRTGIEVLPLMPISLSVIILFTVITSLKRDQIRSKPWEALVGVFCPTVITSLKRDQIRSKPWEALVGVFCPILSVGASFGTLFWLGFEFLPLGFEFLPILVVVPFLILAIGVDDVFIFLHCWAHTDPSKDLRERVADLLGSAGPSVTITSLTNWLSFTIGIATPTPAIRTFCLFISVAVLYAYLYQLFFYTAVMVIGAQREADERNAYLPCIKRVPKRSPKVATLKKETNLWRLGSTNLWRLGSDLVDRYVDFVMSWTARILLAISLIIYWAFSAYGVAQIKVAQIKVGLTSEKLFLDDSPLLELVRLQNNVIFKEGGQMAVFVNSPGDLRKPMAVFVNSPGDLRKPSAIPKIMRILERFEQSNGSVGPSSTQMWLNTYLPFIGLQNRGSINRGSIDFRYKYLYDFFSIPEYHRWSHFVSLGPKEDCLNERPSCINKFFDCLNERPSCINKFFFSTGFQNAVAWSDRLVLLQRWRQLAADYSQLNLTVYEDFSMYADQMYADQLLSIPSVTIQTVAFALLCMTFVAFALLCMTFVLVMFTPSISTILPGTACVLSINLGVFGLLFYWSIDLDPISMTTTLMAIGLSVDFVAHISFHYYKGMTTTLMAIGLSVDFVAHISFHYYKGEIEDSRERLRHALSSIAWPMLQAALSTVLSLMILVLIHAYMVQVFVKVVLLVVVLGLVHGLVVFVKVVLLVVVLGLVHGLVVLPVVYAAIPFQKSGATAKPKVPPLNRRRTAVTXQKRRREMEKKNGRHQREDGTESKEEKEKEWFRDSSRT

SEQ ID NO: 133806 - protein, 89 aa, Heterodera glycines
  Coding regions on vcDNA: vcDNA=SeqID_60229; Strand=-; Position=1 -60,1382-1590
  Homolog annotation: Hit_ID=CAE59402.1; Match level="QueryCoverage =69%, HitCoverage=7%, E-value=2e-22, Identity=75%"; Hit description =Hypothetical protein CBG02766 [Caenorhabditis briggsae]
MAQKLAPIINGWTKCLDEFSVEHEGVQYAYSDFCGAQCETSDAVNIFLTVFRDVQHRGKGNIKLTFPTIDVFGHRIYLAHNIFQVQLNN

SEQ ID NO: 133807 - protein, 209 aa, Heterodera glycines
  misc_feature (33)..(33): Xaa can be any naturally occurring amino acid
  Coding regions on vcDNA: vcDNA=SeqID_60230; Strand=-; Position=1 -110,545-645,697-760,830-875,927-1017,1062-1121
  Homolog annotation: Hit_ID=NP_500920.1; Match level="QueryCoverage =89%, HitCoverage=30%, E-value=1e-44, Identity=50%"; Hit description =C2H2 type zinc finger containing protein (57.1 kD) (4G888) [Caenorhabditis elegans] gb|AAC24408.2| Hypoth
SIPLFPFESPPFPPFEPPPLSLPLSPISSLSIXVPPQYACVKCGQSFSIKRELSTHHRIHSGEQPHKCLQCGKEFGTRQLLKKHSMWHIQCGKEFGTRQLLKKHSMWHIGKRSHTCPHCGKSFFQKRSHTCPHCGKSFFQKGHLKGHLTQHLMIHSGDRPHQCELCDKTFIFKFDLNRHLKIHQERKIKKCLNRHLKIHQERKIKKCGK

SEQ ID NO: 133808 - protein, 106 aa, Heterodera glycines
  Coding regions on vcDNA: vcDNA=SeqID_60231; Strand=+; Position=1 -149,672-843
MGAANLASLSPWNQAASNNESANGSGFLRNHHKWTKWSPIVVSFVQRLMKTKAQFGDVPDKIGVVKIAIIRMVGRFPGSGYGDGMFEFGVRLKSRGFRGATLIQWL

SEQ ID NO: 133809 - protein, 256 aa, Heterodera glycines
  Coding regions on vcDNA: vcDNA=SeqID_60232; Strand=-; Position=1-769
MTSIPPALAQYQICPTSPLEGSSVTMSFPAEKNCTLPTETQPIMNKSILYIPIRIPRSFPVFKCWNVTTVACTESFLRVVTLDHPPKKFESETSLDDCQNSLNHRPMNRISEKRWESSKPIRKEYGWYGVNCYDNVQTVIEEGTGGILDGEMLVTSWGDSLKIEQFTIGKDDWIRLPGAVELLMWRIPSGEYCDTHFSMGPVTTETWPGQAVVVHELQYTFPISKDQDRKNQVIGVPKEAIKTENNVLIHYIGEAE

SEQ ID NO: 133810 - protein, 176 aa, Heterodera glycines
  Coding regions on vcDNA: vcDNA=SeqID_60233; Strand=+; Position=1 -255,479-754
MVPTAEEEEAKTKTETEHLEMIESETEEGKAGKGKMRVAEKGGKASRLPKMMQRKGKAKERVAEDGDKWRKMPKSPLMSVAHSVKTRFTRLTTLRQSKDALPMSRSLEIGRQQSRIPTVCGGGDPMTKSWSLETTAMQNNNNNKNNSGSEMPRRGPITTLMPSPRGMPRRMPTEGG

SEQ ID NO: 133811 - protein, 389 aa, Heterodera glycines
  misc_feature (342)..(342): Xaa can be any naturally occurring amino acid
  Coding regions on vcDNA: vcDNA=SeqID_60234; Strand=+; Position=1 -202,855-1496,4544-4830,5054-5093
  Homolog annotation: Hit_ID=EAK89192.1; Match level="QueryCoverage =99%, HitCoverage=3%, E-value=3e-51, Identity=33%"; Hit description =very large probable mucin, 11700 aa long protein with signal peptide and pronounced Thr repeat (308 aa long
IPASVFCIPIRLNLAEMTVDIVTPGTTQTATRTRTRRTASRRRASTAARSVTVPGASGRSTASNETTTTTTADAATNTDATGAATVTTDAATTATTPPTTTTADGATVTNANEPGATTATNTEAPAATTPATTTTADGATVTNANEPGATTATNTEAPAATTPATTTNADGATVTNANEPGATTTAATTNTEATAATTTTAIADGAVATNTDATGAATATTDAATNTEAPAAATAPMTTTTTADGAAATNTDATGAATTPTTNAATNTEAPAATTPATTADVTSTNICICAVFQGPPAATNGTAGANVTTTTTPATTNVNNNTAPENAAAASSSSSTTVTDXMTRGRMTMHGTTTTTITAWHEEKWRSEWTRILQRNCGPTENKLKNFI

SEQ ID NO: 133812 - protein, 109 aa, Heterodera glycines
  Coding regions on vcDNA: vcDNA=SeqID_60235; Strand=-; Position=1 -114,201-301,638-752
MVRATTARTRASAARARSIKINRRNAKKARAAIGRAGHTRNAIAREKCMMCLGKVSSMTRVTMGCVHEFHRRCLYRWLKYNTNCPVCRFNFMRAIPPEEPAEEQQQQQE

SEQ ID NO: 133813 - protein, 46 aa, Heterodera glycines
  Coding regions on vcDNA: vcDNA=SeqID_60236; Strand=+; Position=1-138
MSPIFLGFYKGLLPPLVIETPKRALKFMAFDRYWRVLRSDALPTWL

SEQ ID NO: 133814 - protein, 110 aa, Heterodera glycines
  Coding regions on vcDNA: vcDNA=SeqID_60237; Strand=+; Position=1 -189,320-463
MVVKHLKGEKKDTPPTYAVEFKASNTKLLSRQQIYDLVAQLMNELSPESAVNLTQPDLLVIVHTIRTVTMLSIVANYYQRRKFALKLATESEPKEKSNEKQNTTHEEGET

SEQ ID NO: 133815 - protein, 32 aa, Heterodera glycines
  Coding regions on vcDNA: vcDNA=SeqID_60238; Strand=-; Position=1-97
MAAPSIRLITTSKAPPATGHRSEQRRPSKPSS

SEQ ID NO: 133816 - protein, 226 aa, Heterodera glycines
  Coding regions on vcDNA: vcDNA=SeqID_60239; Strand=+; Position=1 -247,549-979
  Homolog annotation: Hit_ID=CAE67008.1; Match level="QueryCoverage =97%, HitCoverage=10%, E-value=2e-75, Identity=53%"; Hit description =Hypothetical protein CBG12408 [Caenorhabditis briggsae]
MAPFAFQSDPNVPTTTYVIRKKPQQAREPVFVNIDDIEQFSWIEPLQKVVEERLNEPDYKTIWSAHFVLVFSLDTLKADQHAQDAHSYKEVEHAFINTLVRGDVSSLTWVESGNQYFAQSRDQLGPGLELCSVYYAAVNFRDVMLAYGRLPPDAIPGQFADRECLLGMEFAGRLQNGRRVMGILPAQALATSVVCNRDYCWEVPDGWTLKEAATVPVIYATAYYAL

SEQ ID NO: 133817 - protein, 95 aa, Heterodera glycines; identical to SEQ ID NO: 125597
  Coding regions on vcDNA: vcDNA=SeqID_60240; Strand=-; Position=1-536

SEQ ID NO: 133818 - protein, 47 aa, Heterodera glycines
  Coding regions on vcDNA: vcDNA=SeqID_60241; Strand=+; Position=1-144
VQAWIQVSRSLDFSWTWIFLDFCPGNQGPGPTWNPGPGPGFFQNVDL

SEQ ID NO: 133819 - protein, 43 aa, Heterodera glycines; identical to SEQ ID NO: 126089
  Coding regions on vcDNA: vcDNA=SeqID_60242; Strand=+; Position=1 -91,754-794

SEQ ID NO: 133820 - protein, 172 aa, Heterodera glycines
  Coding regions on vcDNA: vcDNA=SeqID_60243; Strand=+; Position=1 -23,253-356,409-800
MDKWAALVLLIALINALDSAVVRQQRAANADASKPEPNNEKPGNVDSDKGNSDKSQGAGTEGKNPDEPKESQEEDEPNPKKPKESQEVEEDGPNLEEPKKPGTREAEGTWRKKGQGGGGKKTGGKGGKNAKKRGKRAPDEPAPKSPKMPDKFDLKLPSMHKTLIVLGSDPIF

SEQ ID NO: 133821 - protein, 136 aa, Heterodera glycines
  Coding regions on vcDNA: vcDNA=SeqID_60244; Strand=+; Position=1 -121,560-651,694-737,787-867,1742-1813
VSFYSRGGYQFAAKKYGIEKEKPTENFKNMEEIDEYGFMHDMVLLLFDGCVICNGKEVPNVTLSLLQHMPQGPLVDSCQEYVKRPSKALIVPMKRVQQESQGNFAYAVLLMERLCPEKKPATDIDNPANKFYMQML

SEQ ID NO: 133822 - protein, 156 aa, Heterodera glycines
  Coding regions on vcDNA: vcDNA=SeqID_60245; Strand=-; Position=1 -110,248-608
MARCVTSLAFLPIGDLTPGIIALDMALPDELTPVLDCVYTRTLQGDDRTNNHSEAANRRLQCAFACSHPSIWHFIDLLRKDRNLSDDDFAKCSTGQEPPQKAKKYREADRRILTMVQNYLPLNNVDTNIFPIHHPFNHHFIITFLIGISRNYEMRP

SEQ ID NO: 133823 - protein, 200 aa, Heterodera glycines
  Coding regions on vcDNA: vcDNA=SeqID_60246; Strand=-; Position=1 -3,170-364,784-951,1014-1248
MKGAGVHAAHWRDAFLESKAKNASTRAVAQAAARGEFIRTPQNSDYVRLRDLLPEQRDVREAAAEEWHESTDSLRNERWAVARRDREIKALKRELRKEQVEKQKEIEHLEDCCNEYVQSMQRILQMSATQQGLLRLFGKAAIMAKIEDSEEFNFLLEDQELLKIVLGEATDVAAKAAKKRKKPGATPPPQGAVAQQQTVP

SEQ ID NO: 133824 - protein, 316 aa, Heterodera glycines
  Coding regions on vcDNA: vcDNA=SeqID_60247; Strand=+; Position=1-951
MLEQKAYVLNYMPKIYQVHQNERKKKRCYLNVTINGKDVEALFDTGADVTYVRNSTANQCMLNVRRGDFPQARAANKTSIRFFGSALAEIKLGEFEGKFPLLVSEDDCCPCAAIIGTDLMDYITEQGEEEIGLNFKKGSVRIGHIHLPMVAAVTIEKKPIEIRLLTTQTLPPFSDTFVWGQLNQSFDAEKIFITTEREHQYFPLRVGKCLASPGSTRNAPLRLLNFGNCPIKVHAGSRLAILEAISDTTQINSLKEEDKNEDPNIMNEAEWSKFKAEIDHISPEADWTDQPLEFPKEVEKIKSILERTSHYIGCPL

SEQ ID NO: 133825 - protein, 15 aa, Heterodera glycines
  Coding regions on vcDNA: vcDNA=SeqID_60248; Strand=-; Position=1 -30,364-381
MDATQLTMNEANREF

SEQ ID NO: 133826 - protein, 38 aa, Heterodera glycines
  Coding regions on vcDNA: vcDNA=SeqID_60249; Strand=+; Position=1 -95,254-275
MEIFDEYIIVDEKSLSINIGSKFNEVTQFAAMCLPIDS

SEQ ID NO: 133827 - protein, 57 aa, Heterodera glycines
  Coding regions on vcDNA: vcDNA=SeqID_60250; Strand=+; Position=1 -63,114-209,478-492
MKTLRSQAGRQSMPMVVNFGRTGDAQRTGQVGGRRSMPPSVVPANLGGVPPYQETTK

SEQ ID NO: 133828 - protein, 226 aa, Heterodera glycines
  Coding regions on vcDNA: vcDNA=SeqID_60251; Strand=+; Position=1 -354,637-717,1218-1308,1436-1590
MLPPSVGGGWPTAYATQQQQSINAVTSSSAKLLPQQPFYAAGNYSSKAAAASMFGVMPRPPMLCPWGGGSAVIGPPLPAAYAAQQQQPIDSIPSSSSWNFGQQQQYQFAADLSQQHHKMAGPTSSTAALNPTLFVPTAKVLDPELVDEGLKKAKQQVSSVANAQSSDEQRRKLLTEAEVILSTAVSTDVNSFKCVCTHLYTLLGKEDQAKEAFTNCNFGYGNLHLE

SEQ ID NO: 133829 - protein, 160 aa, Heterodera glycines
  Coding regions on vcDNA: vcDNA=SeqID_60252; Strand=+; Position=1 -174,307-615
MDSLFDAGKNEGRKKDEANGGGDGNMLRNGQRKRSQRKDEEHQVEAQNEPNADKATVTSFNLIWPHFKVPPNHAFSAVAFSFSANSSAVHSMGWTDSSTSRTFFESDDSGMPLRKCVGRLGVLPKRDGRQNEIRWTERKALAKGMAETFGMNSCLAQKCI

SEQ ID NO: 133830 - protein, 213 aa, Heterodera glycines
  Coding regions on vcDNA: vcDNA=SeqID_60253; Strand=-; Position=1 -275,437-613,675-862
QILQMHFCARQLFIPNVSAIPLANAFRSVHRISFCLPSLFGKTPNRPTHFLSGMPLSSDSKNVRLVEESVQPMEWTADELALKEKATAENAWTPIYRYRGFVGVWFILRFNLVFLIFSLASLPLSISQHIPISPSIGLILFSSLVFAGIKKYFTRIVAVVSVDTASRSIYRIGYPSVFATRRSRFARFLDVQPLSTNSDSVRGVARLRFTDGF

SEQ ID NO: 133831 - protein, 161 aa, Heterodera glycines
  Coding regions on vcDNA: vcDNA=SeqID_60254; Strand=+; Position=1 -129,654-758,963-1214
MEQFLKQENLDYQVQSTDFMTQANSLEDFFGKVVVDNIVQEKKKAYAKQPNDMKGIAVNWDKWPNVARKVEDANVASKRVSQKKPGTISKQLGSGTSVTQKSSATESAAKSTTQKSSATLRQKSEADREKSKKEEETETETDEEEETTDNEGRGGRRRGKC

SEQ ID NO: 133832 - protein, 33 aa, Heterodera glycines
  Coding regions on vcDNA: vcDNA=SeqID_60255; Strand=-; Position=1 -80,399-420
MTIVMVCRFRFVLALVVTEIHRHIDKCVFHSLQ

SEQ ID NO: 133833 - protein, 137 aa, Heterodera glycines
  Coding regions on vcDNA: vcDNA=SeqID_60256; Strand=-; Position=1-414
MAFFPELQCWHGFSAEAELKVYLPELGLHNSGIHMPLKTYSVTKSTKNCPNHLLKCYKSQCIISKDAIIERIDKKLFPENATYEVEGTELEGERTAENFDQIIYPSEISIMLARKMGSKFCKLTHYWAKKKRKFKIF

SEQ ID NO: 133834 - protein, 137 aa, Heterodera glycines
  Coding regions on vcDNA: vcDNA=SeqID_60257; Strand=-; Position=1-414
MAAAAYSFLAMHDADDGPALAGINLNYRHMVFMYHDKRRALNKPPSSGRKGGAGGGGGSADSPPSSAVAAQLDESPSSSCYFSLHAIKFYFQVVHRHAVSKYRKKKKTTKNCYFFNVKFAKNNPSSCGCAPKFRRRI

SEQ ID NO: 133835 - protein, 39 aa, Heterodera glycines
  Coding regions on vcDNA: vcDNA=SeqID_60258; Strand=+; Position=1-117
MTEQMCRISAERTVGQQIEAVMTYLANVRGEVYENAMCW

SEQ ID NO: 133836 - protein, 102 aa, Heterodera glycines
  Coding regions on vcDNA: vcDNA=SeqID_60259; Strand=-; Position=1-652
SFSYQKKKENYYKENLFIFFKLQKQNSAAFWGLSFFGVFFICPLALSERKYENFCSAKWLFVGISGRNDGQMLDYSMNESADGRQKKYCHFLSDEFKFHWKK

SEQ ID NO: 133837 - protein, 21 aa, Heterodera glycines
  Coding regions on vcDNA: vcDNA=SeqID_60260; Strand=+; Position=1 -22,163-206
MARCTVTHPINQCCKDHDKYV

SEQ ID NO: 133838 - protein, 63 aa, Heterodera glycines
  Coding regions on vcDNA: vcDNA=SeqID_60261; Strand=+; Position=1 -126,185-250
MNRTAVPEENGKMEHTFERMGNIQWGVGELEWEAWMRQLDGTGYQTGHKYRLPILLEPMTKKK

SEQ ID NO: 133839 - protein, 293 aa, Heterodera glycines
  Coding regions on vcDNA: vcDNA=SeqID_60262; Strand=+; Position=1 -78,311-374,468-855,2354-2500,2550-2751
MLDLVGKEKSYSQKIGWGRTVRGRTELVVDILATAGFILDAESALKLRFYIVSFLNYAFPNSEELSASALPPFASVDGSSQFVPPATTTTTAAPLALESSTVEQQQAQPNPFKAAPPYSVYDIANGNFTVLGCTAQRPYLFLTLIARQWAALLMLFMGLERLLFVLYPLWLRSIQMNWFFFGIVIAPQAFGCLFCIIAYFMVHHEHALRKFGGNRLKLASEKRKLRKIKWLLITSSSFVAFPQMLLLFLQLIAPQEMFLIKMLISQLFLAKCFGNILMYNRAIASTRFGFIEM

SEQ ID NO: 133840 - protein, 27 aa, Heterodera glycines
  Coding regions on vcDNA: vcDNA=SeqID_60263; Strand=+; Position=1-83
LKNRFFQKMIYQKLICKIFKCDSKPIF

SEQ ID NO: 133841 - protein, 95 aa, Heterodera glycines; identical to SEQ ID NO: 125597
  Coding regions on vcDNA: vcDNA=SeqID_60264; Strand=-; Position=1 -62,227-1009

SEQ ID NO: 133842 - protein, 112 aa, Heterodera glycines
  Coding regions on vcDNA: vcDNA=SeqID_60265; Strand=-; Position=1 -226,468-580
MGEMVVNEIEWARIERPLDDTQLAFAVQNDMHLKKRTDGATTLDLEAFMMNPFFVRMIQDEKIKQILCRILFDERGMLKYGYPQTKISNLMISLSLNKLKISQKTLPGLTTF

SEQ ID NO: 133843 - protein, 16 aa, Heterodera glycines
  Coding regions on vcDNA: vcDNA=SeqID_60266; Strand=-; Position=1-49
EAIPEGFGLPINLGAS

SEQ ID NO: 133844 - protein, 315 aa, Heterodera glycines
  Coding regions on vcDNA: vcDNA=SeqID_60267; Strand=+; Position=1-948
MVEHLALVAPIVNAGLGRLENFGRNMGEINGGEIRNLPPIGHLFERNGDFEDSWVRERPPLNSPLFESIRHAYLNVGRAENRGHHLPPSFPNRAVEAYATGGQPTAHYTRAHVIQQLHTFYTQPIAVKPTVVQYQAHLQQQFAPAAPNRIHSPVSANFNRDANIGRNQQPQTFQHKERGQQVHKQIAYASHDHLPFQKGTNSRDGNFGQINPVNEQNRYYQSNQVDPNMIMAQTIKSLDNFSYSMTLHHLPELRGNAGADEVNVFFRQLDAVSEDWPNDKRLSAALKSNSRVGQNAQPIPPLPTIPSGMKISEER

SEQ ID NO: 133845 - protein, 233 aa, Heterodera glycines
  Coding regions on vcDNA: vcDNA=SeqID_60268; Strand=-; Position=1 -290,853-938,1555-1880
MAKILSKIDDNGDISSADQTSEYRIFQFVLQFLTKCNLTEQNKINVQNCFCILSFFVEQLLENAINAKHFPLVGIESISMARERFAEKQQQLCADKSISKEIRKYFGESIVNFAKAVELDFDFDNDIQQIVPVLLMQFEKLKENKVWNNANPKFFKTVEWNLLEFELKASDKKEKWEQIEKLRNNWEDTFGKMEQENAKFEEKMQNLKEYLGKMKQEKSVSRKKQLQVKFIEK

SEQ ID NO: 133846 - protein, 107 aa, Heterodera glycines
  Coding regions on vcDNA: vcDNA=SeqID_60269; Strand=-; Position=1 -188,891-1015,1087-1097
MHNFLKDTEKQKIKFSQILFETVTKYNDNVNYDEHRQLISFPLSMGVHLVKRFSALITLISQRFFDYKIQIRDNNLLEINSPTWLLPYYVNYENENEIKQKEAKEIY

SEQ ID NO: 133847 - protein, 25 aa, Heterodera glycines
  Coding regions on vcDNA: vcDNA=SeqID_60270; Strand=+; Position=1 -27,191-241
MYAAAKEQKKNFWLTNYTYRKKIAN

SEQ ID NO: 133848 - protein, 18 aa, Heterodera glycines
  Coding regions on vcDNA: vcDNA=SeqID_60271; Strand=+; Position=1-56
YREAIPEGFGLPINLGAS

SEQ ID NO: 133849 - protein, 130 aa, Heterodera glycines
  Coding regions on vcDNA: vcDNA=SeqID_60272; Strand=+; Position=1 -65,231-558
MERISLFVNIAGIVFIFFCIGSDAVSISDCAERRFPGSESFVCVCNRTFCDLPIGPHRLGKNDNNAIVYISDPAKFRLHQQQVPIEVEYSDQNRRKDKPQRICSSDDEGMEKPAHFGSNNSDLANAIKKC

SEQ ID NO: 133850 - protein, 62 aa, Heterodera glycines
  Coding regions on vcDNA: vcDNA=SeqID_60273; Strand=-; Position=1 -157,285-316
MKGSKPLKDSSKEYQTGLGSGGAFTDAAGVNLNALSNTTRATLLRAYFDKDIATFFTLLWKT

SEQ ID NO: 133851 - protein, 65 aa, Heterodera glycines
  Coding regions on vcDNA: vcDNA=SeqID_60274; Strand=-; Position=1-221
AKNFFYFREKIENFPKKIPVDRARKTMFWKWPSFFWENSLKNPKIQKPENRFLSLARKILKIFEI

SEQ ID NO: 133852 - protein, 54 aa, Heterodera glycines
  Coding regions on vcDNA: vcDNA=SeqID_60275; Strand=+; Position=1 -117,179-226
MPFAVHLCADGPNNVAVQRKSLSRLEFVDIFVNDREAIYKLWNWYHFIGFLGPK

SEQ ID NO: 133853 - protein, 17 aa, Heterodera glycines
  Coding regions on vcDNA: vcDNA=SeqID_60276; Strand=+; Position=1 -45,560-568
MTNFLRFFVNLLRKNDM

SEQ ID NO: 133854 - protein, 20 aa, Heterodera glycines
  Coding regions on vcDNA: vcDNA=SeqID_60277; Strand=-; Position=1 -31,77-108
MESIYAFNPFVNSVSTSLGL

SEQ ID NO: 133855 - protein, 113 aa, Heterodera glycines
  Coding regions on vcDNA: vcDNA=SeqID_60278; Strand=-; Position=1 -249,524-616
MAYFGQQKEQKQELHDGAMELNIIGEGTSKNELGFKEESIRAGFVHTNLSSAEDDMPIDEHGFSEPITRAAFVRKVFLVIGVMTKLNKLFIQTEKIIEFAMNLCFAFSDITVV

SEQ ID NO: 133856 - protein, 140 aa, Heterodera glycines
  Coding regions on vcDNA: vcDNA=SeqID_60279; Strand=-; Position=1 -249,613-786
MAYFGQQKEQKQELHDGAMELNIIGEGTSKNELGFKEESIRAGFVHTNLSSAEDDMPIDEHGFSEPITRAAFVRKVFLVIGVMVITAFCSSVSVLVAMGITTVSCVGIALLTMVTKRDITSRCFIHCIFLPFLVFGFFMS

SEQ ID NO: 133857 - protein, 25 aa, Heterodera glycines
  Coding regions on vcDNA: vcDNA=SeqID_60280; Strand=-; Position=1-76
REKKIMFFSGTLYLLVHISFFETVC

SEQ ID NO: 133858 - protein, 350 aa, Heterodera glycines
  Coding regions on vcDNA: vcDNA=SeqID_60281; Strand=-; Position=1 -186,250-483,691-897,945-1132,1178-1415
MNTTAPTDIELFLLFLGGAVELLINFVGIPLSIANLILVARTSVIHPNMKAILIFQSFFIILRGCCRFVICLFKFITGNQFGAKHMQFFPVLLKIYFIGIYARNFVPHVLIVERILATLFVRTYEKNRGNLFTILWMPFALIIPIYIATTTPSPHDHKQPITNLIIIAVQLLVGSIELGIFYQLSRYNSKIYQKMFQNIGSNNLSIRYQLSENIRIGKQLIPPLSLNLGNIFVGTIILLWDLLNWPYNELIANFCINLNSFFGLLIELFIITCHPFLKRDLCQFLNRIGKMFGFNHLAYNHRIGVTPSLSALNGIAQRNLISGKAWINTQSKPEDHFAILKEAWEKGSNP

SEQ ID NO: 133859 - protein, 38 aa, Heterodera glycines
  Coding regions on vcDNA: vcDNA=SeqID_60282; Strand=+; Position=1 -58,941-999
MVMKFVNLNWISSAISTGVEKKITFKLLSFYDEQIFCF

SEQ ID NO: 133860 - protein, 111 aa, Heterodera glycines
  Coding regions on vcDNA: vcDNA=SeqID_60283; Strand=+; Position=1 -110,378-603
  Homolog annotation: Hit_ID=CAB75701.1; Match level="QueryCoverage =81%, HitCoverage=44%, E-value=2e-31, Identity=70%"; Hit description =putative hypodermis secreted protein [Globodera rostochiensis]
SKYLEYDFESNETIPLFQKLRDEKTADYSQKTAEIDTEMVLLITNPYLVAVDKIKQLLAILKTIPDKQCDQIANAWRQIRIEYAKSLIEKAQAAAAQQEKEEQSKRRISLI

SEQ ID NO: 133861 - protein, 43 aa, Heterodera glycines
  Coding regions on vcDNA: vcDNA=SeqID_60284; Strand=-; Position=1-396
CPFQSSKINPIIFIAIRHLSVGRENGSRGDFFIYRRFDQLHFM

SEQ ID NO: 133862 - protein, 129 aa, Heterodera glycines
  Coding regions on vcDNA: vcDNA=SeqID_60285; Strand=-; Position=1 -42,319-666
MANTGGKIAFENSTVVFNGGKIAEPNGTTNWEITLNLFFVNIISLNDQQQNNDQFYEMNVYCHDKNTQPFYHASFKCWNGGCQRIINVDEQKCPKNAYDIQLWSWDNWNQQQVFDREMVKICFKSINKA

SEQ ID NO: 133863 - protein, 57 aa, Heterodera glycines
  Coding regions on vcDNA: vcDNA=SeqID_60286; Strand=-; Position=1 -128,314-359
MAKKYGILFKIFIFLYTSKDANCGQNKLILDLSPSFHENSQIRKKSNHTVISNDFMV

SEQ ID NO: 133864 - protein, 39 aa, Heterodera glycines
  Coding regions on vcDNA: vcDNA=SeqID_60287; Strand=-; Position=1-185
IRHLSVGRENGSRGDFFHLSEIRSITLHVNISGHYCTFI

SEQ ID NO: 133865 - protein, 207 aa, Heterodera glycines
  Coding regions on vcDNA: vcDNA=SeqID_60288; Strand=+; Position=1 -43,278-436,1645-1797,3609-3670,5059-5265
GDDTNESEESSLELIKCMVENTKTEADIDAEDNDGNSPFMLAVMNQRTQIVRYFISKGVRIDRTNKNVKFLVEQCGGDIELADSDGASAIFYAVAKEQFDVVQYLVSKGARIDQLNHKAKFLVENGADIEVVASDGLTATQPPSPDLHFLLVHTHPRPSDKKNTSDFAPRRSTMAHECYGFGNVRAIKHAHRARCWGICAAPQAAHK

SEQ ID NO: 133866 - protein, 47 aa, Heterodera glycines
  Coding regions on vcDNA: vcDNA=SeqID_60289; Strand=-; Position=1 -78,1327-1392
MIVILLSTRGTAGSDIWFMCLVDRPMAHNSKKMKEFNRIHEMKTKEN

SEQ ID NO: 133867 - protein, 218 aa, Heterodera glycines
  Coding regions on vcDNA: vcDNA=SeqID_60290; Strand=-; Position=1 -272,342-726
  Homolog annotation: Hit_ID=XP_309989.1; Match level="QueryCoverage =66%, HitCoverage=61%, E-value=3e-09, Identity=29%"; Hit description =ENSANGP00000015194 [Anopheles gambiae] ref|XP_319667.1| ENSANGP00000022407 [Anopheles gambiae]
MGDAIQQLTAALQQLLANPPQNAAPALNAHALPSLPTIDCSEPSDDRSISDWLERFNFALDCAAPQLADQSKVKLIMTKLSEAAFSQYSKSRPQSIWIDRYECLRASKSDDENFRPFINRHKRLFRDFQFDKLNEKFSCLMLLTALKSTKDAELRKRILSKLAADGDLIEYDGVVEDLQMYQSTIAEAKVIEERPMASRNLMAVKQKQRPMKPTQKGN

SEQ ID NO: 133868 - protein, 930 aa, Heterodera glycines
  Coding regions on vcDNA: vcDNA=SeqID_60291; Strand=-; Position=1-2793
  Homolog annotation: Hit_ID=NP_510849.1; Match level="QueryCoverage =85%, HitCoverage=57%, E-value=1e-144, Identity=37%"; Hit description= predicted CDS, zn-finger, CCHC type and RNA-directed DNA polymerase and Integrase, catalytic domain cont
MGDAIQQLTAALQQFLANPPQNAAPALNAHALPSLPTIDCFEPSDDRSISDWLERFNFALDCAAPQLADQSKVKLLMTKLSEAAFSQYSKSCLPKKVIDFDFNQTEERLKLAFSRPQSIWIDRYECLRASKSDDENFRPFINRHKRLLRDFQFDKLNEEQFSCLMLLTALKSPNDAELRKRILSKLAADGDLVEYDGVVEDLQMYQSTIAEAKVIEERPMASRNLMAVKQKQRPMKPTQKGNQVQNQTQRVCWRCGKFHHAPSECPSIKTVCRKCNKAGHLEAQCEKHHEWLNRNKNGKFQGKRACTLRIGGVMVNIVNHPTRLIEITVEMNGRKVIFVLDSGAEVTVINEETHCLIGKSQLRRCQEQAAYHDGSKCTLLGRGEAKFKFGDTTKNGTFYVSKSGSLNLLGIEMLDAFGLLDDIRQKVNSSLHLNAIEKENGDQATIIKDLKKIFPEIVADGLGHCKKVKAHLSLKPNATPIYCRPRPVPFNTKSVVEAELERLQSMNVIRPVEHTNWAAPIVVVKKANGSTRVCADFSTGLNSALLLHQHPLPLPEDIFATLNGGRIFSQIDFRDAYLQVELDENSKELCTIATHRGNFQYQRLPFGVKSAPGIFQSIMDSMLAGCAFAVAYLDDVIVVSRSPEEHKKHLQEVFKRIAKFGFRIKPEKCSFFKMEIKYLGFIINKDGRRPDPAKIQAIAEMPVPTNLSTLRSFLVMINHYQQFEKNMRFIRQPLDNLLKQDVVWSWSTDCQKAFDQVIQILQSDQLLAHYDPSQQIIVSADASEHGIGAVISHRYSDGTMKAVAHASHSLSPAEKNYSQIEKEGLALVYAVQKFHKYLFGRHFLLQTDHKPLLSIFGNKKGIKACTANRLQRWAIILLGYDFEIEYQQTLEFGQADVLSRLIAKTPMPEDDIILAKLSTSATIGTLNSVL

SEQ ID NO: 133869 - protein, 73 aa, Heterodera glycines
  Coding regions on vcDNA: vcDNA=SeqID_60292; Strand=+; Position=1 -68,124-139,320-457
MDMAMARIGAVGDGGDRRRRTWCGFVVSRPEEENGKDKKKNEENGKDKKEEENGKDKTKCRHAKSDEKFWKIY

SEQ ID NO: 133870 - protein, 98 aa, Heterodera glycines
  Coding regions on vcDNA: vcDNA=SeqID_60293; Strand=-; Position=1 -76,478-645,888-940
MDEQIAKKLQTSASSIYSWKRQFGYVEKISHERDEKLRIIKQFQKRKQECAEEPITTNKIAKELGVGRNTISRWKKELGLSTHKQYSKQDKFNIVNPI

SEQ ID NO: 133871 - protein, 52 aa, Heterodera glycines
  Coding regions on vcDNA: vcDNA=SeqID_60294; Strand=+; Position=1-157
MFRWDHGPIRPSDSNPTEDLGTLSGSGDLRLCPQYYGPPPPLKCPNVPILRF

SEQ ID NO: 133872 - protein, 92 aa, Heterodera glycines; identical to SEQ ID NO: 124679
  Coding regions on vcDNA: vcDNA=SeqID_60295; Strand=+; Position=1-697

SEQ ID NO: 133873 - protein, 138 aa, Heterodera glycines
  Coding regions on vcDNA: vcDNA=SeqID_60296; Strand=+; Position=1 -80,257-335,708-965
  Homolog annotation: Hit_ID=AAG23825.1; Match level="QueryCoverage =76%, HitCoverage=9%, E-value=6e-51, Identity=93%"; Hit description =guanylyl cyclase [Heterodera glycines]
MYRIRVRVVQSGYRNENKHICDLLIICAKIVDKRKGNLQWKIPFALLQRQNQRRSERTAERSHHSLRSNQTNISALTHATTSSSLAQSKNFTLYAYNGQMCIVHAYGPTMLAMPLSAEGMAECRTVEGKLAIINNMVD

SEQ ID NO: 133874 - protein, 115 aa, Heterodera glycines
  Coding regions on vcDNA: vcDNA=SeqID_60297; Strand=-; Position=1-345
  Homolog annotation: Hit_ID=BAC87222.1; Match level="QueryCoverage =100%, HitCoverage=87%, E-value=1e-35, Identity=48%"; Hit description= unnamed protein product [Homo sapiens]
MKRKRKKEKRKRKRKKEKRKRKRKKEKRKRKRKKEKRKRKRKKEKRKRKRKKEQMKRKRKKEKRKRKRKKEQMKRKRKKEKRKRKRKKEKRKRKRKKEKRKRKRKKEKRKRKRKV

SEQ ID NO: 133875 - protein, 254 aa, Heterodera glycines
  misc_feature (148)..(148): Xaa can be any naturally occurring amino acid
  misc_feature (173)..(173): Xaa can be any naturally occurring amino acid
  misc_feature (189)..(189): Xaa can be any naturally occurring amino acid
  misc_feature (214)..(214): Xaa can be any naturally occurring amino acid
  misc_feature (218)..(218): Xaa can be any naturally occurring amino acid
  Coding regions on vcDNA: vcDNA=SeqID_60298; Strand=-; Position=1-769
  Homolog annotation: Hit_ID=T02995; Match level="QueryCoverage=96%, HitCoverage=45%, E-value=4e-57, Identity=54%"; Hit description =unspecific monooxygenase (EC 1.14.14.1) - common tobacco dbj|BAA10929.1| cytochrome P450 like_TBP [Nicotiana t
GRRATGWPDLTQKDTLSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIG

SEQ ID NO: 133876 - protein, 82 aa, Heterodera glycines
  Coding regions on vcDNA: vcDNA=SeqID_60299; Strand=+; Position=1 -87,166-246,315-381,676-689
  Homolog annotation: Hit_ID=CAE70589.1; Match level="QueryCoverage =96%, HitCoverage=13%, E-value=3e-33, Identity=83%"; Hit description =Hypothetical protein CBG17253 [Caenorhabditis briggsae]
MGNLYLKRRIGFNIVQSYIPTGLIVIISWVSFWIDRRAVPARVTLSFTTLLTMTTLGNGMRFVLPRVSYAKAIDYWFGGIYF

SEQ ID NO: 133877 - protein, 257 aa, Heterodera glycines
  Coding regions on vcDNA: vcDNA=SeqID_60300; Strand=-; Position=1-772
  Homolog annotation: Hit_ID=NP_509585.1; Match level="QueryCoverage =35%, HitCoverage=20%, E-value=6e-44, Identity=95%"; Hit description =tubulin, Beta (49.8 kD) (tbb-4) [Caenorhabditis elegans] emb|CAA86310.1| Hypothetical protein B0272.1 [Ca
MYTRGGELSLAKPPLGKDSVVPSPKVSDTVVEPYNATLSVHQLVENTDETFCIDNEALYDICFRTLKLTTPTYGDLNHLVSITMSGVTTCLRFPGQLNADLRKLATKFVCGCVLFRAVFGSLQHGALPPAPLLHARLRPAHFPRQSAVPGIVRPRTYPANVRCQGSLELWTRPLVSPFHMTEYDGRVRPSPRALSDGGGHFPGSDEHEGGPLGGNASASLPFFLMVSFPKGRRANAECAEQKLRLFCRMDTEQCEDG

SEQ ID NO: 133878 - protein, 154 aa, Heterodera glycines
  Coding regions on vcDNA: vcDNA=SeqID_60301; Strand=+; Position=1 -280,723-907
MDSSATVSEELSAAESRDKQHNSSRRAKHRQQQAVPVAQHPRQQNHLPPNMGNGSSRLKKCFSNAGEGGGCGNGMPNYHQTTTTPGMMNGSYYDNMNWSLNGRKGLEDNFVPEKLKKSGGISVAFAMDELVKGRTLNGTPCKKFQLAYLFVLQY

SEQ ID NO: 133879 - protein, 321 aa, Heterodera glycines
  Coding regions on vcDNA: vcDNA=SeqID_60302; Strand=-; Position=1 -162,215-1018
  Homolog annotation: Hit_ID=AAC47437.1; Match level="QueryCoverage =100%, HitCoverage=100%, E-value=1e-144, Identity=74%"; Hit description=COL-1
MDFEARIKAYRFVAYSTVSFSIISLLSVCFTLPMLQNYVSNVAQNMDRELSACQGSAKDIWSEVNQLKSIPVVGGNRTARQADGYGGGGGAVSGGGGGGGSCSECCSGGGPGPAGPPGPPRQSRKPRSTRITRTTREICFRSMRTSYPGNFKLLLAKVNVAIQPPCKPCPGGQPGQPGPPGPPGQPGSPGQPGSGGGNPEPGPPGPPGPPGNPGGPGQPGGPGQPGQPAASEAAGPAPPGPPGEAGAPGQPGNAGPPGQPGGPGQPGPKGPPGPPGQPGNDGQPGQPGNAGQPGGAGEKGICPKYCAIDGGVFFEDGTRRR

SEQ ID NO: 133880 - protein, 158 aa, Heterodera glycines
  Coding regions on vcDNA: vcDNA=SeqID_60303; Strand=-; Position=1-477
  Homolog annotation: Hit_ID=AAC47437.1; Match level="QueryCoverage =100%, HitCoverage=76%, E-value=2e-87, Identity=64%"; Hit description= COL-1
PPCKPCPGGQPGQPGPPGPPGQPGSPGQPGNSGGNPEPGPPGPPGPPGNPGGPGQPGGPGQPGQPAASEAAGPAPPGPPGEAGAPGQPGNAGPPGQPGGPGQPGPKGPPGPPGQPGNDGQPGQPGNAGQPGGAGEKGICPKYCAIDGGVFFEDGTRRR

SEQ ID NO: 133881 - protein, 140 aa, Heterodera glycines
  Coding regions on vcDNA: vcDNA=SeqID_60304; Strand=-; Position=1 -141,188-469
  Homolog annotation: Hit_ID=AAC47745.1; Match level="QueryCoverage =92%, HitCoverage=40%, E-value=1e-09, Identity=33%"; Hit description =collagen [Meloidogyne javanica]
MFYQIIAMGTFAVSSLCVLTQLVLLPWLNQHTQQLKNDFESRLRRFHHNTRLFDEQFRRVSQFAVGSGGSLTDNAFGRLVKRQLDECPPQRVGPPGPPGEVGGDGESGDTGEDGPPGLDAITLLLEEAQKCIICELELFS

SEQ ID NO: 133882 - protein, 198 aa, Heterodera glycines
  Coding regions on vcDNA: vcDNA=SeqID_60305; Strand=-; Position=1 -120,292-591,670-848
  Homolog annotation: Hit_ID=CAE70079.1; Match level="QueryCoverage =75%, HitCoverage=28%, E-value=9e-14, Identity=35%"; Hit description =Hypothetical protein CBG16520 [Caenorhabditis briggsae]
GDVAPGTPLPSFHGNAGITNATTPLAVGNPYGPTPHQAFSAVNPVIGAAPAQQDPSAWTQYYNQQQAMAIAGGPPSQPASFGATPAQHYQTVPGTMQTAVSQAAQLHSTQMQQQQIHQQQQATIAQPQQAVSAGMGAVSSSGGPAINPQTGQPDYSAQWAEYYRTMGMHEQAALIEAQMKQTHAAAQAQRPQQQLYMQ

SEQ ID NO: 133883 - protein, 68 aa, Heterodera glycines
  Coding regions on vcDNA: vcDNA=SeqID_60306; Strand=+; Position=1 -100,150-254
NEKGTKSDAQQQNENGSAMALEKVPKIDWNQFEVQYLDLVSALHYLLTVEVPRNPVLGNTELTALKRF

SEQ ID NO: 133884 - protein, 246 aa, Heterodera glycines
  Coding regions on vcDNA: vcDNA=SeqID_60307; Strand=-; Position=1 -285,1589-1648,2549-2821,3339-3461
  Homolog annotation: Hit_ID=CAE62276.1; Match level="QueryCoverage =100%, HitCoverage=27%, E-value=1e-123, Identity=83%"; Hit description=Hypothetical protein CBG06335 [Caenorhabditis briggsae]
MYPDQSLYPCNSGPELARRINRALRRADQVECVEAEDYTAQRDWYAPIVADAEAGFGGALNCFELMKSYIESGVSGVHFEDQLGSEKKCGHMGGKVLIPTAQHIRHLNAARLAADVCGVPTIIVARTDAESARLLTTDIDERDHPYIDYAAGRTAEGYFRLRDDNAIQSCIDRAKFYAPHCDLIWMETSYPKLSVAREFAEGVRKEFPDKLFSYNCSPSFNWRQHLRPSDMEKFQKELGAMGFKYQ

SEQ ID NO: 133885 - protein, 19 aa, Heterodera glycines
  Coding regions on vcDNA: vcDNA=SeqID_60308; Strand=+; Position=1-61
KAQEAFIFASKAPHGQNTK

SEQ ID NO: 133886 - protein, 106 aa, Heterodera glycines
  Coding regions on vcDNA: vcDNA=SeqID_60309; Strand=+; Position=1 -22,243-403,454-521
  Homolog annotation: Hit_ID=CAE63849.1; Match level="QueryCoverage =96%, HitCoverage=56%, E-value=7e-31, Identity=50%"; Hit description =Hypothetical protein CBG08408 [Caenorhabditis briggsae]
FGHYGKKWRKKFPGRPPMICEEIEIPPCNPCPPGPPGRQGPTGQPGTPGRSGPPGRPGTNGLPGPPGPPGPPGTPGPTGPDTNGLPGPPGPPGPPGTPGPTGPDGE

SEQ ID NO: 133887 - protein, 63 aa, Heterodera glycines
  Coding regions on vcDNA: vcDNA=SeqID_60310; Strand=+; Position=1-189
MNHGFKLFDQHHKQNVAQIAAEAVMQHNFGAENMEEEVQKMELARVNGNDQQTIMTTMANGNN

SEQ ID NO: 133888 - protein, 75 aa, Heterodera glycines
  Coding regions on vcDNA: vcDNA=SeqID_60311; Strand=+; Position=1 -51,283-459
MGVSGSSLSAYVQVAVHRFTTDAAFAQAVKMITSLAFVLLEDITPALAALEDHLPDELEGVLDWLFEFNFFFQFH

SEQ ID NO: 133889 - protein, 102 aa, Heterodera glycines
  Coding regions on vcDNA: vcDNA=SeqID_60312; Strand=+; Position=1-309
MEGKEKIGNEMEDEIGLPGNPREVRCFKCGRSGHFARECRDAGDRDRGRRVWRNWGDARGRTGRGTWRNSDQNEVGEGPSTSTSSAHLTDFGTFFNYIGGNQ

SEQ ID NO: 133890 - protein, 17 aa, Heterodera glycines
  Coding regions on vcDNA: vcDNA=SeqID_60313; Strand=-; Position=1 -16,420-457
MNLMKIFTVLTQFKNEI

SEQ ID NO: 133891 - protein, 115 aa, Heterodera glycines
  Coding regions on vcDNA: vcDNA=SeqID_60314; Strand=+; Position=1 -79,123-211,798-959,1360-1377
MKSHTTHELPSFYTDEQLLAYIDLKFGGIGNEIAHHGNVQGGIGDMQSIRSAAYTYVMKQIFAFNQIRLLALPSVVSADVESQMQKIITERKCAVVARLQKPEIKAKTVQITVNF

SEQ ID NO: 133892 - protein, 55 aa, Heterodera glycines
  Coding regions on vcDNA: vcDNA=SeqID_60315; Strand=+; Position=1 -67,198-298
MDNAMASMCEGERRHVVIPAALGYGDKGHDNIPGGASPNFDIVLHKLIRPRAGEL

SEQ ID NO: 133893 - protein, 63 aa, Heterodera glycines
  Coding regions on vcDNA: vcDNA=SeqID_60316; Strand=+; Position=1-541
FPDAQSPRNNHPFSWSFLLQHEAAAVSRAQSEILCRNKIKTKRKRKTEINEKEVRGEREKARE

SEQ ID NO: 133894 - protein, 373 aa, Heterodera glycines
  Coding regions on vcDNA: vcDNA=SeqID_60317; Strand=-; Position=1 -100,133-792,1046-1407
  Homolog annotation: Hit_ID=NP_500013.1; Match level="QueryCoverage =91%, HitCoverage=24%, E-value=3e-69, Identity=40%"; Hit description =predicted CDS, polyprotein family member (4B673) [Caenorhabditis elegans] gb|AAC02594.1| Hypothetical pro
MTPTFVVDFSKAMVEGKDLEELKALIEEFADVFTAEHHITTTTEEPIASAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDKVYQMITMPFGLKNATAAFSRAMAIVLSGLEDTSLAYVDDVLIFTKSPNFSEHLTAVRKVLERFRLYNLKLSPKKCIFASNEMNFLGFVLTAEDYDKAFHIFTDASSTGQGGVLMQKDDVTGTFSAISYCSRTLSAAERKWPAVQIEMSAIIYALREFRPFIFMSDIELHTDHKPLAFLLKKSEPISNWHDGSLTTKLSGQNCPRGGKSQHFD

SEQ ID NO: 133895 - protein, 346 aa, Heterodera glycines
  Coding regions on vcDNA: vcDNA=SeqID_60318; Strand=+; Position=1-1056
  Homolog annotation: Hit_ID=NP_491240.1; Match level="QueryCoverage =97%, HitCoverage=26%, E-value=6e-89, Identity=47%"; Hit description =zn-finger, CCHC type and RNA-directed DNA polymerase  and Integrase, catalytic domain containing protein
AVKKKNGKTRVCIDFSTGLNDALELHRHPLPRPEDIFNAIAGSIFSRLDLRDAYLQLELSEESKNLCVINTHQGLFQCQRLPFGVKSAPSIFQSLMDKIIAPIPGAFVYLDDVIIRNQTLEEHIKTIFQVFNKIREYGLRIQLEKCTFMEPQTLFLGHIISEKGIQPDPSRSEAIKQMPAPHDKSTLRSFLGALTYYGKFIKEMRELRSPLDELLKKDIKWEWSRQQQEEFEKAKEMLSDLLLTHYNPKLPIIVAADASKDGIGATISHILADKSERVVEHASCTFTAAQKNYSQIEKEALGLVFAVQKFHRMLYGRFTLLILAIFGSKKGIIYSASRPARALILS

SEQ ID NO: 133896 - protein, 74 aa, Heterodera glycines
  Coding regions on vcDNA: vcDNA=SeqID_60319; Strand=+; Position=1-226
FKPTCRKCAGGEHAIEGGECRVGKVHQKFDAFDFALPTDEFEGTTAKVIRERFTFGVKCLIVFCFAVRNHFILG

SEQ ID NO: 133897 - protein, 61 aa, Heterodera glycines
  Coding regions on vcDNA: vcDNA=SeqID_60320; Strand=-; Position=1 -79,117-163,205-264
MVQPRKCAIPKLKLNDVEQFRNWFLKINLCSEVLEMLQMGGEDQFHDASLFDIFMNEYTGK

SEQ ID NO: 133898 - protein, 150 aa, Heterodera glycines; identical to SEQ ID NO: 128546
  Coding regions on vcDNA: vcDNA=SeqID_60321; Strand=-; Position=1-658

SEQ ID NO: 133899 - protein, 125 aa, Heterodera glycines
  Coding regions on vcDNA: vcDNA=SeqID_60322; Strand=+; Position=1-662
LFEYPKRTLEKIDFFVFGAVPPNRCAQIYGETESFRNSFPIACTLILRWIFAPHNCLSTPNGHLKKSIFFVFGAVPPNRCAQIYGETESFGNSFPIACTLILRWIFAPHNCLSTPNGHLKKSIFL

SEQ ID NO: 133900 - protein, 65 aa, Heterodera glycines
  Coding regions on vcDNA: vcDNA=SeqID_60323; Strand=-; Position=1 -11,71-256
MNRRWICNDVWMDIFPSFDRAQLGLKLALLSPRFNALVDKHFDGKSELTIWRTIEISKDKGPETK

SEQ ID NO: 133901 - protein, 75 aa, Heterodera glycines
  Coding regions on vcDNA: vcDNA=SeqID_60324; Strand=-; Position=1-225
MPQPQLVAVGPRSALQIPYSFLPFAFDFHVLLQRPQRKMYQQQQGTTVGAVHGQKQQQENEVPLLSILDMANTTL

SEQ ID NO: 133902 - protein, 66 aa, Heterodera glycines
  Coding regions on vcDNA: vcDNA=SeqID_60325; Strand=-; Position=1 -73,198-248,294-370
MCPGLFDTKMFCYILCLLLVQSRSGQNSVFEPKQCGNESFGDDDTFVCQTYTCDGGKCKNLLFVLR

SEQ ID NO: 133903 - protein, 107 aa, Heterodera glycines
  Coding regions on vcDNA: vcDNA=SeqID_60326; Strand=+; Position=1 -305,902-926
  Homolog annotation: Hit_ID=S08405; Match level="QueryCoverage=99%, HitCoverage=8%, E-value=9e-28, Identity=56%"; Hit description =hypothetical protein 2 - silkworm transposon mag
VIAYASRTLNSSERNYSQIEKEARAIIFGVDKFKQYLYGRKFVLQTDHEPLKEIFGPKGELPIVAAKRLHRWSLTLMNFDFEVVYCSTKNLAADGLSRLASTAANDE

SEQ ID NO: 133904 - protein, 181 aa, Heterodera glycines
  Coding regions on vcDNA: vcDNA=SeqID_60327; Strand=+; Position=1 -403,940-1082
MEKLAPQNYCLADSTASSLAKAAQMELDFIQSVLLGPQRGNLTAIECLLAQNFSKQSSMMPNYGTERKNAKVPKLEMEKAGGGDEAKLDNGSETDQSDQKQKRKGVGRPKRHPSECKVCGRKSFYCYYSVRCCENGIRCRGCRLDKCLLAGMDPTMVIAMQQEGMAQYLDRLELRKRSALL

SEQ ID NO: 133905 - protein, 109 aa, Heterodera glycines
  Coding regions on vcDNA: vcDNA=SeqID_60328; Strand=+; Position=1 -204,459-584
MVFSILLAFCLAVPIHFVDAKCASDVVEGNKLLSNRKTIMKNPPKEIGKNDDTEIKQFVRDLLDHYNMISDLSKSNSNIEEIVNGIGKITLTKFDKKGKNGKKLNFLYI

SEQ ID NO: 133906 - protein, 52 aa, Heterodera glycines
  Coding regions on vcDNA: vcDNA=SeqID_60329; Strand=+; Position=1 -15,206-349
MHCGALFFFGYGAAKIDQRKIDLMKMPAKYVLIILLHFNAHLSWVRIRTTAW

SEQ ID NO: 133907 - protein, 111 aa, Heterodera glycines
  Coding regions on vcDNA: vcDNA=SeqID_60330; Strand=-; Position=1 -130,639-716,863-899,1455-1522,1792-1812
  Homolog annotation: Hit_ID=CAE59147.1; Match level="QueryCoverage =98%, HitCoverage=10%, E-value=1e-44, Identity=71%"; Hit description =Hypothetical protein CBG02452 [Caenorhabditis briggsae]
FTDAGFAHHDLYFIDGSTPTEEIVLRFLDVVDSAPGAIAVHCKAGLGRTGCMIACWMMKHYRLTAPQCMGWLRVCRPGSVIGPQQQFLIEKQAWCWNLGKANGLHLCPTIK

SEQ ID NO: 133908 - protein, 47 aa, Heterodera glycines
  Coding regions on vcDNA: vcDNA=SeqID_60331; Strand=+; Position=1-141
MHRNCARRRIDDIQKSEHNFLGGRRTVDEVQVMVCKASIGEPLTHTL

SEQ ID NO: 133909 - protein, 70 aa, Heterodera glycines
  Coding regions on vcDNA: vcDNA=SeqID_60332; Strand=+; Position=1-213
MVYASFTTKRELHVRSLLDRRGPVNWTPENWTPENGGPVNWTPNGKLDTVGILDTKGKLDTGKLDTKFLF

SEQ ID NO: 133910 - protein, 33 aa, Heterodera glycines; identical to SEQ ID NO: 126025
  Coding regions on vcDNA: vcDNA=SeqID_60333; Strand=-; Position=1-100

SEQ ID NO: 133911 - protein, 95 aa, Heterodera glycines
  Coding regions on vcDNA: vcDNA=SeqID_60334; Strand=-; Position=1-554
LFEYPKRTLEKIDFFVFGAVPPNRCAQIYGETEFFGNSFPIVCTLILRWIFAPHNCLSTPNGHLKKSIFLFSGQSPRTDAPRFMGRPNPSGIASL

SEQ ID NO: 133912 - protein, 26 aa, Heterodera glycines
  Coding regions on vcDNA: vcDNA=SeqID_60335; Strand=+; Position=1-77
RIHVLRFDVAFFAKGTLLGFTAQHQG

SEQ ID NO: 133913 - protein, 51 aa, Heterodera glycines
  Coding regions on vcDNA: vcDNA=SeqID_60336; Strand=-; Position=1 -24,75-206
MADLNNLTFFLEFANETPNWKLISFATIFGFIATLGIVLNFSVIYVTIRTK

SEQ ID NO: 133914 - protein, 75 aa, Heterodera glycines
  Coding regions on vcDNA: vcDNA=SeqID_60337; Strand=+; Position=1 -48,334-513
MATIQFLKSFGKCTAKKPICCNLVKNDEYNFIKKRITLINHSDPPLSQVMDTLIVTLMRIKKAMESGKKQIIFLF

SEQ ID NO: 133915 - protein, 129 aa, Heterodera glycines
  Coding regions on vcDNA: vcDNA=SeqID_60338; Strand=-; Position=1 -209,541-721
MSFRMIPKLPNLIGNTFKNEFHKSSFFNFFGQKINKNTHVAHGLEPQPFVSLPSYKSHLATHANLIGTERLIEFFKCFRTIPRMFNLVEKEKICVAKIRPAKRFGWRRFFLVRFLIPRFPFLFKKPKKS

SEQ ID NO: 133916 - protein, 76 aa, Heterodera glycines
  Coding regions on vcDNA: vcDNA=SeqID_60339; Strand=-; Position=1-317
YQKGRWRKKFFKIFPYILVISFCFWWGAWNSGIMRTRPIWQVKQRLLTSQKVRCRDETNQHCLPRGTRHGPPKEWI

SEQ ID NO: 133917 - protein, 109 aa, Heterodera glycines
  Coding regions on vcDNA: vcDNA=SeqID_60340; Strand=+; Position=1 -138,184-375
MIPKGTAKNGTNGRKRANLAKEPKGFHKFTAEYASPELHVMDEETGAKVSPKSDMWALGIMLIELLILQNPSFYHLREEEEKRDKLEVSGQKAKTAQKSTPLRRMFGNG

SEQ ID NO: 133918 - protein, 145 aa, Heterodera glycines
  Coding regions on vcDNA: vcDNA=SeqID_60341; Strand=-; Position=1 -71,520-675,1371-1500,1615-1695
MPSSFASVWKHWANFLGNLYLANQLNELITDVQQRRGNAMAEILKRVGLLQPQEVFCALRVELGPSHVGRYIQQCSDQFTKIADLTNTTSDPQLLKSLVEWLQSPEIVMAVNANTDEGKMFNELLNDFAFCCSPSFLATTTTTTA

SEQ ID NO: 133919 - protein, 230 aa, Heterodera glycines
  Coding regions on vcDNA: vcDNA=SeqID_60342; Strand=-; Position=1 -125,244-363,483-561,618-743,923-1086,1161-1237
  Homolog annotation: Hit_ID=XP_213706.2; Match level="QueryCoverage =88%, HitCoverage=4%, E-value=3e-21, Identity=30%"; Hit description =similar to transformation/transcription domain-associated protein [Rattus norvegicus]
MAEKLVAQLNDRLSKTLSSDAISGLSTALQTEQRAWEECWTSSCVQLNDWASLDHFAKSEEISDAALAMESAWHLHDWNQLKDRFAQVDAISSPQTAVRSTMLQLMLNVTNFRLNKETIERQLIDLYRALISEWRRLPSIVSHVHINILNNSHLLHEISESANLLYSNLPLLTNWSGNSNNGTPASTNSNHSLNNAVKHLMKTWRNRPLTTVDQNSGWSDLFNWRLQFFN

SEQ ID NO: 133920 - protein, 203 aa, Heterodera glycines
  Coding regions on vcDNA: vcDNA=SeqID_60343; Strand=-; Position=1 -503,618-726
MGRYDWLAHVVHLLLLSEHAVDDDKQQQQQHHRLVELKQCATLDNTLAQIVAAADSDTIERVQLQQRQQVGEVHGQAVAERLGDSPTKQLDQVRDGGAATEGTTIHAKIASLRLSAPADNIDGTSPPQAPPSLSVPSGGEESLLEAATANRNSPQNSNRTTMLDMQISLLSLATQLTVAQLISNLVDILHTDLAFCRKTFVEV

SEQ ID NO: 133921 - protein, 296 aa, Heterodera glycines
  Coding regions on vcDNA: vcDNA=SeqID_60344; Strand=-; Position=1 -69,287-546,715-840,958-1393
  Homolog annotation: Hit_ID=XP_414752.1; Match level="QueryCoverage =95%, HitCoverage=6%, E-value=2e-24, Identity=29%"; Hit description =PREDICTED: similar to transformation/transcription domain-associated protein [Gallus gallus]
MVLDIFRPLQRAMISCISYTNSQQILRSTYNVLSKLLEKTKCSANGLDELDMLNHHIARVIQDSFAKYAGSLNNASPPMTTITLLRLMHSAQPSYLEAVCLMPFINLLQRLVREHIMSNVGTTGALDQAQKLISDLLSICIEMLCTRTKFLSAESQHNVIQLVLLPLIEKGTVDKIVENIIKVAQEIVTSEIALAQQHQDGQPSQQQQYHHQSQQSQGALVLVKLYGAMEQRLYANNELQRHFLNVVVQLYEQERLLLSEGDATLNKLEPVFHWGLASPNPELRNRSGKNADLIGL

SEQ ID NO: 133922 - protein, 60 aa, Heterodera glycines
  Coding regions on vcDNA: vcDNA=SeqID_60345; Strand=-; Position=1-184
PGLKCPAQAKIFFYFREKIEIFPKKIPVDRARKTMFWKWSPFFWENSLKNHKIKKPENRF

SEQ ID NO: 133923 - protein, 19 aa, Heterodera glycines
  Coding regions on vcDNA: vcDNA=SeqID_60346; Strand=-; Position=1-57
CAIWRYEQFCLTLARTHSA

SEQ ID NO: 133924 - protein, 39 aa, Heterodera glycines
  Coding regions on vcDNA: vcDNA=SeqID_60347; Strand=+; Position=1 -18,394-495
MGLQNQLILLWCRFSRPLLRHSLDEFAKLTNIFVCKEEI

SEQ ID NO: 133925 - protein, 138 aa, Heterodera glycines
  Coding regions on vcDNA: vcDNA=SeqID_60348; Strand=+; Position=1 -228,337-525
MLIAPPPVKILYCYSEMNDSVIGLMKQGIETHNGVPTQTLVQSMPKPLLLILDDLMLSVNNDFLDLLFTRGSHNWDVRTVGSQLFPKRLNYFMEAYNDATSEPFSYLVINMHPNASESERLTTKIFPDEQREVYLPIE

SEQ ID NO: 133926 - protein, 65 aa, Heterodera glycines
  Coding regions on vcDNA: vcDNA=SeqID_60349; Strand=-; Position=1 -191,265-271
MRQMDNMMNSMLGDAWDMLNGFGMMGPPFPNHPMLTDGLNRQNQALRRQQPPQHHFGPDTMMSPY

SEQ ID NO: 133927 - protein, 373 aa, Heterodera glycines
  Coding regions on vcDNA: vcDNA=SeqID_60350; Strand=+; Position=59-1180
  Homolog annotation: Hit_ID=NP_502797.1; Match level="QueryCoverage =94%, HitCoverage=98%, E-value=2e-56, Identity=34%"; Hit description =HASI (4P602) [Caenorhabditis elegans] emb|CAB16520.1| Hypothetical protein Y57G11C.19 [Caenorhabditis ele
MGKTIAPKQPTVDKLLEQIYYDLRSPASYAGMLKVWEEAKRRDPRISLHNVYEFLHRQRTYTLFKPRRNKFPRLKTVPSGLHTDWQCDLCIMDTLRAHNDGYRYILVCIDVLSRKIFTAESESKKSEHMIEAFEKVFKKAGVLPNKLYSDAGLEFQAKRMIEYWKQKDIIKHIMYSPSLHAGVVERANRTLKERLYKYFSENNTLRWLGVIDKIANNVNSTTNRTIGTNPASVTFKNAPTLRKRLYKEHTDDKEIKINTKFKFGDIVRISKEKGQFSKGYYPNFTDELFRVQRVNNTNPHSYRIRDLNGEDIKGIFYDQELVKTTENGTHRAEVLKSRTLNGVKEHFVRWVGLSDKYNSWVRDSDLVKRRAFE

SEQ ID NO: 133928 - protein, 92 aa, Heterodera glycines
  Coding regions on vcDNA: vcDNA=SeqID_60351; Strand=-; Position=1-279
MPNLEIAVSPEGTSKVPTLDLNASQFMRKRLAKSGEQQKTHKTELKVTLEAELNVPTLDLNAAQLSMKRLTEKNKGKFTTAEEAKNEKKEKQ

SEQ ID NO: 133929 - protein, 353 aa, Heterodera glycines
  Coding regions on vcDNA: vcDNA=SeqID_60352; Strand=+; Position=1 -1059,1225-1227
  Homolog annotation: Hit_ID=XP_514527.1; Match level="QueryCoverage =76%, HitCoverage=12%, E-value=3e-15, Identity=26%"; Hit description =PREDICTED: ribosome binding protein 1 [Pan troglodytes]
VRKKVVRKVVRKSSNKSDSPEKNGSPAPEEPPQSPTVKATTTTNGTVPTAGAKTTVGNNTQSGTGAKSVSAIIAGRMASLFNNCAGNGVEGAANGENGTGTNRNDAAPATTGDGGGAAIHEISVARFGGDEPTAQSDEEAAGNNSTRKEAASDAKKGESTGINAKREEAAGNNAKREEAAGNNAKREEAAKNNAKREEAAGNNAKKEEAAKNNAKREEAAKNNAMREESFDTACKQSNGPDVTESGTNRSASETVPKSGTAVEIKPAKAGQLESEPKTDHTVDDSPPIVGSRRVGAVSKTSTEAPNESAVPEHSSAIKERRSQSLDGHELANGTTNGVGTLRMTESSSEDNGR

SEQ ID NO: 133930 - protein, 42 aa, Heterodera glycines
  Coding regions on vcDNA: vcDNA=SeqID_60353; Strand=-; Position=1-182
LREFHISELTSAMHSLAFISFAFCLSLTDAFRTQSSGVRGTL

SEQ ID NO: 133931 - protein, 149 aa, Heterodera glycines
  Coding regions on vcDNA: vcDNA=SeqID_60354; Strand=+; Position=1-447
  Homolog annotation: Hit_ID=EAL51442.1; Match level="QueryCoverage =99%, HitCoverage=47%, E-value=5e-09, Identity=31%"; Hit description =hypothetical protein 7.t00064 [Entamoeba histolytica HM-1:IMSS]
MSLHLPQKCEQLAQCTQCEQYKKERDKKTEALLDKIKESFDTKKQKKQMENELNEQRQKCADLGKQKDLLTCEVCSLREELEREKKANAHFDDDLKEFKRRRLAMDDELKQFKRREKDIGAELEQCKEQNQQLVAAAEERESRIMELER

SEQ ID NO: 133932 - protein, 331 aa, Heterodera glycines
  Coding regions on vcDNA: vcDNA=SeqID_60355; Strand=+; Position=1 -62,123-294,334-559,621-719,763-935,1430-1693
  Homolog annotation: Hit_ID=CAE73451.1; Match level="QueryCoverage =35%, HitCoverage=12%, E-value=8e-37, Identity=62%"; Hit description =Hypothetical protein CBG20900 [Caenorhabditis briggsae]
MPTKPFKPLEQLMGVFPAASRAHIPDGWRWLMTDSSSPIIDFYPETFEIDLNGKKYAWQGVALLPFVEEKRLLDALDSVYATLTTDEIARNATGPDRLFVGNKHNLFSLVYEVHSQKTTIPIKDELTNDDTKETSEGTRETEGEAEETQQAENGESEQIAKAEETTAQEEQANEEAISKPEQAPKQEFETEIEFVDDEEKKWVHIDAVKAYGMSGEVSYDVEALAFGEAHRSLFRNSLEFGDIKYQHQQQWQQGQFYNGQQQQQPVPLFSFGQMAMPPPPPLPPQNWITSHPPPQIQSHVPYGQPPPLISQPRNTQHHHRRNDNNRTYNRK

SEQ ID NO: 133933 - protein, 241 aa, Heterodera glycines
  Coding regions on vcDNA: vcDNA=SeqID_60356; Strand=+; Position=1 -64,113-415,457-578,628-726,776-835,886-962
  Homolog annotation: Hit_ID=CAE70100.1; Match level="QueryCoverage =62%, HitCoverage=20%, E-value=3e-17, Identity=29%"; Hit description =Hypothetical protein CBG16544 [Caenorhabditis briggsae]
PMIESHCCLMPKKSNKEAIIDIPKLLVKGLRESLPKVTCGPSPSFYGKFSRVKYLTTVENEYPSLLLLMGFRVLGLTEFKIYSIISQHGVRLVIPETCPSQLNNIIQNCWRTEPADRPDMRYVLAVLQQIGNDAELQREVAQFLVFRKDEWREMIREQTFALEELKLDLARQMEDLRRREAIVRKRENSHRNFLHLVDVMNVEDVCEWNEDCVCEWVQNIAASAMEDFSEAIVDQLISCIL

SEQ ID NO: 133934 - protein, 92 aa, Heterodera glycines; identical to SEQ ID NO: 124679
  Coding regions on vcDNA: vcDNA=SeqID_60357; Strand=-; Position=1-705

SEQ ID NO: 133935 - protein, 163 aa, Heterodera glycines
  Coding regions on vcDNA: vcDNA=SeqID_60358; Strand=+; Position=1 -87,255-351,648-953
MLFIFSIFLIYIHLNASNGCGTELGIWENKMVQNQLQNDPALLYSLEKLFFIYQMLKSLKIDANRHKNYLTASLEHSMTLMANRFGIPFNEISNVVEPRKSAFMLKEITNLLNDQFENERTGNEHEKEENGQDGYRKNQKWTFRQLSNNSNNLFGKWFNSFHK

SEQ ID NO: 133936 - protein, 75 aa, Heterodera glycines
  Coding regions on vcDNA: vcDNA=SeqID_60359; Strand=-; Position=1-226
  Homolog annotation: Hit_ID=CAE61262.1; Match level="QueryCoverage =77%, HitCoverage=7%, E-value=1e-10, Identity=55%"; Hit description =Hypothetical protein CBG05068 [Caenorhabditis briggsae]
MTTAIGDTIILLITLIAFPNAAVEFLFYAVVMVVVSAILALLAIFYYEYNNYTTTDSEMITKLEETEGKREPLKG

SEQ ID NO: 133937 - protein, 666 aa, Heterodera glycines
  Coding regions on vcDNA: vcDNA=SeqID_60360; Strand=-; Position=1-2001
  Homolog annotation: Hit_ID=XP_415982.1; Match level="QueryCoverage =60%, HitCoverage=22%, E-value=2e-12, Identity=25%"; Hit description =PREDICTED: similar to MOV10-like 1; Mov10 (mouse)-like 1 [Gallus gallus]
MAAAVAAQSFDVKADLRKHTLFVEPVVINEISTRSVVIQFVMPVPSIEELTELCKIWEIDLAVGCKVNPAAKAKPCAHGYVLSIDKRALCVGYEIDAKVILSYQAAKDQDAQDEFDQMRCGELDGCVELIPQTSVRALQERMFTLRSNDCSKVATDEGKEKVGRIMSILLGRPVKPESPKANNPLMTFGALSKLKEGQIDTALCMLDEVPRLVFQQAGPGTGKTFSAASIVATVLATDPTARVLALAPPNVAVVKLVLEMQDALAAGNHVEPMLALFSGTGKLRYAKEVERISPHLLATAVEAQDFQELLQKDQDRVKVERYLDACERNPRLAQEMAVAKIVQEHKNRRLCFATLSFCEQLPALFGETTHLIIDEAGQAPYVQILNLVSQLPCLTKVLITGDRRQLRVHLPSLPIAIREDFGMDTVIQNLDVAQGTDVTTLSVCFRSHSALVRCTEAGFYKPHGELLTPGRDDSERALMTNQTAFKLPKKGVPLVLVHQSTPAQRDEVSTSSANPGQTDTAMRALWRLARAFPGTLIRCICFYAAQALEIERLVAQQEIPDILVTTADATQGHESSLAVVVTTCSVLDSGADSQPFWADAARVDVAISRASHGMIIIGDLLLLNRTETWRRSTWTKRQRKRQWSARSTSTSSSSTTPTTITTETVS

SEQ ID NO: 133938 - protein, 68 aa, Heterodera glycines
  Coding regions on vcDNA: vcDNA=SeqID_60361; Strand=+; Position=1-207
  Homolog annotation: Hit_ID=NP_500401.1; Match level="QueryCoverage =92%, HitCoverage=16%, E-value=1e-12, Identity=53%"; Hit description =putative protein family member, with at least 5 transmembrane domains (4E479) [Caenorhabditis elegans] gb
MPILFRTRFWLVVVAGGAASAFGIVANAMLTRLFLTRPAFRHSPFFFLGFVALFDTLLDSVYIFLLVS

SEQ ID NO: 133939 - protein, 68 aa, Heterodera glycines
  Coding regions on vcDNA: vcDNA=SeqID_60362; Strand=+; Position=1 -190,417-433
VVEDRIRINEANGGIRKDGLMHSEGSLYKGKIMAFLDFLLTLREEQKLSTEQVREQVDAFMFGDHKLY

SEQ ID NO: 133940 - protein, 62 aa, Heterodera glycines
  Coding regions on vcDNA: vcDNA=SeqID_60363; Strand=-; Position=1 -171,278-295
MAICSHQRRSIPAQFPPELLLQNGQQFRHAICLGNRDGMPLTTETWHYRWKYFVGRHINCYV

SEQ ID NO: 133941 - protein, 32 aa, Heterodera glycines
  Coding regions on vcDNA: vcDNA=SeqID_60364; Strand=+; Position=1 -14,213-297
MNEFGFQSSKMFKRANHEKELKLRKKEQKQRD

SEQ ID NO: 133942 - protein, 68 aa, Heterodera glycines
  Coding regions on vcDNA: vcDNA=SeqID_60365; Strand=+; Position=1-207
MEALIIEVCASKFIKIQICDHQKRKINCKKNYKINEFYYFVNLKLEDESQPNIITSIWRHQRQAFKLS

SEQ ID NO: 133943 - protein, 119 aa, Heterodera glycines
  Coding regions on vcDNA: vcDNA=SeqID_60366; Strand=+; Position=1 -207,468-620
  Homolog annotation: Hit_ID=NP_495743.1; Match level="QueryCoverage =63%, HitCoverage=10%, E-value=1e-14, Identity=53%"; Hit description =tyrosine DeCarboxylase, Aromatic amino acid deCarboxylase (tdc-1) [Caenorhabditis elegans] emb|CAC42319.1
MTESTGSLCSSNFASAAQQNVVPPATAASAVDVHQQQQQQQQPMLQTNSFHDRRRLNTLAEKRSFLVRMVSDPKCYNPKIVHHLNMRTHNQTSQDLFRDRTLRCAAGEEDKVTNDKWDK

SEQ ID NO: 133944 - protein, 489 aa, Heterodera glycines
  Coding regions on vcDNA: vcDNA=SeqID_60367; Strand=+; Position=1-1472
  Homolog annotation: Hit_ID=CAE64509.1; Match level="QueryCoverage =100%, HitCoverage=90%, E-value=1e-119, Identity=41%"; Hit description=Hypothetical protein CBG09244 [Caenorhabditis briggsae]
EKAKKDAEDKAKKDAEEKAKKDAEAKAKKEAEEKAKKDAEAKAKKDAEEKAKKDAEDKKAKKDAEEKAKKDAEAKAKKDAEEKAKKDAEAKANKDAEEKAKKDAEDKAKKDAEEKAKKDAEAKAKKDTEEKAQKDAEAKAKKDAEEKANAEAKAKKDAEEKAKKDAEAKAKKDAEEKAKKDAEAKAKKDAEAKKKEEEMKKQKAKPEEKPEAPAEGVAVVPEAKKAEETKEKLKQEEKPVEVPPSPAEKKRKEAEEKKAQKDAEAKAKKDAEEKAKKDAEAKAKKDAEEKAKKDAEAKANKDAEAKKKEEEMKQKAKPEEKPEAPAEGVAVVPEAKKAEETKEKLKQEEKPMEVPQSPAEKKRKEAEEKKDQKDAEAKAKKDAEEKAQKDAEAKAKKDAEEKAKKDAEAKAKKDAEEKAKKDAETKAKKDAEEKAKKDAEAEAKQDAEAKKNEQEMKKQKAKPEEKPEAPAEGVAVVPEAKKRKRQRKS

SEQ ID NO: 133945 - protein, 19 aa, Heterodera glycines
  Coding regions on vcDNA: vcDNA=SeqID_60368; Strand=-; Position=1-59
TFAFSSLALPNTHTIFEML

SEQ ID NO: 133946 - protein, 19 aa, Heterodera glycines
  Coding regions on vcDNA: vcDNA=SeqID_60369; Strand=-; Position=1-59
TFAFSSLALPNTHTIFEML

SEQ ID NO: 133947 - protein, 19 aa, Heterodera glycines
  Coding regions on vcDNA: vcDNA=SeqID_60370; Strand=-; Position=1-59
TFSFSSLALPNTHTIFEML

SEQ ID NO: 133948 - protein, 19 aa, Heterodera glycines
  Coding regions on vcDNA: vcDNA=SeqID_60371; Strand=-; Position=1-59
TFSFSSLALPNTHTIFEML

SEQ ID NO: 133949 - protein, 19 aa, Heterodera glycines
  Coding regions on vcDNA: vcDNA=SeqID_60372; Strand=-; Position=1-59
TFAFSSLALPNTHTIFEML

SEQ ID NO: 133950 - protein, 19 aa, Heterodera glycines
  Coding regions on vcDNA: vcDNA=SeqID_60373; Strand=-; Position=1-59
TFAFSSLALPNTHTIFEML

SEQ ID NO: 133951 - protein, 123 aa, Heterodera glycines
  Coding regions on vcDNA: vcDNA=SeqID_60374; Strand=-; Position=1 -108,939-1202
MDIWSAAITIYEIVLINFLNGSWSSNSMPINMADFRPNIENKVKRIGELCRFARLYDGTLNEQQQQMMIIKLGLLEGAFKPGSEDWWLRYSGVVINILDMWGNKYGMPDIAYLLVVRARENWN

SEQ ID NO: 133952 - protein, 94 aa, Heterodera glycines
  Coding regions on vcDNA: vcDNA=SeqID_60375; Strand=+; Position=1 -76,269-477
MPKLGIIKVILGTPNQAENAFFVLISSAAERHHTFITKKVFILIGFPFFAYFWHIEQPSPIFYIFWHLNQSSPNFVHFFPHLINHRAYLMFDSL

SEQ ID NO: 133953 - protein, 81 aa, Heterodera glycines
  Coding regions on vcDNA: vcDNA=SeqID_60376; Strand=-; Position=1 -119,771-897
MAFLGSLITNVTFISNNSEKCYDQGANSADYHHHFADLKGFLSVIMRAKLCRQTAKACRPKANVLPSKFIITKSSPTLLII

SEQ ID NO: 133954 - protein, 55 aa, Heterodera glycines
  Coding regions on vcDNA: vcDNA=SeqID_60377; Strand=+; Position=1-168
AKSTPSKSLPSYYSHNSPTKTTFGVKENVPISSPLPCGTQIPPKTPPLGYMDHRI

SEQ ID NO: 133955 - protein, 28 aa, Heterodera glycines
  Coding regions on vcDNA: vcDNA=SeqID_60378; Strand=-; Position=1-84
MRTRPIWQVKQRLLTSQKVRCRDETNQQ

SEQ ID NO: 133956 - protein, 123 aa, Heterodera glycines
  Coding regions on vcDNA: vcDNA=SeqID_60379; Strand=-; Position=1 -26,153-347,526-676
MKKGWIKTIDFQISQFHFENLRESFGNSDALFVILSAKWNKYKYELRNIEDELERLSGGKLRVEYVPLLEGYENFSLADDNSLLLNGKIVGVVYSGLSALGYQANEKEMHTRKIVELSTAIVK

SEQ ID NO: 133957 - protein, 116 aa, Heterodera glycines; identical to SEQ ID NO: 127487
  Coding regions on vcDNA: vcDNA=SeqID_60380; Strand=+; Position=1-351

SEQ ID NO: 133958 - protein, 92 aa, Heterodera glycines
  Coding regions on vcDNA: vcDNA=SeqID_60381; Strand=-; Position=1-279
MIIWRSAGCYSDFAWAAKVEPGAGPDPAQDFAGSQYAILIAGFAGLIRPDPVLQKFLNSNPATGSVNLKFPGSMLKFGTQMSDLQQAAIRGR

SEQ ID NO: 133959 - protein, 63 aa, Heterodera glycines
  Coding regions on vcDNA: vcDNA=SeqID_60382; Strand=+; Position=1 -64,121-189,246-304
MAISFLRIFYATNALEHETKCEKWLSLFLRIFYATNALEHETKCEKWLSLFLRNFLCNKRSRT

SEQ ID NO: 133960 - protein, 57 aa, Heterodera glycines
  Coding regions on vcDNA: vcDNA=SeqID_60383; Strand=+; Position=1 -61,123-235
MAISFFEKFSMQQTLSNMKRKKWLSLFLRNFLCNKALEHETKCGAPWPFYFSNNFYI

SEQ ID NO: 133961 - protein, 177 aa, Heterodera glycines
  Coding regions on vcDNA: vcDNA=SeqID_60384; Strand=+; Position=1 -195,366-412,611-900
MRVTIIAGENVASLEISADMELENFLALCKFELPSIADTPIERIALNCSGRQFIANAGLAKKQLKELNIQHEDAIHFETISASSTAQTPHSSLSTPSSAASSSLGAPLQTSNLISSLVQNIKVPQKQKSVAEDRAMSDQIFTMLQHPARLDFLRVDHPELAAAYEKNQRTEVLVHRI

SEQ ID NO: 133962 - protein, 162 aa, Heterodera glycines
  Coding regions on vcDNA: vcDNA=SeqID_60385; Strand=-; Position=1 -180,265-339,949-1181
  Homolog annotation: Hit_ID=AAD11971.1; Match level="QueryCoverage =98%, HitCoverage=91%, E-value=3e-18, Identity=36%"; Hit description =galectin [Trichostrongylus colubriformis] gb|AAC47547.1| galectin [Teladorsagia circumcincta]
MSEISPGQTLNIHGNVNADAHRFEVNLLSNCVEIDAHMGSAPLHFSVRFDEGKVVLNSFAAGEWGKEERHSNPFTKGQPFDLRFRSQQIVRGSQKDGVWGEEEREGAFPLKKEQAADIAVFNEPYSLQIFINGHHYCAFAHRVESPNTDYKFVRVEGDIELT

SEQ ID NO: 133963 - protein, 37 aa, Heterodera glycines
  Coding regions on vcDNA: vcDNA=SeqID_60386; Strand=+; Position=1-131
KMSKVFTFLSFQQLLTWLFPKCLLLIFYQCKHSSFIK

SEQ ID NO: 133964 - protein, 246 aa, Heterodera glycines
  Coding regions on vcDNA: vcDNA=SeqID_60387; Strand=-; Position=1 -152,239-369,465-806,936-1051
  Homolog annotation: Hit_ID=CAE70379.1; Match level="QueryCoverage =90%, HitCoverage=74%, E-value=6e-54, Identity=47%"; Hit description =Hypothetical protein CBG16940 [Caenorhabditis briggsae]
MALPTKIHQIPNLLTVFISSSRCIYENLALEEWLFRNNGVKEDGDSLLIWRNSPAVVIGRYQNPWLESDVRFCAANGIRISRRYSGGGAVYHDEGNLNISLMTTHERHSRKKNLQIVADFLNAKLFGGCASATAPRLIANERDDLLIEPSGAKVSGTAARIARGRAYHHFTLLVDVDIGTVRRALKSPFDDQRIQTNASRSVRAKSVDFHKMMNASTKGGRFCSQSVRFAVQKQRIGSVERRNGQI

SEQ ID NO: 133965 - protein, 43 aa, Heterodera glycines
  Coding regions on vcDNA: vcDNA=SeqID_60388; Strand=+; Position=1-130
MPKKHTQSNKTRKRSGRDLDEIHADLIRPDKMQRIQVLFISHW

SEQ ID NO: 133966 - protein, 125 aa, Heterodera glycines
  Coding regions on vcDNA: vcDNA=SeqID_60389; Strand=-; Position=1-378
MFGCNGGAHIPGSLVTGRILANTLASHFIKVYVNWEEDGKTYQAYYRGQSPRKKYKVKLYPPLSFEMKERRRAEEAAEDGGETPKNKRRDDEVEVINKCIIKNGNWNGDLNSFSSQGHFRNDLPP

SEQ ID NO: 133967 - protein, 80 aa, Heterodera glycines
  Coding regions on vcDNA: vcDNA=SeqID_60390; Strand=+; Position=1-240
RSQASPARPRRKTVHAKRGGIGRRIGRGRANQIGKPGGFDILAPISYRVNLCFFLLLFLSSLSYKQKIINNIFAKQNIKQ

SEQ ID NO: 133968 - protein, 113 aa, Heterodera glycines
  Coding regions on vcDNA: vcDNA=SeqID_60391; Strand=-; Position=1 -183,466-624
MSVRRGSTSSQPASKSGSVETNNSDDSLPVPCTKRQKAIFKARKLMDALWANKPVDLYAEKVKAICIRPNVREGFSDGHVGLGSFETEGRPTEGMFELQSGGPRWVLSEPMHP

SEQ ID NO: 133969 - protein, 62 aa, Heterodera glycines
  Coding regions on vcDNA: vcDNA=SeqID_60392; Strand=+; Position=1 -58,630-760
MKCHLIKLINLPVLVPFQFDDYYFLQNVQCSHWAMNDEVVQIGVIGRIFGRTRVPTGRRNDL

SEQ ID NO: 133970 - protein, 353 aa, Heterodera glycines
  Coding regions on vcDNA: vcDNA=SeqID_60393; Strand=-; Position=1 -180,280-368,832-987,1293-1425,1483-1593,1678-1873,2039-2128,2171-2215
  Homolog annotation: Hit_ID=NP_496969.1; Match level="QueryCoverage =90%, HitCoverage=34%, E-value=4e-99, Identity=54%"; Hit description =gene amplified in squamous cell carcinoma 1 like (2O526) [Caenorhabditis elegans] emb|CAB54451.1| Hypothe
TVRMAAYRPIYTKEKEWVNTGTADGEIMVFRPTMEEFSNFSKYIETIERSRAHLSSGVCKVIPPPGVIPPPGWHPRPSKNPSDYSDLNDFVIHCPVKERIEGGSSTGCYVKNNTVYRKEMRVGDFRRMALSKQFRPPKPNYDLTELERHFWRNLLHHEPIYGADTPGSIYDPGVSQFNMNGLGTILDLLKEQIKGVNIKGVNTVFLYFGMWKTMFPWHVEDMDLYSINYLHFGEPKFWYAIPPSAAAKFERLAAQRFPDLQICKAFLRHKVYIVSPSVLRTNGVPFGSMVQYPGEFMITFPRGYHMGFNLGYNCAESTNFALERWIDYGKNAVLCYCRNDKNAVLCYCRNDCG

SEQ ID NO: 133971 - protein, 80 aa, Heterodera glycines
  Coding regions on vcDNA: vcDNA=SeqID_60394; Strand=+; Position=1-388
LISSQKSCQFKTAKKAEFSKFFISIFFYSSKFSVIFSRLIEPVKSFRMISRLFDSVNNFKSYIDSKLAQTELARRSWPVP

SEQ ID NO: 133972 - protein, 247 aa, Heterodera glycines
  Coding regions on vcDNA: vcDNA=SeqID_60395; Strand=+; Position=1 -85,130-216,310-379,530-563,609-727,780-841,891-986
  Homolog annotation: Hit_ID=CAE72428.1; Match level="QueryCoverage =80%, HitCoverage=43%, E-value=8e-40, Identity=45%"; Hit description =Hypothetical protein CBG19594 [Caenorhabditis briggsae]
PEKSGVLRDNHFQIRYEPYVKVEPDELSALAHRRLVATVDTIEHFCALMDELSALAHRRLVATVDTIEHFCALMDLHNIKDRLLALVKAAFAPLTLFCAVSSTARVTRGAHLSYAEPYHFSNRLVDRALDELVEPFRTFAEPYHFSNRLVDRALDELVEPFRTFNFKEQEIVLMKAIVALNPYLPNLLPNLSAEAAEQVADFRDRVQETLYNVVRETLYNVVRESHPKEVASSRFGNLLLFLPNIMV

SEQ ID NO: 133973 - protein, 117 aa, Heterodera glycines
  Coding regions on vcDNA: vcDNA=SeqID_60396; Strand=-; Position=1 -168,625-810
MVDGDSDLAGSAEMEEARDRMADTLPSMAPQKMAWLMQQSTTATEAAKEEEEENEHVTNSLRSLRENVGQIEDIDRSEEEQRELIEDLQRRLKTKNDFFRNIGGENRNGEGTAADGV

SEQ ID NO: 133974 - protein, 354 aa, Heterodera glycines
  Coding regions on vcDNA: vcDNA=SeqID_60397; Strand=-; Position=1 -201,348-409,495-627,680-827,880-973,1018-1113,1171-1328,1547-1581
  Homolog annotation: Hit_ID=CAE59477.1; Match level="QueryCoverage =94%, HitCoverage=70%, E-value=1e-108, Identity=60%"; Hit description= Hypothetical protein CBG02861 [Caenorhabditis briggsae]
SLLASKNNNCVDSNFNCFDAFDLDSQLTEEERTLRDQAHAYCQEKLQPRVTQAFREERVEVVKGEIEFDPSLLPELGRMGFLGAPYKGYGCAGTSFVGYGYGCAGTSFVGYGLLARELERVDSGYRSIVSVQTSLVIGPIVTYGSEAQKEKFLSEAQKEKFLPKLASGELIGAFGLTEPDHGSNPAGMETKAEWDEQQQLYRLSGLSGSKSWISNAPVADLFIVWARSPKHGNAVKGFIIERGAKGLSTPKIEGFIIERGAKGLSTPKIEGKLSLRTSITGQIVMDEVPVPDEVPVPEANLLPGAQGLSGPFGCLNSARLGISWGALGAAESCFAAAREYAMDRQFGKPIAATQ

SEQ ID NO: 133975 - protein, 76 aa, Heterodera glycines
  Coding regions on vcDNA: vcDNA=SeqID_60398; Strand=+; Position=1 -141,488-577
MSNAWTVLFRQRSSRDAAQTPTPAAKPWSSTKGHGLWGWSEDGLMVSVPWAKKQQTMTNFAVFDKNLRVIVVRRCR

SEQ ID NO: 133976 - protein, 92 aa, Heterodera glycines; identical to SEQ ID NO: 125147
  Coding regions on vcDNA: vcDNA=SeqID_60399; Strand=+; Position=1-304

SEQ ID NO: 133977 - protein, 61 aa, Heterodera glycines
  Coding regions on vcDNA: vcDNA=SeqID_60400; Strand=+; Position=1-187
KGEKYSLEKGHAELLFQFKWSNNDDGSAEEKFVLDLTPTQLKDGKLEFTIDSKGIELKRTW

SEQ ID NO: 133978 - protein, 450 aa, Heterodera glycines
  Coding regions on vcDNA: vcDNA=SeqID_60401; Strand=+; Position=1 -324,379-1396
  Homolog annotation: Hit_ID=XP_318550.1; Match level="QueryCoverage =99%, HitCoverage=46%, E-value=2e-86, Identity=40%"; Hit description =ENSANGP00000020240 [Anopheles gambiae]
PFLIFAVQKFHTLYGRRFTLLTDHTPLIAIFGSKNGIPIYAASRLQRWALILANYDFEIKYISTNCFGQVDVLSRLAAKQRETVEAEERVIVSLDKISLPISDNSALLPVTANLPVTANEVAEHTQLDTTLRKVLTFANGWPKKSPSDLSAFFTHRHKLSEVNGCLLFGERVVIPGALRQRILSALHFTHPGIVRMRALAQQHVYWPRMDLDIERWVRHCVDCAMAAKAPPKTTLSPWPRTNKVYKRIHMDFAGPCSDGNLYLIIVDAFSKWPETFQVKSTSADNVIVQLEWLFSRYGFPREIVTDNGSPFHSKDFSHFCRIKGIKQRFSPPNHPQSNGQAERFVDIFKRQMKKCSHGDKWITNSPFAYRNTPNAALKGQTPAELFLGRSPRTQLSLLKPDISCSNRNQNDYTNNMSKQFDRKHGARHRTFAIGDDVLIINYRNNKKSWY

SEQ ID NO: 133979 - protein, 55 aa, Heterodera glycines; identical to SEQ ID NO: 130740
  Coding regions on vcDNA: vcDNA=SeqID_60402; Strand=+; Position=1 -96,242-313

SEQ ID NO: 133980 - protein, 21 aa, Heterodera glycines
  Coding regions on vcDNA: vcDNA=SeqID_60403; Strand=-; Position=1-62
GTHAFRRSRFGAPVSAPARFS

SEQ ID NO: 133981 - protein, 153 aa, Heterodera glycines
  Coding regions on vcDNA: vcDNA=SeqID_60404; Strand=+; Position=1-459
  Homolog annotation: Hit_ID=EAL45607.1; Match level="QueryCoverage =94%, HitCoverage=37%, E-value=6e-10, Identity=32%"; Hit description =HMG box protein [Entamoeba histolytica HM-1:IMSS]
MVKADNERHSRQLQMAKNVQKLDSLNGRKSKGIEIKEPTQKVPKVEKNDEGIEAKGKEIVEEKTKKTKPKKKKGDGKSRKSKDTSVDKHKAEGEGMDEIWAKIKSDQKQEEEEEEGKGTDKKDGKEEVLEEEEEGSGSAMLRELRQKRGKLKK

SEQ ID NO: 133982 - protein, 19 aa, Heterodera glycines
  Coding regions on vcDNA: vcDNA=SeqID_60405; Strand=-; Position=1 -25,67-101
MASLALSTVKCKKRGNFST

SEQ ID NO: 133983 - protein, 256 aa, Heterodera glycines
  Coding regions on vcDNA: vcDNA=SeqID_60406; Strand=-; Position=1 -491,1431-1519,1562-1752
MRALWRLARAFPGKLIRCICFYAAQALEIERLVAQQEIPDILVTTADATQGHESSLAVVVTTCSVFDSGADSQPFWADAARVDVAISRASHGMIIIGDLLLLNRTETWRRYLDQATTETTVVGPEYFDFEQFNNPDNYYDKDGQLISSSRWHSGTHSWQSLNFWTTSAARLVLYKNMERVFNTPGCRLFYCDTDSLVIAHPPNSCPLKEGKFFGEMTREYADSDIIEYVSGGPKQYALKLKDGKLEKFGIKPKYAG

SEQ ID NO: 133984 - protein, 711 aa, Heterodera glycines
  Coding regions on vcDNA: vcDNA=SeqID_60407; Strand=-; Position=1-2136
MQKPIPSNRPNSSVSKTLACGLEKMVNASGIEPLTVPVLADRSDPLGLKSVQPDPVPMESAKAGTKEMEVMEVDEMSGEKGKKGEMGKEKVKSGGIEEEEESEGSEGELLGDGGFGNLQLNPSLRAGNKAVEKEDKGKSYLVAQVRSDGVIAARMKLFWDFPELVFVPFSLFDNAQPIEIGDLFRLHKCEWTKSETGWEERGDWLYEATGRLNYQATATDVSQLRQRIPTLAVGILVDVQRARDRHVKVAMVSAPELSCVMRAYRRHFPADFTDNDIRYRSVVRLQLRQINSPPWVLYSQQFAYVLPSDFGKKRGDELLVHHANVIAGVEPEPMGYEFPFSAELSWAKVQLGEKVMAAAVAAQSFDVKADLRKHTLFVEPVVINEISTRSVIIQFVMPVPSIEELTELCKIWEVDLAVGCKVNPAAKAKPCAHGYVLSIEKRAFCVGYEIDVKVILSYQAAKEQDAQEEFDQLRTGELDGCVELIPQTSVRALQERMFTLRSNDCSKVAKDEAKVGRIMSILLGRPVKPESPKANNPLMTFGALSKLKERQIDTALCMLDEVPRLVFQQAGPGTGKTFSAASIVATVLATDPTARVLALAPPNVAVVKLVLEMQDALAAGNHVEPMLALFSGTGKLRYAKEVERISPPPARHRGGGTGLSGTPAEGSRTRQGGAVPGRLRAEPTPGPGNGSGENCAGAQKSPLVLRHLVLL

SEQ ID NO: 133985 - protein, 155 aa, Heterodera glycines
  Coding regions on vcDNA: vcDNA=SeqID_60408; Strand=-; Position=1-468
MAGNGNELIKREDDENSVNFMNLFENLELMDSEKLASLRDIEKIFADTSPPPTGPSPIESSVLGVVFISHPILWALVQPDILGERNELLDRKNLSLESDQLVFQSTPSYVTTITLDPNNNWPHFTQISLNWFDYHTVTYVPPWTCNNHQNADELI

SEQ ID NO: 133986 - protein, 173 aa, Heterodera glycines
  Coding regions on vcDNA: vcDNA=SeqID_60409; Strand=-; Position=1 -268,496-618,678-806
  Homolog annotation: Hit_ID=NP_508889.1; Match level="QueryCoverage =75%, HitCoverage=34%, E-value=6e-17, Identity=34%"; Hit description =i-01 protein like (41.5 kD) (XF865) [Caenorhabditis elegans] gb|AAF59637.2| Hypothetical protein Y34B4A.7
MARDWGTLRSSDSAVGRWTHSFTSKFHRCQRRNWEEFWGTCFVQLNITVYESDSVVVELAKQWFEVSDDQTRRTVVGDGAAAISDHVKRGNRFDAIILDACDSSPHIPCPASPFIALKMLGNAKSALRPQGVFVMNALPASEQNEQKTLALLQDKLLSVFPLCVRMTMGRQMN

SEQ ID NO: 133987 - protein, 55 aa, Heterodera glycines
  Coding regions on vcDNA: vcDNA=SeqID_60410; Strand=-; Position=1 -97,222-292
MPFHHVLLLVLVCFFLLFAFLNFGNAQIFGFTGIGIGFSGPENLSLEVHSKRLRH

SEQ ID NO: 133988 - protein, 16 aa, Heterodera glycines
  Coding regions on vcDNA: vcDNA=SeqID_60411; Strand=-; Position=1-49
EAIPEGFGLPINLGAS

SEQ ID NO: 133989 - protein, 95 aa, Heterodera glycines; identical to SEQ ID NO: 124528
  Coding regions on vcDNA: vcDNA=SeqID_60412; Strand=-; Position=1-658

SEQ ID NO: 133990 - protein, 80 aa, Heterodera glycines
  Coding regions on vcDNA: vcDNA=SeqID_60413; Strand=-; Position=1-240
  Homolog annotation: Hit_ID=EAL20892.1; Match level="QueryCoverage =98%, HitCoverage=15%, E-value=6e-13, Identity=43%"; Hit description =hypothetical protein CNBE2530 [Cryptococcus neoformans var. neoformans B-3501A]
MEQKVEEKVEEEQKVEEKVEEEQKVEEKVEEDQKVEEKQKVKEKLEEEHKVEEEQKEKAEQKVEEKVKGTVEEEQKVEEK

SEQ ID NO: 133991 - protein, 96 aa, Heterodera glycines
  Coding regions on vcDNA: vcDNA=SeqID_60414; Strand=-; Position=1-291
  Homolog annotation: Hit_ID=E86336; Match level="QueryCoverage=100%, HitCoverage=34%, E-value=1e-18, Identity=48%"; Hit description =hypothetical protein F14O10.11 - Arabidopsis thaliana gb|AAF88160.1| Contains weak similarity to an unknown p
MEEKVEEEQKVEEKVEEEQKVEEEQKVEEKVKVEEKVEEEQKVEEKVEEEQKVEEKVKVEEKVEEKVEEEQKVEEKVEEEQKVEEKVEEEQKVEEE

SEQ ID NO: 133992 - protein, 185 aa, Heterodera glycines
  Coding regions on vcDNA: vcDNA=SeqID_60415; Strand=+; Position=1 -311,666-702,766-870,1346-1450
MRWTAKWKAECWPSILAARNTASWSRWPNRAGAWHLELKGGMAIGVFYPITNNWLSFLISDCTNKITTQYQLVLLTDLEEIYFCPILKLNFQKNGDLHRTLAEGLIKYIYAYRQAQSRLTSAFSAIEANDMRKMKSLVDDEIVQSRDSRGTALTSLDFFWTWVFMNVCPENPGPGYKMSSLVTIN

SEQ ID NO: 133993 - protein, 358 aa, Heterodera glycines
  misc_feature (149)..(149): Xaa can be any naturally occurring amino acid
  misc_feature (153)..(153): Xaa can be any naturally occurring amino acid
  misc_feature (155)..(155): Xaa can be any naturally occurring amino acid
  misc_feature (168)..(168): Xaa can be any naturally occurring amino acid
  Coding regions on vcDNA: vcDNA=SeqID_60416; Strand=+; Position=1 -190,244-283,569-646,811-857,932-982,1159-1290,1415-1528,1987 -2142,2373-2613
  Homolog annotation: Hit_ID=NP_741115.1; Match level="QueryCoverage =90%, HitCoverage=82%, E-value=1e-127, Identity=48%"; Hit description= ankyrin-related ADP-ribose polymerase like (3E838) [Caenorhabditis elegans]
KIIFKIFFQFFFSRHDAPSDEQVKRWLTIGEVSQLEQIVLDGRAHLLADKTSTNLASAEFLQGVSQYQSKIDVSQYQSKIDAIHKAVEEGDVRRVKSLIDRNSLATARDTHGMTPLHKALLYGQTNTVRFLLAKYAHCVNEADHTIFNXLIDXLXSNYTYYKGIFKFXAGRTALHYAAADANGEHMIKVLQKAGGDAFIEDRYGHTPFFYRTHGKRLNIRTLKDNAVINHLIAGQLNRTLLQDLEEDITDWVHTGNIGKLEELVLNGYADLLLGRNHQVEDAEAISFLEVLPQYQAKIHAIHKAIEQGNLRAVKLLTDRKKLALCRDGRGLVSSREYSSTDPADQLPVILSDFFSSWQ

SEQ ID NO: 133994 - protein, 263 aa, Heterodera glycines
  Coding regions on vcDNA: vcDNA=SeqID_60417; Strand=-; Position=1 -168,396-500,544-769,811-1103
MPKEPSSRAFLFKKWVSNYMNDVYTTDSKIIYCQACQIEVLRNMHLEINTLNLYLKVNNPSFKAFLEKYCGRSILHHETLRSNYVKNCFEGVLSKSKDDIGENGFVWCSVDERTDRNGRCMANLLIGLLNERWNAPHLISVKPLLDENGDPKVDHQTVARFVDEGLADLLSTGAKKNRLLFMVTDSAEYMKKAARNLRVFYPNMVHFTCLAHGLHRIAEEIRNQFKDVDELISSTKMVFRKAPSRVAFYRKKLPTVPLVPKPI

SEQ ID NO: 133995 - protein, 135 aa, Heterodera glycines
  misc_feature (4)..(4): Xaa can be any naturally occurring amino acid
  misc_feature (10)..(10): Xaa can be any naturally occurring amino acid
  Coding regions on vcDNA: vcDNA=SeqID_60418; Strand=+; Position=1 -102,444-539,920-1011,1063-1131
  Homolog annotation: Hit_ID=CAE75218.1; Match level="QueryCoverage =70%, HitCoverage=14%, E-value=7e-38, Identity=75%"; Hit description =Hypothetical protein CBG23167 [Caenorhabditis briggsae]
FNFXLINYFXIIILFIHFYSHRVLGISEGIEHVGSLRQDMALYLLICWIICYFCIFKGVKWTGKVVYLTASFLYLMLFFLLLRGLSLPGASLGLEFYLKPNFSKLLESKVWIFYLKPNFSKLLESKVWIDGVTQV

SEQ ID NO: 133996 - protein, 58 aa, Heterodera glycines
  Coding regions on vcDNA: vcDNA=SeqID_60419; Strand=-; Position=1 -18,143-244,305-361
  Homolog annotation: Hit_ID=NP_982285.1; Match level="QueryCoverage =94%, HitCoverage=14%, E-value=7e-17, Identity=69%"; Hit description =alcohol dehydrogenase 8b [Danio rerio] gb|AAP74382.1| mixed alcohol dehydrogenase Adh8b [Danio rerio] gb|
METEGKVICCRAAVAWEPNKPLVIEQIEVSPPKEGEVRVKILFTGICHTDIFVIILFI

SEQ ID NO: 133997 - protein, 81 aa, Heterodera glycines
  Coding regions on vcDNA: vcDNA=SeqID_60420; Strand=+; Position=1 -63,124-306
MFTKNFFLSVLILLVLIGVKNCAAYGSRKASAFVPEKGFLAFELIKHRSNDAATDSQKAPYTVSNDPCGIKLGPTFRVIYN

SEQ ID NO: 133998 - protein, 121 aa, Heterodera glycines
  Coding regions on vcDNA: vcDNA=SeqID_60421; Strand=+; Position=1 -188,635-812
MAIYGLCVDRLYRQWPQADNTVLWRTTAAHCTDVNVTLFVENKCAETNQFLMDLRLRYKPEEMHEVMHDFVLPVKASEMQVTVGSKDITKGTVHEVARIKRHEFYRLTSSANDITLLEVQF

SEQ ID NO: 133999 - protein, 92 aa, Heterodera glycines
  Coding regions on vcDNA: vcDNA=SeqID_60422; Strand=+; Position=1 -120,361-445,560-633
MSAHAELIDSKILRQDLVHLSPVCPQGFFCQFSAIHKTSHGDSGSPLLREIGGSLYAIGIVRGHESKKNLFAKISPYCDWLKEKSRGEVRCS

SEQ ID NO: 134000 - protein, 54 aa, Heterodera glycines
  Coding regions on vcDNA: vcDNA=SeqID_60423; Strand=-; Position=1 -68,335-431
MAKPSSDWRTIEGLISKKYNKRSACFSRFPVALPGPGPEIFKTREPGPRRTAAL

SEQ ID NO: 134001 - protein, 43 aa, Heterodera glycines
  Coding regions on vcDNA: vcDNA=SeqID_60424; Strand=-; Position=1 -10,557-678
MDTNKEQLRVFSVKIDIGDEELSLAKPSTIFRIANLNFQEENK

SEQ ID NO: 134002 - protein, 118 aa, Heterodera glycines
  Coding regions on vcDNA: vcDNA=SeqID_60425; Strand=-; Position=1-737
LFEYPKRTLEKIDFFVFGAVPPNRCAQIYGETESFRNSFPIACTLILRWIFAPHNCLSTPNGHLKKSIFFVFGAVPPNRCAQIYGETESFGNSFPIACTLILRWIFAPHKCLSTPNGH

SEQ ID NO: 134003 - protein, 20 aa, Heterodera glycines
  Coding regions on vcDNA: vcDNA=SeqID_60426; Strand=-; Position=1 -51,223-234
MSAHAAMSGAIAFSGATKGF

SEQ ID NO: 134004 - protein, 108 aa, Heterodera glycines
  Coding regions on vcDNA: vcDNA=SeqID_60427; Strand=+; Position=1 -96,135-365
MLGSVHKSARTTCARQRTGAFGGANASPTGQQQQVHLQLPCYDFCPVQATAIKSVPVCIPTEAGTLTVPEFLEMAQSRAATGGVYKGQGRIQSELMTRPYKEFLVHGQ

SEQ ID NO: 134005 - protein, 158 aa, Heterodera glycines
  misc_feature (147)..(147): Xaa can be any naturally occurring amino acid
  Coding regions on vcDNA: vcDNA=SeqID_60428; Strand=-; Position=1 -26,107-559
  Homolog annotation: Hit_ID=AAP92584.1; Match level="QueryCoverage =83%, HitCoverage=26%, E-value=4e-35, Identity=61%"; Hit description =Ab2-057 [Rattus norvegicus] gb|AAP85373.1| Aa1262 [Rattus norvegicus] gb|AAP85367.1| Aa1011 [Rattus norveg
RSGACGLICGAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 134006 - protein, 1048 aa, Heterodera glycines
  misc_feature (40)..(40): Xaa can be any naturally occurring amino acid
  Coding regions on vcDNA: vcDNA=SeqID_60429; Strand=+; Position=1 -228,314-392,545-583,629-652,696-800,953-1096,1150-1322,1368 -1402,1446-1487,1535-1607,1703-1751,1796-1889,1994-2037,2080 -2135,2238-2274,2318-2389,2439-2578,...
  Coding regions on vcDNA: Position=...2722-2874,2930-3027,3070 -3143,3194-3325,3368-3420,3462-3499,3542-3565,3609-3640,3684 -3809,3855-3891,4019-4216
  Homolog annotation: Hit_ID=NP_491022.2; Match level="QueryCoverage =98%, HitCoverage=98%, E-value=0.0, Identity=44%"; Hit description =glycine-rich protein (87.0 kD) (1D242) [Caenorhabditis elegans] gb|AAB54209.3| Hypothetical protein F32B5.7
PVSNGCHSLCSSNSVQTGPNGVSTHSSSFSAIDARPNYEXIGNRRGSPSFQRACISIDLLVACQREVNFLRMIDRKAPVLYKAPVLYEKVVVENAIRRYEMCWLPAQAAKPNLHNIPPLDVHWIWHTHPLDVHWIWHTHMLSPTHYREDCLAICGTVVMLSPTHYREDCLAICGTVVDHKLLNADEIQQRYEQSVSSWSEFCPEEPYDFLQSNDRVREQYQQKSKYNLAEAVQRQRNFNYQVSLPHFTAVSLPHFTAPRFLTDAIDRYIKFLQLKQTYADHFLTPCYDFDLVWHTHQVHPLDYHRDCVAIFGAVLKHDDVAIFGAVLKHDDSVNDRSKGSSVNDRSKGSKLLKGETMTKKAWNTHFKESFWRRETMTKKAWNTHFKESFWRRGCMYRGHVGHVAPAFLGFESQDNATITYGHIHIPSIATITYGHIHIPSIALKEIPVQREQLRMKLNYGGKKIITFNADLCDKPVTRSSFSLVWQPNATANSVTRSSFSLVWQPNATANSASIVKFSIVKFPFERKTPHDLLISLDLWNRTLIHKRDHDLLISLDLWNRTLIHKRDVVRLLGRLPLERLLPSENTKPQQGRLPLERLLPSENTKPQQRVVQAYLESVKEGEFRARVNVTASVSLNRELELLAGDYVEQSLQPDSRLWALCQSAALNRSQLHPGVHVFTAIHTLVDVRDGTKYFAQILVDVRDGTKYFAQIVHSAPLLLSMILIFGTEQRLLSMAHLLLSMAHLIGADSLPSKEQLDSNLVQFLPHLSQFLPHLSSPDERVLLVLNREGDFGILKGRWHGFVRRQTGDKRRKGKSGSAGVLGKSGSAGVLNVELFNLLKNTVQKFQVPNSDGNTVQKFQVPNSDGSTLFTIGDSTLFTIGDAQARLNGRAQARLNGRRMHCRTTQTSEYLSCIFGIGTLFILRMHCRTTQTSEYLSCIFGIGTLFILCNPDKVRARSESTTPGHQCQKWPMCQKWPMTLACGYGRPVPSNRILAAQHQQNFTSAEVAPMLLMMNAMTDGTFSGCDGAASCGSVTDIANCDMNPLNFLN

SEQ ID NO: 134007 - protein, 558 aa, Heterodera glycines
  misc_feature (3)..(3): Xaa can be any naturally occurring amino acid
  misc_feature (7)..(7): Xaa can be any naturally occurring amino acid
  misc_feature (24)..(24): Xaa can be any naturally occurring amino acid
  Coding regions on vcDNA: vcDNA=SeqID_60430; Strand=-; Position=1 -414,459-617,659-864,908-1176,1224-1511,1556-1642
  Homolog annotation: Hit_ID=CAE64108.1; Match level="QueryCoverage =98%, HitCoverage=86%, E-value=0.0, Identity=72%"; Hit description =Hypothetical protein CBG08717 [Caenorhabditis briggsae]
FNXKVEXVKNLTIRALVVYHCFFXGMALNLETDNVGVVVFGNDKVIKEGDVVKRTGSIVDVGVGEALLGRVVDALGNPIDGKGPINVSKRSRVEVKAPGIIPRVGVREPMLTGVKAVDSLVPIGRGQRELIIGDRQTGKTAIAIDTIINQKRFNSSTEEKKKTGKTAIAIDTIINQKRFNSSTEEKKKLYCIYVAIGQKRSTVAQIVKRLTDTDAMKYTIIVSATASDAAPLQFYTIIVSATASDAAPLQFLAPYSGAAMGEFFRDNGKHALIIYDDLSKQAVAYRQMSLLLRRPPGREAYPGDVFYLHSRLLERAADVFYLHSRLLERAAKMNETHGGGSMTALPIIETQAGDVSAYIPTNVISITDGQIFLETELFYKGVRPAINVGLSVSRVGSAAQTKSMKQVAGSMKLELVAGSMKLELAQYREVAAFAQFGSDLDASTQQLLNRGVRLTELLKQGQYVPMAIEEQVAVIYAGVKGHLDKIDPSQITRFEREFLAHIRAHEQELLKVIREEGQLTTATDEKLKNVIREEGQLTTATDEKLKNLVTSFLGGFKA

SEQ ID NO: 134008 - protein, 25 aa, Heterodera glycines
  Coding regions on vcDNA: vcDNA=SeqID_60431; Strand=-; Position=1 -26,161-212
MLETMNIIRIDNLRKQCRRQAPPET

SEQ ID NO: 134009 - protein, 123 aa, Heterodera glycines
  Coding regions on vcDNA: vcDNA=SeqID_60432; Strand=+; Position=1 -289,391-473
MRKTFCGQIIEGKGIENATEKVGKMSIELAKELENDKTLKENIQNALKNKKDKFIFKFSNAIELTDQLTNNYTQEYLEKLKTTFYLELAGFLKSSKASIENLCQKQQIAFAPRRHRRADFADK

SEQ ID NO: 134010 - protein, 142 aa, Heterodera glycines
  Coding regions on vcDNA: vcDNA=SeqID_60433; Strand=-; Position=1 -185,276-519
MLALIINNTPYFLYSSDFWIEIRNSMKTLRNLEFYLKDKKPRFLLLFLGGGGEMQQIDEKHHNLKISQSFKSFQIQMFLLAIVMLLSIICSNGIYEVRQNEGNDLFGELRQNAIIGGMEQFGNEFKHNGICKGIMSRSSLLF

SEQ ID NO: 134011 - protein, 232 aa, Heterodera glycines
  Coding regions on vcDNA: vcDNA=SeqID_60434; Strand=-; Position=1 -127,212-620,669-802,851-878
  Homolog annotation: Hit_ID=CAE66579.1; Match level="QueryCoverage =99%, HitCoverage=29%, E-value=2e-89, Identity=70%"; Hit description =Hypothetical protein CBG11896 [Caenorhabditis briggsae]
MYDWVSGKRILKNSYYIDKEKALERFPMLKKESLKGALIYYDGQHNDARMNLAIVLSAIRNGAKCCNHVAVEHLLKDENGKLCGAQVKNMVLSISHFFKSPPPPSNGQLTGELFPIRAKCIVNATGPFTDSIRMMADPDTEPICRPSAGVHIVLPGYYSPANTGLLDPSTTDGRVIFFLPWQRMTVAGTTDSPCDVSFSPKPRNSDIEFILGEIRGYLNKDISVRRGDVMSA

SEQ ID NO: 134012 - protein, 140 aa, Heterodera glycines
  Coding regions on vcDNA: vcDNA=SeqID_60435; Strand=+; Position=1-507
  Homolog annotation: Hit_ID=NP_492115.1; Match level="QueryCoverage =93%, HitCoverage=16%, E-value=6e-42, Identity=62%"; Hit description =FAD dependent oxidoreductase and Calcium-binding EF-hand (80.8 kD) (1I143) [Caenorhabditis elegans] emb|C
LTGELFPIRAKCIVNATGPFTDSIRMMADPDTEPICRPSAGVHIVLPGYYSPANTGLLDPSTTDGRVIFFLCVFVLECPHKLSYIFSPWQRMTVAGTTDSPCDVSFSPKPRNSDIEFILGEIRGYLNKDISGWQCQKSQI

SEQ ID NO: 134013 - protein, 37 aa, Heterodera glycines
  Coding regions on vcDNA: vcDNA=SeqID_60436; Strand=-; Position=1 -52,210-265,315-320
MSITQNKVHIHDQRPKLQKKIADFINIFLYLSTLFGE

SEQ ID NO: 134014 - protein, 153 aa, Heterodera glycines
  Coding regions on vcDNA: vcDNA=SeqID_60437; Strand=-; Position=1 -52,311-626,1645-1738
MPQFIEARNLHRPHTFERIFWPNLRPSTRPNTQWKCGDLIISCQLKIEFRSFNGEHVRDSPWHIQFSGAVGPASSPALSSDHEEHVARNLAALRRHEQRAAGGALNGRDGVAEEFVNGNGEDIITELVGPGLNRAAVNELAHFSIHSNQRLRC

SEQ ID NO: 134015 - protein, 22 aa, Heterodera glycines
  Coding regions on vcDNA: vcDNA=SeqID_60438; Strand=-; Position=1-67
MARIVPQEADGTVRVEWKPIEA

SEQ ID NO: 134016 - protein, 139 aa, Heterodera glycines
  Coding regions on vcDNA: vcDNA=SeqID_60439; Strand=-; Position=1 -163,221-301,737-837,905-941
  Homolog annotation: Hit_ID=NP_741881.1; Match level="QueryCoverage =91%, HitCoverage=21%, E-value=2e-47, Identity=75%"; Hit description =UNCoordinated locomotion UNC-110, MAHi, uncoordinated in Japanese MAH-2, TWiK family of potassium channel
AVVTMCVIWASTHKAYFTSLHYFGRAKRFLGMSEELREIVTLLGVLRRKKHGKIITWDDVCNFLENELYNRPFEPHELLMKLRFIDENTLSSALSTMRHNSFQSDFLRDAEYLRRLRALRPDQPAYLLRALRPDQPAYL

SEQ ID NO: 134017 - protein, 85 aa, Heterodera glycines
  Coding regions on vcDNA: vcDNA=SeqID_60440; Strand=-; Position=1 -41,237-453
MVCIRPNLFFLIKSYIFFGFTVKRLMYESISAYDSDGLARNNGEIKKNAKHSYGVGDTVGIGVNSATRQIFFTKNGIRLGWQINK

SEQ ID NO: 134018 - protein, 174 aa, Heterodera glycines
  Coding regions on vcDNA: vcDNA=SeqID_60441; Strand=+; Position=1 -129,194-589
MNSQQRQAERAQLRARLNLLVDEVDIVVQGLINNYQADGLINGAPHEGQLMGMDHGQGLQHEQQQQQQPWELDPPMPAQQLEIGPQLPDAWELVPYQPTPQWDQVAHVEQQPQQQQHYHHQQQQQQQQQGAWDEEWEGPLSPNALAQIQDEADGLRQDLSKDFGSGSLHKTKIK

SEQ ID NO: 134019 - protein, 217 aa, Heterodera glycines
  misc_feature (2)..(2): Xaa can be any naturally occurring amino acid
  Coding regions on vcDNA: vcDNA=SeqID_60442; Strand=-; Position=1 -45,206-295,396-489,640-833,1282-1347,1397-1501
  Homolog annotation: Hit_ID=NP_496316.1; Match level="QueryCoverage =75%, HitCoverage=7%, E-value=6e-67, Identity=75%"; Hit description =PDZ domain protein (2L48) [Caenorhabditis elegans]
FXKAKKKRVIGGLSPVLGTVVIHEVYPDGAAAIDARLKPGDQVLEVNGTSLRGTAHEQAISLLRRTPAKVRLLIYRDVNLQMSMLDPAQIYNILAIELTKKSGKGLGVSIVGRKNEPGVYISEIVKGGVADNDGRLMQGDQILEVNGQNVANCLQEDVATLLKTCTGRVVLKVGRWKLNETATCTGRVVLKVGRWKLNETAQKVRSAQPPNGTNAVA

SEQ ID NO: 134020 - protein, 376 aa, Heterodera glycines
  Coding regions on vcDNA: vcDNA=SeqID_60443; Strand=-; Position=1-1131
  Homolog annotation: Hit_ID=AAS38911.1; Match level="QueryCoverage =94%, HitCoverage=93%, E-value=3e-16, Identity=22%"; Hit description =similar to Leishmania major. Ppg3 [Dictyostelium discoideum]
MFAFSTFSSLSWPFSPPILLLFSLLTLQNSLSVDALFGWGDKSESAEQSDTSLSINLALNHQHSSVSQSDEDETQENAEQPAVQQQQQQQQYGSGGYGSYSSGGYGSGSWSNSAGTGTASASSSAQQQQSGSQPSKESDDDSEETIPYGDDMITGGDAGADQSVDGQQTVISSGSEIIYSSNMNTSDVTNYASGSYDNSSNNYDSSSNGTGGNNAIPQQPLISPNSGSISSSKSNYNYSSVSSSVQIDYSSSQNGGGGTNYLEEQHNSDYSASSNSNQNGDNAADQQNQQQQSQEYTNYLNSIRTALNQTNGQTQQRQARARLAACVHAISVLLWQGYDQLLQNNGTSCRKNGDTGNSGGEQANDGSSSCTVKSRN

SEQ ID NO: 134021 - protein, 263 aa, Heterodera glycines
  Coding regions on vcDNA: vcDNA=SeqID_60444; Strand=+; Position=1-792
MKILFVLFLYFAILTIFFHRFSAANETNEHISTAVDADAEIEKLSKKHVTFADPIETEIKGRVTLAELIKKERDGESTALISQEGPSAADDADQLIKKDERIREKQWLIKGSEMENAAEKRDEKAIAEQVEKTHNSLSLTQEESADLLKTERKPMINGSLAENPNPNNGTIFADVIEEMEAKRALKRNALVKLIEMEQKGVHQTDPAPMPKAEDGIRESSTTDVADRIVEEQKKAADGPKAPIAKQTLAELLEMERSSQEEAI

SEQ ID NO: 134022 - protein, 149 aa, Heterodera glycines
  Coding regions on vcDNA: vcDNA=SeqID_60445; Strand=-; Position=1 -126,1343-1511,2024-2175
MASSADAFPNGAVAIECELQLLAKQIDETLTTAQQKEATTAKDNVLLLRQKCQKLEQNLAECKEFLNRMAMEDDFRTNTNRTIIVVEDKENVPEVVQKAADQTDGNNASDIIFVDDVIRNKWVAKIGQKSVKNEPTEVVELDDQPSEAE

SEQ ID NO: 134023 - protein, 107 aa, Heterodera glycines
  Coding regions on vcDNA: vcDNA=SeqID_60446; Strand=-; Position=1 -156,214-322,415-473
MRLDSDESDIAWFLGSVIHLLAFQTYPLEEWHSRNKTLADQCQLDGTFKMPQTSNHFVCFCSKTASTKCYFLLKSSKFVLIFLMVSRKKCSPRRFGKENFLTEMDNC

SEQ ID NO: 134024 - protein, 94 aa, Heterodera glycines
  Coding regions on vcDNA: vcDNA=SeqID_60447; Strand=-; Position=1-285
  Homolog annotation: Hit_ID=AAM22073.1; Match level="QueryCoverage =94%, HitCoverage=55%, E-value=6e-11, Identity=44%"; Hit description =retinitis pigmentosa GTPase regulator [Canis familiaris]
MAEERREKVEGQRGKPRGENGEKENEKDEMEKEKREKEMEEGKREGGEGKGKGREMEMEEGKRETEEERKEKEIREEMEEGKRDGEEREEIFVF

SEQ ID NO: 134025 - protein, 122 aa, Heterodera glycines
  Coding regions on vcDNA: vcDNA=SeqID_60448; Strand=-; Position=1 -276,445-537
MLHKATRMVVLEYFESFFGQWDKKQAQPWMDEYEVRSVRRQAEKIKAGKAGGTVELIAAAKKFNMNVLVYKTDKDMWLCMSPKTAHKWDLDKNCQSKDAMTIALELYDNENYDVIMDVQQKK

SEQ ID NO: 134026 - protein, 58 aa, Heterodera glycines
  Coding regions on vcDNA: vcDNA=SeqID_60449; Strand=+; Position=1 -13,661-755,809-877
MNLCDDPQALQKQWKSIRDKYIKEKKRRKGGTTTMMDHSESTTNGTRNFNGKMDKKYS

SEQ ID NO: 134027 - protein, 18 aa, Heterodera glycines
  Coding regions on vcDNA: vcDNA=SeqID_60450; Strand=+; Position=1-56
YREAIPEGFGLPINLGAS

SEQ ID NO: 134028 - protein, 37 aa, Heterodera glycines
  Coding regions on vcDNA: vcDNA=SeqID_60451; Strand=-; Position=1-111
MSDSSIRRLSILSILPTDMSRSHHHKGAKMDGRIVVL

SEQ ID NO: 134029 - protein, 38 aa, Heterodera glycines
  Coding regions on vcDNA: vcDNA=SeqID_60452; Strand=-; Position=1 -85,290-321
MATPLVGGWFVNAQQKKVVTGYLTPCNHGTLNIILPIY

SEQ ID NO: 134030 - protein, 174 aa, Heterodera glycines
  Coding regions on vcDNA: vcDNA=SeqID_60453; Strand=+; Position=1 -106,418-836
MVIKSGMGWKKMHFERKFTPHFCTAVGFTCHVLIGGLLNENVRANAICVKLESGESIPLYTRIEYRQANDRLLNILRRYNEYLPDDYNLIIVRNAKLKLCTKLHCTNCPLYELNIVRTAYCTNSIVRTAFVRTANCTTAYCTNSIVRTAFVRTAQCTNCHDPEFKTASFNLFYD

SEQ ID NO: 134031 - protein, 34 aa, Heterodera glycines
  Coding regions on vcDNA: vcDNA=SeqID_60454; Strand=-; Position=1-102
MSKMGRMESDTDPNTVTILRKHQAPQRVLKSDAA

SEQ ID NO: 134032 - protein, 96 aa, Heterodera glycines
  Coding regions on vcDNA: vcDNA=SeqID_60455; Strand=+; Position=1-288
  Homolog annotation: Hit_ID=NP_490744.1; Match level="QueryCoverage =100%, HitCoverage=13%, E-value=2e-37, Identity=69%"; Hit description= long chain fatty acid Coenzyme A ligase and a putative endoplasmic reticulum membrane protein, the two g
ITIEGDPVPGHVGVPVPCCAVKLIDVPELNYFAKDGAGEVCIKGPNVFRGYYKMAEQTAETLDIDGWLHTGDIGRWTEQGTLKIVDRKKHIFKLAQ

SEQ ID NO: 134033 - protein, 264 aa, Heterodera glycines
  Coding regions on vcDNA: vcDNA=SeqID_60456; Strand=-; Position=1-792
  Homolog annotation: Hit_ID=XP_146481.3; Match level="QueryCoverage =72%, HitCoverage=14%, E-value=1e-16, Identity=33%"; Hit description =PREDICTED: similar to carboxylesterase 2; carboxylesterase ML3; acylcarnitine hydrolase M1 [Mus musculus]
MAQSFGDIGQFGINYANDGTVLRNIPIITTVSLDGIPKINGIIQRRQEDEGEEEHQLSIDESLQMVESTFILEDAEEEEEEEEIPDIDVEVEEEVMLTKLYKGAPNAEIETIEEEEEPMDEEESGREREKEERWKRVGMEEEQRDGRETERVEDGEGKEEKRRWNREITDEKVEERWKRLGMEEEQRDGRETERERGEEEEEEREIGVGIELVKEKEESAEVLLDVTEGTAQKQQQRIVLIVPDNQMPKQPVAMPLPEENASKT

SEQ ID NO: 134034 - protein, 73 aa, Heterodera glycines
  Coding regions on vcDNA: vcDNA=SeqID_60457; Strand=+; Position=1 -57,103-267
MLNVVEGQTEEEPTYEIKQLEVNCGSVAGTSLDRRAAQLNHVMLKKVGFHAAPEDLPENWPDRAQIESIKMAW

SEQ ID NO: 134035 - protein, 81 aa, Heterodera glycines
  Coding regions on vcDNA: vcDNA=SeqID_60458; Strand=-; Position=1 -130,222-337
MLPNFLSLCSVFAVFLLLFTAQFPPKVRGMICGAKALKYQRMEGFSLTSSPRWRLSRPKSMSTDTLKSPKIFTPERSESNL

SEQ ID NO: 134036 - protein, 215 aa, Heterodera glycines
  Coding regions on vcDNA: vcDNA=SeqID_60459; Strand=+; Position=1 -53,304-769,917-1045
MALVKNGTVRIPFLMKTRIKFPIILKRMFGKHSKQLLFGMLTVMVTVMLNVSSMNNDDDNNNNYHPYYYYNNYGYGNDSNFPGNNNWYNANAYTDNWYSVNDGDDDTSGYGSTTSGNYGFETNSYSSSTLGGNYDYGNSSESSSAPALTKKKKELQQIFRGNVQIRETDSDGLCFEVYCGTSNPTDGIFTDHYGNFEETLHKEQIKALKKMQIWN

SEQ ID NO: 134037 - protein, 88 aa, Heterodera glycines
  Coding regions on vcDNA: vcDNA=SeqID_60460; Strand=+; Position=1 -61,300-505
MGAQSASLAYGNGTLFAALGAGTPGSATDRAYGLRPLRHFLHSSTPSGGPSLTKTEPTSASACSFFFYMMKAISEIFFGWVHMEERDL

SEQ ID NO: 134038 - protein, 380 aa, Heterodera glycines
  Coding regions on vcDNA: vcDNA=SeqID_60461; Strand=-; Position=1 -985,1056-1213
  Homolog annotation: Hit_ID=AAA93301.1; Match level="QueryCoverage =81%, HitCoverage=82%, E-value=9e-51, Identity=37%"; Hit description =HASI
MVPLLNEARKTNSSIKRRDVEEYLAEQPSYTMHRQAIRRFKRLPTLASGLHTDWQADLAVFDRLAPQNKGFRYLLVCVDTLSRQLFVEPVKSKKSEDMVHAFDRLFAHSKYIPWKLVTDQGLEFTAKRMQTYFDSKNVKHFCMYTSPQFHAGIAERANRTIKERLFRYFTARQTQRWLDVIQDIVNGINHSYNSSIQMRPVDVTFRNADTLREKLANEAAMSRPKRLPRFHVGDLVRIEKHKHVFQKGYVGRFTSEIFKVDSADEGRSPVTYRIRDADNELIKGRFYASDLCRVRKNTHQDGEKLYDIEKVLRKKKKDGVEYAYVKWKGKNDKTKKCPPFRQILFMLLFPRTRTLKGTGRTLSVCDYHEKYNLIRNGMWA

SEQ ID NO: 134039 - protein, 40 aa, Heterodera glycines; identical to SEQ ID NO: 126546
  Coding regions on vcDNA: vcDNA=SeqID_60462; Strand=-; Position=1-181

SEQ ID NO: 134040 - protein, 123 aa, Heterodera glycines
  Coding regions on vcDNA: vcDNA=SeqID_60463; Strand=+; Position=1-372
MRLMSIREAVESGLFDVTSGELINPISGRHYPVQRAVQMRLVQTTPERAQQLEDALAQAQQQHAHIVQPLQKRPSGQFSPSSISLGSGGGGGVIAGPAGGAEHGYSSYSQRRSSYGVGDGYPS

SEQ ID NO: 134041 - protein, 92 aa, Heterodera glycines
  Coding regions on vcDNA: vcDNA=SeqID_60464; Strand=-; Position=1 -100,329-507
MYFGSGGDPELKKCVICGNLVQLADKMMIDRVTLHNKCFNCGYCGNPLKPGECAMEVHSFGRRWYCSGPAGSCAMLPTAQKEARRKTQAAKQ

SEQ ID NO: 134042 - protein, 102 aa, Heterodera glycines
  Coding regions on vcDNA: vcDNA=SeqID_60465; Strand=-; Position=1 -148,206-366
MKRKEFIQRSDELKRMFEIGKQKQFVKELGIGKEMFRKLKREFGIEMRKSGNRFSNEEKMSKMTIYYQMKKANPSLLDKEIAELLEISERTLRNWKNKNQNL

SEQ ID NO: 134043 - protein, 138 aa, Heterodera glycines
  Coding regions on vcDNA: vcDNA=SeqID_60466; Strand=+; Position=1-414
MLADQQKMVQDQSQQIAQLIAIRQNAPNAAAQPNQGANSVPILPDISPFEPTDDKSRISEWIERFKFALDCTAPTADDEVKVKCLMNKLSESAFSEYSRSVLPSSVTDFSFKVTTEKLEKLFAKAQSIFIDRYECLKA

SEQ ID NO: 134044 - protein, 987 aa, Heterodera glycines
  Coding regions on vcDNA: vcDNA=SeqID_60467; Strand=+; Position=1 -334,395-1345,1406-2770,2801-2992
  Homolog annotation: Hit_ID=XP_318550.1; Match level="QueryCoverage =99%, HitCoverage=99%, E-value=0.0, Identity=42%"; Hit description =ENSANGP00000020240 [Anopheles gambiae]
LKTAVLFNKKPVEFHLDTGSDIVVIDQLTHEYVGRPPIEKCNEIGKAFDGTKISFIGKGFGTFKFGKIEVEQTFFVAKAGSLNLLSCKMMDLFGLLDELKLKISNPAVNACPEVEIQGLEKAFHEIFEVEIQGLEKAFHEIFSEELGHCLKEKAHLALKDDARPVYRKARPVPYNSLEVVESELSRLEKMNVINKVEHLEWAAPILIVKKADGSARLCIDYSTGLNDALLDCQYPLPIPEDIFATLNGGKIFSQIDLRDAYFQVELDENSKNLCGLATHKGNYRMERLPFGVKSAPAIFQSIMDKMLAGLEFATAYLDDIIIVSKSIPEHTNHLKEVFGRIQAYGFRVKLAKCKFFRDQIKYLGQIIDKNGRRPDPAKIYAISQMPAPNDIPSLRSFLGMVNHYQQYVKNMRFIRKPLDDLLKKEIDWSWSEGCENAFRKIKETDASELGIGAVIYHKFQDGDASELGIGAVIYHKFQDGNIKAIAHASKSLAPAEKNYSQIEKEGLALIFAVQKFHKMIYGRHFTLQTDHKPLVSIFGSKKGIRQCSANRLLRWSLILLAYDFTIEYINTKDFGPADALSRLIAKGNETEDEKIIAMINAETDFETNFGQTISKLPLKFSDLVAASERDENIIQVQKFVKKGWPNEKAMDKENQIVRDLCRRKEELSTEKGCLMYGERVVIPKVFHSKILKLLHKGHPGMKRMKQLARQYVFWPKIDQDIEDFVRECVPCQAAAKAPIKTNLQSWPKTSGPWQRVHLDFAGPFFGKHFLIVVDSFSKYPEVFEMSTISTAMTIEKLRYLASRHGIPETLVSDNGTQFKSTEFAKFTAANGINHLFSAPYNPMSNGQAERFVDTFKRAFRKLKEGMSSVKEIIETFLVTYRTTPTDSKSPAEMLLGRKPRTTLDLLKPPPIKKFNRRFGTRPQIKKFNRRFGTRPQIFASKDAVWARHRLSQNWKAGTICGCSGVIYNVRFEDGSGRYHANQLRFRK

SEQ ID NO: 134045 - protein, 35 aa, Heterodera glycines
  Coding regions on vcDNA: vcDNA=SeqID_60468; Strand=+; Position=1 -49,533-591
MKSGAALAPLLARHPLENLRNLNKIIAQLTLCELK

SEQ ID NO: 134046 - protein, 178 aa, Heterodera glycines
  Coding regions on vcDNA: vcDNA=SeqID_60469; Strand=+; Position=1 -68,137-239,281-445,498-695
  Homolog annotation: Hit_ID=NP_493387.1; Match level="QueryCoverage =100%, HitCoverage=68%, E-value=5e-79, Identity=80%"; Hit description= protein YR-29 (29.7 kD) (1O220) [Caenorhabditis elegans] emb|CAB04941.1| Hypothetical protein W09C5.1 [C
PQNEHIELHRKRHGRKLDHEERTRKKLARAVHDRSKVAKKLRKGKAKLYHKKRYAEKVQMRKLIKQHEEKKQKGTTDTQTEGAVPAYLLDRQKETAGKALSTAIKQKRKEKAAKYQVPLPKVRAVSDAEAFKVVNTGKTRRKGWKRMVTKVTFVGETFTRKPAKFERFIRPMGLRFKK

SEQ ID NO: 134047 - protein, 59 aa, Heterodera glycines
  Coding regions on vcDNA: vcDNA=SeqID_60470; Strand=-; Position=1 -60,800-918
  Homolog annotation: Hit_ID=CAE61287.1; Match level="QueryCoverage =94%, HitCoverage=7%, E-value=8e-15, Identity=67%"; Hit description =Hypothetical protein CBG05109 [Caenorhabditis briggsae]
MVMEDIHEVGKKAGLFTFEQAKDIHLYAELFTVENDLLTPTMKSKRPQLMAHFKDELCK

SEQ ID NO: 134048 - protein, 29 aa, Heterodera glycines
  Coding regions on vcDNA: vcDNA=SeqID_60471; Strand=-; Position=1-89
MSHLIGLKNDGQQMSFLAVWPQMSGHAMI

SEQ ID NO: 134049 - protein, 62 aa, Heterodera glycines
  Coding regions on vcDNA: vcDNA=SeqID_60472; Strand=-; Position=1 -148,188-228
MAKLITVNSAKGKFCDGYCYHKHKMTKNKTWWKCELYQQGCKGWGFESNDQILLQIEREQQI

SEQ ID NO: 134050 - protein, 353 aa, Heterodera glycines
  misc_feature (102)..(102): Xaa can be any naturally occurring amino acid
  misc_feature (107)..(107): Xaa can be any naturally occurring amino acid
  Coding regions on vcDNA: vcDNA=SeqID_60473; Strand=-; Position=1 -89,136-210,395-578,756-793,834-1068,1566-1743,1801-1931
  Homolog annotation: Hit_ID=CAE60135.1; Match level="QueryCoverage =97%, HitCoverage=92%, E-value=1e-61, Identity=45%"; Hit description =Hypothetical protein CBG03681 [Caenorhabditis briggsae]
HIKEACVLTRLVASSVRLSEAVVGIIKALMNSGDLQIVNKDQTGLMNSGDLQIVNKDQTGLMEDLQTEADRSAQLCIERSLREKFGKNLTIVGEEVNECRLXSLFGXLPFLQEIELPSTPFEPLEALPPSHHLVVWVDPLDGTSESQMAKINKFQALLRHVTVLIGITYTSESQMAKINKFQALLRHVTVLIGITYKGRPVAGIVHQPFYNGEQSRTVWSIVGVGTFGLKKTAQQNMNFPKGKAAFICLVVQKALDALEEKKLISEVERAGGAGFKVLRCLEGATAFVYAAGDTKKWDIAAPEALLMAAGGGTLSDMSGRQIRYETSVQLANSGGLLATASGVDHQVSGRKRK

SEQ ID NO: 134051 - protein, 55 aa, Heterodera glycines
  Coding regions on vcDNA: vcDNA=SeqID_60474; Strand=-; Position=1 -27,185-325
MNAKKCLTTCGDCTMKIKKNEDLAIKNFLVEIELKPSEPDFGSGKSRVPEHPKET

SEQ ID NO: 134052 - protein, 142 aa, Heterodera glycines
  Coding regions on vcDNA: vcDNA=SeqID_60475; Strand=+; Position=1 -133,408-528,635-718,3533-3623
MNRARSDPELNANFPQRTNDLFGGRVYCIGSLRRLTNVIFLIDTGSPFCLIAAQFIREHNLAIVNTNITFSLGGVGGVSLRTLGRAEGVEMRIGRTRFSSDLDCVRDESYHVLKTQSIMTYWMTCTRRSLPLSRIRQCVALC

SEQ ID NO: 134053 - protein, 61 aa, Heterodera glycines
  Coding regions on vcDNA: vcDNA=SeqID_60476; Strand=-; Position=1-186
RNQPGQPLSAAGARQQTKHHLGQCKLRLGPADRDPVVARQRHLQANTNAGAGDGSNDQKAI

SEQ ID NO: 134054 - protein, 118 aa, Heterodera glycines
  Coding regions on vcDNA: vcDNA=SeqID_60477; Strand=-; Position=1 -48,114-422
  Homolog annotation: Hit_ID=AAO85453.1; Match level="QueryCoverage =94%, HitCoverage=95%, E-value=3e-27, Identity=55%"; Hit description =putative gland protein G16A01 [Heterodera glycines]
MTSPFKVGAAAFGAGMCFAKTYMEKPKSEDDKEAPKKEEATTGGDAEEKAKKKDKKGDGAAAADKKEEKRKDKHKSKEGKSDDSNRRSKKDKHGKKDAAEPAANAGEQSTAETTQADE

SEQ ID NO: 134055 - protein, 80 aa, Heterodera glycines
  Coding regions on vcDNA: vcDNA=SeqID_60478; Strand=-; Position=1 -40,158-282,544-621
MTDQKNENRKQQREFVLRHKLAERTKKRTRYGLNSIKKMLIGGGKLAEKFSNEFQDFYLTSINLEKVPTYASLNREFHPL

SEQ ID NO: 134056 - protein, 16 aa, Heterodera glycines
  Coding regions on vcDNA: vcDNA=SeqID_60479; Strand=-; Position=1-49
EAIPEGFGLPINLGAS

SEQ ID NO: 134057 - protein, 29 aa, Heterodera glycines
  Coding regions on vcDNA: vcDNA=SeqID_60480; Strand=+; Position=1-88
MNNGIQFGLMDQNNLVDFWDTYQTTNLRG

SEQ ID NO: 134058 - protein, 590 aa, Heterodera glycines
  Coding regions on vcDNA: vcDNA=SeqID_60481; Strand=+; Position=1 -72,130-392,432-656,732-893,942-1130,1171-1309,1654-1972,2045 -2177,2247-2295
  Homolog annotation: Hit_ID=NP_504523.1; Match level="QueryCoverage =97%, HitCoverage=30%, E-value=1e-163, Identity=50%"; Hit description= CHromoDomain protein, helicase Mi-2 like; chromatin remodeling protein, LEThal LET-418, abnormal Eversio
MIYRFVTRNSVRRITSVAKKKMMLHLVRAGMQKGPSMLHLVRAGMQKGPSMSKTELDDVLRWGTEELFKEEEANELGKSSEHNIVWDDRAVDALLERGAEEEGEEANERKDWANEYLSSFKVATYTTTVATYTTTKEEEQEEEEDEVLKEEVQETDPDYWEKLLRHHFEQEQEVERMNLGKGKRVRKQVNYATEALQQDWHADQDYSDDQDYSDSYSGASDHDGSGSNEDEFDSAREERRRKRERDSEKLPPLLARVNGQLEVLGFNPRQRRAFFNAVVLGFNPRQRRAFFNAVMRWGMPPHDAYQCQWLVRDLKGKSERAFKAYTSLFMRHLCEPGADSQECFNDGVPREGINRVQVLTRECFNDGVPREGINRVQVLTRIGIMSLIRKKVQEFEAINGEWSMPEVKVEMIDAATELTGSETDRPSSKVGEEKDKEETSEEKQQLEETAEEPLHQQQQPHREPRPLFKFNIADGGFTELHSLWVNEERVAVPGNEYEIWHRRHDYWLMCGIVTHGYSRHGYSRYNEIQNDPRFAIVNEPFKSEQGGNFMEIKNKFIQRRYKLLEQALIIEEQLLLEQALIIEEQLRRAA

SEQ ID NO: 134059 - protein, 160 aa, Heterodera glycines
  Coding regions on vcDNA: vcDNA=SeqID_60482; Strand=-; Position=1 -110,401-517,895-952,1037-1161,1375-1416
  Homolog annotation: Hit_ID=CAE63782.1; Match level="QueryCoverage =95%, HitCoverage=38%, E-value=5e-53, Identity=66%"; Hit description =Hypothetical protein CBG08323 [Caenorhabditis briggsae]
SSIFKVLNEEEQLGMRLAAKLGREVLDEAARAIEPGVTTDEIDRVVHEACIERECYPSPLGYYKFPKSCCTSVNEVICHGIPDKRALINGDICDVDVTVFHRGFHDVTVFHRGFHGDLNETFLVGDAVSEENLKLITVGFPPMDQITFILKNSEKKWQIF

SEQ ID NO: 134060 - protein, 128 aa, Heterodera glycines
  Coding regions on vcDNA: vcDNA=SeqID_60483; Strand=+; Position=1 -255,618-746
  Homolog annotation: Hit_ID=NP_505661.1; Match level="QueryCoverage =64%, HitCoverage=11%, E-value=3e-21, Identity=61%"; Hit description =step II splicing factor (74.5 kD) (5K834) [Caenorhabditis elegans] emb|CAA94899.1| Hypothetical protein K
MSNLPVSSLIRQQHGGGLGEEDGIESGKRKSKDEYRRQKDLEEQRKAGTAPAMVDVETGRDINPHIPEFIEKTPWYVPSSGPTLKPSLEMGYDAKRDRWNGYNAEDYSLVAAEFEKMEETRKLIRAEQ

SEQ ID NO: 134061 - protein, 114 aa, Heterodera glycines
  Coding regions on vcDNA: vcDNA=SeqID_60484; Strand=-; Position=1 -75,159-428
  Homolog annotation: Hit_ID=XP_453837.1; Match level="QueryCoverage =42%, HitCoverage=59%, E-value=3e-13, Identity=75%"; Hit description =unnamed protein product [Kluyveromyces lactis] emb|CAH00933.1| unnamed protein product [Kluyveromyces lac
MGPLGAQTFNAWVQSQATLASYPFRLSWGKLRREPATRCLDYPFAPIPKSDDRFARQNRFGLPPEFPLASSCSGIVHHLSGLSAYALSPPHRMRSRRDYVAPQHRSARDHTSAP

SEQ ID NO: 134062 - protein, 66 aa, Heterodera glycines
  Coding regions on vcDNA: vcDNA=SeqID_60485; Strand=-; Position=1 -39,102-263
MEESGDELGTDKQSVSRDRDDDNIAQQQDSTNPISQNMVSPKKRWTSALRVVTAMARFRNMPRVGN

SEQ ID NO: 134063 - protein, 299 aa, Heterodera glycines
  Coding regions on vcDNA: vcDNA=SeqID_60486; Strand=-; Position=1 -130,174-940
MILSKIAETLAPSKKSLGKSEQGEAVSAAEAAPAVRQQKEQKKEDEMPKKYEDKYEKVKKLGNEAKEVARSAGHSAKEAASRVGSSLKNAFTEKDHQQRNGQNDNNNQKGTEGQNGIEERQKQSKSDQKNGERSDQRMGSDQRMGSDQRMGDNVIKGWEVIRETEHKVIKGWGVIRETEHKVIKGWGVIRETEHKVIKGWGVIRETEHKVIKGWGVIRETEHKVIKGWGVIRETEHKVIKGWGVIRETEHNVIKGWEVIKGWEVIRETEHKVIKGWGVIRETEHKVIKGWGVIRETEHK

SEQ ID NO: 134064 - protein, 116 aa, Heterodera glycines
  Coding regions on vcDNA: vcDNA=SeqID_60487; Strand=+; Position=1-351
MYEISADPTDKGVKKRVISTDNGQFKWNIWNAVRDLDTNAKITVLLCLDDEYRVYGQFADYDAMEDEMGERFHEVFQVVYNNYPIYEIDETVPIEHDVPIEYEDEGHSTCTIQKSV

SEQ ID NO: 134065 - protein, 82 aa, Heterodera glycines
  Coding regions on vcDNA: vcDNA=SeqID_60488; Strand=+; Position=1-246
MIGRAVRNRPFIFEGIFKFILYPRKMAISFFEKFYTSQKRLRMRRRAVHNRHFISQRIFIFRGYPRKMAISFFDKFYTHTNA

SEQ ID NO: 134066 - protein, 92 aa, Heterodera glycines; identical to SEQ ID NO: 125147
  Coding regions on vcDNA: vcDNA=SeqID_60489; Strand=+; Position=1-304

SEQ ID NO: 134067 - protein, 187 aa, Heterodera glycines
  Coding regions on vcDNA: vcDNA=SeqID_60490; Strand=+; Position=1 -150,816-944,1729-2013
  Homolog annotation: Hit_ID=CAE50173.1; Match level="QueryCoverage =49%, HitCoverage=20%, E-value=2e-10, Identity=39%"; Hit description =novel protein [Danio rerio]
MHLNRRDSTHQNSIHWIQLSAFQSLELNPLSFQSPGSNRPAFQSLGLNSPVGQHDAPKYETVPKLMEDFVRDVNHHLHRMDAPELAARAHFELAYIHPYMDGNGRVCRLVANWILSKGRFRMFELPEIARDEYNAGLDLAVRGRREGHATGLDANINRSGEHDWPRPFILLIYFHVQNAQQENVTFD

SEQ ID NO: 134068 - protein, 29 aa, Heterodera glycines
  Coding regions on vcDNA: vcDNA=SeqID_60491; Strand=+; Position=1 -23,915-981
MPNEKQKLSIHRGVFFVVAFLGNGQNRSK

SEQ ID NO: 134069 - protein, 132 aa, Heterodera glycines
  Coding regions on vcDNA: vcDNA=SeqID_60492; Strand=-; Position=1 -232,480-646
  Homolog annotation: Hit_ID=XP_497599.1; Match level="QueryCoverage =95%, HitCoverage=76%, E-value=3e-11, Identity=40%"; Hit description =PREDICTED: similar to Hypothetical protein CBG22491 [Homo sapiens]
MNLLITVVPLLIKFVLLLFTVQPLLIIVPPLLITVEPLLITAVPFLITVVPLLIIVVPLLITFVPLLITVVPLLINHITFAPLLIIFVTLLISVVPLLISVVPLIIAVVSLLFIVVPLLITVAPLLITVYLF

SEQ ID NO: 134070 - protein, 53 aa, Heterodera glycines
  Coding regions on vcDNA: vcDNA=SeqID_60493; Strand=-; Position=1-351
LFSKYFLSFFSAGTASDNIFYLFRKINFFFFLIYFNYISFLNFLINIFKLSPY

SEQ ID NO: 134071 - protein, 152 aa, Heterodera glycines
  Coding regions on vcDNA: vcDNA=SeqID_60494; Strand=-; Position=1 -228,382-612
MCYVPATTTAQRRTDASTAVRSPHERASHIGAANQPSEAARHRHIATQQPYTGFHMCSTERYTTAPTYGSTPKAWLQQVHLQLPCYDFCPVQATAIKSVPVCIPTEAGTLTVPEFLEMAQSRAATGGVYKGQGRIQSELMTRPYKEFLVHGQ

SEQ ID NO: 134072 - protein, 29 aa, Heterodera glycines
  Coding regions on vcDNA: vcDNA=SeqID_60495; Strand=+; Position=1-88
MVVSFPVLRAVTSGVFVLAATSVAVMRRR

SEQ ID NO: 134073 - protein, 68 aa, Heterodera glycines
  Coding regions on vcDNA: vcDNA=SeqID_60496; Strand=+; Position=1-207
IIERADWTASDFCGQLFTDCPPNSDEMQQILSSFELANKLNGSAANRDEENGGGNDGGGGGGTGNLLE

SEQ ID NO: 134074 - protein, 77 aa, Heterodera glycines
  Coding regions on vcDNA: vcDNA=SeqID_60497; Strand=+; Position=1-232
NYLRVFSSWDYSQKSWLFIFDQFNSQNHNHFHFSYHLLCRSLPPQCFSFFLCLFHCCLRLKATRKQMYTYMFTIRHG

SEQ ID NO: 134075 - protein, 131 aa, Heterodera glycines
  Coding regions on vcDNA: vcDNA=SeqID_60498; Strand=-; Position=1 -264,311-443
  Homolog annotation: Hit_ID=EAA45732.2; Match level="QueryCoverage =65%, HitCoverage=16%, E-value=1e-10, Identity=41%"; Hit description =ENSANGP00000025171 [Anopheles gambiae str. PEST]
SSITPSTLSGEPAPAVGTKIEAQLALYKDVERVGIDADIFLWWKENGLRFPELAKIAQIVHSIPATSVSSERLFSKAGLIYANSLRNKLSGKTVRQMLVVKANMDDVKLAPPIEPDPIDLIDYENEMINDD

SEQ ID NO: 134076 - protein, 84 aa, Heterodera glycines
  Coding regions on vcDNA: vcDNA=SeqID_60499; Strand=+; Position=1 -211,261-304
MKVLPPSLSPPPYRQFDLQQPYRWPAAAELQQQPEQTQFSSNFGPLRQQQQQQQQQQQQLNQRQQMKSGIGFYKNILFSSKFIN

SEQ ID NO: 134077 - protein, 233 aa, Heterodera glycines
  Coding regions on vcDNA: vcDNA=SeqID_60500; Strand=-; Position=1 -144,362-919
MELEQSFELPVYPDDESLSPANSLPTDTVPFGPDVDEVPELGPNPHDQNCEEAINDYWQRYREGKEYRERKKEEKMKKTGQRKRKVSGMATAAGEKEQKEEKKEDEKKGAEEELQQQLPINAGTEGTNEGKAEVGEETDGAETTEEAKKEMGSAPGEMVEDGTEGREDVCKKGNSESADVGLEVEQLKKMLRDSGQMATDNAPLPLPRWVKGCGAFKRKYKKIYDNMIKINNS

SEQ ID NO: 134078 - protein, 152 aa, Heterodera glycines
  Coding regions on vcDNA: vcDNA=SeqID_60501; Strand=-; Position=1 -343,497-612
MDVTLPVSNSAGEWIGEERRDGVVLYAPWTDEWHVQQQQQQQQHQQQQHQQQQQQQQQQFVRRTGTGWTRFPAWNEPLVANDWREKEENLIQRKRLQRENPEYWAQILEEEKRAVCCWGREDSGWKFWRRALVNDVCMGLKVLRLTMIGDGI

SEQ ID NO: 134079 - protein, 150 aa, Heterodera glycines
  Coding regions on vcDNA: vcDNA=SeqID_60502; Strand=-; Position=1 -343,497-604
MDVTLPVSNSVGEWIGEERGDGSVVLYAPWTDVWHVQQQQHQQHQQQQQQNEVQQQQQQLVRRTGTGWTRFPAWNEPLVANDWREKEENLIQRKRLQRENPVYWARILEEEKRAVCCWGREDSGWKFWRRALVNDVGMGLKVLRLTMIGD

SEQ ID NO: 134080 - protein, 262 aa, Heterodera glycines
  Coding regions on vcDNA: vcDNA=SeqID_60503; Strand=+; Position=1 -418,459-826
  Homolog annotation: Hit_ID=NP_507780.1; Match level="QueryCoverage =85%, HitCoverage=15%, E-value=8e-28, Identity=32%"; Hit description =predicted CDS, DNA polymerase type B, organellar and viral family member (5T899) [Caenorhabditis elegans]
MSEFVDWILGFKRFETVAFAHYGGRFDSHFVLKELTERGVETELMMADLKIYQMKARGVYFRDFWLLSQNKLADLPKTLGFKTLAKLYFPHKYNKNVNFGKKLTHLPPLEDYCPDNMKEEECAKLVKWHNENYRMEFELGEQLKVYCENDVEILMEAILKFRQLFLEITDGMDVLKDSVTIAGVVMRIFRTKFLRENHLPIIPEGGYERAENQSKIAVKYFEWLAQSKRVRLRHACNGGEVEIGGLKVDCIIGAEKKIIEFQ

SEQ ID NO: 134081 - protein, 46 aa, Heterodera glycines; identical to SEQ ID NO: 129884
  Coding regions on vcDNA: vcDNA=SeqID_60504; Strand=-; Position=1-357

SEQ ID NO: 134082 - protein, 53 aa, Heterodera glycines; identical to SEQ ID NO: 126996
  Coding regions on vcDNA: vcDNA=SeqID_60505; Strand=-; Position=1-351

SEQ ID NO: 134083 - protein, 36 aa, Heterodera glycines
  misc_feature (13)..(13): Xaa can be any naturally occurring amino acid
  Coding regions on vcDNA: vcDNA=SeqID_60506; Strand=-; Position=1-292
NKSKRKKINLFFXINKKHLSEAVPAEKKTKNFSKKS

SEQ ID NO: 134084 - protein, 152 aa, Heterodera glycines
  Coding regions on vcDNA: vcDNA=SeqID_60507; Strand=-; Position=1 -82,649-1025
MILPTRLFFLLFQFLLVISTLSETQPKLPSWAQIDEMYSKLFGLPIKKEQQTVDELTEANVPKELDQNLIFEIEASVFANEIEEILKNASIKSLTEEQNKILEKKRKNFKEFFGVAEEKRRPTMSRVCELWKFGRQIGDEFGGIKTFFTSFF

SEQ ID NO: 134085 - protein, 131 aa, Heterodera glycines
  Coding regions on vcDNA: vcDNA=SeqID_60508; Strand=+; Position=1 -70,119-444
MLGPALFNIRFPLVQKMEFSEKIVPFGVLTMEEVIGIEKYHSPPNFRGMSNGILYPLQFPCHGRISPRGTILVHIDKLSEFAGESVGSRRYSIIEPIMGFGWRIVAQIRINIKTKEKFLGFCLFSLVPKGG

SEQ ID NO: 134086 - protein, 121 aa, Heterodera glycines
  Coding regions on vcDNA: vcDNA=SeqID_60509; Strand=-; Position=1 -258,307-414
MSIKNDVENCSSFILQHVTGHFSKNNVEWWYDLKKRIFVQTLPEKMTKIGKIINLEFVIKAYTCEIEGGLNAKMTFITDFLLKDEMTFKSVMPIKICHSHKLNGEASNLEQLTDHVIHIVI

SEQ ID NO: 134087 - protein, 78 aa, Heterodera glycines
  Coding regions on vcDNA: vcDNA=SeqID_60510; Strand=-; Position=1-234
MRSLLFLAFVALFVVKCSADESMQNDENDEQSPPGPPPSNEMSEESNDRRKRSPFFNFFGGFKKGGRGGRPKGEKPNG

SEQ ID NO: 134088 - protein, 104 aa, Heterodera glycines
  Coding regions on vcDNA: vcDNA=SeqID_60511; Strand=+; Position=1-315
MRRRSIRSGIASGEISRVSPFLNDIVHVNKLGHEEMMNSSKFSSAASVRSANVPRQRMRSRSAGRQSIARLIPASKPNVHIHKPAIPASRPNVQIHKPAPKEHI

SEQ ID NO: 134089 - protein, 523 aa, Heterodera glycines
  misc_feature (522)..(522): Xaa can be any naturally occurring amino acid
  Coding regions on vcDNA: vcDNA=SeqID_60512; Strand=+; Position=1 -94,1290-2766
  Homolog annotation: Hit_ID=NP_499726.1; Match level="QueryCoverage =98%, HitCoverage=22%, E-value=1e-72, Identity=32%"; Hit description =predicted CDS, RNase H integrase-like protein family member (3O318) [Caenorhabditis elegans] pir||T26836
STTNSNISYSKIQPGPYSTAGFNPKIALSVLFLCPPHTLSIPSNFGLCYGRLRSVLNTVSKKHPFLEKYNEIFSEQLKLGIIEKVDNPSKFSHPLHYLPHHAVINEQKGKLRIVYDGSAKIGPGLALNNCLHPGPVILPQLIGLLIRFRFPQIAIIADIEKAFLQISIHPQHRDCTRFLWLKDSSQPLSQQNIQIFRFGRVPFGLSCSPFLLAATIQHHLSLSPSPLSNEILNNIYVDNILLNASTSSEGQSKCSDAISLFQCASLNLREFTSNSPETLAHLSHDQKLTGPNQKFLGIKWVTDTDSLIYCLSPPPPNFLLTKRSVLAFVSSFYDPTGLISPVLLSHKLFLQSLWHEKIGWDDILPKNCEESWSKLFTHWSPNSEISIPRFISFLNVKDNKHYQLHCFSDASNNAMSVTVFMRISHCSQENAKSHLIFSKTKIKPLPKRSPALLTIPRLELIAALLGTRALKFVFSQLSEFDLDPILNLWVDSSAVIGWLHSPPERDIFVKNRISPIHSTKNXL

SEQ ID NO: 134090 - protein, 133 aa, Heterodera glycines
  Coding regions on vcDNA: vcDNA=SeqID_60513; Strand=-; Position=1 -287,371-485
MQNEAVLLNGSDKGGASFEFDDGSASSDTTDANDDEFVVPNSTDESDETCCDTFFEFNEAHTSSRKQNKGKAKRREKTVKGVKDDGEEANYMERIKATLLTTPMTSKHCPMTAAFQIPFGTDFTGHKRNESRQ

SEQ ID NO: 134091 - protein, 117 aa, Heterodera glycines
  Coding regions on vcDNA: vcDNA=SeqID_60514; Strand=-; Position=1 -103,159-237,457-509,706-824
  Homolog annotation: Hit_ID=CAE71783.1; Match level="QueryCoverage =83%, HitCoverage=18%, E-value=6e-13, Identity=36%"; Hit description =Hypothetical protein CBG18786 [Caenorhabditis briggsae]
GAIAQLMLSNSTTFVKDCCWLISNVLAGNTSQIQDVIDAQLLPILLSVLQKGEHRLQNEADFEYARISPFGAAHCCTNQIYSNVFKIIEEFFSEDENEGLEMKGDVQPQNQAIQQKP

SEQ ID NO: 134092 - protein, 135 aa, Heterodera glycines
  Coding regions on vcDNA: vcDNA=SeqID_60515; Strand=+; Position=1 -16,335-523,614-816
MKRENGLLTRNFSNEQKKEIIHRFEIIKEEFMRKFKIKTNAKISDKIARKVGVNLETINRWKRSFGSTAKPIYTSAEQLEFIRKYDALKIQNPLISDQNTAQMIGTNAISIKRWKKKFGIAYPCKRDGSRELIGQ

SEQ ID NO: 134093 - protein, 173 aa, Heterodera glycines
  Coding regions on vcDNA: vcDNA=SeqID_60516; Strand=-; Position=1 -127,174-296,745-818,871-1003
  Homolog annotation: Hit_ID=NP_501769.1; Match level="QueryCoverage =91%, HitCoverage=39%, E-value=5e-39, Identity=49%"; Hit description =putative protein family member, with at least 6 transmembrane domains, of bilaterial origin (4K621) [Caen
ENYNKMDNASGTDLLIGYLSLFVSCLSFGFLFVPLKRCDTKDGLFVQWVQLFVQWVQCAVVFMAGLIINIARGLPPFNLIAAIGGFLYATGNVASVPIIAEMGIGLGMFIWGSFQIIVGWSVAKFGLFGIIVGWSVAKFGLFGTKPQQIKSPLINYLGVLITLISGVMFVFVY

SEQ ID NO: 134094 - protein, 32 aa, Heterodera glycines; identical to SEQ ID NO: 127531
  Coding regions on vcDNA: vcDNA=SeqID_60517; Strand=+; Position=1-247

SEQ ID NO: 134095 - protein, 161 aa, Heterodera glycines
  Coding regions on vcDNA: vcDNA=SeqID_60518; Strand=-; Position=1-486
  Homolog annotation: Hit_ID=NP_701428.1; Match level="QueryCoverage =71%, HitCoverage=4%, E-value=6e-12, Identity=38%"; Hit description =hypothetical protein PFL0315c [Plasmodium falciparum 3D7] gb|AAN36152.1| hypothetical protein PFL0315c [Pl
MLNLDPKERMTAKGVVDYLDGKCKPKYYEKTAEKVAMFGNVSVEELRKLTETEGFTEGFNAFLKGPEKEWKNEMEKKEANEKKHEEQIKKMEQQKALKEKEKKKTEKEKKKMEKKKEEAIENLKEKALMKKKNIKEHLANALKSIAGLLEELKQRSAICED

SEQ ID NO: 134096 - protein, 170 aa, Heterodera glycines
  Coding regions on vcDNA: vcDNA=SeqID_60519; Strand=-; Position=1 -280,325-557
  Homolog annotation: Hit_ID=EAL30522.1; Match level="QueryCoverage =94%, HitCoverage=14%, E-value=4e-44, Identity=53%"; Hit description =GA19253-PA [Drosophila pseudoobscura]
KYAAKQAHVELAERMRKRDPGSAPRLGDRVPYVIVNRGGGANTPAYEKAEDPIFVLQNNIPIDFDYYLEHQLVKPLARILDPVMGDQAEKLLISGEHTKKKARTKLKSGMMAGYFSKKSVCLGCKTRMDFEEEAAPATCEQCRPRIDKIYLEQARRPISFVFVIPFALNS

SEQ ID NO: 134097 - protein, 207 aa, Heterodera glycines
  misc_feature (1)..(1): Xaa can be any naturally occurring amino acid
  Coding regions on vcDNA: vcDNA=SeqID_60520; Strand=-; Position=1 -115,495-573,655-875,935-1083
  Homolog annotation: Hit_ID=NP_510362.1; Match level="QueryCoverage =99%, HitCoverage=48%, E-value=4e-77, Identity=71%"; Hit description =isocitrate dehydrogenase (41.6 kD) (XO790) [Caenorhabditis elegans] emb|CAB02822.1| Hypothetical protein
XGVIECLKIMTREKCERVAKFAFDYATKHGRKKVTAVHKANIMKLGDGLFLNVCTETSKLYPKIQFEQMIIQFEQMIIDNCCMQLVAHPEQFDVMVMPNLYGNIVDNLAAGLVGGAGVVNGESVGSDYVIFEPGSRHTYKEAFGRQIANPTAMILCCAQIANPTAMILCCANMLNHLHLDQYGSALRESVEKVIRDGKVRTRDLGGV

SEQ ID NO: 134098 - protein, 143 aa, Heterodera glycines
  Coding regions on vcDNA: vcDNA=SeqID_60521; Strand=+; Position=1-432
MSDKIPHNDALDLARQIAPDLTNNLFDDVSEANQILNSIPKDELQKLNPEQKWMKLFEADLPHLYKLVSIVLSVPVSNASVERVFSLCGSQWTDVRNSLKVETVKALLQTKINFDLTCPEMYQMLISNHKLLDQIGGWDKYFE

SEQ ID NO: 134099 - protein, 23 aa, Heterodera glycines
  Coding regions on vcDNA: vcDNA=SeqID_60522; Strand=-; Position=1-71
NFTIMVSFESHRCLEDIYNRFLS

SEQ ID NO: 134100 - protein, 334 aa, Heterodera glycines
  misc_feature (29)..(29): Xaa can be any naturally occurring amino acid
  Coding regions on vcDNA: vcDNA=SeqID_60523; Strand=-; Position=1 -983,3374-3400
  Homolog annotation: Hit_ID=NP_502915.1; Match level="QueryCoverage =99%, HitCoverage=38%, E-value=6e-41, Identity=31%"; Hit description =predicted CDS, integrase, catalytic domain containing protein family member (4Q923) [Caenorhabditis elega
IERDIYVDNIILGLERAEEIKSYYSLLKXIFSNADMNVREFVSNCTKEIERLPSEDQVVKGGVKLLGIKWDINNDTLVIHFPVFKSEKLTRRKVLAQIAKPFDPNGFAAPAILPAKLFRQRVETNKKLKWDTSLSNEELNEWITLMKDWENQSITVPRNIIPKEMIKNCQCELHAFSDASHKAMGTAIYLRVINPNQINANLIFGKSLVVPAIIPSKYRTIPILELHAMLLTSKWLNYVKGQIEKSLKIETVQLWTDSTDVLDFLNSNRKLERYIKNRVEKMRQWNVHIEGQSNPADVASRGTSPEDLELWWKGPPFISLKNTQWPSSSLSWGI

SEQ ID NO: 134101 - protein, 371 aa, Heterodera glycines
  Coding regions on vcDNA: vcDNA=SeqID_60524; Strand=-; Position=1 -937,1007-1185
MKILLIFLLLCALIFKKAINQIEAGKIIQEKSFAEIFGQRWDDGAEENICQNDQIIHGEIADQNNQFGQNVRQFDQIFDENVKVKEEESEEMSTDYDELGDQLPMPTNNGQSCDNFSNAIDKKKRETVEKFHNIKEKVKQMGKKYSRKEWVKIERKIAKKLGVSQEKIYKWKREFGMMKNKNYSVEEKRIMLKQFDQIYGKLKTKFNEKLEGKRTKCQKIIAKHLGIHIKTIFYWKKQLKVGKMVKKQKTDDEKREIVEKYFKTKIKFMQNEKHSLKEWKEFNAKIKQMFGIYYRTIEKWDKKIGLNQILSKGQKHYTFAEKTEKIKQYYQLKNQNPKLNDRQIAEILNITKRSLERYKSEFKRKSEGVTD

SEQ ID NO: 134102 - protein, 119 aa, Heterodera glycines
  Coding regions on vcDNA: vcDNA=SeqID_60525; Strand=-; Position=1-360
MWDVFVREMWPIFAPNIRHLFFSNAYHLDNFRRLISPTILTDLNPSMCSGDLFPDGIADDGPNATAGQSLSKWLHTPTKDGKPKRLTCYDYPSKSSEWVNTFKEASPHIGTKLFGLIAI

SEQ ID NO: 134103 - protein, 43 aa, Heterodera glycines
  Coding regions on vcDNA: vcDNA=SeqID_60526; Strand=-; Position=1 -126,650-655
MEEKKKKRRQRMRRKGEKFERSVEKGNVWRCVDGGHLVVCPSY

SEQ ID NO: 134104 - protein, 39 aa, Heterodera glycines
  Coding regions on vcDNA: vcDNA=SeqID_60527; Strand=-; Position=1 -64,660-715
MVVLNQIFAVFVVSFLSAFFNGKSYGNIQKDFYKFQSFL

SEQ ID NO: 134105 - protein, 366 aa, Heterodera glycines
  Coding regions on vcDNA: vcDNA=SeqID_60528; Strand=+; Position=1 -86,174-378,425-474,530-725,881-978,1041-1213,1258-1344,1408-1464
  Homolog annotation: Hit_ID=XP_419506.1; Match level="QueryCoverage =99%, HitCoverage=16%, E-value=3e-52, Identity=36%"; Hit description =PREDICTED: similar to FLJ00002 protein [Gallus gallus]
LAMQMSKIGSDIWLSRWASAVSPLPNGSDFPLFSRPIQKMVPSTNAQQEETNFYLFVYIGIAALNTICTLIRAFLYAFGCILAAKQMHERILHRILNATLTWWDRTPCATLTWWDRTPCGRVTNRLSTDVNRVDDALPFQLLSTDVNRVDDALPFQLNILLASLFPLVSSLLVTVVALPLLSPFVLLLTVAYFFLQAHSLPSNHSHRRIAALSLSPLYSHLAETVSGLVSIRAFRITHRFSSLMFSSLMCHRLEGNVRALFSQLACYQWLAVRTQMLGVAIVSVVAFASVFDVHFFHLADPGLIGLSITYALSFTLIGLSITYALSFTALFNGALNTFVETEKELVSLVSVERICDYLANVPEEIA

SEQ ID NO: 134106 - protein, 175 aa, Heterodera glycines
  Coding regions on vcDNA: vcDNA=SeqID_60529; Strand=-; Position=1 -90,338-775
  Homolog annotation: Hit_ID=NP_493361.1; Match level="QueryCoverage =98%, HitCoverage=43%, E-value=1e-16, Identity=31%"; Hit description =putative protein, with a transmembrane domain, a coiled coil domain (51.7 kD) (1O13) [Caenorhabditis eleg
MPSKKTSCTGEFCFRAFIKSKLGHLNAYRTTNDTEAIERAKESRQNGERKAGKMRPKNGRERVKGKGTREKEEREKTKEEDETEGEEAKDKGHKGVREQGEDGGSRRRELQEDEEGEEETAEKEETEQEEEAQEEMENGRGDSETKQQQQHVIFERPTLAPAVTESNNTAWVFFY

SEQ ID NO: 134107 - protein, 70 aa, Heterodera glycines
  Coding regions on vcDNA: vcDNA=SeqID_60530; Strand=-; Position=1 -46,219-320,920-984
MERIEMWKVIAYAKHRYENRPFNLTVLMDGEITDDEKANTWTDACSSTFVELCEYDSERETAHFPMEWSN

SEQ ID NO: 134108 - protein, 242 aa, Heterodera glycines
  Coding regions on vcDNA: vcDNA=SeqID_60531; Strand=-; Position=1 -100,221-269,324-466,709-747,798-915,965-1045,1162-1276
  Homolog annotation: Hit_ID=CAC70163.1; Match level="QueryCoverage =100%, HitCoverage=77%, E-value=2e-50, Identity=47%"; Hit description= conserved hypothetical protein [Brugia malayi]
LSSIVFLFAFACTVWNFREHYNAFYLLNSINLMVCIYAVKSSRIRSLRLLTFLMLLLTFLMLAMFIYDLFMVFGTTLLTTDGCSVMMEVKTGISTEKTSIRHPIAPIDLKEVPEKIPLLFYVPMIPLLFYVPMFADPMGRCFDVEVEREYRRVMLGLGDVIIPGYLIAFCFYVDVVKYLIAFCFYVDVVKRSRFYAYGSISIIGYSLGMFATFVALLLMETGQPALLYLVPFTLGPIFAWAL

SEQ ID NO: 134109 - protein, 84 aa, Heterodera glycines
  Coding regions on vcDNA: vcDNA=SeqID_60532; Strand=+; Position=1 -69,940-1125
MAFETNELDGNQTLYWSAHSAAQKQRENHFCVGRRWQLTAVPLLEIDTEIGASGGQTFATDIQKSEAGVVFVESGGWTLKILGI

SEQ ID NO: 134110 - protein, 148 aa, Heterodera glycines
  Coding regions on vcDNA: vcDNA=SeqID_60533; Strand=-; Position=1 -48,90-207,314-461,520-650
MSVFFVYNDTFRQEIEPLLLNSSSTELRFYRPQTAWPMDPAVGVLWLFAVGSILVGSLWAAFESKAMLAKRVPLDVSVSDGLGSSRAALSDEDQPAQPNEPTNKGPLKRTQSAEIAQMNVCQHLSVVLVALVFIVIVLTLAYFFRKFA

SEQ ID NO: 134111 - protein, 53 aa, Heterodera glycines
  Coding regions on vcDNA: vcDNA=SeqID_60534; Strand=-; Position=1 -21,126-263
MLGKIPTELCDQLLATEDALLVQAYDKDSFFAAGMVENGVREWAKENEGKVLK

SEQ ID NO: 134112 - protein, 19 aa, Heterodera glycines
  Coding regions on vcDNA: vcDNA=SeqID_60535; Strand=-; Position=1 -29,418-448
MSIKWFYLVYRELRNPMTN

SEQ ID NO: 134113 - protein, 46 aa, Heterodera glycines
  Coding regions on vcDNA: vcDNA=SeqID_60536; Strand=+; Position=1-139
MERYKRQQQRQQQQQQAKVSQVLEHCCFPIPTDNLAEETTNALRGH

SEQ ID NO: 134114 - protein, 84 aa, Heterodera glycines
  Coding regions on vcDNA: vcDNA=SeqID_60537; Strand=-; Position=1 -94,529-689
MMDATIILKKNAPSSTSNSEKQKGGICLWSEVWTFEQKQCKMAFGRDNDAEIHDVITDLGLQVEGYAEKLKDYENMEDSSMAVA

SEQ ID NO: 134115 - protein, 120 aa, Heterodera glycines
  Coding regions on vcDNA: vcDNA=SeqID_60538; Strand=+; Position=1-362
  Homolog annotation: Hit_ID=NP_701782.1; Match level="QueryCoverage =82%, HitCoverage=12%, E-value=2e-22, Identity=48%"; Hit description =hypothetical protein PFL2110c [Plasmodium falciparum 3D7] gb|AAN36506.1| hypothetical protein PFL2110c [P
MGDKKSKYGIEIKNFFKWCFSGRGSESGRGTESGSETKVEEEQKVEEKQKVEEEQKVEEEQKVKEKVEEEQKVEEEQKVEEEQKVEEKQKVEEKVEEEQKVEEDQKVEEKQKVEEEQKVE

SEQ ID NO: 134116 - protein, 134 aa, Heterodera glycines
  Coding regions on vcDNA: vcDNA=SeqID_60539; Strand=+; Position=1 -136,395-663
MSEFLIFLLGFSFAMLLMLCLLVSLVLFVLYTTWYYWTKEEQQEECIFYALEFAKLYQTVGREISRDKFRHIMKTGKKQHELALVLMEKAGINTQQKTFGLKHLQFVQNWDKEFPDIFRIVAFDMVNEHFQNCL

SEQ ID NO: 134117 - protein, 393 aa, Heterodera glycines
  Coding regions on vcDNA: vcDNA=SeqID_60540; Strand=+; Position=1 -215,587-674,1117-1309,1535-1792,1842-2174,2401-2495
MSEEGEGSWVDIYSFMGAEGTEERHGTTLWNIYELAKIQSAKLDGMINEAMWAEHEENWRNKTEKNGQKKKGNERVLIEGAGPIGLFCAVHLFLAGANVTLSFGRINTLDGEVGQQNVKDIEQILKMRLVELTSFVESKIGPEQPNRLKLLYQTELKGIKRDGPMEEKVENAKEIYAARRAAALHQQKQADQSDLPSQKQADQEDHNAAVEQVRLEKWEGKVPELRHLAPIPFDILFCAGGANDRIRNKLLGNPIRRSISKNYGLVVFHKGSPNEKDGIMEQRVFDHLTGFFKVKMSDFEPILQKQNFDKFVTNHGNILPKEFIKKYENLTQLIVRGLVKENEGKYEEDEIHKPHTKHIYKQQSANTSHRFDNAAGGGGICSGHKARVAAIGK

SEQ ID NO: 134118 - protein, 23 aa, Heterodera glycines
  Coding regions on vcDNA: vcDNA=SeqID_60541; Strand=+; Position=1-70
LGPRFWAPGSFGPNPKIEKCAFL

SEQ ID NO: 134119 - protein, 144 aa, Heterodera glycines
  Coding regions on vcDNA: vcDNA=SeqID_60542; Strand=+; Position=1 -184,646-896
MRSGKIVSRKCVSGNFIVTKTESLAFSRSLTTIQYPFWPLPNPGPEFEQKVESPNFRFSIFGRLGVEWSAYALRDYHQGKITEKELIERMSKKLNSIEQRVVKKVREYVTIEDKEGEKTDKASTILDKDEDKVYKAIYHAKKTQ

SEQ ID NO: 134120 - protein, 96 aa, Heterodera glycines
  Coding regions on vcDNA: vcDNA=SeqID_60543; Strand=+; Position=1 -65,136-236,353-405,450-521
  Homolog annotation: Hit_ID=CAE62112.1; Match level="QueryCoverage =88%, HitCoverage=7%, E-value=4e-30, Identity=70%"; Hit description =Hypothetical protein CBG06150 [Caenorhabditis briggsae]
EAKGHDSDAAVSAVQNEYGNNRVEMEVPKFVELFIERATAPFFVFQVFCVGLWCLEDMWYFSLLTLFMLVTFEATIVKQQLKNMSEIRLDLFAIFL

SEQ ID NO: 134121 - protein, 40 aa, Heterodera glycines
  Coding regions on vcDNA: vcDNA=SeqID_60544; Strand=+; Position=1 -11,391-502
MNRRYTDHSVITASYIIRLLSTEIDPVELMNRMDQRNADI

SEQ ID NO: 134122 - protein, 58 aa, Heterodera glycines
  Coding regions on vcDNA: vcDNA=SeqID_60545; Strand=-; Position=1-321
FGPRGRLGPNPKIGKCAFLKIKNLKTKPEGSLATWHKLGLINTRSFFTILLIPNPIIF

SEQ ID NO: 134123 - protein, 104 aa, Heterodera glycines
  Coding regions on vcDNA: vcDNA=SeqID_60546; Strand=+; Position=1-315
MRSSESRAKGGGECSEGTVECGSGGGGKQLGPLRRSTTWGRKSRTLTNWQRTNCSRRTPWAARRTNWRAWGKRRRWTAKWLFDGQLRQIGQMANGKNGTNDTKI

SEQ ID NO: 134124 - protein, 28 aa, Heterodera glycines
  Coding regions on vcDNA: vcDNA=SeqID_60547; Strand=-; Position=1 -53,674-707
MPCNFTPTFPFGQFNILQATELKRFMFL

SEQ ID NO: 134125 - protein, 120 aa, Heterodera glycines
  Coding regions on vcDNA: vcDNA=SeqID_60548; Strand=+; Position=1 -112,259-445,545-610
PLIVKEEPIDEQFRLADLEKEIQALAKRLSLLFRIENDVFVLMLPTEEGDHWLSRLLMLRDDNSSIRLAEFTGSSEAFAEKAEHWLKSDFEGPQQLMEALNAKCVEYFQQQKMAQDEDNL

SEQ ID NO: 134126 - protein, 50 aa, Heterodera glycines
  Coding regions on vcDNA: vcDNA=SeqID_60549; Strand=-; Position=1 -90,758-820
MPCHLHTVGGGTTAHLHATLAQTMGNTIAALGAPVIGIFVGIASISKLLL

SEQ ID NO: 134127 - protein, 80 aa, Heterodera glycines
  Coding regions on vcDNA: vcDNA=SeqID_60550; Strand=+; Position=1 -78,143-307
MAAWVFLVPNSWLIMGLWQKSREKSWALNGRNRACQFPSKTKVELIFGIVNVLKLTTELSIRVERDREFWAKPGLGLAGI

SEQ ID NO: 134128 - protein, 48 aa, Heterodera glycines
  Coding regions on vcDNA: vcDNA=SeqID_60551; Strand=-; Position=1 -73,216-289
MNQIKLCSLTEKGDSGGPLLRTLNDFFNKVSVFCEWINRATRGEVSCK

SEQ ID NO: 134129 - protein, 33 aa, Heterodera glycines
  Coding regions on vcDNA: vcDNA=SeqID_60552; Strand=-; Position=1 -52,264-313
MIYVLIYGNDSHVNSRAFIIHVSNRYFKHLDPN

SEQ ID NO: 134130 - protein, 21 aa, Heterodera glycines
  Coding regions on vcDNA: vcDNA=SeqID_60553; Strand=-; Position=1 -54,589-600
MRTRPIWQVKQRLLTSQKKGF

SEQ ID NO: 134131 - protein, 95 aa, Heterodera glycines
  Coding regions on vcDNA: vcDNA=SeqID_60554; Strand=+; Position=1-588
LFQYPKRTLEKIDFFVFGAVPPNRCAQIYGETESFGNSFPIACTLILRWIFAPHNCLSTPNGHLKKSIFLFSGQSPRTDAPRFMGRPNPSGIASL

SEQ ID NO: 134132 - protein, 39 aa, Heterodera glycines
  Coding regions on vcDNA: vcDNA=SeqID_60555; Strand=+; Position=1 -73,695-741
MALAHQLAEFAVAPLALALLKNGKEIFPRKYTKNGFPNN

SEQ ID NO: 134133 - protein, 67 aa, Heterodera glycines
  Coding regions on vcDNA: vcDNA=SeqID_60556; Strand=+; Position=1-204
  Homolog annotation: Hit_ID=NP_702767.1; Match level="QueryCoverage =88%, HitCoverage=5%, E-value=1e-10, Identity=50%"; Hit description =hypothetical protein [Plasmodium falciparum 3D7] emb|CAB62887.1| hypothetical protein [Plasmodium falcipar
VDSADREKRQDNRADREKRQDNRADREKRQDNRADREKRQDNRADREKRQDNRADREKRQDNRAIMY

SEQ ID NO: 134134 - protein, 844 aa, Heterodera glycines
  Coding regions on vcDNA: vcDNA=SeqID_60557; Strand=+; Position=1 -1411,1621-2744
  Homolog annotation: Hit_ID=NP_502797.1; Match level="QueryCoverage =42%, HitCoverage=99%, E-value=4e-56, Identity=35%"; Hit description =HASI (4P602) [Caenorhabditis elegans] emb|CAB16520.1| Hypothetical protein Y57G11C.19 [Caenorhabditis ele
MANKFVLVPQEIYRGLTSATDTGDINLDAVRHDLTRARAERTNPSAKNVSYNQQLRRYLQMRREVTDKPARVELVKGLSVLMRRGGADDEAEVVDTPPRPPRPPPPPPPPGQHPPRRPPSPPGPGPSPPGSPPPRPQRPPRPPRAAAPPSRRDGRVEEWRKKRNDIQQRQPVVRDLLAEAAAAPLPESDEEDDYMLESGFALPAPSQYYGDLPVLPDNADAIEEMDTAQHRIATRRKLKKADDDDGDDDLHRKKYRVYYPPPPSRPPPSRPQPKIETPRPPPRPSLKKEPQPLLDPRPSTSQQVDRKHKREPKFDLDPRPSTSRQAGYNPPAEPKHEQKPSKKPPPRATPYHIPKREPKIEETLPRQQPSPAAPQVPPVPPPRRGTKRRHPPENGDESGELRIRKRVRQARRVRVYYSPEPGPSTSAQSDEQQQQQQQQQQRELFAIPSNQLTMAQRIELIYIKCNRYADQHKQQDVNKEGISSEKMEMINTTLDKLYNDPSSPAAFAGVSALWKEARKKLKNLRKKDVQHYLEGHRTYTLMRPRRVRFPRAKTVAAGFMTDVQVDLADFQALSRHNRGHRYLLVAVDVLSKRLFVVPLKNKKAEEMLDAFKELVKQMPMVPHRIFSDKGTEFKNKLLKEFFEEQEIEKHEPVHSSVKASVAERAIRNVKQRLYRYFAERETLNWVDVVQQIVDGINSTPSRVHGMRPIDVNFENAQKVWKRIYESPQKRKKPRFRKDEFVRMSREKGQFEKGYLPNYGDEILEIDEVLKAVRPIRYKLRDDRGEKFRGTFYDQELARVRKDADTSYRIEKVYRKRRKPDGTTEMLVKFIGYPEREWIDESQIV

SEQ ID NO: 134135 - protein, 172 aa, Heterodera glycines
  Coding regions on vcDNA: vcDNA=SeqID_60558; Strand=+; Position=1-516
MSNSFFVFLPSNVTDYPDNQPNKFRVRLPKPLHFNGSWVCGLHSISYPYSWSTIGTLDEQWIDIHFTDIGVPEEDKHRIVRVPVPRSSHNRVEQLRDFVATTLRNHANAKLKPLPREEEADRNRTKPLYSPPPAKRSIKDVNDLSLFPSPPRVNEPEKPPKSPPAHVPPTEP

SEQ ID NO: 134136 - protein, 606 aa, Heterodera glycines
  Coding regions on vcDNA: vcDNA=SeqID_60559; Strand=+; Position=1-1821
  Homolog annotation: Hit_ID=CAA84230.1; Match level="QueryCoverage =57%, HitCoverage=67%, E-value=4e-39, Identity=33%"; Hit description =extensin-like protein [Zea mays] pir||S49915 extensin-like protein - maize prf||2111476A extensin-like dom
MSNSFFVFLPSNVTDYPDNQPNKFRVRLPKPLHFNGSWVCGLHSISYPYSWSTIGTLDEQWIDIHFTDIGVPEEDKHRIVRVPVPRSSQNRVEQLRDFLTTTLRNHANAKLKPLPREEEADRNRTKPLYSPPPAKRARRSLALSSPPRHEEAPARPLESPPLYDEPKLQKAQKTPEKPAKTAPATPILLDSPPLYDETKLQKPQKTPEKPAKTPAKPPSQAPPIPATPTAAVSKPSQPIAPVAPPTPTAKSVATPTPAKTVSPPPAKTPSPPPPAKMPSPPSPPPAKTASPPSPPPAKTASPPPPAKTASPPATTITTTTKPKTPPPLVKHSPPPTAAKQPSPVKTTPASKLKPAKTVPKPPPPPPKQKTPPKPSPILESPPRYEESNRTIVKPPVIQPSPPHLEEANKTITKQTTFNTTAKEVMPTEPVAAALTQLADLPENTFSFRINPLPVVPRSVSIQYLDDVERFKVSFNDRLIRHLSFSPQLGYVLGFENPQHVMSNEVAKYPVDLRGGISSFAVYSKGLTENMIVGNSLSSLLRVVSVSGATPGDYNEKIYDSPIFARVLPREINEIEIELRTMDKGRLVPFAYGTTLVVLLFKKVINF

SEQ ID NO: 134137 - protein, 69 aa, Heterodera glycines
  Coding regions on vcDNA: vcDNA=SeqID_60560; Strand=-; Position=1-227
NNANFFGIHVYRYGKNENKCALNSDVSADRSIFIQHHQRVALAHHHQHYSSSGHRLIKFDAHCCGPVPY

SEQ ID NO: 134138 - protein, 158 aa, Heterodera glycines
  Coding regions on vcDNA: vcDNA=SeqID_60561; Strand=-; Position=1 -195,242-474,747-795
KGVIALVDVMFEEKRTPKKKKVGRLLLQEELPQDLSRNELLHYLCYGRLGTNLFEIYFVMTQAINSIAIGNLFGLLLDFAMSSPTPWLMKRPICCGIFYRQHMPWILQQPMSVMLSHGIFPEVRSDGFEFFWLFNPHLKKYAGNDDTMTDGIFWAKLS

SEQ ID NO: 134139 - protein, 264 aa, Heterodera glycines
  Coding regions on vcDNA: vcDNA=SeqID_60562; Strand=+; Position=1-792
MDNHPRKRSSNFSIDHILSAPKRPRQGFLINELLGVVHFLGSFQQGEGTSKQAKDYVKKLDNSIEHVAKFHYVKVKSKFTITDLPSTPEALLAGIFQHCIDEAIADSRERNIEPTHLGCMISSPLLEGGDIPTPVRQMTNNTLDTILNQFKKVAQSKQQKNVSLWGEPFTVTITTLNRNGLPPKRRVKGGARRPVKTAVHHRINDQCLIKIRNNDNHFCLFYALQATMVDKTCNWPRWKFSRYLNNQYGQQGQLHRDAVELMKQ

SEQ ID NO: 134140 - protein, 60 aa, Heterodera glycines
  Coding regions on vcDNA: vcDNA=SeqID_60563; Strand=+; Position=1 -75,656-763
MVYELEQQLQIDNCCALKVQLSVALIFLSINHKKINAKQNVNRYRTHVEALTTKPQIYQK

SEQ ID NO: 134141 - protein, 33 aa, Heterodera glycines
  Coding regions on vcDNA: vcDNA=SeqID_60564; Strand=+; Position=1-100
MGTIDVIRRALLCIFWPTPEEILCRNSGPIHLK

SEQ ID NO: 134142 - protein, 99 aa, Heterodera glycines
  Coding regions on vcDNA: vcDNA=SeqID_60565; Strand=-; Position=1 -125,189-363
MPLFVLCNGFYSVQQNCDVFCTPDGLMPIKTFENSYYKQDSVAMGMGDKLFCKAIQPFVRLKLSNEEFVLIRAIIYSHMGQLRPKNIIINELKLIWIKF

SEQ ID NO: 134143 - protein, 66 aa, Heterodera glycines
  Coding regions on vcDNA: vcDNA=SeqID_60566; Strand=-; Position=1 -94,400-506
MPLKIAGCKHFFRRTISLMKEYNCKKGGECKERMKEHPGKNAVLNSVIRRDGEGQNSILNYILRGL

SEQ ID NO: 134144 - protein, 57 aa, Heterodera glycines
  Coding regions on vcDNA: vcDNA=SeqID_60567; Strand=-; Position=1 -103,389-459
MMDQQWACGTLRGKTQTTIYGVEIREFASKTGTKGLFSFFGDATLKNNFHYNCKNYR

SEQ ID NO: 134145 - protein, 65 aa, Heterodera glycines
  Coding regions on vcDNA: vcDNA=SeqID_60568; Strand=-; Position=1-196
IFLVKAKTTVDNKTIPDDFTIKLSTLFNYGDSVRLSVQPEHGARNQSNNNFMFIFMHESLEENGK

SEQ ID NO: 134146 - protein, 163 aa, Heterodera glycines
  Coding regions on vcDNA: vcDNA=SeqID_60569; Strand=-; Position=1 -228,403-575,629-719
MITICTSEEQWTNGKIEGTEGTEETFRKRVAEAVREEVVARMRAMDDLAELDYAEEVIRHYVERAAGDGPDALVNRVDVAEVAANSANPWAASQSVCADDLVFNPTPRGQSVEDKEQKDMRSFAEMVANFVTFGDPNREERRTDKNTFTTVYQREKANCEGAN

SEQ ID NO: 134147 - protein, 60 aa, Heterodera glycines
  Coding regions on vcDNA: vcDNA=SeqID_60570; Strand=+; Position=1-182
VDPRLYYALMITVIGSTFPLINVSMNTIFSAAVGPRLQAKQQSILMVSGGMGRMLGPLLI

SEQ ID NO: 134148 - protein, 160 aa, Heterodera glycines
  Coding regions on vcDNA: vcDNA=SeqID_60571; Strand=+; Position=1 -238,342-466,612-728
  Homolog annotation: Hit_ID=XP_422588.1; Match level="QueryCoverage =75%, HitCoverage=31%, E-value=4e-25, Identity=49%"; Hit description =PREDICTED: similar to presenilin associated, rhomboid-like [Gallus gallus]
MIAAVNDFEMTQKRFQSVIDQAIYEFRRTFSFTPPYKRKTEAAKLIWTIIGANVAIFLLWRVPTLVPLLWQYFSSGVASKSLCMPMLFSVFSHQNLMHLFFNMYVLNSFAIGAITLLGPSQFLAMYLSGGLFSSWVSLCQKAVMRSTMPSLGASGAICDV

SEQ ID NO: 134149 - protein, 17 aa, Heterodera glycines
  Coding regions on vcDNA: vcDNA=SeqID_60572; Strand=+; Position=1-52
CLKSPYSCNERSFSRNC

SEQ ID NO: 134150 - protein, 95 aa, Heterodera glycines; identical to SEQ ID NO: 128210
  Coding regions on vcDNA: vcDNA=SeqID_60573; Strand=-; Position=1-647

SEQ ID NO: 134151 - protein, 168 aa, Heterodera glycines
  Coding regions on vcDNA: vcDNA=SeqID_60574; Strand=-; Position=1 -49,158-615
MFRGPFTLILSGATGSGLIGEGVETFNGIPDMNKIKEQEKPLLLILDDLMLNMQNTFLDLLFTRGSHNWNVSVIFVTQSLYGRDIKTARANAHYLVLMRNPSGQLQVRTLGSQLFPKRLNYFMDAYHDATNNQFSYLMINMHPNSEEEFRLCSKIFPDETLEIYLPIE

SEQ ID NO: 134152 - protein, 137 aa, Heterodera glycines
  Coding regions on vcDNA: vcDNA=SeqID_60575; Strand=+; Position=1-414
  Homolog annotation: Hit_ID=EAL47145.1; Match level="QueryCoverage =96%, HitCoverage=62%, E-value=1e-14, Identity=34%"; Hit description =transcription initiation factor TFIID, putative [Entamoeba histolytica HM-1:IMSS]
MQKPIIVNIIALANLGTGIKLNSLTITECEFKYNPRKFNAAVIKCASPIKATALLWESGKMICLGTKSLIDCENAIKNFIEIIKGSGCPGASYTGHTVENIVSTFKFGREIELNEFRKNRRAFYEPEICCGLNFKTG

SEQ ID NO: 134153 - protein, 372 aa, Heterodera glycines
  Coding regions on vcDNA: vcDNA=SeqID_60576; Strand=+; Position=1 -79,124-199,253-296,346-419,469-516,599-696,750-834,914-1166,1300-1415
  Homolog annotation: Hit_ID=NP_499861.1; Match level="QueryCoverage =97%, HitCoverage=49%, E-value=1e-86, Identity=51%"; Hit description =tetradecanoyl Phorbol Acetate resistant TPA-1, TPA-1 (64.9 kD) (tpa -1) [Caenorhabditis elegans] gb|AAC269
GSSSTPWAKEGGIRRRRGAIKHAKVHEIRGHQFVATFFRQPTFCSLCSEFMHEIRGHQFVATFFRQPTFCSLCSEFMWGLNKQGYRCRLCTLAWGLNKQGYRCRLCTLAVHKKCHEKTLVHKKCHEKTLSQCPGSAKNSKETIYLKERFKIDYLKERFKIDVPHRFKQYNFKSLYNFKSLTFCDHCGSLLYGLFKQGMKCEVCGVNCHNRCERHMPNLCGVNHNRCERHMPNLCGVNQKQLSDALLEIKRGGRHNSSKCSTEWATSSKWASACRNNNKVPLPLRLFRPQTAGSLDIVGTEKDGAEEGAGGDSPRHFKLQNFAIHKVLGKGSFGKVLLVELKGRQQFFAMCLKKDVILEDDDTECTFIERRVL

SEQ ID NO: 134154 - protein, 220 aa, Heterodera glycines
  misc_feature (185)..(185): Xaa can be any naturally occurring amino acid
  Coding regions on vcDNA: vcDNA=SeqID_60577; Strand=-; Position=1 -140,519-556,668-854,976-1146,1330-1454
  Homolog annotation: Hit_ID=CAE58012.1; Match level="QueryCoverage =99%, HitCoverage=28%, E-value=7e-77, Identity=58%"; Hit description =Hypothetical protein CBG01082 [Caenorhabditis briggsae]
EVYCGPESVCSLDGLHFNTLYSARVRAFNGSGEGPYSELISLQTAPVAWFHLSPDDSSSLLLFSNDCCTVTGASIDYRTVLGTVTFSQGIHYWEASVDRYDGNADVVIGVAQPPVNRRAMLGKDAHGWSMYVDGQRSWFFHADTHHGRMSSGVIGCGSVIGVAMDCDRGTLSFAINGTRKLKNNXPYLYRNMPRGLFCPAFSVNSKATITVHSGLKLPEV

SEQ ID NO: 134155 - protein, 214 aa, Heterodera glycines
  Coding regions on vcDNA: vcDNA=SeqID_60578; Strand=-; Position=1 -66,1049-1144,1450-1683,1743-1926,2560-2629
  Homolog annotation: Hit_ID=NP_503395.1; Match level="QueryCoverage =98%, HitCoverage=27%, E-value=7e-36, Identity=41%"; Hit description =tripartite motif protein (83.7 kD) (5B704) [Caenorhabditis elegans] gb|AAC69216.2| Hypothetical protein C
LWVMRNGAHPRHTLFSAASSPLTELSQSLQMLSAKVRQATEDITALKQLQNEIDANCDAFSRGIEREMDELIALLQLRRQQLTDFAAGEKERRKAQLREQIGRSTAQLGRNRALIQFCIELLKESDPAAYLQGFALASRVTDQEFLWHREIRTKPEVEVQFEFDIDSAQLRTAIDQLEFIQLKGESLTTIFFFFHCSAPSAPQVADECSAENNS

SEQ ID NO: 134156 - protein, 102 aa, Heterodera glycines
  Coding regions on vcDNA: vcDNA=SeqID_60579; Strand=+; Position=1-309
MQQFGCLSLFPVGISAGLLIMPMLLLLLMPSSTDGIEIVVNVDENIANEINQQQITVKVRASRGTAAYLRKLADFWGKKPSEMAIFSLSTSPAPNFPNIFKI

SEQ ID NO: 134157 - protein, 138 aa, Heterodera glycines
  Coding regions on vcDNA: vcDNA=SeqID_60580; Strand=+; Position=1 -23,124-517
MKVTKLGSFVSIGFATKEMPLDGAIGQHLNSYGYRSDGSFGCNGISRPYKMGFGTMPMPFNAAIGQQRDRRYVGSANWPFPLEFVPVPMPSDGALAFQSPAFSTGDVVGCGVCLATRQIFLTKNGRRIGGPNTKRKSK

SEQ ID NO: 134158 - protein, 80 aa, Heterodera glycines
  Coding regions on vcDNA: vcDNA=SeqID_60581; Strand=+; Position=1-583
NCLSTPNGHLKNRFFCFGAVPPNRCAQIYGETESFENSFPIACTIILRWIFAPHKCLSTSNGHLKKSIFLFHKYFFQKVL

SEQ ID NO: 134159 - protein, 36 aa, Heterodera glycines
  Coding regions on vcDNA: vcDNA=SeqID_60582; Strand=+; Position=1-155
KPKLFGLFKKELKIFKIFIHLPFDRKSIREPYLTFN

SEQ ID NO: 134160 - protein, 39 aa, Heterodera glycines
  Coding regions on vcDNA: vcDNA=SeqID_60583; Strand=-; Position=1-134
GLDTTSAELSVLESIFKLGDAAPSAISTDLRDTLIESML

SEQ ID NO: 134161 - protein, 365 aa, Heterodera glycines
  Coding regions on vcDNA: vcDNA=SeqID_60584; Strand=+; Position=1 -113,171-446,906-985,1084-1711
  Homolog annotation: Hit_ID=AAQ96252.1; Match level="QueryCoverage =41%, HitCoverage=46%, E-value=3e-10, Identity=31%"; Hit description =LRRGT00039 [Rattus norvegicus]
MNVEESPLLTEFKTFLQATLVAFGSDGALFSLVNQKFSEDWVGSPSLKEYATKLGFAGSKGILKLLQSIPDQVIEQCVMVSNRCNNLHVIILKVSILVNPTGEVILKPVPMEETRDNLAKIDATNRELKAEKMRRQQFHGPLPAAVTAQLAAAMMPAPAKKKINPNLIPLEPTRIAQCDSTNNIVDNGNANKVTSGVSCSASKITNNANGNASKVPSGANKITNNANGNASKVPSASNRSPSKVTSGANKITNNANGNASKSGANGRANKVTNGANASAGKVPSASNRRPSKVTSGANIITNSTNGSAKIARNAGAIGTNGSTAVTRTTSATEQRQQNIKIRKVSFEKAMRYMEREAWKQAEKRS

SEQ ID NO: 134162 - protein, 28 aa, Heterodera glycines
  Coding regions on vcDNA: vcDNA=SeqID_60585; Strand=-; Position=1-86
VKINRNSRVHSIVARNSPEKLQNNVKLI

SEQ ID NO: 134163 - protein, 128 aa, Heterodera glycines
  Coding regions on vcDNA: vcDNA=SeqID_60586; Strand=-; Position=1 -106,160-282,588-746
PNIMLTLSNNGFFLNFFFIFVLIYATNYGYALFAVQNERRQLDSLDGLWTFVREPPNSVGIGLQNQWASLELALFEFVNGKLVTEHCGGHLPFQVEVELVDVNLISVAVNNTLSHDTIPPGDFATIKL

SEQ ID NO: 134164 - protein, 153 aa, Heterodera glycines
  Coding regions on vcDNA: vcDNA=SeqID_60587; Strand=-; Position=1-462
ANTGAPNIMGLDWIVPFEKATQSPIATTLDLSSAPTKVNTIDERPRHFKIGDTVRVLNYGKSGKPNWLEGKVVAGKGLIWKVKIPLLNITVNRHVNQMRSFVPYQSETTFPNDTVDQVPQQKSPCHSTVTTTPPTNLPVQPTQRPQRQRRPPI

SEQ ID NO: 134165 - protein, 75 aa, Heterodera glycines
  Coding regions on vcDNA: vcDNA=SeqID_60588; Strand=+; Position=1 -13,127-341
MTKNDIFSNKKAIWENELTFRLRMVVFLKNALNPNLMKTLIKDRIYEIFGAKNAEITHQLYDKYPSLTYGIGDLI

SEQ ID NO: 134166 - protein, 317 aa, Heterodera glycines
  Coding regions on vcDNA: vcDNA=SeqID_60589; Strand=+; Position=1-951
MDFFAYFHAIEVIFEQKEYPISEWPKLRIQCAQLIDTIPLEVNFTENDEIMKMINELNAKIGKMQSFLKENKNCMDEKQIEKTSNELEKKIELLKILKQISNEIDQLLARENQDEAQEEEGRKLYEKVKKIQSEFEEIELGDQQKQQHLLSDVEFGSEDSKEFEKDKTFGLGDQNGQNVEFSGSRPDQNKQTDNTDYDQYPSSSNEMRSNTAADRNQSYAKYGQFIPADQQIGSDAENKARSSKNCGTVPNPPFINLKTLFLLKADMEKLKSNDKKEKESKNKNKSKERKANSIDDLTAVQNDLSQMHVQTMAKVPM

SEQ ID NO: 134167 - protein, 65 aa, Heterodera glycines
  Coding regions on vcDNA: vcDNA=SeqID_60590; Strand=-; Position=1 -57,249-386
MVSMDHPNADFYFDRDVQCAYDEGNFEAHLAEDSEEETEDGSSRDETEEQQKEGDEEEKHEGEQM

SEQ ID NO: 134168 - protein, 41 aa, Heterodera glycines
  misc_feature (4)..(4): Xaa can be any naturally occurring amino acid
  Coding regions on vcDNA: vcDNA=SeqID_60591; Strand=+; Position=1-127
IVQXLLVLKKKIKKFTTFHQKFRKSEFRPPKMLEIGSLSVP

SEQ ID NO: 134169 - protein, 146 aa, Heterodera glycines
  Coding regions on vcDNA: vcDNA=SeqID_60592; Strand=-; Position=1-443
  Homolog annotation: Hit_ID=NP_702063.1; Match level="QueryCoverage =98%, HitCoverage=5%, E-value=6e-16, Identity=20%"; Hit description =hypothetical protein PF14_0175 [Plasmodium falciparum 3D7] gb|AAN36787.1| hypothetical protein [Plasmodium
STHQHFNHWGLNPPTFQSLGLNPPTFQSLGLNPPTFQSLGLNPPTFQSLGLNPPAFQSLALNSPAFQSLGLNPPTFQSLGLNPPTFQSLGLNSPAFQSLGLNPPTFQSLGLNPPAFQSLGLNPTAFQSLGLNSPAFQSLGLNPTAF

SEQ ID NO: 134170 - protein, 76 aa, Heterodera glycines
  Coding regions on vcDNA: vcDNA=SeqID_60593; Strand=-; Position=1-3,46- 81,335-374,855-1006
  Homolog annotation: Hit_ID=NP_495454.1; Match level="QueryCoverage =52%, HitCoverage=6%, E-value=4e-14, Identity=87%"; Hit description =lysyl (K) tRNA Synthetase (krs-1) [Caenorhabditis elegans] gb|AAK68395.1| Lysyl (k) trna synthetase protei
MVVLLTPCLHMLPLPYALLGSDREPGIETPIMNPIAGGATAKPFTTHHNDLDMKLYLRVAPELYHKAAFIFFNEKF

SEQ ID NO: 134171 - protein, 133 aa, Heterodera glycines
  Coding regions on vcDNA: vcDNA=SeqID_60594; Strand=-; Position=1 -17,220-321,373-655
  Homolog annotation: Hit_ID=AAL78214.1; Match level="QueryCoverage =70%, HitCoverage=49%, E-value=4e-11, Identity=35%"; Hit description =putative esophageal gland cell protein Hgg-20 [Heterodera glycines]
MSSEILVSTVFLLLVDCATILFCFFLDNAKKRRRPHKKEIFICSDCWLLVFDFLAPSQLGLEIALISHRFDIYVDEHFKTRKWKLNKQFLIQWDIQENGTKKMQIVNSDGNPLPIPQNPLPNKVIGFRDIHIM

SEQ ID NO: 134172 - protein, 179 aa, Heterodera glycines
  Coding regions on vcDNA: vcDNA=SeqID_60595; Strand=+; Position=1 -243,294-506,1430-1513
MENSNSNNNELIGGGGRLAVPERNVALEQDGEAEADAGREADKAEDDDDDGDDDYSPFAGDNIFLPAHWKPNFWARQFTLETFCTLHLEVMGLRNTMAGTLRDCEMTVGNFHPMPPEEVPGAMQQFVAWFNHELASASSSAAEFAARAQHTLVYLRNDLQSHQLEFDLMLSFSLRLTFC

SEQ ID NO: 134173 - protein, 145 aa, Heterodera glycines
  Coding regions on vcDNA: vcDNA=SeqID_60596; Strand=-; Position=1-438
MDILPSFDRPQLGLKMALLSPRFDALVDKHFDGQSEFPILRTIKICKGAVAAMPKLAVIIDEDNSVPFPLPDHSLLEPFELVNGRTNEKLILIKASEDEWVDRWIMKRCQNGETTAAIQWEGEEVNSSNLNNVHIGIHDVNICIG

SEQ ID NO: 134174 - protein, 263 aa, Heterodera glycines
  Coding regions on vcDNA: vcDNA=SeqID_60597; Strand=-; Position=1 -567,620-844
  Homolog annotation: Hit_ID=BAB78478.1; Match level="QueryCoverage =81%, HitCoverage=31%, E-value=1e-13, Identity=28%"; Hit description =preproMP73 [Cucurbita maxima]
MDPANNASSAEQAPNVPFFRMRRKPMNTTTMRKRREEDENEEEKRRERKRAEEEDEEEAMEAEGKGEKQRQRGEESDGSGTSTEDDEGAKAAAEATRMKLVERRKHLRGRNLMHTVGPYLHHKNKKGIQTSKKRRREIEALAEEESSEDESDEKSGREGQTSFDPDVKFASSGTQRTGPSDMGATARSEVDTEYGRDSQSQFERIQEMLKKERMEREKREAEEEEDRKKYGEKAKRKEQPGTSQQVVTITISPSDILSMYQLN

SEQ ID NO: 134175 - protein, 120 aa, Heterodera glycines
  Coding regions on vcDNA: vcDNA=SeqID_60598; Strand=+; Position=1 -58,385-515,565-735
  Homolog annotation: Hit_ID=NP_504700.2; Match level="QueryCoverage =80%, HitCoverage=21%, E-value=1e-30, Identity=69%"; Hit description =dihydrolipoamide S-succinyltransferase (49.8 kD) (5H188) [Caenorhabditis elegans] gb|AAC04462.2| Hypothet
MKILLARPGLKCPNSSKKLSGEVVEIQGPAFAESISEGDIRWNKQVGDFVKTDDIVAEIETDKTSVEVPAPFAGKIVELLVEEGAKVLAKQKLYKLEKGAEGGEGPAKEAKEEMPKKEGE

SEQ ID NO: 134176 - protein, 19 aa, Heterodera glycines
  Coding regions on vcDNA: vcDNA=SeqID_60599; Strand=+; Position=1 -48,203-214
MHSCPWFMSHLMSLPQLHN

SEQ ID NO: 134177 - protein, 43 aa, Heterodera glycines
  Coding regions on vcDNA: vcDNA=SeqID_60600; Strand=+; Position=1-500
CFAVPRTGRQWMAFNLQEIRLAICGCKKLLGMELFFEVSQTPY

SEQ ID NO: 134178 - protein, 156 aa, Heterodera glycines
  Coding regions on vcDNA: vcDNA=SeqID_60601; Strand=+; Position=1-470
  Homolog annotation: Hit_ID=NP_702063.1; Match level="QueryCoverage =84%, HitCoverage=3%, E-value=2e-10, Identity=22%"; Hit description =hypothetical protein PF14_0175 [Plasmodium falciparum 3D7] gb|AAN36787.1| hypothetical protein [Plasmodium
PPAFQSLVLNPPTFQSLGLNPTAFQSLGVNPPTFQSLGLNPPAFQSLGLNSPAFQSLGLNPPAFQSLGLNSAFQSLALNPPAFQSLGLNSPAFQSLGLNPPAFQSPGLNPPESITETQFSGISSNATQIKQFSDILPVSQSPDKKLCQIHHCNIIS

SEQ ID NO: 134179 - protein, 84 aa, Heterodera glycines
  Coding regions on vcDNA: vcDNA=SeqID_60602; Strand=-; Position=1 -139,190-305
MFAAVVGDFCGKRADLFISGEKLPEMFGQLDSKDQLELKRCFVKIEDECMQLNVLASDVNVCGCKVTIGDKLVTPVKRKSDEAI

SEQ ID NO: 134180 - protein, 108 aa, Heterodera glycines
  Coding regions on vcDNA: vcDNA=SeqID_60603; Strand=-; Position=1 -161,289-454
  Homolog annotation: Hit_ID=CAE69100.1; Match level="QueryCoverage =88%, HitCoverage=89%, E-value=1e-12, Identity=44%"; Hit description =Hypothetical protein CBG15126 [Caenorhabditis briggsae]
MSSSHAKVTVLLLLFVIAFVALAVSAPIEEEANAIVEANNGKLAASIGTDEATSLVRHKRYGYGYGYGRRYGGYGGWGGYGYGGWGGGYGYRSCYCGYGGYGYGYYGK

SEQ ID NO: 134181 - protein, 178 aa, Heterodera glycines
  Coding regions on vcDNA: vcDNA=SeqID_60604; Strand=-; Position=1-538
  Homolog annotation: Hit_ID=AAF15366.1; Match level="QueryCoverage =93%, HitCoverage=97%, E-value=7e-32, Identity=51%"; Hit description =ring-infested erythrocyte surface antigen [Plasmodium falciparum]
KAGSGSKFLNRVREEQKVEEEQKVEEKVEEEQKVEEKEEQKVEEKVEEEQKVEEKVEEKVEEEQKVEEKVEEEQKVEEKVEEKVEEEQKVEEKVEEEQKVEEKVEEKVEEEVEEEQKVEEKVDEEQKVEEKVEEKVEEEQKVEEKVEEEQKVEEKVEEEEKVEEDQKVEEEQKVEEKV

SEQ ID NO: 134182 - protein, 37 aa, Heterodera glycines
  Coding regions on vcDNA: vcDNA=SeqID_60605; Strand=+; Position=1 -70,126-169
MRTRNALKTTKMRNAKHEIINVPVFSAILSNEWEFKI

SEQ ID NO: 134183 - protein, 94 aa, Heterodera glycines
  Coding regions on vcDNA: vcDNA=SeqID_60606; Strand=-; Position=1 -136,508-577,629-707
MHNYRENELLRISMLLDPHFAYDLNLFMGGFWKSIEEDLIDFAKETTSVCSERLFSKAGLIYANSLRNRLSGKTVRQMLVVKANMDDIKLAPPI

SEQ ID NO: 134184 - protein, 98 aa, Heterodera glycines
  Coding regions on vcDNA: vcDNA=SeqID_60607; Strand=-; Position=1 -34,158-287,328-460
MANRLQLLHYEGNDIADSIYNALDENGLKIVKLISIVRDDAKNMQRMARVLGKSSHQCVVHFLHLVVHDVLKLGQIKELTDKVHEWVKFCLTRKGFDV

SEQ ID NO: 134185 - protein, 296 aa, Heterodera glycines
  Coding regions on vcDNA: vcDNA=SeqID_60608; Strand=+; Position=1 -58,105-607,675-1004
MIKNVMNRRHGSAHSPMEIAIEKPIKAIEKNIIRPKIEINLENELDGQSATNSNISPNFKCPINEYLAAVVAYHGFYYKVPAKTIAKIAMNLIFAVLFSQNWSTKQQQNSDQPIFDGILIFDHFSVIRQNEFEFGAEELAGNLKIEFNGTVEKVKDSRERTLPSEQRSKKQMIWLKDVLFMSPEQIKDKRSTTTGKDLVWFVGLLLYRMLFNNKHPMDNWEPKRRLDMEFMAKMGFSKLNQFNCMYKTDDFVTGDFGIVPLKPKSRWIWMPESERDETGEMALVEERIGMEQVAAN

SEQ ID NO: 134186 - protein, 57 aa, Heterodera glycines
  Coding regions on vcDNA: vcDNA=SeqID_60609; Strand=+; Position=1 -78,183-278
MHSTYSRFAGDEEYTAPQKKLFDLTKMCLHTFPEHRISPNFLEQILVLISNWQMYCD

SEQ ID NO: 134187 - protein, 96 aa, Heterodera glycines
  Coding regions on vcDNA: vcDNA=SeqID_60610; Strand=-; Position=1-291
MNDIQIQSQQHNVGGHLQQNDNKLKQELDEVIVNSYKFIGLGGGRRGGANLNLAEQKIQKHFARNNLSQAIDEANQRDFVNLESEYIDKQIVADLI

SEQ ID NO: 134188 - protein, 309 aa, Heterodera glycines
  misc_feature (110)..(110): Xaa can be any naturally occurring amino acid
  Coding regions on vcDNA: vcDNA=SeqID_60611; Strand=+; Position=1 -154,197-315,362-413,461-559,610-785,1348-1426,1543-1590
  Homolog annotation: Hit_ID=NP_495888.1; Match level="QueryCoverage =91%, HitCoverage=50%, E-value=1e-43, Identity=36%"; Hit description =mu opioid receptor family member (2J148) [Caenorhabditis elegans]
FFHRNIFLASPPLPQAMSSLDECESDPILGRPIIRIPIILAYIAVFLICLIGNSFAILVICAHRSMRTATNNSFAILVICAHRSMRTATNFFLANLAVADLLVAIFCIFXNMFHLVGIDDGRWLFGNMFHLVGIDDGRWLFGATLCKLYAFVLATLCKLYAFVLHLFPCTSIGILVCASVEKYIAVLHPLLALKVFTPRFRVLLMASAVLHPLLALKVFTPRFRVLLMASIWAISLLFSLPYYIFTSYIFYKNVAVCTRLMPLTNSTSFVLWYCVPLLIILFLYTRNGLVLWHNDDNCLGDRQCQNKSQ

SEQ ID NO: 134189 - protein, 110 aa, Heterodera glycines
  Coding regions on vcDNA: vcDNA=SeqID_60612; Strand=-; Position=1 -100,965-1080,1194-1310
  Homolog annotation: Hit_ID=NP_505680.2; Match level="QueryCoverage =69%, HitCoverage=13%, E-value=1e-09, Identity=46%"; Hit description =amino acid/polyamine transporter, family II (57.3 kD) (5K912) [Caenorhabditis elegans] emb|CAD54163.1| Hy
LANSFITGHAIFSIIIVLNPVNQAAEKFFKIPPIFGLLGGFAATFSAIRALTSTHFVPPCYVSALISASVNDEDKSIAGGPVNCCGAFQNISIYGENGAYCSRVDLHFYE

SEQ ID NO: 134190 - protein, 34 aa, Heterodera glycines
  Coding regions on vcDNA: vcDNA=SeqID_60613; Strand=+; Position=1 -36,565-633
MSDFDSEVRLRPLIVSKNICRTNEYKCKKKNNIH

SEQ ID NO: 134191 - protein, 87 aa, Heterodera glycines; identical to SEQ ID NO: 129152
  Coding regions on vcDNA: vcDNA=SeqID_60614; Strand=-; Position=1-940

SEQ ID NO: 134192 - protein, 158 aa, Heterodera glycines
  Coding regions on vcDNA: vcDNA=SeqID_60615; Strand=+; Position=1 -388,454-540
EYQQQCHRNNIINSGGSCPLALSSSERMVSELIAAVIEQSRQRQQLQKHQQQLLISTNKVEETNNSGGSENEAEGEERGDEMAPEEGGSIWQQSKGENGTVTAEAVPNHPTTANAGGDEAQQKKEMFMRWVHQHGNNMYPSREQKERLAAQMDTSYEK

SEQ ID NO: 134193 - protein, 98 aa, Heterodera glycines
  Coding regions on vcDNA: vcDNA=SeqID_60616; Strand=+; Position=1-297
MLELLGVDVVEEDGVESVEVLEQLGVDEVDDAELVELLRVDEVDDVELVELLGVDDVELLEVVDVGVVAVEVLKVVVEVDEVDVEDVLVVMLSLQQQM

SEQ ID NO: 134194 - protein, 132 aa, Heterodera glycines
  Coding regions on vcDNA: vcDNA=SeqID_60617; Strand=+; Position=1 -190,345-437,556-669
MDGQLIASDQKSLSSVSGASSSGTQLTCTVCGDVATGRHYGSVGKLSINKKFLLVKVACNGCKELLNERQFTDNRAVCRACRYARCIQFGMKVDAASTAATDAPTEEESQGALSPEPNKNTIVHQKMEERHK

SEQ ID NO: 134195 - protein, 71 aa, Heterodera glycines
  Coding regions on vcDNA: vcDNA=SeqID_60618; Strand=-; Position=1 -70,522-667
MAFVALATVTAMVVVVVVVVEKAVFKKRFETKIARNGVWMDRSEGKGGGGIICSMEQKELKQQKNPMEDME

SEQ ID NO: 134196 - protein, 124 aa, Heterodera glycines
  Coding regions on vcDNA: vcDNA=SeqID_60619; Strand=+; Position=1 -267,309-416
MPPLRAEQHPPPLAPQTNNVQQQQPTVPSPLNERQQSVQPTQGEHPQIRANATLQPNVVQAQQQQQQQSHQFLALDHDNDDQLLNQIFLDLTTTAEMEPIALDNSNNNNNNNMVVNDFWFCLFV

SEQ ID NO: 134197 - protein, 158 aa, Heterodera glycines
  Coding regions on vcDNA: vcDNA=SeqID_60620; Strand=+; Position=1 -181,281-454,574-694
MVDMSKMWTEDQPIHVRVAAKGAKPCATGFIMNVERQESETGLSIVAKLFLAYQEAKNYDFNLFTEMAKNTTTGLGTIMSILMARQGERTPPQNSWDELFVATSADVDHSDRELLLLLAKDGTERTVADTVAPNVNKMLVPKRKVTADALLDSFRRED

SEQ ID NO: 134198 - protein, 105 aa, Heterodera glycines
  Coding regions on vcDNA: vcDNA=SeqID_60621; Strand=-; Position=1-318
MQLSNEEFGTNDQQFKTARIGKVFVEVFRATKKLVNCEANSLMIKLLMAFLDESIDQLDAFFCRFNLAKKDIHNRVTEKGFISDYLMENCVNYIIKTNDTNGNSG

SEQ ID NO: 134199 - protein, 68 aa, Heterodera glycines
  Coding regions on vcDNA: vcDNA=SeqID_60622; Strand=-; Position=1-361
AVLVRFITAPNLLASQQSLLNLPDRTGAHDSTVPSTPPKAKRYNQNIRKNFLKHFFSIFLFDTKASEC

SEQ ID NO: 134200 - protein, 55 aa, Heterodera glycines
  Coding regions on vcDNA: vcDNA=SeqID_60623; Strand=-; Position=1 -111,360-416
MQSECPKDCTWGACHPHEGAIGDECCKAGYGFKCCEEMSHDQRTAAYPLYVSLDK

SEQ ID NO: 134201 - protein, 89 aa, Heterodera glycines
  Coding regions on vcDNA: vcDNA=SeqID_60624; Strand=-; Position=1 -40,327-434,503-591,1140-1172
MFRFDSKNAKSENEVPDVEAAAFKVMLSFIYTGELAELNGDNAMAVLYAGLVDASLQVPVSSLRNVFVAYVQAELYELEFHLVFYQKMN

SEQ ID NO: 134202 - protein, 32 aa, Heterodera glycines
  Coding regions on vcDNA: vcDNA=SeqID_60625; Strand=-; Position=1-118
LFNFLFLAANIFYNNLSVWSDVRKTEKIIKIL

SEQ ID NO: 134203 - protein, 64 aa, Heterodera glycines
  Coding regions on vcDNA: vcDNA=SeqID_60626; Strand=+; Position=1-388
LIRSQKSCQLKTAKKAEFSKFFISIFFYSSKFSVIFSRLIEPVKSFRMISRLFDSVNNFKSYID

SEQ ID NO: 134204 - protein, 363 aa, Heterodera glycines
  Coding regions on vcDNA: vcDNA=SeqID_60627; Strand=-; Position=1 -595,819-1315
  Homolog annotation: Hit_ID=NP_572354.1; Match level="QueryCoverage =90%, HitCoverage=58%, E-value=2e-17, Identity=28%"; Hit description =CG3075-PA [Drosophila melanogaster] gb|AAF46204.1| CG3075-PA [Drosophila melanogaster] gb|AAN71404.1| RE4
MITRHMRTHLLLDGSPVPFLFAGTPTMEYAEIPPISKLSLNSSSSSSPGAAVNAATASSTSTSGSCGTTATAQQSLSDTGTTTALAGGSLSSASSATVPWDEPQATRVVAQPQPPAPPDPAPAEPGNSNNHKTAAMEQQQQRQQQHMEHMVAAAKLLSAAAQQQNQQQHQAVQEAAAAARMPSLEGLLNQQMVLSTLHAQLPAHMRRSTPNLFSVPDYQQPSAFRPPPPAAAAVANLLQSQQPPQQSPSSVAANASATVAAVALSNALSSVQQLLQHQQQQHQQQQQQQRLAAMAVAAAGAATANGLFRQHSFGGIGFTEQQQQQQLVQLQQIAATQPTPPPLLQQQQQQQQAAHNQQQNPPK

SEQ ID NO: 134205 - protein, 21 aa, Heterodera glycines
  misc_feature (2)..(2): Xaa can be any naturally occurring amino acid
  Coding regions on vcDNA: vcDNA=SeqID_60628; Strand=-; Position=1-64
PXHLKTKRNRSKGKGRRGNLA

SEQ ID NO: 134206 - protein, 166 aa, Heterodera glycines
  Coding regions on vcDNA: vcDNA=SeqID_60629; Strand=+; Position=1-501
MSNLNPGNWWYYFERQGKSTAKCKADGCSYSKTLNASLSTTVLASHLKNHHPQLYKQREDFVQAEKQKTEKKGQSGINPLKRAFVGLREDKDNRYSNIKKTIANAIELRLKQAEEQKNLVLATILDPRFKTIYLDSSRLNQYKDWLISEVESYHAKTDVILFFLFL

SEQ ID NO: 134207 - protein, 123 aa, Heterodera glycines
  Coding regions on vcDNA: vcDNA=SeqID_60630; Strand=+; Position=1 -93,200-260,312-410,899-1015
MPIQQKHQQVARKLNTSILKSLNERLYPQPWELKWRKVNVSETDQNGFILTPCFHDLAEFPAANLFNKKFRIRMKAELEQEQKTCIIHIPCKFSLLIFNPFVAGEVFEFHILDGVEHLDKCSA

SEQ ID NO: 134208 - protein, 24 aa, Heterodera glycines
  Coding regions on vcDNA: vcDNA=SeqID_60631; Strand=-; Position=1 -52,295-317
MEKACKIWRDYIDFSALELLELAS

SEQ ID NO: 134209 - protein, 25 aa, Heterodera glycines
  Coding regions on vcDNA: vcDNA=SeqID_60632; Strand=+; Position=1-75
MSCYNSIKQKSEKSEISSTDSQRKK

SEQ ID NO: 134210 - protein, 243 aa, Heterodera glycines
  misc_feature (8)..(8): Xaa can be any naturally occurring amino acid
  Coding regions on vcDNA: vcDNA=SeqID_60633; Strand=-; Position=1 -134,209-333,423-509,724-833,1159-1385
  Homolog annotation: Hit_ID=CAE71394.1; Match level="QueryCoverage =98%, HitCoverage=40%, E-value=1e-36, Identity=34%"; Hit description =Hypothetical protein CBG18301 [Caenorhabditis briggsae]
LLFVHLNXFCFVLNYSSVFNCKGNEVNEGVPLITEFALFTFDYNFTVKLSQFLEEDTENFTVKLSQFLEEDTENSDIRSYLRHREMLRKKITSRPTILQLVRLLVRLRAKHGGQQLLCANTHLYYDPKYEEVKIIQTLLCLRYIDKIRAQLSNDSSCQIQVIFAGDFNSKSQLLSGSPDYTNFTSPGSSLGFNGCLDYIWAHPPLRIEHIWPMPDHRLVTKYDALPSPIAPSDHLPILCDVQL

SEQ ID NO: 134211 - protein, 19 aa, Heterodera glycines
  Coding regions on vcDNA: vcDNA=SeqID_60634; Strand=-; Position=1-60
EPVNSCIGCKCRRCCTPNS

SEQ ID NO: 134212 - protein, 106 aa, Heterodera glycines
  Coding regions on vcDNA: vcDNA=SeqID_60635; Strand=+; Position=1-321
MALTIEQHLQEISQQNQNPSLSGIDVFELGDETTNIEDWLQQFCFALDCSAPNLKDEQKVKLLMTKLSKAAFSEYKKSCLPKDVTDSNFAKTEQQLKALFAKPQSV

SEQ ID NO: 134213 - protein, 775 aa, Heterodera glycines
  Coding regions on vcDNA: vcDNA=SeqID_60636; Strand=+; Position=1-2328
  Homolog annotation: Hit_ID=XP_318550.1; Match level="QueryCoverage =80%, HitCoverage=63%, E-value=1e-140, Identity=42%"; Hit description= ENSANGP00000020240 [Anopheles gambiae]
MYLSTIAEAKCIEQPAPSKQILAVKQNFVPKTKGFEARGQFQQQLKVCWRCGRGSHFPSACPHIKIACRKCSKVGHLEAQCNQHQTWLIRQGKMQSRKQGNLKLGGVLINLVNQPKRLIECPIKMNGNFVEFALDSGAEVVVVNEETHEAIGKPKLSPCNVEAKYHDGTKCTLLGKGEAEFEFGGIIRKGQFYVSKRGSLNLFGIEMLDAFGLMDDVRKKVAMTLNVNNVKKEESVVDETLSRLRAKFPNVFSTNLGHCKKAKARLSLMADAKPVYCRPRPVPYNTKLVVEAELDRLLAANVIRPVDHTRWAAPIVVVKKAAGSARVCADFSTGLNNVLLSNQHPLPVPEDIFATLNGGHVFSQIDFRDAYHQIELEEGSKELCTIATHRGNFEYQRLPFGVKSAPGIFQSIMDSMLADCPFAIAYLDDVIIVSRTRKEHWTHLAEVFKRIDNFGFRIKPEKCSFGKERIKFLGFIIDKDGRRPDSTKIEAIRRMPIPTNVSTLRSFLGMVNHYQQFVKNLRFIRQPLDDLLKQDTVWNWSSECQKAFDQVIGTLQSDQLLTHYDPSQEIIVSADASEHGIGAVISHRYADGSIKAIAHASHSLAPAERNYAQIEKEGLALIYAVQKFHKYLYGRHFILQTDHKPLLSIFGNKKGIKSCTANRLQRWALILLAYDFDIEYQNTSEFGQADALSRLISKTTIEDDEVIVANLMNVETELLNAVVKQFPLNSDQLIVEIGKDEVLKGHEVPSHSMAHFKEYVFKNHSISPQARSLIN

SEQ ID NO: 134214 - protein, 214 aa, Heterodera glycines
  Coding regions on vcDNA: vcDNA=SeqID_60637; Strand=+; Position=1-645
  Homolog annotation: Hit_ID=CAG83749.1; Match level="QueryCoverage =98%, HitCoverage=33%, E-value=5e-27, Identity=42%"; Hit description =unnamed protein product [Yarrowia lipolytica CLIB99] ref|XP _499823.1| hypothetical protein [Yarrowia lipol
ICTPSNNAVPLLITVVPLLITVVPLLITAVPLLIIVVPLLITVAPLLITVVPLLITVAPLLITVVPLLITVAPLLITVVPLLITAVPLLIIVVPLLITVAPLLITVVPLLITAVPLLIIVVPLLITVVPLLITVVPLLITAVPLLIIVVPLLITVAPLLITVVPLLITVAPLLITVVPLLITVAPLLITVVPLLITVVPLLITVVPLLITVALF

SEQ ID NO: 134215 - protein, 269 aa, Heterodera glycines
  misc_feature (12)..(12): Xaa can be any naturally occurring amino acid
  misc_feature (19)..(19): Xaa can be any naturally occurring amino acid
  misc_feature (26)..(26): Xaa can be any naturally occurring amino acid
  misc_feature (33)..(33): Xaa can be any naturally occurring amino acid
  misc_feature (40)..(40): Xaa can be any naturally occurring amino acid
  misc_feature (47)..(47): Xaa can be any naturally occurring amino acid
  misc_feature (54)..(54): Xaa can be any naturally occurring amino acid
  misc_feature (61)..(61): Xaa can be any naturally occurring amino acid
  misc_feature (68)..(68): Xaa can be any naturally occurring amino acid
  misc_feature (75)..(76): Xaa can be any naturally occurring amino acid
  misc_feature (82)..(82): Xaa can be any naturally occurring amino acid
  misc_feature (89)..(89): Xaa can be any naturally occurring amino acid
  misc_feature (96)..(96): Xaa can be any naturally occurring amino acid
  misc_feature (103)..(104): Xaa can be any naturally occurring amino acid
  misc_feature (110)..(110): Xaa can be any naturally occurring amino acid
  misc_feature (117)..(117): Xaa can be any naturally occurring amino acid
  misc_feature (124)..(124): Xaa can be any naturally occurring amino acid
  misc_feature (131)..(132): Xaa can be any naturally occurring amino acid
  misc_feature (138)..(138): Xaa can be any naturally occurring amino acid
  misc_feature (145)..(145): Xaa can be any naturally occurring amino acid
  misc_feature (152)..(152): Xaa can be any naturally occurring amino acid
  misc_feature (159)..(159): Xaa can be any naturally occurring amino acid
  misc_feature (166)..(166): Xaa can be any naturally occurring amino acid
  misc_feature (173)..(173): Xaa can be any naturally occurring amino acid
  misc_feature (180)..(180): Xaa can be any naturally occurring amino acid
  misc_feature (187)..(188): Xaa can be any naturally occurring amino acid
  misc_feature (194)..(194): Xaa can be any naturally occurring amino acid
  misc_feature (202)..(203): Xaa can be any naturally occurring amino acid
  misc_feature (210)..(210): Xaa can be any naturally occurring amino acid
  misc_feature (216)..(216): Xaa can be any naturally occurring amino acid
  Coding regions on vcDNA: vcDNA=SeqID_60638; Strand=-; Position=1 -601,682-870
  Homolog annotation: Hit_ID=AAK50002.1; Match level="QueryCoverage =87%, HitCoverage=34%, E-value=6e-31, Identity=41%"; Hit description =ORF73 [Human herpesvirus 8]
EEVQQRLEEQQXLEEVQQXLEEVQQXLEEVQQXLKEVQQXLEEVQQXSKEVQQXLEEVQQXSKEVQQXLEEVQQXXEEVQQXLEEVQQXLKEVQQXLEEVQQXXEEVQQXLEEVQQXSKEVQQXLEEVQQXXEEVQQXLEEVQQXSKEVQQXLEEVQQXSKEVQQXLEEVQQXSKEVQQXLEEVQQXXEEVQQXLEEVQQQXXEEVQQQXEEVQQXLEEVQQRLKEVQQRLESGHSNIAFTVIKELFLFKIDKKSMCYIFHFLKYNTLF

SEQ ID NO: 134216 - protein, 304 aa, Heterodera glycines
  Coding regions on vcDNA: vcDNA=SeqID_60639; Strand=+; Position=1-915
  Homolog annotation: Hit_ID=NP_608540.1; Match level="QueryCoverage =99%, HitCoverage=66%, E-value=8e-33, Identity=28%"; Hit description =CG2839-PA [Drosophila melanogaster] gb|AAF51469.2| CG2839-PA [Drosophila melanogaster]
MEQENGEIIEKMDKEKAKADQKMKELIGEEKRTKKKNKRAMKRKQRQRSAADQKEGESEQKEEKGKERNREESEQKEEKGKERNREESERISEESEQEEEKRKERTEEESQWNTKESEQKEEKGKERKGEESGQDFAREENDVEIVNDQNGGERKQAKKNCENNSMELRENQERKIRKEKKTQKRESAQKELKRKKDNDGKSERISEEKIEEKGRKNNNERKESREKNEGESTQNERKRNKEKRKQKLKALEENNEININSWNKTATDSVTTEESQKQGQEYGEETMEKGGKASAEKERENAIE

SEQ ID NO: 134217 - protein, 31 aa, Heterodera glycines
  Coding regions on vcDNA: vcDNA=SeqID_60640; Strand=-; Position=1-93
ITVYALIIAQSLLIPQSPIIPSLRGVLKNNP

SEQ ID NO: 134218 - protein, 95 aa, Heterodera glycines; identical to SEQ ID NO: 124528
  Coding regions on vcDNA: vcDNA=SeqID_60641; Strand=-; Position=1-807

SEQ ID NO: 134219 - protein, 227 aa, Heterodera glycines
  Coding regions on vcDNA: vcDNA=SeqID_60642; Strand=-; Position=1-684
MKRPMDSTATPPSSKTTRISADALAGQIDSLSAAVNALLVQDDISQAVKLQFGVLLTTLHTCQHVIDGLNNNANNNSAEEQERRRSLVIVGLPENASTRPSERVREDQKVVSGILDELGVVAVPTTTYRMGRPYVHRASPRLLKVVLPASVHQHIALGGWKKERIRLRSLPNWGRLLIRPSLSREQLQAEYEQRQAKRNGMTNHPPNANTISTQLHELGRQMNQNFH

SEQ ID NO: 134220 - protein, 92 aa, Heterodera glycines; identical to SEQ ID NO: 125147
  Coding regions on vcDNA: vcDNA=SeqID_60643; Strand=+; Position=1-304

SEQ ID NO: 134221 - protein, 100 aa, Heterodera glycines
  Coding regions on vcDNA: vcDNA=SeqID_60644; Strand=+; Position=1-303
MIGRAVRNRPFIFEGIFKFILYPRKMSISFFEKFYTSQKRLRRDGGLCTIAILFHRGFLYLEVIPEKWLSLFLINFIHIQMLSSMIGRAVRNRPFIFEGI

SEQ ID NO: 134222 - protein, 88 aa, Heterodera glycines
  Coding regions on vcDNA: vcDNA=SeqID_60645; Strand=-; Position=1 -135,177-305
  Homolog annotation: Hit_ID=AAH82031.1; Match level="QueryCoverage =100%, HitCoverage=49%, E-value=5e-21, Identity=51%"; Hit description= Unknown (protein for MGC:95163) [Rattus norvegicus]
MYIFGYGSLLWNPNFLYDEAIQGVVIGYVRRFWHLSPDHRGTPDNPGRVVSLFPDVSGSCWGIAYKINRKNIESTLKYLDHREKAGYQ

SEQ ID NO: 134223 - protein, 80 aa, Heterodera glycines
  Coding regions on vcDNA: vcDNA=SeqID_60646; Strand=-; Position=1 -40,102-302
VNGESLVNARHDEAVRALKQAGKMVNLQGIQLIHSFIFNIFEFFSLSSAISTRFAPPSGEYAAPAELGGESGRCVVGWAD

SEQ ID NO: 134224 - protein, 128 aa, Heterodera glycines
  Coding regions on vcDNA: vcDNA=SeqID_60647; Strand=+; Position=1 -94,424-510,585-790
MKIFLNSMDKCENGGGTRIIGVINDQLTEEKKKGFSASSSNIQFGKHLLTKNSFLTTDKLEICAYSLSFIRSIFNLGVESLNYLQLVTTASKANIKIFKEQIKQIDSICNKFQIGINANVYFEAPWGN

SEQ ID NO: 134225 - protein, 426 aa, Heterodera glycines
  Coding regions on vcDNA: vcDNA=SeqID_60648; Strand=+; Position=1 -255,528-655,707-741,1128-1375,1780-1925,2430-2529,2835-3060,4654-4793
  Homolog annotation: Hit_ID=CAE73996.1; Match level="QueryCoverage =74%, HitCoverage=77%, E-value=2e-84, Identity=46%"; Hit description =Hypothetical protein CBG21630 [Caenorhabditis briggsae]
ATGSRTFASSTSAFVTNDHQQQQQIHRRTSGTTTFVKGTALISRGSIVGGLVELKTFGMASSNGAELGLNPWDFDVQPDDDFVSQTKILEMPNSHRLGACHSCKGEMLVHCFHCRGSGNDKCSYCRQVGTGMKAGVAHPAVYTHPMIGGGTFPGAPASVGGCGVAGTAPNRGAAGFHHQHQLHHPFANPSMVRPALLGAQRDKPYAAGTPVHFMAKAGLPPPGIGQHDLCIFCHGRGIRDCQHCKGQGKKHCLTCGGNGQVHVYTKLKVVFSVECTDYYSACGVPEVLLRQANGELIFSETRPYPIKRDGLTEINDVSRRFCAAHLKKLLDSCRVLKQRHCVESIEVAKVRFRLGSKMGHFFVYGRQRLCYIPEGPTRCTSAQPNARLRQLSARELLAFAKRRDPYGRPVCMLTLFYAPDCVFSAK

SEQ ID NO: 134226 - protein, 42 aa, Heterodera glycines
  Coding regions on vcDNA: vcDNA=SeqID_60649; Strand=+; Position=1 -54,242-316
MAAQFEKARPEQWKKICQRRVKPQEIGAVLRDKCLPLEANVQ

SEQ ID NO: 134227 - protein, 216 aa, Heterodera glycines
  Coding regions on vcDNA: vcDNA=SeqID_60650; Strand=-; Position=1 -225,470-682,1063-1272
  Homolog annotation: Hit_ID=AAH08288.1; Match level="QueryCoverage =98%, HitCoverage=53%, E-value=2e-19, Identity=34%"; Hit description =UBXD1 protein [Homo sapiens] gb|AAK13258.1| UBX domain-containing protein 1 [Homo sapiens]
EKVLPVKGTIEFLKAIGFREEMRAAPAADGQQQSAERYLVLSAQPTAGGVDTLRNALATLLDGKPIAIRVFREAKVFKIESNQQQLPNPEIPPDFFKRTVEEIRREQQRMSEELEKIMTLRTRKMREADTKRKDAEGNPFKYCYIRGIFNVHERFANVREFVAQHLAIHHGTFTLTAALGANQQQQQQLREEEHTLLDYELVPSALIHFQWDTETR

SEQ ID NO: 134228 - protein, 49 aa, Heterodera glycines
  Coding regions on vcDNA: vcDNA=SeqID_60651; Strand=-; Position=1-149
DKAAFAAAIRGKKRRSRPKRDEDEEAPLPLHSSSMMNLNKIFDYFCGLN

SEQ ID NO: 134229 - protein, 19 aa, Heterodera glycines
  Coding regions on vcDNA: vcDNA=SeqID_60652; Strand=+; Position=1 -56,881-884
MRRRRHFRWLCKCLLLLVR

SEQ ID NO: 134230 - protein, 121 aa, Heterodera glycines
  misc_feature (111)..(111): Xaa can be any naturally occurring amino acid
  misc_feature (116)..(116): Xaa can be any naturally occurring amino acid
  misc_feature (119)..(119): Xaa can be any naturally occurring amino acid
  Coding regions on vcDNA: vcDNA=SeqID_60653; Strand=+; Position=1 -110,155-349,1710-1733
  Homolog annotation: Hit_ID=AAD09564.1; Match level="QueryCoverage =94%, HitCoverage=48%, E-value=1e-25, Identity=52%"; Hit description =cyclophilin [Onchocerca volvulus]
VSKAERGRCFFDIHIDGEPVGRIVMELFDELVPHTTENFVMLCTGQAGINFVMLCTGQAGIGKVTGKPLHFKGSMFHRVIKNFMIGSDFSAANGTGGSHFFMFLFLSENEXMEHTXSAXTS

SEQ ID NO: 134231 - protein, 111 aa, Heterodera glycines
  Coding regions on vcDNA: vcDNA=SeqID_60654; Strand=+; Position=1 -73,118-227,552-704
MLGFVYADDLSELNGDNAMEVLYAAKKYNITGLIGPPLQIPISELRNVFLAYAQALLFELEALRWADEKCRQNGVECSPENLRAVLGPALFKIHLPNIHEADFSKYVGKNV

SEQ ID NO: 134232 - protein, 52 aa, Heterodera glycines
  Coding regions on vcDNA: vcDNA=SeqID_60655; Strand=-; Position=1 -26,401-463,931-1000
MRPKEEAKGKIGLGLKVSPYQSLFAFATKRCGQRRGQTCKKWIQNFVTAICL

SEQ ID NO: 134233 - protein, 557 aa, Heterodera glycines
  Coding regions on vcDNA: vcDNA=SeqID_60656; Strand=+; Position=1 -168,827-1171,1542-2702
  Homolog annotation: Hit_ID=NP_501429.1; Match level="QueryCoverage =20%, HitCoverage=16%, E-value=3e-20, Identity=45%"; Hit description =tc5 transposase and CENP-B protein and Tc5 transposase, C-terminal family member (mut-x) [Caenorhabditis
MHVNPLNVIQLLQKKFSKYKEQTPINAFESDIAKNFAEEIERCNKNDEEMEISHDLITKFISKSHYINLEKVKKEAEEFVECVKNFVKDEQISSRDLLNADQSGFELELHAKRSLAPVGTKLIECVVQSVSSTTHSYTVMPMITASGSLLSPLFIVLAEQKGKFPQKGIFQCPRRRRQKRHISIRIGRGKRFANLDRPLPNCPKRSQKSAFGPISIELPQGLSLLPETEREGMRKSLESAPFLLEKLRATEIQKKTLVTAERVILGDSNAYQLKKLWPRSAFVGVQEGSTAEVIRQFDQVVLASKVKWLIAMVGKDSILAGDSVDSVIEKVKRLRQLCLRFAHVKIFWLLPPFIYNKKAESEEFCGRMRALFRKKSEIELVAVTEEGRSLLEIWRFGKNFNNEHVNHNGWMTEKGLKTLNAWLTSLVPNFPGDRELGIRTVKSKVVKIGAVKGGGPGDPSLIRGNAPERNVRGEGPGDPSPSRTIGISDNGPTGSARPMTNQNRGFEFGRVGTGYRSVPPPTFRGPSSRFHPYQQSRGRPAFHPTPMNRRNRFEPRR

SEQ ID NO: 134234 - protein, 38 aa, Heterodera glycines
  Coding regions on vcDNA: vcDNA=SeqID_60657; Strand=-; Position=1 -69,704-751
MDFKAVIVGFIYYFYVTYKSIVKYLFFINSILNQKKRN

SEQ ID NO: 134235 - protein, 79 aa, Heterodera glycines
  Coding regions on vcDNA: vcDNA=SeqID_60658; Strand=+; Position=1 -64,755-930
MAEKFVLPLTAQNFRLERKTSVEEPLFILGQNFFEQLHYGAFLDDYAGIWLFGIDTMQKWGRRSTKIVVHRHQKCGLMV

SEQ ID NO: 134236 - protein, 181 aa, Heterodera glycines
  Coding regions on vcDNA: vcDNA=SeqID_60659; Strand=+; Position=1 -154,413-579,923-1145
  Homolog annotation: Hit_ID=NP_502029.1; Match level="QueryCoverage =98%, HitCoverage=43%, E-value=5e-55, Identity=51%"; Hit description =pyruvate kinase (56.2 kD) (4L677) [Caenorhabditis elegans] emb|CAA93424.2| Hypothetical protein ZK593.1 [
IAASDGVMVARGDLGIEIPAQKVFLAQKMMIAKCNMAGKPVITATQMLESMICLEAETAFFHSRYFEELLQNTPSPTGPGETIASAAANAARRCRASAIIVLTTTGKSAQECSRFRVPIPVLAITRYEQVARQLQLCRGLFPLYYPHMERDTEWTEDVNKRIAYGIGVGKERGFIHNGDFV

SEQ ID NO: 134237 - protein, 169 aa, Heterodera glycines
  Coding regions on vcDNA: vcDNA=SeqID_60660; Strand=+; Position=1 -412,535-632
MEKLAQQNPSLVDSTASSLEKAAQMELDFIQRVLLGPHRGNLTAIECLLAQNFSQNSSMMPNYGGATWKNSKMPKLETEKHIVGDVDEPKSDNESETDRGDQKLKRKGVERPKRNPSECKVCGRKSMYCYYSVRCCEANPALSRKKTRDRNLDGIPIQYAPGRFSKYLR

SEQ ID NO: 134238 - protein, 39 aa, Heterodera glycines
  Coding regions on vcDNA: vcDNA=SeqID_60661; Strand=-; Position=1-118
MAKRQISLLKIEEIYEQMGNVYHVVNLNELEWVNLFFEK

SEQ ID NO: 134239 - protein, 88 aa, Heterodera glycines
  Coding regions on vcDNA: vcDNA=SeqID_60662; Strand=+; Position=1 -169,857-954
MTTVGKTDGSQGRTVAQNVWGELSQTSELRWPKFHAADFAPEQWPKLAHKVLSSAINIAAAKGKEKVSERVKEAKRKARTFIVKNSEQ

SEQ ID NO: 134240 - protein, 123 aa, Heterodera glycines
  Coding regions on vcDNA: vcDNA=SeqID_60663; Strand=+; Position=1 -168,1718-1921
MEEPRRKYDDEEEEEAEAALVSDGGDSSAATDSPPLSRALLALWWDEHSETDEADDRQLVQLTLIVRDVEQHFECVDQIQVDVAETVGRPTNAEKMGQKLRELEKACGSAAPMKQIGWQCPRR

SEQ ID NO: 134241 - protein, 715 aa, Heterodera glycines
  misc_feature (156)..(156): Xaa can be any naturally occurring amino acid
  misc_feature (590)..(590): Xaa can be any naturally occurring amino acid
  Coding regions on vcDNA: vcDNA=SeqID_60664; Strand=-; Position=1 -88,152-277,325-492,612-719,944-977,1039-1122,1173-1265,1364 -1408,1717-1889,1941-2008,2072-2280,2308-2373,2599-2655,2716 -2865,2976-3051,3297-3417,4008-4155
  Homolog annotation: Hit_ID=NP_505469.2; Match level="QueryCoverage =89%, HitCoverage=86%, E-value=1e-116, Identity=39%"; Hit description= RAS guanyl releasing protein (5K36) [Caenorhabditis elegans]
ADSPCCSNYATEPMDLFELIRRCCDCFGVQGDPAEPDPDFPCWFFSASGDPAEPDPDFPCWFFSASEWLCPELAELMAIFVSLYQAIENVGYGQKVCSAVGFWIRRHPAHIENVGYGQKVCSAVGFWIRRHPAHFDANAQLGRLLDRLKVKMSKRXNNNKANGLEIGRRPSYAWLRNVSVRNPVSRHSLCFEQWSPEDIATSMSHIDHKVLSRVNVVSELKRYVRVGRLCQQTPLLERSIGIFNSFSGWVQCQVLSKATASFSGWVQCQVLSKATASERAEIITKFVQVGRHLRRNNNFNTLMAVIGGITHSNVARLLLTHSLLPPDILDDLSALTKLLSHANNYAAYRKTLRSVGGRFKVPIMGVHLKDLIAFSVPGWNSSKGVHLKDLIAFSVPGWNSSKTRCRTSAGLFQLSQLLSHFCRTSAGLFQLSQLLSHFLGVCRTAHCFGDVNLDLINTLKVLFDIAYDERELYQLSLEREPKTASSVAAAQPAVFADWAAGVCAQPDPDPAVFADWAAGVCAQPDPDTVDKIAAMVDAVFKHYDNDRDGYIYISRAEFKQFASNFPFLDAFGEIDSDRDGKRIYRQLNDXSVSHHSFDQDCRNGLAHQWTDAQFLAPAVCAHCNKLLWMRHGVRCKMCSCSLHGQCKAEAALKCTRRRPTTSGGSAKRNAKTKNKTMPKFERCPKKRSQKRAKDSEVTHQRKVKSEQKPREGAPL

SEQ ID NO: 134242 - protein, 92 aa, Heterodera glycines
  Coding regions on vcDNA: vcDNA=SeqID_60665; Strand=-; Position=1-659
MFEYPKRTLEKIDFFVFGAVPPNRCAQIYGETESFRNSFPIACTLILRWIFAPHNCLSTPNGHLKKSIYFCFRGSPPEPMRPDLWGDRIFRE

SEQ ID NO: 134243 - protein, 120 aa, Heterodera glycines
  Coding regions on vcDNA: vcDNA=SeqID_60666; Strand=+; Position=1 -231,456-587
MVENGTEIKTYRNELKSFQEEVDKAKNTTLEHVANNDMKQAKKSADVAKGIAKQAKIKYTSILEGYNDKSEKGFSGKNARLFHAEEANYMPDLTGGVRQLYIYAPNLIENTIIGNQMAPL

SEQ ID NO: 134244 - protein, 54 aa, Heterodera glycines
  Coding regions on vcDNA: vcDNA=SeqID_60667; Strand=-; Position=1-167
KKHPRNPPLCTIDGVRPPPAPLQKFTLTKKQLSHNFGSAAVPQLVAEFNNLVRL

SEQ ID NO: 134245 - protein, 82 aa, Heterodera glycines
  Coding regions on vcDNA: vcDNA=SeqID_60668; Strand=+; Position=1 -23,761-985
  Homolog annotation: Hit_ID=CAE68383.1; Match level="QueryCoverage =86%, HitCoverage=62%, E-value=1e-24, Identity=59%"; Hit description =Hypothetical protein CBG14139 [Caenorhabditis briggsae]
FWGTLSILRGEALFGAQQIQRFYRDIDETLAWMGEKELTLATDDFGRDLNNVQALQRKHEGTERDLAALESKVARHGEILSV

SEQ ID NO: 134246 - protein, 95 aa, Heterodera glycines
  Coding regions on vcDNA: vcDNA=SeqID_60669; Strand=+; Position=1-465
LFEYPKRTLEKIDFFVFGAVPPNRCAQIYGETESFGSSFPIACTLILRWIFAPHYCLSTPNGHLKKSIFLFSGQSPRTDAPRFMGRPNPSGVASL

SEQ ID NO: 134247 - protein, 46 aa, Heterodera glycines
  Coding regions on vcDNA: vcDNA=SeqID_60670; Strand=+; Position=1 -50,418-508
MNIAAQLHISTAKTLQNRLQQREDDQLKELIKLEKRQGKRRNWCCI

SEQ ID NO: 134248 - protein, 104 aa, Heterodera glycines
  Coding regions on vcDNA: vcDNA=SeqID_60671; Strand=-; Position=1 -115,159-297,349-409
MLSRVFGICVFSVVLDCPRSYPRAGPTVTFNKPIIHPNVSNASDRTRNQMCINLLDLWNDTNNLSQVVEGIRSGTMRMRPIPMQLQHMVGTGPTTKQWSEGMSS

SEQ ID NO: 134249 - protein, 41 aa, Heterodera glycines
  Coding regions on vcDNA: vcDNA=SeqID_60672; Strand=+; Position=1-123
MRVVPIPANTDNYMYLIIDDDDKYQKGHRPAALVDPVNVEK

SEQ ID NO: 134250 - protein, 117 aa, Heterodera glycines
  Coding regions on vcDNA: vcDNA=SeqID_60673; Strand=-; Position=1-515
MQTRYASSVRFHLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSS

SEQ ID NO: 134251 - protein, 39 aa, Heterodera glycines
  Coding regions on vcDNA: vcDNA=SeqID_60674; Strand=-; Position=1-592
KRATISIKLTTHKVLAPVPYRGCKGEHNTSLLLYFRRGS

SEQ ID NO: 134252 - protein, 136 aa, Heterodera glycines
  Coding regions on vcDNA: vcDNA=SeqID_60675; Strand=+; Position=1 -77,646-979
MPDRTGLVFSKMTGFGIRSLIIRSIRKTNKRQGFLVETKPDRIRSKIRRTGPDWHFQNDRIRDPVSHNPVNLCNPVNPYFSKKSPDRIPDPGKSGTGSGPVRSLLLNNSNAKKQALARKLNKNFVFGKFCPKIFMF

SEQ ID NO: 134253 - protein, 25 aa, Heterodera glycines
  Coding regions on vcDNA: vcDNA=SeqID_60676; Strand=-; Position=1-75
TCTCGVVVKLSTFHNFSPGFNSPLG

SEQ ID NO: 134254 - protein, 24 aa, Heterodera glycines
  misc_feature (18)..(18): Xaa can be any naturally occurring amino acid
  Coding regions on vcDNA: vcDNA=SeqID_60677; Strand=+; Position=1-73
RDGPRFRFSHFAFRIIRXFWRFAF

SEQ ID NO: 134255 - protein, 167 aa, Heterodera glycines
  Coding regions on vcDNA: vcDNA=SeqID_60678; Strand=+; Position=1 -223,868-1148
NPDNPAGSRKKSSGFIGIRSGSRLGIRLDRFSKMFGIDRDRDSVGIPTRDPSDPSCPVSTAKARSNGHKLKPYVHTSLAAALASARSSAWPVLTPTNLISTALPAIVAINAALNCAGVQSSFGLRVDNVWPSRPFWPMMVVLMKLFAMSSFNRTTIECAASCAATNA

SEQ ID NO: 134256 - protein, 116 aa, Heterodera glycines
  Coding regions on vcDNA: vcDNA=SeqID_60679; Strand=-; Position=1 -5,509-854
MSSLTTLTWCCQSALRLETGETTPALVAAHEAAHSIVVLLNEDIAKSFISTTIIGQNGLDGQTLSTRRPNEDCTPAQLRAALMATMAGKAVEIKLVGVSTGHADDLADARAAAREV

SEQ ID NO: 134257 - protein, 27 aa, Heterodera glycines
  Coding regions on vcDNA: vcDNA=SeqID_60680; Strand=-; Position=1 -67,584-600
MSLFNPNEPFEMRIETVQEEGEDCRFS

SEQ ID NO: 134258 - protein, 112 aa, Heterodera glycines
  Coding regions on vcDNA: vcDNA=SeqID_60681; Strand=+; Position=1 -105,147-382
WRLSLGVAVDKLGGQKTGIGVGLCGGEENPRRPPEEHQRNAIFGAETAAEKVWAKKCCFCAGGRDDGQRPAVGAGDGVEWRGERVPRPSDAECAGDGQISAKFDAMAQRALF

SEQ ID NO: 134259 - protein, 40 aa, Heterodera glycines
  Coding regions on vcDNA: vcDNA=SeqID_60682; Strand=+; Position=1-125
NGSAAAKVWQRRKTEREGQCPSHLMGRGTAQRKRRTEEAS

SEQ ID NO: 134260 - protein, 91 aa, Heterodera glycines
  Coding regions on vcDNA: vcDNA=SeqID_60683; Strand=-; Position=1 -80,137-332
MTTVLFTNSIISREFHSMQLRFNSLCRDLSSVVRCTLPIIKDNCGEKPANLLLKFIGLEFSRYFDEHRRNSRIVYEQYEWGLVGCSTIHNV

SEQ ID NO: 134261 - protein, 178 aa, Heterodera glycines
  Coding regions on vcDNA: vcDNA=SeqID_60684; Strand=-; Position=1 -240,763-1002,1077-1133
MMSMCEHTCGLCAADACFDAADDCTSLGHLCFHQAVSPLVRQQCARSCGLCTPQQRAETAPRGGGAESREVVGVQKTPKEIYSDFLKDKCAKTCGHCLSEEDKVRLGNDYGSDSSNSEDYDQPFESVRRIRNRPSAAPPAGGQKNSADNGTTVAQRAKGTKALQSEANQVENFPSELS

SEQ ID NO: 134262 - protein, 37 aa, Heterodera glycines
  Coding regions on vcDNA: vcDNA=SeqID_60685; Strand=+; Position=1-112
MEKEKLWGGIEFREKNGEWKEEMERKKEQGEEREQSG

SEQ ID NO: 134263 - protein, 88 aa, Heterodera glycines
  Coding regions on vcDNA: vcDNA=SeqID_60686; Strand=+; Position=1 -195,682-751
  Homolog annotation: Hit_ID=CAC83611.1; Match level="QueryCoverage =86%, HitCoverage=40%, E-value=7e-14, Identity=43%"; Hit description =EXPB1 protein [Globodera rostochiensis]
MNAFFSFGIFLAIQFHAQFVLADVTASIKPSSTWNGGGQYILSFKNNDNSKTVCSVKFTLTPASGGTNPNGPPATPTLQLIEAKYYSN

SEQ ID NO: 134264 - protein, 132 aa, Heterodera glycines
  Coding regions on vcDNA: vcDNA=SeqID_60687; Strand=-; Position=1 -192,412-618
MNRHSIQYLTSIGCLKQSTPSHNRRVSSQESPRALMTLPGSSSRSLYSDLASPSGQYLFPSRIIKWENELNLTKTKLKSAFEEKMKEIIERFDELKELYMYPKKTAERICERIGHFGNDLYTMEKRIGAKLP

SEQ ID NO: 134265 - protein, 66 aa, Heterodera glycines
  Coding regions on vcDNA: vcDNA=SeqID_60688; Strand=+; Position=1 -135,363-428
MCRPFRYAILYYNQIGIISFNNGLVTPKQFKRMISINILIKYKFVVQIKHELHYFFRMCRPFRYAI

SEQ ID NO: 134266 - protein, 176 aa, Heterodera glycines
  Coding regions on vcDNA: vcDNA=SeqID_60689; Strand=-; Position=1-529
  Homolog annotation: Hit_ID=XP_320889.1; Match level="QueryCoverage =98%, HitCoverage=19%, E-value=2e-21, Identity=35%"; Hit description =ENSANGP00000012033 [Anopheles gambiae] ref|XP_313651.1| ENSANGP00000013044 [Anopheles gambiae] ref|XP_314
MNVDTGAQATVLTIETWIKLGQPKLLPTDIETRNCNDVTFKTIGKFRCLVSIMGQPAKKLTAYVTEELNYDLFGLPWIEATELIPKEIMFPETHTSVGIRASSAAPFQEIADVKSLTTALKENFPDVFGKELGQCTKIKAQLILKSDARPVFCKARPVPHGSLEAVNTELDRLLQI

SEQ ID NO: 134267 - protein, 425 aa, Heterodera glycines
  Coding regions on vcDNA: vcDNA=SeqID_60690; Strand=+; Position=1 -171,284-403,449-671,728-972,1134-1527,1594-1718
  Homolog annotation: Hit_ID=NP_499260.1; Match level="QueryCoverage =21%, HitCoverage=5%, E-value=1e-13, Identity=40%"; Hit description =clathrin heavy (3L297) [Caenorhabditis elegans] emb|CAA83003.1| Hypothetical protein T20G5.1 [Caenorhabdit
PSKSGLLYLFTKLGYVHLFDIETGTKVCNTRISDKAVLLSTELKEDDEVLCIDGSGKVISVGLDKSAIIPFILKHHKNTELALKFASRYNLDTDGVTSDSNNNDQPVAIQAHHQCQSVQQVLQRNSSVNAMGLLISVSNCFKNLVEHFQWSKFWHLQWDGTNAIVRVDPEKQNVGRIGSVSFTVTNRETCAIYFKIKSTSNSFYSICPENGIIQPKENVEVIIKPNDDELGQFARNNDQKAQVLDHGIELLFSVQKTPHNQQNSEQRKGSTNKGKMSKKGKQMMEQKEKASEPIEIPKADLGETSQHSEGLLEKRSKKTSPIPENLETILESDREQSQGLASPAPESFQGFELVPRVAETSNNSEGVSVQEPKVEANRSNSSVNPQYSAEIALSLLEKMSARDAVQFRIDLNSFLEKYEAKFLDE

SEQ ID NO: 134268 - protein, 139 aa, Heterodera glycines
  Coding regions on vcDNA: vcDNA=SeqID_60691; Strand=+; Position=1 -97,436-529,609-837
MSTLADFFLDDYIFIAYGTERISLDDFFVISEEVELPMELKEQVKILEVLGDGNTALVYKAAFRTEKRDKNEEEQWMTDALKIVREETLQNDEVLGFVRTEVGLLGVLSHEHIVQLRDVQILDGSWFIRMELVQVGVQS

SEQ ID NO: 134269 - protein, 138 aa, Heterodera glycines
  Coding regions on vcDNA: vcDNA=SeqID_60692; Strand=+; Position=1-417
MRFGQNEEEEDGHGDADSCDFAVSESSAEFFFSRRASMDELSEQGGSSSGPPMDQQQKTNANSDGTNKKGGIEAANVVGTSRRESVQKHIQIGTTTPATLALALNGTTMDGETATTTGKETPKVGRRVVVGQQQMRKT

SEQ ID NO: 134270 - protein, 71 aa, Heterodera glycines
  Coding regions on vcDNA: vcDNA=SeqID_60693; Strand=+; Position=1 -155,229-289
MKWMASQWNTLIAGWHWLWLDEVKMEEDEEIEDVSVVVPWAEEAEEDEQFPMAYRIPIFGIMTKYPRKCTS

SEQ ID NO: 134271 - protein, 59 aa, Heterodera glycines
  Coding regions on vcDNA: vcDNA=SeqID_60694; Strand=-; Position=1 -77,152-254
MHVHLQSVFVGYDHCLTTPSSPFQLRVEIGLAYLTSNIVKDIARLKFDCHLHDLIMVCF

SEQ ID NO: 134272 - protein, 97 aa, Heterodera glycines
  Coding regions on vcDNA: vcDNA=SeqID_60695; Strand=-; Position=1 -99,1229-1422
MVAPAWGDGPKKEEWPRNGGHGLCQFAHGELGDGTRTVPIDFEDERVSESPQLPPPPTVPIPMGHLNDSEFEQWCETEIDEAMEEYCDAVKQYTDKY

SEQ ID NO: 134273 - protein, 160 aa, Heterodera glycines
  Coding regions on vcDNA: vcDNA=SeqID_60696; Strand=+; Position=1 -360,681-803
MARTALRCARPNKWCPTLATKNHADFLWWLQMMIKNGTEMRKFFDIMLEQIKAEVDQFNKNCEEIVEKWAQKHKKSRTATNSSASIASCQNFGQNVPTLQSYYVYYQLFRHLNTIRAAQTMTSEHYLLSYWVATMTDQLKIQIKYFATKNGCAEMIQSLI

SEQ ID NO: 134274 - protein, 106 aa, Heterodera glycines
  Coding regions on vcDNA: vcDNA=SeqID_60697; Strand=-; Position=1-321
MAFQSLGLNPPAFQSLRLNSKAFQSLGLNPPAFQCLGLKSPAFQTLGLTHQLSMAFQSLGLNPPAFQSLRLNPPAFQSLGLNTPAFQSLGLKSPAFQTLGLNPPAF

SEQ ID NO: 134275 - protein, 38 aa, Heterodera glycines
  Coding regions on vcDNA: vcDNA=SeqID_60698; Strand=+; Position=1-116
RLIEPVKSFRMISRLFDSVNNFKSYIDSKLAQTELARR

SEQ ID NO: 134276 - protein, 23 aa, Heterodera glycines
  Coding regions on vcDNA: vcDNA=SeqID_60699; Strand=+; Position=1 -45,456-482
MRLHVHHAHQAVISSILTAFSPI

SEQ ID NO: 134277 - protein, 268 aa, Heterodera glycines
  Coding regions on vcDNA: vcDNA=SeqID_60700; Strand=-; Position=1 -21,84-314,803-967,1514-1602,1991-2291
MLCFLILPPTKCQSSLTPLMAHRGQLLPPHRTTAHLPAESPPPPRRFATGGRTQVLPLTAQNCRRVTPLVMLMADQQQQQRQQQTLSVQIARGRMPTTSDSRATTTTGTNSAMKSCATIHEDPEEANRLLSDELLSIDRVQPPSYSPPEPPNNKPLTINICRESINFSRCSYGGAQTPLNTTTGSSSADPSVDSILNGCGRRGAQVRISELESEINADGTPNCANVVTGQLEPSCHAVMCRRVPRSISQQLELMNMAQQQQPSPDQQQ

SEQ ID NO: 134278 - protein, 68 aa, Heterodera glycines
  Coding regions on vcDNA: vcDNA=SeqID_60701; Strand=+; Position=1 -94,185-297
MHAFCARAIYHRACQSKAKQQRCCFERIKGIESVHILLEKYICNLSTILRSELEMINFTIQTNFRCSN

SEQ ID NO: 134279 - protein, 83 aa, Heterodera glycines
  Coding regions on vcDNA: vcDNA=SeqID_60702; Strand=+; Position=1 -208,863-906
MRLQARQLGMAVEECFPDWPKLRQQYCRIRKQAVRERMQRNWEMMVMMHGGERMIDEDFDGQEQYYDGSDEPINKNPIVEQNQ

SEQ ID NO: 134280 - protein, 39 aa, Heterodera glycines
  Coding regions on vcDNA: vcDNA=SeqID_60703; Strand=+; Position=1 -65,432-486
MQKISKRHYIQQLKNSQKAAAGKCKKKHSSKKRKPINVQ

SEQ ID NO: 134281 - protein, 128 aa, Heterodera glycines
  Coding regions on vcDNA: vcDNA=SeqID_60704; Strand=+; Position=1 -135,191-253,420-608
MAFSTVCMLMDFFKWMAFGVGTICNVLMSRLIIWHTPKLMRIYSKILLQTCAADLLLLIMTILFIPKIIIIYFQNKVLCHLVHLYNEQRRTDTDSRWFDQFEWINGRKSWLDFASLCFLDFSRNGIIV

SEQ ID NO: 134282 - protein, 173 aa, Heterodera glycines
  Coding regions on vcDNA: vcDNA=SeqID_60705; Strand=+; Position=1 -180,287-398,449-489,626-814
  Homolog annotation: Hit_ID=NP_491571.1; Match level="QueryCoverage =64%, HitCoverage=25%, E-value=1e-11, Identity=40%"; Hit description =predicted CDS, putative endoplasmic reticulum protein (1F911) [Caenorhabditis elegans] pir||T15188 hypoth
MGTKNGRIPYELLFELISALPFDIRWAVTRVSKAFDGFVWQKQFSWVRAELTRKEAQRQKEAAQSLSTAAHSLSTAAQSLSNSAFNKNKLFFNLLTKQMCSVRQLTVDMLQGIEAQQAVKKGGRIPKAGCSSAGGGRGGGAGRKGGGRGGGAGRKGGGRGGGAGRKGGGRGGR

SEQ ID NO: 134283 - protein, 51 aa, Heterodera glycines
  Coding regions on vcDNA: vcDNA=SeqID_60706; Strand=+; Position=1-158
SNYEETGMFGGMNIYHQKYFTVPLPEFRPEAAALGASTHSVSQSPTVRASA

SEQ ID NO: 134284 - protein, 181 aa, Heterodera glycines
  Coding regions on vcDNA: vcDNA=SeqID_60707; Strand=+; Position=1 -289,350-486,962-1081
MDPINGFYSNNEDNVTLTVDFILKNAEMGLFASSVPRTSDRTINWEIEKVSEFFREAIGSERKSETVHIKGFPWKIVAKLSQFKDLDFFLLCAIPKTSNWSCKCSATLRIGSDDFSDRFDNLIFNNELPICRFDVGLPFSHLELIGTNKGWYDKEEDKVTVVIDFLFDDEKMEKPYGSIFS

SEQ ID NO: 134285 - protein, 106 aa, Heterodera glycines
  Coding regions on vcDNA: vcDNA=SeqID_60708; Strand=-; Position=1-323
PGRPRKSLTNFDPTCADYRSLHRILMSDKERAEMYRKRNQQQRERRRQMTKDELAEARAKARQKAEERRARMDAAQLETARRKHAEQRRKYREKVRRAEQRGKRNE

SEQ ID NO: 134286 - protein, 602 aa, Heterodera glycines
  Coding regions on vcDNA: vcDNA=SeqID_60709; Strand=-; Position=1 -441,967-1309,2024-2382,2440-2524,3435-3631,3770-3888,3977-4122,4355 -4473
  Homolog annotation: Hit_ID=EAL49477.1; Match level="QueryCoverage =96%, HitCoverage=50%, E-value=2e-24, Identity=22%"; Hit description =hypothetical protein 42.t00003 [Entamoeba histolytica HM-1:IMSS]
MANSQVTYTVFDSDCLMLSDLELTDSTVLRLDEDESDGGEGEEEEEDAFHQNRMFLLTEEAEETKRGSFLDRSVILDGPTLNLALPVIESNKMRAEEENEETPTPMVEMSRTDDFRRERDEDRLNRNHLRLEFAAKSEPTQKTTTAAASLFPSAPPANPMRTKCKAPSKSQMIMDQLKASIEAEKQRAKRKKEEEEEKRKRDEEEKKRKEEEEEEKKKKEEEEEKKRKEEEEEKKKKKEEKKKREEEEKKRTMDAEKSELNVALPRSHSRSRITPSARPVLSSRENTSIALKGTAPMSGMTRRSMTTKSQSVEHVAVAQKHLSGIGRNIANGRTKESKSANASDRQRKEVEDELNRTKQMLKQTTKTLDVFAVVASHFDRKLDNANTESAVLMAQKGDEAAQHQRAIAEQTSQRIGESELRIANEERRNVQIETGKSRIAIRSGQIARKRGPNSQIGSTNWRLARRSEPFETVAKLEGYQHELNDIRVKADAVVKEKEVLEYQLNGQNGGEANNGTPRTRKSFAVPSVSASTPPNRTPETQRKRTSHLSMSCHSNGKANTPRFVPPDSSSNGRRVVNFDSTREDNEEPNRAVDSEEKCDRSP

SEQ ID NO: 134287 - protein, 210 aa, Heterodera glycines
  misc_feature (75)..(75): Xaa can be any naturally occurring amino acid
  misc_feature (81)..(81): Xaa can be any naturally occurring amino acid
  Coding regions on vcDNA: vcDNA=SeqID_60710; Strand=+; Position=1 -75,137-194,275-540,597-758
  Homolog annotation: Hit_ID=CAE56180.1; Match level="QueryCoverage =100%, HitCoverage=23%, E-value=3e-39, Identity=44%"; Hit description= Hypothetical protein CBG23800 [Caenorhabditis briggsae]
PERMKNEQWFRPKVIFWNIGINHEASLAASIGDSLAASIGDISLEEEINRTAAIAIAYGTAANGGRASKRSEEGXGKVLKXVSSCPSKKNWAIFTQVMALNSASGGVPIICCKSGKDRTSMGVTLDEGRILKESCGVSNQQISEMIKCLRKNGVRRISEMIKCLRKNGVRRENCRKNIGKPFYSFSPFQLGFLPPPFRPPSGTFSNVVSS

SEQ ID NO: 134288 - protein, 88 aa, Heterodera glycines; identical to SEQ ID NO: 124691
  Coding regions on vcDNA: vcDNA=SeqID_60711; Strand=-; Position=1 -96,135-305

SEQ ID NO: 134289 - protein, 101 aa, Heterodera glycines
  Coding regions on vcDNA: vcDNA=SeqID_60712; Strand=+; Position=1-420
FVFPGRRTKKFVGKREGTNWGGGGRKPNETRSKSGDAEKPRRREKGGGVVEARREGRMTPNDGSDWRGVGVPAVSHLAVPQILSCDQKEGLLNNLLRDGII

SEQ ID NO: 134290 - protein, 304 aa, Heterodera glycines
  Coding regions on vcDNA: vcDNA=SeqID_60713; Strand=+; Position=1 -174,218-518,880-992,1389-1495,1743-1868,1955-2048
  Homolog annotation: Hit_ID=XP_426694.1; Match level="QueryCoverage =43%, HitCoverage=6%, E-value=7e-10, Identity=32%"; Hit description =PREDICTED: similar to mKIAA0804 protein [Gallus gallus]
MCEHMQHTVRKEVLSDCDIAQGNKLLLYLSCCLAGRAYPYGELPDEHLAKTVPLETYKFLVQLRPKFVTGPPSSATTTPSPTTASKEDDQGGYGIALDAAAVVQPINNNHVDNNNSSNKPSVADLRFPHLQLLLKLDPQQFLNVINTCADAPVFASVDVDQTGVATSVSECACPETGRTAHCGPVESGARNRLGQCLAAHLVLSHLPGLLADAQSNPRKLPFQFIRQCFALRHHYHFVGQRVGGLVALLASAWCSDGPLSERGHAMAAAETAQCCPLLLLQCFSCPYVDHFASAGRPGAHPTRI

SEQ ID NO: 134291 - protein, 45 aa, Heterodera glycines
  Coding regions on vcDNA: vcDNA=SeqID_60714; Strand=+; Position=1 -132,778-783
MPVSNANETKNPSAGKNDREMDERWAKKREDSEDSLTRRELTPAG

SEQ ID NO: 134292 - protein, 42 aa, Heterodera glycines
  Coding regions on vcDNA: vcDNA=SeqID_60715; Strand=+; Position=1 -51,688-765
MSMHFHKNGFEKYIKKLFDLGFIGNFGSTCTVLDSLCCAVYF

SEQ ID NO: 134293 - protein, 259 aa, Heterodera glycines
  Coding regions on vcDNA: vcDNA=SeqID_60716; Strand=-; Position=1 -48,107-316,361-492,539-748,903-962
  Homolog annotation: Hit_ID=CAE71970.1; Match level="QueryCoverage =99%, HitCoverage=4%, E-value=4e-77, Identity=54%"; Hit description =Hypothetical protein CBG19042 [Caenorhabditis briggsae]
SFSPIFEALNCPLTVQECLSFGDTSKNVFAGPECLSFGDTSKNVFAGPSALFHAIEPFVPCPVDTAHIALPNFALEAHLRFAENLHELWAMRKVDLGWTYGEVRNEQTKRHPCVRNEQTKRHPCLTNFERLPDTEKAYNVSLALDTMRTIEALGWHMILDQPPTRLRPVILDQPPTRLRPVRLPQNYAQANGYKPQPLDTHEIELSEAMEPLIEALAGNTHNVWAKEKIRRGWTFGISEFVDASQKRTPHLVPYDQVDE

SEQ ID NO: 134294 - protein, 70 aa, Heterodera glycines
  Coding regions on vcDNA: vcDNA=SeqID_60717; Strand=-; Position=1-213
MSTNMSSHGRRQRLERSSSSIRELQQLQEIALAIENLAAPNPRRRHDSSAGESEHGEILMAINQLQQVDE

SEQ ID NO: 134295 - protein, 67 aa, Heterodera glycines
  Coding regions on vcDNA: vcDNA=SeqID_60718; Strand=+; Position=1-202
MDLLVSLELLDLHYNMIARLPDELFRCLVLRTLDISGNQSLNIGNLQTWPSWCCARTKSGTCPAQSG

SEQ ID NO: 134296 - protein, 95 aa, Heterodera glycines; identical to SEQ ID NO: 133575
  Coding regions on vcDNA: vcDNA=SeqID_60719; Strand=-; Position=1 -124,620-1135

SEQ ID NO: 134297 - protein, 88 aa, Heterodera glycines
  Coding regions on vcDNA: vcDNA=SeqID_60720; Strand=-; Position=1-465
STGYREAIPEGFGLPINLGASVRGDCPENKKIDFFKCPFGVLKQLWGAKIQRRIKVQAIGKLFPKDSVSQKSGRIGSGGLPPKQNKSI

SEQ ID NO: 134298 - protein, 74 aa, Heterodera glycines
  misc_feature (19)..(19): Xaa can be any naturally occurring amino acid
  Coding regions on vcDNA: vcDNA=SeqID_60721; Strand=+; Position=1-264
SPNVLDCSEAHQILQGNCXRTLQMLINFLRIFCLEEHSSSHLPHQHYFFLIIFFILSPNVLDLSEAHQILQGNC

SEQ ID NO: 134299 - protein, 85 aa, Heterodera glycines
  Coding regions on vcDNA: vcDNA=SeqID_60722; Strand=-; Position=1 -317,350-457
GPERLGPRFWAPAFGPPFLGPGVVWAPVFGPRGRLGPTQKSKSAFLKIKILKTKPEGSLATWHKLGLINIRSFFTILLIPNPIIF

SEQ ID NO: 134300 - protein, 93 aa, Heterodera glycines
  Coding regions on vcDNA: vcDNA=SeqID_60723; Strand=+; Position=1 -21,301-475,554-639
MTNRINFQFSNVYLPKSMPRANDLAFATTACDSLLITAQSSTFSWWIAYLMPDNATIFYNSKITKNIYTTNENFLAEWVPIELVNGNIMLSNG

SEQ ID NO: 134301 - protein, 181 aa, Heterodera glycines
  Coding regions on vcDNA: vcDNA=SeqID_60724; Strand=-; Position=1 -93,139-284,366-531,718-858
MAGPDSRFILEFFNREAKEIGVTQELLDNSQPSDQLIQAYYFLCDLIFENVGTTKENEYEMATELTRARAKMIIRTQQHCNLVYNKLFDGSNEFLYSDLFQPDPRRTKMHIAQLIRLYTTKCDIAKELSAVDNHIQLKDREEALNRMETRNDEMGSKVRRFKDKLNDRQALVEDEKSRVER

SEQ ID NO: 134302 - protein, 89 aa, Heterodera glycines
  Coding regions on vcDNA: vcDNA=SeqID_60725; Strand=-; Position=1 -207,350-409
MPFSDFDGRAMQNDFLRSNGPSFLSDYADLWLLALDMLPMAHQTAEEQREQLKMELFISRSSNCSMEAWFVQPSDSVGPSDPKMPFDDS

SEQ ID NO: 134303 - protein, 45 aa, Heterodera glycines
  Coding regions on vcDNA: vcDNA=SeqID_60726; Strand=-; Position=1 -124,226-239
MATKMAQSFGAPLKCAQCQCKRITMTKKDQSFWSHQLPLRNLKRL

SEQ ID NO: 134304 - protein, 78 aa, Heterodera glycines
  Coding regions on vcDNA: vcDNA=SeqID_60727; Strand=+; Position=1 -157,497-576
MNENEKQKEFVKLFKKYKKQNKEIMNLEIAKKLGIHQNKLLEFRKRFDPTYKINARENDDEANSEEDRHFFYLTAKIM

SEQ ID NO: 134305 - protein, 19 aa, Heterodera glycines
  Coding regions on vcDNA: vcDNA=SeqID_60728; Strand=+; Position=1-59
TFAFSSLALPNTHTIFEML

SEQ ID NO: 134306 - protein, 19 aa, Heterodera glycines
  Coding regions on vcDNA: vcDNA=SeqID_60729; Strand=+; Position=1-59
TFSFSSLALPNTHTIFEML

SEQ ID NO: 134307 - protein, 19 aa, Heterodera glycines
  Coding regions on vcDNA: vcDNA=SeqID_60730; Strand=+; Position=1-59
TFAFSSLALPNTHTIFEML

SEQ ID NO: 134308 - protein, 19 aa, Heterodera glycines
  Coding regions on vcDNA: vcDNA=SeqID_60731; Strand=+; Position=1-59
TFAFSSLALPNTHTIFEML

SEQ ID NO: 134309 - protein, 19 aa, Heterodera glycines
  Coding regions on vcDNA: vcDNA=SeqID_60732; Strand=+; Position=1-59
TFSFSSLALPNTHTIFEML

SEQ ID NO: 134310 - protein, 19 aa, Heterodera glycines
  Coding regions on vcDNA: vcDNA=SeqID_60733; Strand=+; Position=1-59
TFAFSSLALPNTHTIFEML

SEQ ID NO: 134311 - protein, 19 aa, Heterodera glycines
  Coding regions on vcDNA: vcDNA=SeqID_60734; Strand=+; Position=1-59
TFAFSSLALPNTHTIFEML

SEQ ID NO: 134312 - protein, 119 aa, Heterodera glycines
  Coding regions on vcDNA: vcDNA=SeqID_60735; Strand=-; Position=1 -9,421-702,793-860
MPQEVGRTTVAELTYFDPNNPNRVMMMKKKIYFSWDVRQITISAYLGTGHICTEQTDFDQWTNKSYLEFFPDQWVELQNNTGCDDNALVTFKINLEEATQTFYWFKIFKIQFTMITKIL

SEQ ID NO: 134313 - protein, 63 aa, Heterodera glycines
  Coding regions on vcDNA: vcDNA=SeqID_60736; Strand=-; Position=1 -18,461-634
MEEFINLIPELHANSRTWRSIVTMDEFSQFQSTPTVPMDIGDTTPPPHATNDRSNTSNKSTIT

SEQ ID NO: 134314 - protein, 179 aa, Heterodera glycines
  Coding regions on vcDNA: vcDNA=SeqID_60737; Strand=+; Position=1 -259,493-636,687-823
MAAKPIFFCGSHETVAEFGGWGGRSLLWWAKGTLKEARCRGNSKHYKIVLVFSFCRLTNSFLMAASDVFEAMFRFDSANATTSTSKPPSDLASSSNPVVVSDVDADVFRAMLGFIYADDLSGMNGDNLFDVLYAAKKYNIAGLVKACAEFPISELGNVFHTLAEARLFGEKVTFSRNTN

SEQ ID NO: 134315 - protein, 107 aa, Heterodera glycines
  Coding regions on vcDNA: vcDNA=SeqID_60738; Strand=-; Position=1-324
MADDSQSCYLELARNDEDGTLMLFNGISAKTLGQLLQQRIDELDTETNFWMMGLDVLVNRFDEEREYFRQLLANFNTAIGAMNAEDQRKRLGGRKCGGQTAGEENEI

SEQ ID NO: 134316 - protein, 97 aa, Heterodera glycines
  Coding regions on vcDNA: vcDNA=SeqID_60739; Strand=-; Position=1 -108,175-360
MSTKSDIWSLGVTIYELLLIQPHFGLYKKPNQRSNKHNKFLSEFSNIYKGFAFDKKDKEFEYCTNDLDWLDGHLDQIDQMIRIWNEQHPRIALLLTV

SEQ ID NO: 134317 - protein, 224 aa, Heterodera glycines
  Coding regions on vcDNA: vcDNA=SeqID_60740; Strand=+; Position=1 -70,1212-1610,1864-2068
  Homolog annotation: Hit_ID=AAO50779.1; Match level="QueryCoverage =71%, HitCoverage=10%, E-value=1e-10, Identity=24%"; Hit description =similar to Mus musculus (Mouse). Sex-determining region Y protein (Testis-determining factor) [Dictyosteli
ILGPPTVVTRDGHQQRGRVNGNHQSNNMGKLAAATAGATAHNHHHHHHHNHHHRNHHYHNNNHHSSSSARNGSSSAAATTTVAHHVATGEQATGGMPTLPLVVASLSNGGNAMDNATVPRTPASGGSTFDELFKPSTNGYCSTNNNNNNTNSVMNTQQQQLMATQMMAHMFAAAQQQQQQQQLISAGGTDQQVAAAAAAAAATTLMATAQMAAHMAAASAAGGF

SEQ ID NO: 134318 - protein, 148 aa, Heterodera glycines
  Coding regions on vcDNA: vcDNA=SeqID_60741; Strand=+; Position=1 -282,518-601,980-1060
  Homolog annotation: Hit_ID=CAE61305.1; Match level="QueryCoverage =44%, HitCoverage=6%, E-value=1e-15, Identity=62%"; Hit description =Hypothetical protein CBG05139 [Caenorhabditis briggsae]
MAAAGGANACGGGGVPPPTTTSGAATTPLLSQLTLPLTPSAMPSTGTGNNSNGGGSNGCGGAGATNGSSNAPSPSPQKRARTRIADEQVKILRQYFDINNSPSEEQIKEMAHKAQLPEKVIKLITLSIIDQIKPFYAHFGGKILKNIS

SEQ ID NO: 134319 - protein, 231 aa, Heterodera glycines
  Coding regions on vcDNA: vcDNA=SeqID_60742; Strand=+; Position=1 -463,900-1130
  Homolog annotation: Hit_ID=CAE65084.1; Match level="QueryCoverage =41%, HitCoverage=84%, E-value=5e-14, Identity=47%"; Hit description =Hypothetical protein CBG09942 [Caenorhabditis briggsae]
MEEDEQQQEKNREEEEEKREREEEAEKGKEEEEAERMMDNKEEEEEEQAEEEEQKLKDEGRMEEEEEDRRHRHGDEALVERHGDKASSSPPSHSAAAFVDPGTFLASLGNPTAQQSAAMMPPLFPFFGTGAANSAAATPGASGGGMESFASMFSAFPFHSFGQLATAASSSTPTSNGFSSPSAAQQQQQQPSPFLQPSPAGLMAAAAAAAAGTNNGGTFGHLFSGQNMLLN

SEQ ID NO: 134320 - protein, 245 aa, Heterodera glycines
  Coding regions on vcDNA: vcDNA=SeqID_60743; Strand=+; Position=1 -48,223-282,336-490,602-743,1100-1432
MSTASESGSDKIVFQKNTSSANDNAQSNQQKEQVQKWKVGDQCMALYEVDGKWYPAKIEQISPVKNTCTVSYIGYDQKAILKLEDILGSAEFAANSHFQHHSVDLNWYFNTSHSLSFFEQTPPIKRRRLSIEQPIALTKFLPESNCCIGNEKSGTTSDNLKTPDFVSENSTTVRLYLEGIRDKLRPNMSGIVVSNVFNFYLSESDVEAADDHGDEREAEGTSGTTKAKDKLEKAIFPFLRLRTMM

SEQ ID NO: 134321 - protein, 56 aa, Heterodera glycines
  Coding regions on vcDNA: vcDNA=SeqID_60744; Strand=+; Position=1 -27,78-166,210-264
MLKKQDTKALTANAVVLAGLSVATSVAFYNIDKISAYWTMPFTLWAIFCAGLTVKA

SEQ ID NO: 134322 - protein, 134 aa, Heterodera glycines
  Coding regions on vcDNA: vcDNA=SeqID_60745; Strand=+; Position=1 -47,236-296,358-511,923-1065
MAFKMEVAAEEPKLMPGLRNEHALVVNGKVLFVNKYLLAAHSKFFEELFFGANAKETPEIEIKEVENAAEHFERVLSVMYPQNIELDEENSAGDEQGGLCGDGDQLHGQSVEQQEVGGGRSGGTDGTPQRIVQK

SEQ ID NO: 134323 - protein, 125 aa, Heterodera glycines
  Coding regions on vcDNA: vcDNA=SeqID_60746; Strand=-; Position=1 -214,1275-1438
  Homolog annotation: Hit_ID=NP_506013.2; Match level="QueryCoverage =41%, HitCoverage=9%, E-value=3e-11, Identity=63%"; Hit description =ADDucin, spectrin assembly factor, adducin head domain related (add -2) [Caenorhabditis elegans]
MGQGNGASTYSAPPPSAVVSHGRARHSLDNSQRTMPRNAGPREIGGLEGGTTTAREWCRKRGRNSAVGAATPKPLVPIADLGDSNKYSAEETDCRNKLASLYRLVDLFHWSQAIYNHITVSQKQG

SEQ ID NO: 134324 - protein, 41 aa, Heterodera glycines
  Coding regions on vcDNA: vcDNA=SeqID_60747; Strand=+; Position=1 -82,501-544
MPQGTECGRKWDKGHRRTAKRSARSSVVNFYLFVNILSILL

SEQ ID NO: 134325 - protein, 115 aa, Heterodera glycines
  Coding regions on vcDNA: vcDNA=SeqID_60748; Strand=-; Position=1 -126,364-448,556-692
  Homolog annotation: Hit_ID=NP_491243.1; Match level="QueryCoverage =57%, HitCoverage=30%, E-value=2e-14, Identity=50%"; Hit description =guanylate kinase (24.9 kD) (1E428) [Caenorhabditis elegans] gb|AAB42236.2| Hypothetical protein T03F1.8 [
MRSVVPHFPPLPALRDFIYMYRMDADKTLSQNYLMDMNLTRKEQRLRQRGSETEETIAKRLKHAKEDMEAVEKQPSLFDYVVINDILDKAYNDFLDVINPELDALQKQKQHQQQQ

SEQ ID NO: 134326 - protein, 30 aa, Heterodera glycines
  Coding regions on vcDNA: vcDNA=SeqID_60749; Strand=-; Position=1 -42,579-629
MAFVLQESVLAFKKTRQRRNPAKGRDPDKS

SEQ ID NO: 134327 - protein, 157 aa, Heterodera glycines
  misc_feature (155)..(155): Xaa can be any naturally occurring amino acid
  Coding regions on vcDNA: vcDNA=SeqID_60750; Strand=-; Position=1 -87,147-229,799-820,873-943,1021-1114
  Homolog annotation: Hit_ID=NP_494974.2; Match level="QueryCoverage =94%, HitCoverage=14%, E-value=3e-32, Identity=53%"; Hit description =Adenosine/AMP deaminase (85.4 kD) (2F499) [Caenorhabditis elegans] gb|AAO21474.1| Hypothetical protein C3
QLSPFLKFLMKGLNISLSTDDPLRLHITKEPLLEEYSNARILWKLSSEPLLEEYSNARILWKLSSCDMCELARNSLQSGFEDRTKMYWLGSNYKEEGDRTKMYWLGSNYKEEGVFGNDMTRTNVPDIRTNVPDIRVSFRHEALVSELYNQALMLXMK

SEQ ID NO: 134328 - protein, 201 aa, Heterodera glycines
  Coding regions on vcDNA: vcDNA=SeqID_60751; Strand=+; Position=1 -36,90-659
MLSEDGSRDNQMERSLVRGVEGHDDLSGRIGSLSLRTIHQQQPVTLPADRGRAGPLDDGQPPTQSAGRRRTRRRGKRRPLNLVKALCRFNGGCMPSVLPQMIQRRRIENLCFLRDLRLQTVHLKSNIMISANSLSFHSAGSLLAYRGYLSITVEQHLYVRHRVRLRFPFLPCVVQYGGNHHHYYFPLELLEICSRPTDESS

SEQ ID NO: 134329 - protein, 159 aa, Heterodera glycines
  Coding regions on vcDNA: vcDNA=SeqID_60752; Strand=-; Position=1 -196,427-710
MVDERTGEIRYVQKIRGITFDVQNSQTLQFEHFRQKVLNYGRQGEEPAVFHYDKIQPTRASQIVTRQEISSDNMDNSECKTEKEMDLKPEEKGHGEEKGEEEIVFLGMTINETPKDEKKELPPSTSSGDSRKRRHSFDGSATSMLGAMIKAQGEARAEW

SEQ ID NO: 134330 - protein, 40 aa, Heterodera glycines; identical to SEQ ID NO: 126546
  Coding regions on vcDNA: vcDNA=SeqID_60753; Strand=-; Position=1-181

SEQ ID NO: 134331 - protein, 86 aa, Heterodera glycines
  Coding regions on vcDNA: vcDNA=SeqID_60754; Strand=+; Position=1-258
MTYKLIGSPKIKACKEQAVLYDGSTRSFIGKGTGTFEFNGVNVEQEFYVAGKDSLNLLSIQTMDAFGLLDELKEKISSKMVICAKA

SEQ ID NO: 134332 - protein, 181 aa, Heterodera glycines
  Coding regions on vcDNA: vcDNA=SeqID_60755; Strand=-; Position=1 -135,255-365,425-520,586-789
MVFNALFRHLLGHVLIIERFLATISTNSYENFSKMQFTFIWLIITFIIAFVNTVTNGQSWTFTTLNLITQTMSTVISLFEYLLIIVIRNYNCRRYISQFEEASPKNYHIGQRYQVSENVKTATQLSPTFLCLFLTNLSSNFFVFVTTFGIVTESNNICLTFAFGIWTDVFLSAATELTIMT

SEQ ID NO: 134333 - protein, 30 aa, Heterodera glycines
  Coding regions on vcDNA: vcDNA=SeqID_60756; Strand=+; Position=1-91
MLNIFSTNKINFNLLVPGSRPVVFLASGQA

SEQ ID NO: 134334 - protein, 19 aa, Heterodera glycines
  Coding regions on vcDNA: vcDNA=SeqID_60757; Strand=+; Position=1 -55,312-316
MNGPKSGENSGKKKQIKKV

SEQ ID NO: 134335 - protein, 71 aa, Heterodera glycines
  Coding regions on vcDNA: vcDNA=SeqID_60758; Strand=+; Position=1 -15,532-594,641-778
  Homolog annotation: Hit_ID=NP_505385.1; Match level="QueryCoverage =91%, HitCoverage=11%, E-value=4e-21, Identity=66%"; Hit description =innexin, putative gap junction protein, OPUs gap junctional protein (65.3 kD) (inx-10) [Caenorhabditis el
MVLTTQFGGKPIECLTPDIFSSSWEEYAENYCWAQDTYFVAPSTNVESLEKIERKQRRISYYQWVGVNMHR

SEQ ID NO: 134336 - protein, 155 aa, Heterodera glycines
  Coding regions on vcDNA: vcDNA=SeqID_60759; Strand=+; Position=1 -144,360-391,439-529,912-1112
  Homolog annotation: Hit_ID=NP_509132.1; Match level="QueryCoverage =80%, HitCoverage=25%, E-value=3e-41, Identity=59%"; Hit description =yeast SMF (divalent cation transporter) homolog (smf-1) [Caenorhabditis elegans] gb|AAC46569.1| Yeast smf
MRTSNSASSAAVADDANGGRNSSDDSPPVEPEEEALDYMVTIPETDGESAFSFRKLWAFTGPGFLMSIAYLDPGNIESDLQSGTVARYRLLWVLLLAHCVGFFLQRLSARLGVVAGRSMAELAFEYYPRVPRLCLWAMVEIAIICQFNTLISHYK

SEQ ID NO: 134337 - protein, 88 aa, Heterodera glycines
  Coding regions on vcDNA: vcDNA=SeqID_60760; Strand=+; Position=1-267
MTYPFLRYSILIVILCLVYGNDDENRQEAIHKNDDYIIGDVYLGDEFWDQFSPITDLPTIDGVEFIGNHLKYTDQTENDKTHESVIEK

SEQ ID NO: 134338 - protein, 184 aa, Heterodera glycines
  Coding regions on vcDNA: vcDNA=SeqID_60761; Strand=-; Position=1 -318,388-624
  Homolog annotation: Hit_ID=XP_309989.1; Match level="QueryCoverage =82%, HitCoverage=63%, E-value=2e-16, Identity=29%"; Hit description =ENSANGP00000015194 [Anopheles gambiae] ref|XP_319667.1| ENSANGP00000022407 [Anopheles gambiae]
MALLFQQLTDTLKNIANQNANPNKQNSDLFATINSQLSEFIYNPEADLVFEIWHERYGPFLETDGQSLPDEMKTRLLVGKLGAQEYARFTESILPQKPTDLSYNVTLQKAPSQSPIDFAAQVSAQCERAQMTLTKEEIKALVFISGLSSADRDLRERCLKMMEEDRAKNTDIKFERLVEECRSI

SEQ ID NO: 134339 - protein, 96 aa, Heterodera glycines
  Coding regions on vcDNA: vcDNA=SeqID_60762; Strand=+; Position=1 -130,615-775
  Homolog annotation: Hit_ID=AAF76926.1; Match level="QueryCoverage =56%, HitCoverage=28%, E-value=9e-25, Identity=98%"; Hit description =hypothetical esophageal gland cell secretory protein 12 [Heterodera glycines]
MEYTYVGFTVHLNVFSFTFNCAGVHRARNELEFHTECYVEVASGDYVNGTMLTGLCRQILLEDLKESRKHDILEWTEVPQKLKEQLEKQEFDQKCN

SEQ ID NO: 134340 - protein, 94 aa, Heterodera glycines
  Coding regions on vcDNA: vcDNA=SeqID_60763; Strand=+; Position=1-285
MPSSYGTSGAMSQSYGMGGGGPPAAYDTGARGSYGSAGAASYGTGSMGSGASYGQAEPKMSVAMPSAMPPPPAMPMAAPYGGDGSGRYGNDGRR

SEQ ID NO: 134341 - protein, 89 aa, Heterodera glycines
  Coding regions on vcDNA: vcDNA=SeqID_60764; Strand=+; Position=1-398
  Homolog annotation: Hit_ID=EAK87022.1; Match level="QueryCoverage =77%, HitCoverage=23%, E-value=9e-09, Identity=48%"; Hit description =hypothetical protein UM06140.1 [Ustilago maydis 521] ref|XP _403755.1| hypothetical protein UM06140.1 [Usti
NPPPTPLPSPQPCGQYNQYGSGGAFGGGGGGSYSQPNCNTYGQQNNYGQSNYGGQSNYGQQESAGGFGGIGGSPSQFGVGAPGCGGASC

SEQ ID NO: 134342 - protein, 256 aa, Heterodera glycines
  Coding regions on vcDNA: vcDNA=SeqID_60765; Strand=-; Position=1 -253,319-525,575-697,1119-1238
  Homolog annotation: Hit_ID=CAE64495.1; Match level="QueryCoverage =93%, HitCoverage=76%, E-value=7e-40, Identity=37%"; Hit description =Hypothetical protein CBG09221 [Caenorhabditis briggsae]
EVGITILNSMLVSVPFPSTRLFWSVQENGEWGEEEFHSNPFFHGKPFDVRIRVHEKRFDFFVNQVPWAVFEHRTDFRKIDHIQASGDVASGDVSLSAVHWGGRYFEMPYEMTFHDHALESGQRLFVYGIPRGDFAVSLISDSLEELFRMSALFDKQIVVRNAQTDKEWGAEESEGVVRNAQTDKEWGAEESEGGPFPFRKGEGFDLVILNEPLALQISINGTPFCSFFHRTIDAHKDYKQVRISGEVELTGMEVSL

SEQ ID NO: 134343 - protein, 169 aa, Heterodera glycines
  Coding regions on vcDNA: vcDNA=SeqID_60766; Strand=+; Position=1 -80,137-290,343-618
MPQAQSVILLAHDGHNTDLASETLTASARLSKKVPIFAIAGGKTPPALAKLDEYTGGQRRRVFAFEQDGQQFLDALDEEIEFCPSPSSVPAEKNEAEPSPSVALAAEAEKPIQKSEVKKPMEIIRKQVRNSKDLVKLECGTNSGEVRNNCKFNNPLGQKIKNKCLGFMT

SEQ ID NO: 134344 - protein, 90 aa, Heterodera glycines
  Coding regions on vcDNA: vcDNA=SeqID_60767; Strand=+; Position=1-274
GKMTFCCCHLFCGNRDKKAAFVRLGSAMKHFDRDIVPTSDGARRRRKSEQKLRLETDEQRMRLEMERRTKTRKQIGERKRRRLSTDDNWE

SEQ ID NO: 134345 - protein, 55 aa, Heterodera glycines
  Coding regions on vcDNA: vcDNA=SeqID_60768; Strand=-; Position=1-169
CCSKMVRKKKRDQKRRKEEDDDEDQEVEEKRQKLNFSEKDTELFVGGIKLGQRSS

SEQ ID NO: 134346 - protein, 131 aa, Heterodera glycines
  Coding regions on vcDNA: vcDNA=SeqID_60769; Strand=+; Position=1 -249,294-438
DPTFIQPFALLYVASIFAQFPLFFTPFECFLKWAFTLWHFALCQFLANFVWRIRLAEFAQFTVVKLALFQMILAQFYADFCHRLIFGSNFAFLPMMVPSVACALLVFFAYCHFILIVFAESVQIHFFKFRC

SEQ ID NO: 134347 - protein, 39 aa, Heterodera glycines
  Coding regions on vcDNA: vcDNA=SeqID_60770; Strand=-; Position=1 -115,479-483
MNALMLSALSTFFVLFCAIVGGGVIRKAQDTEQPPMATG

SEQ ID NO: 134348 - protein, 20 aa, Heterodera glycines
  Coding regions on vcDNA: vcDNA=SeqID_60771; Strand=-; Position=1-63
ETPGGVRQTPREKLATDQTT

SEQ ID NO: 134349 - protein, 558 aa, Heterodera glycines
  misc_feature (18)..(18): Xaa can be any naturally occurring amino acid
  Coding regions on vcDNA: vcDNA=SeqID_60772; Strand=+; Position=1 -219,318-371,469-518,788-906,950-1116,1225-1356,1685-1832,2117 -2287,2622-2801,2854-2897,2946-2975,3025-3087,3343-3474
  Homolog annotation: Hit_ID=AAR30497.1; Match level="QueryCoverage =93%, HitCoverage=36%, E-value=1e-102, Identity=44%"; Hit description= RhoGEF [Caenorhabditis elegans]
SARVDALGTVKRGTINHXWLNIFYFYFRYNRAKDDPFSLFLAEAENNPCRKLQLKDMIPAEMQRLVKYPLLLETVAKYTPEPSDELQRLLSGIQGAKNIVSEVNSAKRNAENVRRMEELQKKLDFSGAEKSFFQNRLSNVRLSMHKLVFEGPLVWRQARGKHKLVFEGPLVWRQARGKNIDLHVVLLEHLLVFLTNGDGRRRTAAIFSSKFTRWQPIMRLTSVEVEEKAGDKRSFNLLYCDLRMFELVAQTATERKTLVRLGSDDGSAWRRRDAATNKSSEDGSLQRLNSSSMDHVHVLMHPALVNANEIVIQQPTVMDNAQPVLSVSERLRKNDRMIFAALAEKHQILAELLNDYGGAAAAEELDRMADQMTGLAVLDLKQRNAKELAMSAIVQGNRLLESINKVGHHFVYISMIKIILLGNDELMLPSVPCYKLTSELMLPSVPCYKLTSVAAPLMNHVAAPLMNHLKAMLQVLQDQEREIQTLKQRLKLKAMLQVLQDQEREIQTLKQRLKRFIPQDTQSNPSRKTASEETLVESGEQRIKVTRTSVEEDTPPPP

SEQ ID NO: 134350 - protein, 21 aa, Heterodera glycines
  Coding regions on vcDNA: vcDNA=SeqID_60773; Strand=+; Position=1-63
RVQNIPIGTWKRRGGPKGKGP

SEQ ID NO: 134351 - protein, 166 aa, Heterodera glycines
  misc_feature (161)..(161): Xaa can be any naturally occurring amino acid
  Coding regions on vcDNA: vcDNA=SeqID_60774; Strand=+; Position=1 -55,713-806,857-1049,1105-1188
  Homolog annotation: Hit_ID=XP_322018.1; Match level="QueryCoverage =83%, HitCoverage=24%, E-value=4e-29, Identity=43%"; Hit description =ENSANGP00000012089 [Anopheles gambiae]
GFSDLGDKPLHSSILPFPMTNKSRIFYYHHPDLGNFHYGPQHPMKPARLAATHSLVLNYELHKHATHSLVLNYELHKHLTCVHPPKATQHDLARFHAPEYVQFLKRISPLNADQYEGLFNRFNIGEDCPVFDGIFDFCSPVFDGIFDFCSLYTGGTLGGCXKECVL

SEQ ID NO: 134352 - protein, 121 aa, Heterodera glycines
  Coding regions on vcDNA: vcDNA=SeqID_60775; Strand=-; Position=1-366
MEDGEPVQALPPQNPGQGPKEPINRAPLGKRGRGYAMGGHGPRGQWKNGGQKIQKRVGYLVRQLEREFHGHHDVPPSCSSWTCHRARGWDRGGRGGGRGRGGRGMQFGRAHYHAGPSHGGR

SEQ ID NO: 134353 - protein, 587 aa, Heterodera glycines
  Coding regions on vcDNA: vcDNA=SeqID_60776; Strand=-; Position=1 -181,521-2100
  Homolog annotation: Hit_ID=AAM11674.1; Match level="QueryCoverage =69%, HitCoverage=51%, E-value=4e-68, Identity=36%"; Hit description =pol protein [Drosophila melanogaster]
MANLTELYSPENFNETIEAAKIVQEITRLSKPDSWDEQSERTDQIAATIVANGLFAFLRGENGQDEGVAQVNIVEKEACGPNFKIGGMVNEKRVIFLLDTGAHVSLCSMKTAIRLGITKLEMAQISGVIGVGGKIVPILGQSKILLELAGCYVETIVYVTEAEIGGTQSYDLIVGRNTFRQMPLLLDLQTGNLISKENGQIFACEKVKGVKIEFCEENRKIEDGEQMKVELERCLERHKHVFSSHEYDLGHCAYEAPPILTTTEIPEKIKPYPVPEKYESELKVQIEKMLESGVIKESCTPWAHSIVLVKKSNGQLRPCVDFRPLNKITIPDPYPIPRMDKTIIRAAGKRWYTTLDLASGFWQIPLDKKSSYKCGIVTPWGLYQMLKLPFGLKNAPSIFQRVMDKILDGIPNVTVYIDDILVHTNTVEQHLDTLNNIFEKLGKNGLKVKKEKCSFLKTQCTYLGHVLTKDGYSPSLNNREVIEAFPVPKNAKEVKRFLGMMSFFRKFIPDFAKLAYPLNQLTKQENIEFKWEDQETEAFENLKRQLLKAPCLRAPDYKLPFYLFTDASATAYAGALMQSEKSDEMHA

SEQ ID NO: 134354 - protein, 61 aa, Heterodera glycines
  Coding regions on vcDNA: vcDNA=SeqID_60777; Strand=+; Position=1-184
MSEEGEIREDSPEAPEAVPPQADQQEVDQTIFREKKSTHKKTILVHDGYEYGFDKLSRADP

SEQ ID NO: 134355 - protein, 81 aa, Heterodera glycines
  Coding regions on vcDNA: vcDNA=SeqID_60778; Strand=+; Position=1 -100,641-786
MGPQKSKICLCFHFCDGGQVVHDGEVVTDGSSPQSFKNSSGENFVQCISNFKLWNFMYSQAIQCSDGSVVVVVVGDLVEVP

SEQ ID NO: 134356 - protein, 85 aa, Heterodera glycines
  Coding regions on vcDNA: vcDNA=SeqID_60779; Strand=-; Position=1-259
NRSKIRPAKILSNAFQTSNFGILCIARRFSAQMVLSLLWLWAIWSKYRNTANVADPVTVEQFHVQFKAILAHSFIQRQINDRWKA

SEQ ID NO: 134357 - protein, 219 aa, Heterodera glycines
  Coding regions on vcDNA: vcDNA=SeqID_60780; Strand=+; Position=1 -310,389-738
MDEEMLEFGDSLPSKSATPIGDLVPFPSTPTAPMDTGEMTPPPVAIDERSPRIEQLEKQLKDRDDTIQFLREQVRNREALISDLRRQLEQCAAPPTATPTTSKTTPNRGRPRKAIDELQRSSRKWLTEQILDAIDRDRSRSASRCSLERIHREVRYKYGHYTPKKAPAKKGKDEMEANDGLLLMTQLGTQKTYQRMKATLRLIHKKFDILPPLKKVHLG

SEQ ID NO: 134358 - protein, 57 aa, Heterodera glycines
  Coding regions on vcDNA: vcDNA=SeqID_60781; Strand=-; Position=1-171
MMSNANNLNKLQKKEPIEDCFDCKVTFATGSFLLGSYMFYDSFKSTSKSPILLRSIA

SEQ ID NO: 134359 - protein, 160 aa, Heterodera glycines
  Coding regions on vcDNA: vcDNA=SeqID_60782; Strand=-; Position=1 -174,306-614
MDSLFDAGKNEGRKKDETNGGGDGNMLRNGQRKRSQRKDEEHQVEAQNEPNADKATVTSFNFIWPHLKVPPNHAFLAVAFSFSANSSAVHSMGWADSSTSRTFFESDDSGMPLRKCVGRLGVLPKRDGRQNEIRWTERKALAKGMAETFGMNSCLAQKCI

SEQ ID NO: 134360 - protein, 213 aa, Heterodera glycines
  Coding regions on vcDNA: vcDNA=SeqID_60783; Strand=+; Position=1 -275,436-612,677-864
QILQMHFCARQLFIPNVSAIPLANAFRSVHRISFCLPSLFGKTPNRPTHFLSGMPLSSDSKNVRLVEESAQPMEWTADELALKEKATAKNAWTPIYRYRGFVGVWFILRFNLVFLIFSLASLPLSISQHIPISPSIGLILFSSLVFAGIKKYFTRIVAVISVDTASRSIYRIGYPSVFATRRSRFARFLDVQPLSTNSDSVRGVARLRFTDGF

SEQ ID NO: 134361 - protein, 37 aa, Heterodera glycines
  Coding regions on vcDNA: vcDNA=SeqID_60784; Strand=+; Position=1 -78,937-972
MNVNKEEERLEKKVTKWAIMLTSEDKNGRNTNQHFVL

SEQ ID NO: 134362 - protein, 143 aa, Heterodera glycines
  Coding regions on vcDNA: vcDNA=SeqID_60785; Strand=-; Position=1 -181,287-444,662-754
  Homolog annotation: Hit_ID=CAE67645.1; Match level="QueryCoverage =86%, HitCoverage=35%, E-value=4e-17, Identity=40%"; Hit description =Hypothetical protein CBG13204 [Caenorhabditis briggsae]
MDVPSKQESTNFVIQLDDEDDKKADDEKEVEPKEVYRRLIELLNEKETIGAALKRLNNEKKSNAAEERKRRWAAKKSGANVQEDEKTKQIAELTSLADSLISLGNMEAYQLDQNSINALLDDLQAKNKIPGAKEATLDMFSEG

SEQ ID NO: 134363 - protein, 39 aa, Heterodera glycines
  Coding regions on vcDNA: vcDNA=SeqID_60786; Strand=-; Position=1-117
DKIGNFEATVYNYKGLSFETTTRTNLDGPTKRNWEKYIK

SEQ ID NO: 134364 - protein, 46 aa, Heterodera glycines
  Coding regions on vcDNA: vcDNA=SeqID_60787; Strand=-; Position=1-140
SNKATGFAAYARFSTSDGPPSGSSAPHNNQLASPKPSADKMAEMGN

SEQ ID NO: 134365 - protein, 39 aa, Heterodera glycines
  Coding regions on vcDNA: vcDNA=SeqID_60788; Strand=+; Position=1-165
WKKIPEGENLIKSIPSGDRAGCRGVSSAGSFHHGTEPFG

SEQ ID NO: 134366 - protein, 24 aa, Heterodera glycines
  Coding regions on vcDNA: vcDNA=SeqID_60789; Strand=+; Position=1 -52,295-317
MEKACKIWRDYIDFSALELLELAS

SEQ ID NO: 134367 - protein, 95 aa, Heterodera glycines; identical to SEQ ID NO: 124813
  Coding regions on vcDNA: vcDNA=SeqID_60790; Strand=-; Position=1 -542,842-882

SEQ ID NO: 134368 - protein, 394 aa, Heterodera glycines
  Coding regions on vcDNA: vcDNA=SeqID_60791; Strand=-; Position=1 -79,129-289,331-467,528-630,682-930,988-1168,1288-1438
  Homolog annotation: Hit_ID=CAH03734.1; Match level="QueryCoverage =99%, HitCoverage=98%, E-value=1e-81, Identity=42%"; Hit description =protein-O-fucosyltransferase 2 [Takifugu rubripes]
NPGEGFNLRRDVYLRVANTVRQLREKGFDFVLVLPPWGNCWHFDFVLVLPPWGNCWHWRTKPRQTKIRWSELFDLDSLSDFVPVIEFDEFLEGGQGTSVSTVGTSVSTVLYLQHYAEGWADGEYTLKYDIRPCIEADKYYAKRGDKWNNGHFFDYADLHAKDLQCLSIQGQSSTLAEAIAQSILSRSLMVDSILSRSLMVDRAETILHDQFGDHFFWKARKSMRYAKRLRSIGDTFRADQLANTSDYLCAHLRRADFVWAHREEIPSIEGAAAQIAQNIAQNASKLDISDVFLSTDATPSEVNIGESFGETKCPMVKFSDENEQMELSGAAISIIDQWICANSRFFIGTHLSTFSFRIHEDREILGHDARTTFNRFCPDNVSDCEQPAKWTIVN

SEQ ID NO: 134369 - protein, 229 aa, Heterodera glycines
  Coding regions on vcDNA: vcDNA=SeqID_60792; Strand=+; Position=1 -591,925-1023
MHNRLCSAEKASVKRDGHRKSVDLTSNASTALVKCHYFLVLICLFPQNSHILLNGNNDPKWVVMVNSLDSLDPETRKKTSVPRYYSQQQHTRLQGMFRSATLSPNGRGELEKTAHDGRCPRYLFARPPLNGEETTKNKKKRVEEKPKGKEKQSKKEAKTDEKGKNKGKDELDVFAALGTLQKSLVTRDLMSRFCGQQDCPLARHFPVFLIPSKTPRWPRKLHGITKVSS

SEQ ID NO: 134370 - protein, 253 aa, Heterodera glycines
  Coding regions on vcDNA: vcDNA=SeqID_60793; Strand=+; Position=1 -162,212-355,416-694,752-928
MSRPILDELTRALFAHLRGGNACFDEVSQKGWRNPPTQRTVGPSGAFHDGFAGRENELIELFRRCPRCSRSLRPIILDKFTDEKDGQQYERMWWTCPGIEQKECFFPLDIPKEVFWTRRSMDQSLRGILPLPNLHLLPLSLRALYHKLFKSKVNIEKIVRISAFVPSDGQKSAVQQANFGAEEQPKRQESAQIVQRSVGSVGPSLPSTFPPLPASSVRHLPTPPSVRSHNQCASLCDGFPSSSKRCDQRTVHS

SEQ ID NO: 134371 - protein, 310 aa, Heterodera glycines
  Coding regions on vcDNA: vcDNA=SeqID_60794; Strand=-; Position=1 -174,219-271,351-410,463-580,637-797,844-893,997-1055,1109-1152
  Homolog annotation: Hit_ID=CAE71226.1; Match level="QueryCoverage =94%, HitCoverage=36%, E-value=1e-78, Identity=53%"; Hit description =Hypothetical protein CBG18092 [Caenorhabditis briggsae]
IAIGEVFKFESIALECHSLFCQCTVGWLEPLLARIGEEKRAVACPIIDVINDRTFAYQKGIELFRGGFNWNLQKGIELFRGGFNWNLQFRWYSVPLDIARAYSVPLDIARARSAVPTAPISSPTMAGGLFSIDRSPTMAGGLFSIDRAYFEQLGTYDPGMDIWGGENIEMSLRVWQCGGRVEIVPCSHVWQCGGRVEIVPCSHVGHVFRKASPHDFPSGSSSNRVLNANLARLSEVWMDEWRHFFYKVHFFYKVAPRKSQNPPKMKVSERVELRRRLGCRPFAWYLHVWPEHFLQHRYLHVWPEHFLQHR

SEQ ID NO: 134372 - protein, 99 aa, Heterodera glycines
  Coding regions on vcDNA: vcDNA=SeqID_60795; Strand=-; Position=1 -81,135-227,555-682
SIDQFGAILEKIDKLEQQKQDEKNTKPLVVQIEQLQNDQKALLGRIAQLEKLEPNRKEMDNGAQIERTFETNADYNQQQKVKIVLFDCCFLVLNHKMLH

SEQ ID NO: 134373 - protein, 18 aa, Heterodera glycines
  Coding regions on vcDNA: vcDNA=SeqID_60796; Strand=+; Position=1-56
YREAIPEGFGLPINLGAS

SEQ ID NO: 134374 - protein, 206 aa, Heterodera glycines
  Coding regions on vcDNA: vcDNA=SeqID_60797; Strand=-; Position=1 -456,512-674
  Homolog annotation: Hit_ID=CAE69971.1; Match level="QueryCoverage =99%, HitCoverage=51%, E-value=3e-80, Identity=73%"; Hit description =Hypothetical protein CBG16368 [Caenorhabditis briggsae]
VGYCQGSAFIVGQLLLQMPEEEAFAVFMRLMETYRLRELYKPTMTELGLCMFQLEVIVQEQMPDLHMHLYVVLPVSISLINWFSNNMGFDTSMYASSWFLTVFLTTVSLELANRIMDWFLVDGIDAVFRIAISILQQSRIDLLQLDMEGMLKYFQREVRERYENDHELLFAIASKVHLNVKRMKRLEKEYMTKKTKEQEEAIELRA

SEQ ID NO: 134375 - protein, 21 aa, Heterodera glycines
  Coding regions on vcDNA: vcDNA=SeqID_60798; Strand=-; Position=1 -54,575-586
MRTRPIWQVKQRLLTSQKKGF

SEQ ID NO: 134376 - protein, 71 aa, Heterodera glycines
  Coding regions on vcDNA: vcDNA=SeqID_60799; Strand=+; Position=1-262
LFEYPKRTLEKIDFFVFGAVPPNRCAQIYGETESFRNSFPIACTLILRWIFAPHNCLSTPNGHLKKSIFLF

SEQ ID NO: 134377 - protein, 37 aa, Heterodera glycines
  Coding regions on vcDNA: vcDNA=SeqID_60800; Strand=-; Position=1-112
MLIRSIFYEISDRVIFDPSYFRKYVFYKAATWLSLLS

SEQ ID NO: 134378 - protein, 50 aa, Heterodera glycines
  Coding regions on vcDNA: vcDNA=SeqID_60801; Strand=+; Position=1 -115,287-324
MANSVAAAATMISTAAVRTNTVQIGDGGNLNLAHHKAKRMGFCSSHCLRF

SEQ ID NO: 134379 - protein, 33 aa, Heterodera glycines
  Coding regions on vcDNA: vcDNA=SeqID_60802; Strand=+; Position=1 -86,135-150
MTSRKRDKQRQTSEITFKMEEKAYIWRNGVLIV

SEQ ID NO: 134380 - protein, 133 aa, Heterodera glycines; identical to SEQ ID NO: 126960
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  Coding regions on vcDNA: vcDNA=SeqID_60803; Strand=-; Position=1-401
  Homolog annotation: Hit_ID=BAB33421.1; Match level="QueryCoverage =91%, HitCoverage=43%, E-value=1e-47, Identity=75%"; Hit description =putative senescence-associated protein [Pisum sativum]

SEQ ID NO: 134381 - protein, 30 aa, Heterodera glycines
  Coding regions on vcDNA: vcDNA=SeqID_60804; Strand=-; Position=1-90
AEPVDFIKHNLTLQSYYLAGDAPKALTPLV

SEQ ID NO: 134382 - protein, 38 aa, Heterodera glycines
  Coding regions on vcDNA: vcDNA=SeqID_60805; Strand=+; Position=1-115
  Homolog annotation: Hit_ID=CAE60127.1; Match level="QueryCoverage =97%, HitCoverage=22%, E-value=6e-10, Identity=67%"; Hit description =Hypothetical protein CBG03670 [Caenorhabditis briggsae]
MDIRSDQHRYPFCIVWTPIPLISWLFPFIGHIGIATSK

SEQ ID NO: 134383 - protein, 302 aa, Heterodera glycines
  Coding regions on vcDNA: vcDNA=SeqID_60806; Strand=+; Position=1 -67,112-344,386-488,565-673,726-925
  Homolog annotation: Hit_ID=NP_494763.1; Match level="QueryCoverage =97%, HitCoverage=89%, E-value=3e-49, Identity=41%"; Hit description =u2 snrnp-specific A' protein (28.9 kD) (2E615) [Caenorhabditis elegans] gb|AAK31542.1| Hypothetical prote
KQREISLRNLQIPTIENLGVTRDQFDVIDLTDNNIRKLDNLPRLKRLRDQFDVIDLTDNNIRKLDNLPRLKRLETLLLHNNRVDFISKEIGDQLTKLSTLVLTNNNLAQLGDIDVLASCPRLEYLSLQGNPLTHLPKYRLQGNPLTHLPKYRQYVIYKLKNVRVLDYKRIRLAERQAAKKLFKGESGERQAAKKLFKGESGARLKSELVKRSHSEGGEETEPNEHSSSTPSKVTRKEYWNEHSSSTPSKVTRKEYWPCQELISGAKTLVDVERVQQILQSGENGTEEQQNGQNGTDVHMEEQ

SEQ ID NO: 134384 - protein, 118 aa, Heterodera glycines
  Coding regions on vcDNA: vcDNA=SeqID_60807; Strand=+; Position=1 -84,127-396
MEVVHRRNLIERLDKLKASHEAFFTVPQLKAVSNNQLSLFLRRLLKSADIKQHISTELLERILLIEESNENASDTAKMAFRTEGELGQFADRLTYIGKSETHLNLNQQTDEEDELTDE

SEQ ID NO: 134385 - protein, 121 aa, Heterodera glycines
  Coding regions on vcDNA: vcDNA=SeqID_60808; Strand=+; Position=1 -26,1035-1374
MTNEIDQERFKTYQTALKSQEQLNELKHAFYNLEEDFHEDDDRFGTTEAKGIKISLPFRKMLKKRSVIVDQNTEQTDTESDPEDYEYDADPSSPREMCKFKRRRMTYSSGTAKPPKVTKSK

SEQ ID NO: 134386 - protein, 330 aa, Heterodera glycines
  Coding regions on vcDNA: vcDNA=SeqID_60809; Strand=+; Position=1 -119,627-834,876-1541
MKDAIDNMIKVALKTTEEKMKRKVRMFGVAITGAGLAFPVIVNTDKFCLFYALASSMNYLIMDKYSFIRFMKNLARQKEAAVELLRNCGIDGNEISYGVEQLPNVQKYWDEIYPGKYRVVAFEKSADPRKSICVLWKAPMGREKVVPIFLENGHWDGLKNYVCFFNRGRKFCIDCECFFDKDVKHTFECRARCYYCNRVGGMPCEKESGVKIECPKCHRYFYNWECYNYHQGHQTCKLWRRCVICDKTYLFNPKKEHECGETYCQLCSVSHDPKRGCYIMPIEEKEEKDVYRIVVWVSSTNKINKNKSLTPGFGDFAGFYLQGGPEGACY

SEQ ID NO: 134387 - protein, 86 aa, Heterodera glycines
  Coding regions on vcDNA: vcDNA=SeqID_60810; Strand=-; Position=1-260
QFRRATNAASYKIQFTAHAPSTSTMVPFELVNERTREKLTFTKAGYDRWIIKRCQIGETTTAQWTDENSINNLNNVSINLSGVNCI

SEQ ID NO: 134388 - protein, 120 aa, Heterodera glycines
  misc_feature (79)..(79): Xaa can be any naturally occurring amino acid
  misc_feature (92)..(92): Xaa can be any naturally occurring amino acid
  misc_feature (105)..(105): Xaa can be any naturally occurring amino acid
  Coding regions on vcDNA: vcDNA=SeqID_60811; Strand=-; Position=1 -118,445-691
  Homolog annotation: Hit_ID=CAE72131.1; Match level="QueryCoverage =69%, HitCoverage=14%, E-value=5e-34, Identity=77%"; Hit description =Hypothetical protein CBG19227 [Caenorhabditis briggsae]
FLETDRYQLYGFGAVVDLLNGTNWEQSGIFPRVSLCDFQVRVMGNLQEYTIQCVLIINIFNEKIFVLLWFWSEIIIIFXFNSFLNVFASSFXFYILKILKCKHIXYLEDCFEFYLNGLFF

SEQ ID NO: 134389 - protein, 326 aa, Heterodera glycines
  misc_feature (322)..(322): Xaa can be any naturally occurring amino acid
  Coding regions on vcDNA: vcDNA=SeqID_60812; Strand=+; Position=1 -932,2026-2074
  Homolog annotation: Hit_ID=NP_502797.1; Match level="QueryCoverage =96%, HitCoverage=88%, E-value=4e-54, Identity=35%"; Hit description =HASI (4P602) [Caenorhabditis elegans] emb|CAB16520.1| Hypothetical protein Y57G11C.19 [Caenorhabditis ele
KNKILTKLYYNLKSPASFAGIQKILNEAKKIDPDITTDDVNKFLEKQRTYTIHKPIRKRFPRLKTIPSGFHTDWQCDLCIFDQLKKHNDGYKYLLVCIDVLSRMIFSAPAKSKKSEDIIEAFDRVFEKSKIIPMKIYSDSGLEFQAGKMKNYLGKFIIKNVMYSPDLHAGVVERANRTIKERLYRYFTKMDTLRWVDVIDKIITNINNSVNRTLGIKPTSITFENAGIIWERLFGNIETQKNNKFKIGDLVRITKEKGIFAKGYLPNFTEEIFKIYKIIKSDPIAYRIEDLNGDNIKGIFYDAELVRVSKKQNSVYSVGIYXASRV

SEQ ID NO: 134390 - protein, 287 aa, Heterodera glycines
  misc_feature (57)..(57): Xaa can be any naturally occurring amino acid
  misc_feature (143)..(143): Xaa can be any naturally occurring amino acid
  misc_feature (145)..(145): Xaa can be any naturally occurring amino acid
  misc_feature (261)..(261): Xaa can be any naturally occurring amino acid
  Coding regions on vcDNA: vcDNA=SeqID_60813; Strand=-; Position=1 -90,172-228,374-453,535-612,824-1073,1117-1219,1300-1435
  Homolog annotation: Hit_ID=NP_498711.1; Match level="QueryCoverage =97%, HitCoverage=42%, E-value=3e-66, Identity=44%"; Hit description =tyrosinase and metridin-like ShK toxin family member (68.4 kD) (3I965) [Caenorhabditis elegans] gb|AAA279
AFPPDFSECSNQHHFANAQMRPFDLTNKDGLSNAYLSNAYTDNLFRFSARPSCNFFXDDCGSPFLFCDRRDAETPHCVSKIRIGGIRIGGNCQGFEGIDCCWEGECQNWRCRNDWHFAQKAFNSTEATTRQREQRMAQTHNQXQXLATNDCFNDDPCCSAWAKLSECSANPAFMHRYCRRACHQCEAQTAHKGCTDRHISCCTDRHISCGYWRSAGECSRRRQWMAENCRQSCGWCQISQQQCQISQQQLCASVARMSRMXEAFLSFCLWSADSKRKVEKFQNGRQQ

SEQ ID NO: 134391 - protein, 19 aa, Heterodera glycines
  Coding regions on vcDNA: vcDNA=SeqID_60814; Strand=+; Position=1-58
GPGSRSRILKSSGPGPDRA

SEQ ID NO: 134392 - protein, 193 aa, Heterodera glycines
  Coding regions on vcDNA: vcDNA=SeqID_60815; Strand=-; Position=1-580
  Homolog annotation: Hit_ID=NP_491240.1; Match level="QueryCoverage =84%, HitCoverage=11%, E-value=8e-19, Identity=35%"; Hit description =zn-finger, CCHC type and RNA-directed DNA polymerase  and Integrase, catalytic domain containing protein
MSNGAAERFVDIFKRAMKKSRKEGKEWAEKALLAYRTTPSAALDGHSPDELFLGRRLRTKLSLIHPPNQKSKLIDLENFQNSKKIYIRKMEHQFNSKHGTKTTNFQAEEPVYFWNFKDNKSVWLPGKVIERVENSPTYRIFAPSLGRAVHQHANQLRRRFPVELNFENDQSKNPAKPGIFDSEKEVSLRREVL

SEQ ID NO: 134393 - protein, 94 aa, Heterodera glycines
  Coding regions on vcDNA: vcDNA=SeqID_60816; Strand=-; Position=1 -122,408-570
MYIIVFLLSTLNISISFARISGTIGPIQTKIYVDGENYENSKANLDRFPFLKDATKEAKKEFEKISNNKSLTKFELEAARMEWAKKQTKTIKAN

SEQ ID NO: 134394 - protein, 139 aa, Heterodera glycines
  Coding regions on vcDNA: vcDNA=SeqID_60817; Strand=-; Position=1 -124,295-590
MIISIKSAISALPFEPENGKKLNHFPIPYYRQFQPPYDSPSRISQNRGLFLAMANGNANGDSVGKEENERGFLPKRLRPPPRFPRPRPTRPRPTQPPRPVPMTNAYTPAPSPVPHPTQANHGDYPAGPPYNPHWKNQCN

SEQ ID NO: 134395 - protein, 20 aa, Heterodera glycines
  Coding regions on vcDNA: vcDNA=SeqID_60818; Strand=-; Position=1-59
CHRVDPTHIIITAMDGSNGG

SEQ ID NO: 134396 - protein, 194 aa, Heterodera glycines
  misc_feature (185)..(186): Xaa can be any naturally occurring amino acid
  Coding regions on vcDNA: vcDNA=SeqID_60819; Strand=+; Position=1 -543,2991-3033
  Homolog annotation: Hit_ID=XP_320889.1; Match level="QueryCoverage =98%, HitCoverage=24%, E-value=2e-48, Identity=49%"; Hit description =ENSANGP00000012033 [Anopheles gambiae] ref|XP_313651.1| ENSANGP00000013044 [Anopheles gambiae] ref|XP_314
AKPVYCRPRPVPYNTKLVVDAELDRLLAANVFRPVDHTRWAAPIVVVKKATGSARVCADFSTGLNNVLLSNQHPLPVPEDIFATLNGGQFFSQIDFRDAYHQIELEEGSKELCTIATHRGNFEYHWLPFGVKSAPGFQSIMDSMLADCPFAIAYLDDVIVVSRTRKEHWTHLMEVFKRIEKYCFXXKIINKYFL

SEQ ID NO: 134397 - protein, 117 aa, Heterodera glycines
  Coding regions on vcDNA: vcDNA=SeqID_60820; Strand=+; Position=1 -165,439-627
MQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDGGALF

SEQ ID NO: 134398 - protein, 76 aa, Heterodera glycines; identical to SEQ ID NO: 128275
  Coding regions on vcDNA: vcDNA=SeqID_60821; Strand=-; Position=1 -81,222-528

SEQ ID NO: 134399 - protein, 42 aa, Heterodera glycines
  Coding regions on vcDNA: vcDNA=SeqID_60822; Strand=-; Position=1-142
NGGTKFCNCPASRRGLKALYCIIKTENNFRIFFTIYFKRQKK

SEQ ID NO: 134400 - protein, 394 aa, Heterodera glycines
  Coding regions on vcDNA: vcDNA=SeqID_60823; Strand=-; Position=1-1185
  Homolog annotation: Hit_ID=NP_920205.1; Match level="QueryCoverage =95%, HitCoverage=24%, E-value=8e-32, Identity=28%"; Hit description =putative DNA helicase homolog [Oryza sativa (japonica cultivar -group)] gb|AAP52492.1| putative DNA helica
MLSNWAIHLPNQQPIVYRAFQLVSKAQQIQQGELPETHCSAYWKQWQNEWKNDPKFKDILFEKVPEQFRWAKDKWVLYKRQQIKRPPIGRIVAVPPSDPERFALYSLMRHFPGDPDHLKMVNGLLCTSFTDAAIMHGLLEDGKIWDKTLAEAALSRWPDQMRWLFVSIMVYGQPSNAIELWNKYKDQMYNPQGIITPAQHKAAELEALADLDWRLHSCFNLSCVHFGLPDPPNSIAKNTDAAIEEFFFGDDDLNLPPGQPNLRPQPKAPPPLNSDQQKVFDAVLLAIQSNPRDPTVPRRFFIYGDGGTGKTFLFGQIIRRLRKAPYTYKVLATASTGCAAILLPYGKTAHSTFRLGREVSLDKLPSIPLEKFFARRIREAQLIWKMRSPCFTTR

SEQ ID NO: 134401 - protein, 37 aa, Heterodera glycines
  Coding regions on vcDNA: vcDNA=SeqID_60824; Strand=+; Position=1-113
SQKKWLSLFLINFIHIQMLSSMIGRAVRNRPFIFEGI

SEQ ID NO: 134402 - protein, 152 aa, Heterodera glycines
  Coding regions on vcDNA: vcDNA=SeqID_60825; Strand=+; Position=1 -108,231-356,775-998
MDVQKTGKNPQRRPNPDLASGDFVNAPPKRRRNTNSSRLEGNPPQEQPGQVQPSVLMVQQQQPVLPIQQQQQQRQFVNYSKPFTMGEQQQQQQQGEEDVIRERIRRRQLQELAAMELAKPLPEDLQFCAQYNAYGLTDIGWLLMGWRDQMVI

SEQ ID NO: 134403 - protein, 289 aa, Heterodera glycines
  Coding regions on vcDNA: vcDNA=SeqID_60826; Strand=+; Position=1 -102,160-249,307-387,447-536,591-671,728-1002,2025-2175
  Homolog annotation: Hit_ID=NP_062318.1; Match level="QueryCoverage =53%, HitCoverage=9%, E-value=1e-11, Identity=33%"; Hit description =formin 2 [Mus musculus] gb|AAF72883.1| formin-2 [Mus musculus] sp|Q9JL04|FMN2_MOUSE Formin 2
MFPNDDGYESEDDEILLPPPPIPPQLGHPPPNVPAVRVQPMHVGQQRLPLRDLPQIFHPPPNVPAVRVQPMQQPVPMRAVPQFLHPPPNAPEIGVGPIHDGQQPLPLRALPQFAQPPPNVPAVRVQPIQQPIPLRDVPLFVNPPPNVPVIRVQPMPQPLPLRDMPQIHHPPRNVTSIWIKLWLLFLSLWVFLQGIHVRQIQREYAVPQFAHPPPNVPYHPPENVPVMLGLVSHISGCLFRSFLRFGNCSKLPAHREKYNGKQIPLSDEDGEETKGNGHGIDGKGRDKHG

SEQ ID NO: 134404 - protein, 311 aa, Heterodera glycines
  Coding regions on vcDNA: vcDNA=SeqID_60827; Strand=+; Position=1 -119,266-764,804-870,1178-1321,1364-1468
GPLLQCPVRPRDHPCPPLPTIEPRHCFQRVHAQTAIIWGIKMYSFQKYFEEALEKEDFFCQKNRAEVEALLIEASNYKIIIHRDYESRYSDYIATYRRTPLFCFCMIERNLRFFYDTGTGTPIGRVTTVLHVTVEASYTGEGFISPMFSFWFYWEGRSQTTNESFTSRLYLYTVSMLRAMGKAWGRELLLNPVEVLIDMFYQRIDRDLVGSWSLFYRLPPSLFDTSRRACVLCRKGACSCGVEKALTPYLKVSVADDTEILENVAFFGVRGKKNGMEELRGLSGAVCTMKIGARVKEFGGKKGIYYSLIDI

SEQ ID NO: 134405 - protein, 200 aa, Heterodera glycines
  Coding regions on vcDNA: vcDNA=SeqID_60828; Strand=+; Position=1 -111,275-316,430-518,560-886
  Homolog annotation: Hit_ID=NP_660107.1; Match level="QueryCoverage =77%, HitCoverage=6%, E-value=1e-37, Identity=48%"; Hit description =WD repeat domain 9 [Mus musculus] emb|CAC44373.1| WDR9 protein, form A [Mus musculus]
LYNLHPHTRILGHLSSIFCVAFDRSGRFLFTGADDNLVKVWDAQRCLLRFTFRGHSGEITDLSVSYDNNLLASGSVDKTIRVWCLRKGTAFRVWCLRKGTAFRIFRGHTGTVNSVQWVPLLAGPMRYLLSAGNDCAVMFQRYNAETLAFEDPPFKFNERPRGERIAPKSQIRRNAQFMGGGGDLLLIIPLFRRIFQKKKW

SEQ ID NO: 134406 - protein, 240 aa, Heterodera glycines
  Coding regions on vcDNA: vcDNA=SeqID_60829; Strand=+; Position=1 -60,121-316,546-679,926-964,1024-1235,1501-1582
  Homolog annotation: Hit_ID=XP_321024.1; Match level="QueryCoverage =92%, HitCoverage=13%, E-value=3e-23, Identity=30%"; Hit description =ENSANGP00000011207 [Anopheles gambiae]
MMYKLSAQGVARLYEFQAHSDRIDTLVWSHHSLRFVSGSKDGTAKVWSLDEEGRWAPVELNPFPTVQQTPRVTATTGDGESPAAGVALPPSQQSTNRRAANANAGATPNNGYKLTMLCWTLDDDMVISIGELIVSAGHDGLVIVWNVYNGKQMSKHRNENNDREAVAIFDNQISADGTTVACVDAMGHLSIYGVDHNQEALKRPHEQFFTTDYKVAEHESGIHFARFRKPDPDSNKKSKI

SEQ ID NO: 134407 - protein, 318 aa, Heterodera glycines
  Coding regions on vcDNA: vcDNA=SeqID_60830; Strand=+; Position=1 -104,343-513,637-734,937-1084,1504-1629,1684-1990
  Homolog annotation: Hit_ID=CAG02962.1; Match level="QueryCoverage =71%, HitCoverage=22%, E-value=9e-19, Identity=24%"; Hit description =unnamed protein product [Tetraodon nigroviridis]
PQLGDEVAYFLQGHKTYLKELKENGIQVTKVMQPRFHDMQNVLDFLVLKQHFDASKQLNLQPGNRVESIVDDKFYTGKVLRVTAAEYDSYPNSDWCAVCVEWDNGEDDRYSPWDLQALTKGRKSESPATKHDTAKLGEYHPMAGEWLVPEWALANAPPRASSSAVSSRPSNSLLRSLAILYDVQMLGKNALAYNKPKYPIVRHACALVETIFVFMEDWKQNDPLPMFRHFVEAGTEGTKYWQLDLLATSNGGGIGSTSTLFTTGSGSVSGSALSNGTANHQQNATSARLQVAPGPSSSSATAGLPLWASECSAMVDEL

SEQ ID NO: 134408 - protein, 154 aa, Heterodera glycines
  Coding regions on vcDNA: vcDNA=SeqID_60831; Strand=-; Position=1 -157,211-406,878-989
MEEKQKFIHQFDKIIGKKEQQSVGRKDKLEIAERVGINLRTIDKWKSEMGLKVTKESQRIALVKEYYRIKKEDPKVPTKEIAKSFNASKATLFYWKKQFDKNNYESSSSADGPEQLSCSDGPHLCDHLPVDQKAWEWNNGTRKRSRKRKISEFY

SEQ ID NO: 134409 - protein, 53 aa, Heterodera glycines
  Coding regions on vcDNA: vcDNA=SeqID_60832; Strand=-; Position=1-162
KKPRPLDEKQKVEIVKKYEQMKNENGKMKDSEISKKLKMFPWKIIGAEKGISA

SEQ ID NO: 134410 - protein, 137 aa, Heterodera glycines
  Coding regions on vcDNA: vcDNA=SeqID_60833; Strand=-; Position=1 -60,203-274,489-725,820-864
FEESPPADADQSTQKLEKQKFEEAPLPPQEQTVENGRHTMNGENVLHQQQLKEEERTSAADAVPSKNGNGMPKVLDLDQAAEIIYKSINRGGHGGGLIKMFKKAPKSDTDQILTILTASNYHTQIFETFRSKFQIIG

SEQ ID NO: 134411 - protein, 150 aa, Heterodera glycines
  Coding regions on vcDNA: vcDNA=SeqID_60834; Strand=-; Position=1 -91,254-460,521-675
MKVVRTIHLWTDNRSLNNPSIDNLSLKDILTIWRSVALNESFLSTKTARQINRRFKSDIFKRNFGTFRKLPTKRMYAEMMAKCYDNIFYLHDKQVTDCPGPHRCRIKPINGLNCFIAKRKLIEQELALGIFWYISPKKGKFRFSNEGCSL

SEQ ID NO: 134412 - protein, 29 aa, Heterodera glycines
  Coding regions on vcDNA: vcDNA=SeqID_60835; Strand=-; Position=1 -12,109-186
MNAKLFYNFVMTCETLSIHFWHFRQKSKE

SEQ ID NO: 134413 - protein, 109 aa, Heterodera glycines
  Coding regions on vcDNA: vcDNA=SeqID_60836; Strand=+; Position=1 -84,146-258,306-439
  Homolog annotation: Hit_ID=CAE64022.1; Match level="QueryCoverage =92%, HitCoverage=18%, E-value=1e-44, Identity=79%"; Hit description =Hypothetical protein CBG08617 [Caenorhabditis briggsae]
ALHGRETSHYQQAAFFELGAMILQNMFGALSFLRFQKDDDLVDRLSYFYTSSFLIMMAVLVSFKQFGGRPLECWVPAQFTSSWEAYTEMFCWSENTYFVPVEEVGIIGL

SEQ ID NO: 134414 - protein, 68 aa, Heterodera glycines
  Coding regions on vcDNA: vcDNA=SeqID_60837; Strand=+; Position=1 -50,422-578
MAQMVANIVTVILAALKVASRPTLRERKKVGKRGGKFSQKSVGDGCKNLKKDIGERQQRCWGIFFIKS

SEQ ID NO: 134415 - protein, 67 aa, Heterodera glycines
  Coding regions on vcDNA: vcDNA=SeqID_60838; Strand=+; Position=1 -79,223-347
ELAYGLTRFELLCGFRPSDEIAFNMKAFPELCLAMGNENCALFIAANESENTGFPDLSQLLKRWWVN

SEQ ID NO: 134416 - protein, 499 aa, Heterodera glycines
  Coding regions on vcDNA: vcDNA=SeqID_60839; Strand=+; Position=1-1498
  Homolog annotation: Hit_ID=AAK52058.1; Match level="QueryCoverage =86%, HitCoverage=40%, E-value=2e-77, Identity=35%"; Hit description =RNA-directed DNA polymerase [Drosophila melanogaster]
MEPKWIWKGTHLAFANELLCDRNGLLRENSTKEILTLNSERKKMEIDPTFVGDFSRAMVKDKDLEKLKALIEEFSDVFSKFRYDLGLFTAAEHHITTTTEEPIASAPRRMPYKYKEELKKHINQLLEAGVMVESDTPWVTPIVIVQKKDGGIRPCLDFRKLNEVTVPDRYPLPRLDSIMERVGNCQFYSSLDLASSYFQIKLSEETSRKCGIITEDKVYQMITMPFGLKNATAAFSRAMAIVLSGLEDTSLAYVDDVLIFTKSPNFSEHLTAVRKVLERFRLYNLKLSPKKCIFASNEMNFLGFVLTAEGFKPSLSRIEILKEMPVPLNVKEVKRVLGQAGFYRRHIENFAMVVEPLLKLTRQCNKFEWGREQQKSFDKIKELLTQAPSLIFPDYDKAFHIFTDASSTGQGGVLMQKDDVTGTFSAISYCNRTFSAAERKWPAVQIEMSAIIYALREFRPFIFMSDIELHTDHKPLAFLLKKSEPISNWHDGSLNLQIS

SEQ ID NO: 134417 - protein, 45 aa, Heterodera glycines
  Coding regions on vcDNA: vcDNA=SeqID_60840; Strand=+; Position=1-140
FTNNSSGTNREFSQESGFLFFKNRDRDLKNPGIPDPVPIPLNSTL

SEQ ID NO: 134418 - protein, 88 aa, Heterodera glycines
  Coding regions on vcDNA: vcDNA=SeqID_60841; Strand=+; Position=1 -124,556-696
QDPLGLDQKAPGAFLRLNRPAQLPLRAFSPALLRCHDLSKHRSPELNEEEREYALDYCTSKNQYYVAPEEGIPWANPERRARQLGYYH

SEQ ID NO: 134419 - protein, 18 aa, Heterodera glycines
  Coding regions on vcDNA: vcDNA=SeqID_60842; Strand=-; Position=1 -49,95-100
EAIPEGFGLPINLGASCP

SEQ ID NO: 134420 - protein, 41 aa, Heterodera glycines
  Coding regions on vcDNA: vcDNA=SeqID_60843; Strand=+; Position=1 -36,73-162
MHAINDIITQNTAKIKRGFRAGDADALLQLGLQLVTDLNQY

SEQ ID NO: 134421 - protein, 95 aa, Heterodera glycines
  Coding regions on vcDNA: vcDNA=SeqID_60844; Strand=+; Position=1-289
PCPPCDSEDEVVLKVGPEQFTVSKHFLMSVSPVFHKMFSVDMLEKAQGEVSLEETNGEEFGAFLDAISPKMASPNRKKKMHTNAKNVPLFTQLPM

SEQ ID NO: 134422 - protein, 126 aa, Heterodera glycines
  Coding regions on vcDNA: vcDNA=SeqID_60845; Strand=-; Position=1-381
MEHDFGFGTSCGPSSLNEDKSGNNNNNRNGDDEERKIISVIIDEDEDEEEGEEEEGETTELAHQTEDIGQSAELAPQQAEDNGSVALAPAPTSAPAETLESAPPPAPATEEEGGAEDADCEPDNLS

SEQ ID NO: 134423 - protein, 32 aa, Heterodera glycines
  Coding regions on vcDNA: vcDNA=SeqID_60846; Strand=-; Position=1 -58,255-295
MRTDPEAKNFAEQLLEIGNAIKNLHLSLKYLK

SEQ ID NO: 134424 - protein, 589 aa, Heterodera glycines
  misc_feature (239)..(239): Xaa can be any naturally occurring amino acid
  Coding regions on vcDNA: vcDNA=SeqID_60847; Strand=-; Position=1 -227,268-397,445-578,837-1009,1130-1188,1232-1340,1389-1509,1745 -1832,1882-1990,2036-2199,2418-2555
  Homolog annotation: Hit_ID=NP_741633.1; Match level="QueryCoverage =93%, HitCoverage=91%, E-value=3e-86, Identity=36%"; Hit description =OSMotic avoidance abnormal OSM-6, protist raft-like and intraflagellar transport protein component IFT52,
FELFNPYSRNFYSIFMPYLMFFSPSNFEPYLLKFTNYKKTIIFKLVNGDELVESAFEKCRIFVLPCPRAKFTEFEFDLIRKFIHSGGSVLFDLIRKFIHSGGSVLVMCAEGGERTNINFLLEEFGIAFNSDCVIRTMFHKYFDPKEACVIRTMFHKYFDPKEALVPNGVINRAIPSAAGVKRQLATEEKPNSSALTFVYPFGCTLSVDRRSVCVLSTGTVCYPISRPICAFHKVQKVNXQINDQAQIISSVQMFTDPFFGKEDNAKIFEVIVKFLSDGFELEVIVKFLSDGFELNQIDAAEPNISDFHQIPDNLQLSSQPKMCLQESEIEQTFTGDITQLSSQPKMCLQESEIEQTFTGDITKLFDTSLSSISLEHWPEAIRLYDKIGLKHEPLTLVSPAFQVPMPPFAPAIFAPEFRELAPLQLELIFAPEFRELAPLQLELFDLDDAFATHEIQLAQLTNRCAENELDLYIREAGEILDINKTLLRCAENELDLYIREAGEILDINKTLLRSERRTEGKITAKKVMEYVILHIIEWKKSTGDDSDEFPSAFLTDEIGMPIEANDRKATEDKEEEEDAFSNIDQYDDL

SEQ ID NO: 134425 - protein, 77 aa, Heterodera glycines
  Coding regions on vcDNA: vcDNA=SeqID_60848; Strand=+; Position=1 -3,148-219,285-315,565-692
MDSAERFFTPKPSPSVSDWTFSSEMAKKNNKAGIKADTEQEPVNEQQSYFDQLRQLIFDTPEFAPHGLETVKDEEQT

SEQ ID NO: 134426 - protein, 52 aa, Heterodera glycines
  Coding regions on vcDNA: vcDNA=SeqID_60849; Strand=+; Position=1 -97,156-217
MSLMRQLLTFLSIILLLLSLVTLSDAQLFGGWGWNSGIYMPGFYCAHAKVCG

SEQ ID NO: 134427 - protein, 222 aa, Heterodera glycines
  misc_feature (7)..(7): Xaa can be any naturally occurring amino acid
  misc_feature (19)..(19): Xaa can be any naturally occurring amino acid
  misc_feature (91)..(91): Xaa can be any naturally occurring amino acid
  Coding regions on vcDNA: vcDNA=SeqID_60850; Strand=+; Position=1 -249,384-526,616-808,1764-1828
  Homolog annotation: Hit_ID=NP_939376.1; Match level="QueryCoverage =90%, HitCoverage=52%, E-value=6e-44, Identity=47%"; Hit description =Galactose-1-phosphate uridylyltransferase [Corynebacterium diphtheriae NCTC 13129] emb|CAE49535.1| Galact
EFNVLFXSQRTLPMPITVXDPLTGDLVSVAVARQTRAFLPPAKFDPLAPQCAENPDAEIPSLYDVSVFENKSPAFGPLLEIVDKWQKFIIXINQNYSKVGRCEVVCFTPEKTGSFDTLSPSRARTVIEAWADRTAAAWADRTAALSAMPNIQQVFPFENRGEVIGVTLHHPHGQIYAYPYITPRTQALIASLDRYGNEKTGNNMFDFILIHHAQYQMKNILE

SEQ ID NO: 134428 - protein, 276 aa, Heterodera glycines
  Coding regions on vcDNA: vcDNA=SeqID_60851; Strand=-; Position=1-828
MSAKIIRVPKIACDLSLAKNGVSKNRNYAQKASQTILTLPIPSTIAFIHPIMSAKIIRVPKIACDLSLEKNGLSKNRNYAQKASQTILALPIPSTIAFIHPIMSAKIIRVPKIACDLSLEKNGLSKNRNYAQKASQTILTLPIPSTIAFIHPIMSAKIIRVPKIACDLSLEKNGLSKNRNYAQKASQTILALPIPSTIAFIHPIMNAKIIRVPKIACDLSLEKNGVSKNRNYAQKASQTILAHPIPSTIAFIHPIMNAKIIRVPKIACDLSLAKNG

SEQ ID NO: 134429 - protein, 63 aa, Heterodera glycines
  Coding regions on vcDNA: vcDNA=SeqID_60852; Strand=+; Position=1-502
LTSKNNSLPKSFLQPHIANLISCRLKAIHCLRFSAQQSTNTVFDSLQKIIHYPKVFYNQLLPI

SEQ ID NO: 134430 - protein, 40 aa, Heterodera glycines
  Coding regions on vcDNA: vcDNA=SeqID_60853; Strand=-; Position=1-338
INVVDWNKWTKKQSQRQNLKALGDWNKWTKKQSQRQNLKA

SEQ ID NO: 134431 - protein, 116 aa, Heterodera glycines
  Coding regions on vcDNA: vcDNA=SeqID_60854; Strand=+; Position=1-439
HWVPRQGVPIHELLGLVNHGNTPLTRIPTPPPTLGSASPVLSSPQHLCLRPHLHKSINSPNFFNTQTSCMFYSFRQLPIAGETEATTKVAPQQQPSPFNAEHKRKQALEPRRPRSP

SEQ ID NO: 134432 - protein, 137 aa, Heterodera glycines
  Coding regions on vcDNA: vcDNA=SeqID_60855; Strand=-; Position=1 -22,500-668,727-897
  Homolog annotation: Hit_ID=CAE60135.1; Match level="QueryCoverage =83%, HitCoverage=30%, E-value=2e-24, Identity=52%"; Hit description =Hypothetical protein CBG03681 [Caenorhabditis briggsae]
TGKSISTALDALEEKKLISEVERAGGAGFKVLRCLEGATAFVYAAGGTKKWDIAAPEALLMAAGGTLSDMSGRQIRYEPSVQGTLSDMSGRQIRYEPSVQLANSGGLLATASGVDHQVAGGKGKDCSSIGTEIWAPP

SEQ ID NO: 134433 - protein, 43 aa, Heterodera glycines
  Coding regions on vcDNA: vcDNA=SeqID_60856; Strand=+; Position=1 -61,119-189
  Homolog annotation: Hit_ID=AAP30760.1; Match level="QueryCoverage =76%, HitCoverage=11%, E-value=5e-10, Identity=96%"; Hit description =putative gland protein G10A07 [Heterodera glycines]
MRTILFIAMVCLLMAVLMEMANSKAVKKDNKKGQNEFQCILYN

SEQ ID NO: 134434 - protein, 73 aa, Heterodera glycines
  Coding regions on vcDNA: vcDNA=SeqID_60857; Strand=+; Position=1-224
YPPPFGEHEKEEKDDEKEGGEKEVEEAGDEEGKGERDGDDQQGGEERRKKKGTMMTKTRGLIKRKSNKKKEKK

SEQ ID NO: 134435 - protein, 247 aa, Heterodera glycines
  Coding regions on vcDNA: vcDNA=SeqID_60858; Strand=+; Position=1 -61,175-221,369-501,553-710,1118-1462
  Homolog annotation: Hit_ID=NP_503138.1; Match level="QueryCoverage =91%, HitCoverage=92%, E-value=3e-55, Identity=35%"; Hit description =zinc finger (50.9 kD) (5A602) [Caenorhabditis elegans] gb|AAG24206.1| Hypothetical protein W03F9.1 [Caeno
MDDAEKPLEIISLCPNCHENDCGHHNSNLQSGEQAQEFGTEIVLKVQKLEDLNRTIVRSEYGTIQIPELELTIPAKSRSGDLTTVEGVVQSVREDLQHFQPERKKTEPNTAEKIDHFIGRLSKLLSLQSSWTLKLRDPSGNCFIQNPDPFHVDPRCITSHYYRRLEEDKLLGLIDDDAYEIQSAKLSQDEVDDREWKSYEDVKAEVLHFSTQCSACGASCDTRMKSTGNFYGFHLVCLHLKSTKGNE

SEQ ID NO: 134436 - protein, 199 aa, Heterodera glycines
  Coding regions on vcDNA: vcDNA=SeqID_60859; Strand=+; Position=1 -102,150-647
  Homolog annotation: Hit_ID=CAE62365.1; Match level="QueryCoverage =99%, HitCoverage=89%, E-value=5e-54, Identity=47%"; Hit description =Hypothetical protein CBG06449 [Caenorhabditis briggsae]
MSTDCDICGFKSNEVKSGGATQENGCKLILRIAEAADLSRDLLKSDTCQIIIPELDIEMGQGVLPSRFTTVEGLLIAIKEQLERQAPFFLGDSATEEERTKFQKLLDRLRDAIQIKEPLTLVLDDPAGNSYLQARFLAYSFILFALFQSLTDHVEDKRLQKEFYTRTNEQNEELGLNDMKVDNYEELETLKEDDEMDDR

SEQ ID NO: 134437 - protein, 124 aa, Heterodera glycines
  Coding regions on vcDNA: vcDNA=SeqID_60860; Strand=+; Position=1 -114,153-240,286-404
  Homolog annotation: Hit_ID=CAE68266.1; Match level="QueryCoverage =100%, HitCoverage=100%, E-value=6e-30, Identity=50%"; Hit description=Hypothetical protein CBG13943 [Caenorhabditis briggsae]
VVKFSPTCGTILTLSDGKDYCKQFSCGSCSYTLPISKKLTSRIYSKKKELTSRIYSKKKEDEKIIGGTEMWENAQVTNERCPSCSRCPSCSHDKAYFQQIQTRSADEPMTIFYRCANCGHRWKE

SEQ ID NO: 134438 - protein, 24 aa, Heterodera glycines
  Coding regions on vcDNA: vcDNA=SeqID_60861; Strand=-; Position=1-80
RTLSTAVRQRSSKIYSMPQILWAG

SEQ ID NO: 134439 - protein, 18 aa, Heterodera glycines
  Coding regions on vcDNA: vcDNA=SeqID_60862; Strand=+; Position=1-54
MYMKMVANYLNGSSPVSA

SEQ ID NO: 134440 - protein, 110 aa, Heterodera glycines
  Coding regions on vcDNA: vcDNA=SeqID_60863; Strand=-; Position=1-332
FAGDKDFVMMTIKNKFPRTIILEGLKAEKDSGIEWNVEQLIKGLEEIITMREEAMRCTKITRAIGGQHENWDSGQRQFNRPRSNWQNNRYRNNNREYIKREERNPQNNQR

SEQ ID NO: 134441 - protein, 62 aa, Heterodera glycines
  Coding regions on vcDNA: vcDNA=SeqID_60864; Strand=+; Position=1 -83,193-298
MRITEGHDTVWVDQANSNGLIEKEAIRNVGIVQILFPSTAMPIDKYITGEICEIQVHNTKFY

SEQ ID NO: 134442 - protein, 467 aa, Heterodera glycines
  Coding regions on vcDNA: vcDNA=SeqID_60865; Strand=+; Position=1-1402
  Homolog annotation: Hit_ID=NP_912739.1; Match level="QueryCoverage =90%, HitCoverage=34%, E-value=1e-58, Identity=35%"; Hit description =unnamed protein product [Oryza sativa (japonica cultivar-group)]
LFYPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGDDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLERE

SEQ ID NO: 134443 - protein, 122 aa, Heterodera glycines
  Coding regions on vcDNA: vcDNA=SeqID_60866; Strand=+; Position=1-367
MQAGTTQIPGFGQLYILDPVEAMEMRRNNPIFTGENVKNEDAFVQGHELNEATLELLVEMIKKYHPAAQAYKQAREQLQELLKKHNPEELRFFRMTLLNERRTPAALKDPKLHPHQIITPST

SEQ ID NO: 134444 - protein, 442 aa, Heterodera glycines
  Coding regions on vcDNA: vcDNA=SeqID_60867; Strand=+; Position=1 -409,826-1030,1650-1919,1978-2042,2100-2197,2245-2528
  Homolog annotation: Hit_ID=CAE73368.1; Match level="QueryCoverage =73%, HitCoverage=59%, E-value=3e-22, Identity=25%"; Hit description =Hypothetical protein CBG20804 [Caenorhabditis briggsae]
SPQQLVESAANNLPPAAMKKPPHFVPIKPNHHHHQQQQQQHPVVEEKFKQYMPSSSSSTASSATSSPAAMPPPAVTPNNDNNNNDGGGGRHQTNATTATTALAMVADEYVDVVGDGAEGRSSLMRHQRKAHIEFYRKLKGLRSRGSTLDCQQCGQTVANTDACARSHLHAHCDVAQFVCKLCQRGFTDQHLVFEHINTEHPTKKGTQCIEDRRDMVQLMQLLTDCFPRIVCKTKDAMQEHLERLLSADTQKLAAAGDAVACTAAAEPTVCSNNSSDVNSSTVGGTSSMQCCHLCKADVPSERTALHAHLNAHPAFRCKKCKFVCMSHAEQKEHQRVEHGLDDEVTANSSQLPYCVSSALEVQYDMLRACFPLQNRQQQQSHSAPPPAGEHPATADASVAVSPPAAGAKRRRKTLKPDDSASAACGGKQKRNKKCSTASSIED

SEQ ID NO: 134445 - protein, 358 aa, Heterodera glycines
  Coding regions on vcDNA: vcDNA=SeqID_60868; Strand=-; Position=1 -243,463-1293
MQRKKYELEELERAAERRDQESPENEQRKISDFFQHHPEDYNKKLNESRLIFTQHLSGLQEVMSKYIGEKDINEIRQLNTEMQAKAVGLKDNASFENQIDRAKQLIEYRRKRFAALEFEAKKRDEQQQFVAAAANTITAPTASALIGREALKKRTGISASTDGEVGDKADVGPQTATTTTHGEVLKEKILEQQKHTDNDDTADAGPQAATTTHGEALREKILEQQKRTDDDDKAAVGQQTIPTATKTHGETLKEKISQEQKHLVDDKSNSANAKQDDGSGTDEKIAHGQTLIARLKQSEEQKKEWGDPPARYNDDDGRAPKHGEMLWKTVRSTVPTNQQQMGDVIHHHLADAEQTRGQ

SEQ ID NO: 134446 - protein, 20 aa, Heterodera glycines
  Coding regions on vcDNA: vcDNA=SeqID_60869; Strand=+; Position=1-61
MARRKLLLLLLIHLTYEAVQ

SEQ ID NO: 134447 - protein, 22 aa, Heterodera glycines
  Coding regions on vcDNA: vcDNA=SeqID_60870; Strand=-; Position=1 -33,133-168
MGADPKTLGKWEMLAFSLFPCV

SEQ ID NO: 134448 - protein, 32 aa, Heterodera glycines
  Coding regions on vcDNA: vcDNA=SeqID_60871; Strand=+; Position=1 -20,186-264
MFSFRIRHTVQKNISNWSLGHQLKLMEKLIMK

SEQ ID NO: 134449 - protein, 469 aa, Heterodera glycines
  Coding regions on vcDNA: vcDNA=SeqID_60872; Strand=-; Position=1-1410
  Homolog annotation: Hit_ID=NP_740973.1; Match level="QueryCoverage =91%, HitCoverage=78%, E-value=1e-14, Identity=22%"; Hit description =M protein repeat containing protein (72.5 kD) (2C572) [Caenorhabditis elegans] gb|AAM97999.1| Hypothetica
MSNLFYVLLPSDSPGYDNKPNKCRVHLPRTLTFGGQWLCGLHSIIYTNSWPAIGTTENQWIKVHLKNGDKIKIDIPAGSYQNEQELENAINESIKNGIKQPATRVKRQLEDGVDLFFHYNPDDYWEKIEEERQRYKELLKLIVTKSRERDDETDTHRKRKIEDEEIDPLQNQSLTKKARIEALEEAARQRDDGKEEKEERTGQEFLEMYPVNYREKLNEVRLELIRDLFNIQDHMKKYQGVTDGRTIQELNETPLKMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQLRRLVDYRKKRFAALEYEAKKRDALQQQPMALALTHGEALKERIGKIEGTTTTADGEETKTHGKSLVELIEQVQKERDDSKAKTEGKTRGEILGDKLKAKIDEQDSSADGRSMVKH

SEQ ID NO: 134450 - protein, 207 aa, Heterodera glycines
  Coding regions on vcDNA: vcDNA=SeqID_60873; Strand=+; Position=1-623
ERDDETDTHRKRKIEDEEIDPLQNQSLTKKARIEALEEAARQRDDGKEEKEERTGQEFLEMYPVNYREKLNEVRLELIRDLFNIQDHMKKYQGVTDGRTIQELNETPLKMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQL

SEQ ID NO: 134451 - protein, 60 aa, Heterodera glycines
  Coding regions on vcDNA: vcDNA=SeqID_60874; Strand=-; Position=1 -67,113-192,281-316
MFHSTYELSFKDAAIINKIYCNENCKNTENKCQKGGYPNPKNCNQCLCPMEIAKLTGAMN

SEQ ID NO: 134452 - protein, 49 aa, Heterodera glycines
  Coding regions on vcDNA: vcDNA=SeqID_60875; Strand=+; Position=1-147
MNLPAEEIWAAHEGYIQSDTTVEEVAQMFYQEQVADNGRQITRDQYLTE

SEQ ID NO: 134453 - protein, 77 aa, Heterodera glycines
  Coding regions on vcDNA: vcDNA=SeqID_60876; Strand=-; Position=1-232
  Homolog annotation: Hit_ID=AAA28932.1; Match level="QueryCoverage =100%, HitCoverage=19%, E-value=2e-17, Identity=54%"; Hit description= potential zinc-finger domains centered at aa 135 and aa 364; 43 kDa protein; putative
IKRRFSPEAVDTIFETDETGTIDWIPMLISVQCWRRLVFELAEQFPHCLMLTFAIKLISDAGFQHEISNVNTAAQQV

SEQ ID NO: 134454 - protein, 36 aa, Heterodera glycines
  Coding regions on vcDNA: vcDNA=SeqID_60877; Strand=-; Position=1-108
MSNASRGPIPDDVATVPTREIHLNSPFNIRTIYNFR

SEQ ID NO: 134455 - protein, 275 aa, Heterodera glycines
  Coding regions on vcDNA: vcDNA=SeqID_60878; Strand=-; Position=1 -84,180-413,455-522,2502-2940
MLRTDKHLLLQLMDTLKSDPMLDFTFLQSNSELRNKSRQQLVDFLVYGIGRKLSGFELKRRRNISSRKSPGLLNLEGEASKECPGKEPSSAATDWEEIGTANVAEQVDLLVQEATDWDNLALMYEGWTAYIDHFVLAFLRANKQIFDKDTALLLNVWKYNDNDIVQPIWNVLVHEIWPIFAPNICHLDFPDGDDLNNLRRLISPTILTDLKQLNSINPDNIFPAAIGDFDDEPNATAGQMLSKWLHTPRKDGQSKRLFFMENKQRDFEWVNTFKV

SEQ ID NO: 134456 - protein, 25 aa, Heterodera glycines
  Coding regions on vcDNA: vcDNA=SeqID_60879; Strand=+; Position=1 -18,293-352
MYFLKLLEVALKEAKVQDVGRLVIE

SEQ ID NO: 134457 - protein, 111 aa, Heterodera glycines
  Coding regions on vcDNA: vcDNA=SeqID_60880; Strand=-; Position=1-333
MIQRTEKGTAILIEAVKKEAERAWKEVSVLADEADEYAKSAHGALNRAIKSREKAPYAPGVREWFVKMSDCIWEIYTILDKINAESERVETIWREVDLCKDLDQATKLEDK

SEQ ID NO: 134458 - protein, 210 aa, Heterodera glycines
  Coding regions on vcDNA: vcDNA=SeqID_60881; Strand=-; Position=1 -483,1189-1336
  Homolog annotation: Hit_ID=NP_608540.1; Match level="QueryCoverage =97%, HitCoverage=58%, E-value=4e-15, Identity=32%"; Hit description =CG2839-PA [Drosophila melanogaster] gb|AAF51469.2| CG2839-PA [Drosophila melanogaster]
RKGKEERAEEIGEKVRDKGKGEEEEKRDEDIPTEFELDTSRGLGRHLLETLSRELQYQEEVDTEISKRRRRVGADGREIPEGVEEEERTTEEEKGRGRDEGRGKEQRIREEEKRRTEEQRMREDVERRRREEMRRTTPIEEEEEHELLETEEITQQQHEQKEFYDGTAKTTKAAADEPQHKTTPTLSTHSSGKTERRNGGNVQRRVNFTG

SEQ ID NO: 134459 - protein, 31 aa, Heterodera glycines
  Coding regions on vcDNA: vcDNA=SeqID_60882; Strand=+; Position=1-136
TKLLITPNSVSGINFCALIQNLQVASDHCHF

SEQ ID NO: 134460 - protein, 84 aa, Heterodera glycines
  Coding regions on vcDNA: vcDNA=SeqID_60883; Strand=-; Position=1 -165,216-305
MSPSENSDHPFQQPDNVQAVQQPHEEQDEEAELRAQIEDAEEDLLLNWWLEDPTIIRFFWTPSSTCHRSSTSSVHAHEAKIMRQ

SEQ ID NO: 134461 - protein, 267 aa, Heterodera glycines
  Coding regions on vcDNA: vcDNA=SeqID_60884; Strand=-; Position=1 -37,238-520,708-932,1211-1469
MRRDHLRILWDPNYVTLLCANITFYGNPENADIYTSEIERILDPVYKFVNQWFDSLLDSTWPTYENLLIRNTMQDISKGMIIPETNATYQQIVDVVYETMRFIGHPGYRRKYVVTRDRRFDLLSWDFWFACRPNSCTNTTTLNARFISIRTKTDTNDVFESLQKLINFKVSSWPIFFSAMDSELYSYTFIETAIKVLAKKYGLNFNNFTNHSSYVVLRQDVYLSGCLNSFAMKCNEDLDNAFLQALHYHEDGTVFTNCEDWVVILGI

SEQ ID NO: 134462 - protein, 35 aa, Heterodera glycines
  Coding regions on vcDNA: vcDNA=SeqID_60885; Strand=+; Position=1-113
WVPISRKPSDLAKIVQQRIILHVFRFLFCSLRQKD

SEQ ID NO: 134463 - protein, 35 aa, Heterodera glycines
  Coding regions on vcDNA: vcDNA=SeqID_60886; Strand=+; Position=1-113
WVPISRKPSDLAKIVQQQIILHVFRFLFCSLRQKD

SEQ ID NO: 134464 - protein, 333 aa, Heterodera glycines
  misc_feature (47)..(47): Xaa can be any naturally occurring amino acid
  Coding regions on vcDNA: vcDNA=SeqID_60887; Strand=-; Position=1 -197,469-562,630-661,727-771,831-933,1013-1144,1197-1280,1546-1728
  Homolog annotation: Hit_ID=CAE75020.1; Match level="QueryCoverage =98%, HitCoverage=82%, E-value=1e-86, Identity=58%"; Hit description =Hypothetical protein CBG22924 [Caenorhabditis briggsae]
VTRLGRIACISFSLFGIPLTLVTIADLGKFLSEHLVWLYGKYLSLRXLIFIDPTRPPNGHSKSDLNSFACSSDHSIFVLRIPALLVLAILVLYTALGGVLMSQLEPWSFFTSFYWSFFTSFYWSFITMTTVGFGDLMPRREHYVGFGDLMPRREHYTALILLYIVLGKFATKSSYSFPSAIGLAITTMCPSAIGLAITTMCIDLVGIQYIRKIHYFGRKIQDARSALAVVGGKVVLVSELYTNLVVLVSELYTNLVQKRQRNNTLRDAFIIENLYVSKRHIIPFIPSDIRLIKYIDQMEPPLTRSNSLLASDHPHSNSCRFCHSHFGMAHHIE

SEQ ID NO: 134465 - protein, 123 aa, Heterodera glycines
  Coding regions on vcDNA: vcDNA=SeqID_60888; Strand=-; Position=1 -130,511-710,812-851
  Homolog annotation: Hit_ID=AAU87822.1; Match level="QueryCoverage =95%, HitCoverage=21%, E-value=3e-30, Identity=56%"; Hit description =Twik family of potassium channels protein 7 [Caenorhabditis elegans]
KYAKLILPHVALVLLTCAYTIFGASIFYSVEHPHEIASKRRQVKPFGRHPFQFVSALLRLALSNASGVRVEWEHLARSHLHEMSDNLFNAFEKHFLTATEVKRNVTISIWCLISPIFFIYSFP

SEQ ID NO: 134466 - protein, 179 aa, Heterodera glycines
  Coding regions on vcDNA: vcDNA=SeqID_60889; Strand=-; Position=1 -117,374-496,640-805,1277-1410
  Homolog annotation: Hit_ID=NP_504050.1; Match level="QueryCoverage =71%, HitCoverage=36%, E-value=3e-19, Identity=42%"; Hit description =predicted CDS, putative protein family member, with at least 5 transmembrane domains (5E270) [Caenorhabdi
MWGCESMAEMCLAINRCLELASPRLTRFLFDGKRILLWMLFPTLYGLYFFIFTKPIIFSGMYITWFFNPHFEYINDFEEKYRNDLHTVHNYIVVIVLSSTYLTFAAILFFQGRQFKTIRTDTTRVSQKKVIIINKDFHPSDSDQHCKWMCCTHLCVYELCAAEPISDHSWPISLDHGTW

SEQ ID NO: 134467 - protein, 49 aa, Heterodera glycines
  Coding regions on vcDNA: vcDNA=SeqID_60890; Strand=-; Position=1 -35,82-111,161-206,263-299
MAFTVFFAYRGSFNRNFVILSNDARNWQTLAREIDDEVRAPLLFTILYK

SEQ ID NO: 134468 - protein, 122 aa, Heterodera glycines
  Coding regions on vcDNA: vcDNA=SeqID_60891; Strand=+; Position=1 -90,1005-1280
MTTAMLEGIPGLVTSTCGKIRENFPTLDQQTFVFTYLLLICALQFAKYVVIDIYKCVQNRTSLPKDCGQMVHVKMEEIFADFIKEIKATHAEIGSIEEIRQGSKAIFWHIHNKIQTDKVIWK

SEQ ID NO: 134469 - protein, 178 aa, Heterodera glycines
  Coding regions on vcDNA: vcDNA=SeqID_60892; Strand=-; Position=1 -230,279-585
MLDQIRSDFSRADKCELSSRINLEDEGKEVLKFGQILYETLEKHSENVKYDEKKQLLTFPLQMGERIIKRLGKLIEINFNEHKKIANDIDFIKTIQTVASMENELIAEKRKVTISEYVNLRLINLLFSLALRLLIQTEQNELIDQYLPIYLFAIKLSREEWYLIIIKIKNIKNLFIIE

SEQ ID NO: 134470 - protein, 67 aa, Heterodera glycines
  Coding regions on vcDNA: vcDNA=SeqID_60893; Strand=+; Position=1 -113,177-267
MPLLSLNLLSIEYIVWPICNGLFVMAYSSCTPVLFLCSTEYRKAFCKYVCRKQHGLTVVVPLQNMPA

SEQ ID NO: 134471 - protein, 58 aa, Heterodera glycines
  Coding regions on vcDNA: vcDNA=SeqID_60894; Strand=-; Position=1-174
MPEKSITFLILLFLLIFSAYEAAMLREYVKLPYTPEQTSFVGDVATGAGYGMMLNVSK

SEQ ID NO: 134472 - protein, 520 aa, Heterodera glycines
  Coding regions on vcDNA: vcDNA=SeqID_60895; Strand=+; Position=1 -216,613-911,952-1268,1427-1718,1774-1946,1992-2081,2125-2298
  Homolog annotation: Hit_ID=XP_393347.1; Match level="QueryCoverage =100%, HitCoverage=37%, E-value=1e-35, Identity=28%"; Hit description= similar to ENSANGP00000016848 [Apis mellifera]
KGVKRKADTTTSFDEEGPSTKQPIKREVRPIKKGPAPVDYSQLKPLLKGKLNERMKFCHKLLNELITSKRCKSYFNVKWRHLPAEMPPDTAEKAVPTLALPPKEEKKEILTKTSISNKPSSVSPTALLQKFKPVDDDEQIDFLILQVQAEHARVTEKQTQLQQYSHDLLQLKIRRREARTQQQITPPLSAESHQAIKKLLNACLPISSIPTSLSLPHSTAFLPSINAVQTSVVGLLQPNVQSQLPPAMPTISPPQQMKKKAGPGRPRVTNSGSSAFIAQSVSVSQINQVPVQQQFPAVDAPHPNLLPQQPNAKSGRGRKPGSKNKPKTESQKEDTLTKEYEFNSEDEHSSEPMTYDEKRQLSMNINNLPGDKLTSVVNIIKAREQIKDLNPDEIEIDFETLKPVTLRELEAYVKACSQQPDKKPKKTSTTSYPKSLHPEHPKKKDTDPQAQQFNGSAPPTGKLPNGDSGQLSVTSTTTAFAGRTTQGMVAQKEDENSSSESSSGSSSSESDSSDSSDSES

SEQ ID NO: 134473 - protein, 171 aa, Heterodera glycines
  Coding regions on vcDNA: vcDNA=SeqID_60896; Strand=+; Position=1 -390,535-661
SGSFAASKVPPPVPPPPPSISSAVIPPSVPKAPSSHVHSGAAPLLQTNNPTEISAGISGSVLDHLLPSVTNGEKGTGGAAIGAGLLNKNSWSSLAQKATEGVGQMGHAVNATNAYELFRKQAREKEERVTPPNDGQQQQQQPKINPEEVNRLREQEKVSLLRGEMGTIRFI

SEQ ID NO: 134474 - protein, 71 aa, Heterodera glycines
  Coding regions on vcDNA: vcDNA=SeqID_60897; Strand=-; Position=1 -108,759-866
MAKELVISAPNLMNEIKSGNFDAKLAIESLNKHSFAEGNVDVYDRYGGHYYSHKLLYDVIVIAIVSFVVLR

SEQ ID NO: 134475 - protein, 21 aa, Heterodera glycines
  Coding regions on vcDNA: vcDNA=SeqID_60898; Strand=+; Position=1 -54,577-588
MRTRPIWQVKQRLLTSQKKGF

SEQ ID NO: 134476 - protein, 210 aa, Heterodera glycines
  Coding regions on vcDNA: vcDNA=SeqID_60899; Strand=-; Position=1 -125,369-696,749-927
  Homolog annotation: Hit_ID=D96715; Match level="QueryCoverage=49%, HitCoverage=81%, E-value=5e-40, Identity=72%"; Hit description =protein F4N2.10 [imported] - Arabidopsis thaliana gb|AAF27056.1| F4N2.10 [Arabidopsis thaliana]
FATPTRGLTTPRLATSTRSTDCYYVDITCDAPNNGQPVYIEVSCGRKCYVPTTPTTPTSPTTITTPTTPTTPTTPTTPTTPTTPTTPTTITTPTTPSTPTTPTTPTTPTTSTTPTTPTTPTTPTTPTTPTTPTTPTTPTTPTTPTTPTKNPPNCCDKCIAGSVKPGEQGIDCNGAKLNPEFGYKITNYKCASLNVTCSSYLVNNGIIAIK

SEQ ID NO: 134477 - protein, 160 aa, Heterodera glycines
  Coding regions on vcDNA: vcDNA=SeqID_60900; Strand=+; Position=1 -84,236-404,477-647,697-754
MHIPKIEFPKEIVPSLANLSLNRQPIDVDRLLKLLERTQKDVQRLTTANQQLTTANQQLTTTNQQQQNTINHQQQNIQQLQNLLAGQQPLVPAFAPGVFGEQQQHHHAPADFLGDQHALGGQNPHAAPFGPDFFGGQPENFGVQQQHMQEQQGPPPPPPP

SEQ ID NO: 134478 - protein, 201 aa, Heterodera glycines
  Coding regions on vcDNA: vcDNA=SeqID_60901; Strand=+; Position=1 -84,788-1309
MPAQTIGGLEDAQPRHEVQIGECAEELIQFYADAHEYLGNWSQQFSETDEIIGDWVIFESEPTIRKAYRHFCGASTDEMDALFGEIAELKQTLKELEGDRFNRKNVDEKWAAIFKNPNFVLLKSLVSAILSIFPSNAFCESVFSVLMNIKTDERNSIGMPLLNSLISIKFNANISCPNAHNYFLSLPNLLKQVKSGDKYVV

SEQ ID NO: 134479 - protein, 122 aa, Heterodera glycines
  Coding regions on vcDNA: vcDNA=SeqID_60902; Strand=+; Position=1 -122,296-442,802-903
QKENGEATAETTTKTAITPTISEQQTTGSSSIAAVQSILVTDAPTIVPTSSSSSASPPPPPQTTQSPVISFMTLMNKEENANIKHGEEKGLKLEENSGQIAAELKAFEEAQSQLGNISKKLN

SEQ ID NO: 134480 - protein, 102 aa, Heterodera glycines
  Coding regions on vcDNA: vcDNA=SeqID_60903; Strand=-; Position=1 -90,137-355
MLLFLLQNDVQTHFLEFEQISFVIFAHRALLWIAENNEFEQKVEKSNIVRTRYFRSQSTCKTSEKSLKTCKLIDSSGLLKITSSNKRSKSRTLFELYKNDQD

SEQ ID NO: 134481 - protein, 137 aa, Heterodera glycines
  Coding regions on vcDNA: vcDNA=SeqID_60904; Strand=+; Position=1-412
MNRFDQNDFTITSVHQMRNRPRNTIGEIAEVSFAPLEEVERPDRVLERLVRRLFDRVLDGRSAPMLIGLQLHPPTFENPFTIPLRPPEQNNPAAIADLIQRLNDQSAAGIDLTAGTTVTKVLAVWPMQADQSDAGRS

SEQ ID NO: 134482 - protein, 257 aa, Heterodera glycines
  Coding regions on vcDNA: vcDNA=SeqID_60905; Strand=-; Position=1-773
MVGIGMAFLLAIMGCICPILGRFWSGAAALGKAIAWGAKYPIRLFNWATGRQISPPTAAQVEIKLKRGARKARTRVRELQQQLQLSRRARAAAHAWRQPKRNQLTVRGTVAAGLLPLLLLIGTTFASKPLSVTVRSEDCARTAKGLQCAGTATTIITLLPADQVNSFVIRTQQDELLGTVRLRLASITMVCVPKTESWLRSYTISTVAVKRCPSAGSCRDDNCSTMNGRVMVPELNELNHRPGHSMCMSSTSFWAVC

SEQ ID NO: 134483 - protein, 132 aa, Heterodera glycines
  misc_feature (115)..(115): Xaa can be any naturally occurring amino acid
  Coding regions on vcDNA: vcDNA=SeqID_60906; Strand=+; Position=1-399
  Homolog annotation: Hit_ID=NP_508324.1; Match level="QueryCoverage =98%, HitCoverage=5%, E-value=2e-11, Identity=26%"; Hit description =predicted CDS, peptidase family A16 and RNA-directed DNA polymerase and Integrase, catalytic domain and Zn
EDCARTAKGLQCAGTATTIITLLPADQVNSFVIRTQQDELLGTVRLRLASITMVCVPKTESWLRSYTISTVAVKRCPSAGSCRDDNCSTMNGRVMVPELNELNHRPGHSMCMSSXASGQCACGHPSASCLFY

SEQ ID NO: 134484 - protein, 392 aa, Heterodera glycines
  Coding regions on vcDNA: vcDNA=SeqID_60907; Strand=+; Position=1 -638,868-1078,1210-1540
  Homolog annotation: Hit_ID=XP_318162.1; Match level="QueryCoverage =94%, HitCoverage=41%, E-value=1e-33, Identity=29%"; Hit description =ENSANGP00000020700 [Anopheles gambiae]
NFCRSWFLPLNIHNGKLEFELDSGADVTVIDEIDWKHIGKPKLEPSQGLVAYGGKSIAGILGKAKVKLTHEGRTTESNIHVINGKHKNLCGRDLIMGLKIDLNRAFGIPTIRAVENKKELEACLAQYPEVFQDGVGRCKKMASLKFKEGCQPKRCKPRPVPFSLRNEVEKVLDQWQAEKIIEPVATSEWATPLVIMPKANGKLRLCFDYKVTQVMEEVLQGIDGVAVYLADILITAATDQQHVKRSDQVLKRLSENGLRVKREKCEFLKPEIEYLGHIVDKKEPLNELRRNDAKWTWTKSQQKAFDRIKNVLTSTKVLVHYDPQKPLFLAADASDYGVGAVIFHKDEKGKVGVIAYASRTLNSLERNYSQIEKEARAIIFGVDKFKQYLYGR

SEQ ID NO: 134485 - protein, 60 aa, Heterodera glycines
  Coding regions on vcDNA: vcDNA=SeqID_60908; Strand=+; Position=1 -76,155-261
MDSTKPIVFLKVSLKGKPATVVGRVDTKTSVLSEAFASKIGDIDSNLRGRERPQLPMCPL

SEQ ID NO: 134486 - protein, 92 aa, Heterodera glycines
  Coding regions on vcDNA: vcDNA=SeqID_60909; Strand=+; Position=1 -111,157-219,393-499
SSNDYQPNNGQLINNSDQGKINGQVGTVVGHDQQGAASLTNDQINQLITQLQAKQAAGKGRPRVKITKTVAEIFLDEQETTNEAIMANPSNK

SEQ ID NO: 134487 - protein, 68 aa, Heterodera glycines
  Coding regions on vcDNA: vcDNA=SeqID_60910; Strand=-; Position=1 -171,236-271
MIEIVIIFLAKSIKELSRRAPMGRYASFLAGLEPPRKAKKYQAADERLFNLVQNYIPNFSVEFRAIII

SEQ ID NO: 134488 - protein, 178 aa, Heterodera glycines
  Coding regions on vcDNA: vcDNA=SeqID_60911; Strand=-; Position=1 -339,803-1000
MPKKANEAEKEADLKPKKANKAEKGWTNGVKEIANAIFEKSKNVLYPKKKIYFAFGEPFNATAFHGDKELKIYTELKADQKNGKFYVEVDMTDFDQFQNQPKAMIDFKNAKGLIYGGATVQVLHNVAVLDFSDEVRNYFLNGSGQLFFRNESTGQQYSVDANGDYDIVHNEGPFRGFG

SEQ ID NO: 134489 - protein, 24 aa, Heterodera glycines
  Coding regions on vcDNA: vcDNA=SeqID_60912; Strand=-; Position=1-80
RTLSTAVRQRSSKIYSMPQILWAG

SEQ ID NO: 134490 - protein, 39 aa, Heterodera glycines
  Coding regions on vcDNA: vcDNA=SeqID_60913; Strand=-; Position=1-117
MNDLWANCLCFEWTIGHFRPLVSLEVMGKAAAEEYGNCK

SEQ ID NO: 134491 - protein, 92 aa, Heterodera glycines
  Coding regions on vcDNA: vcDNA=SeqID_60914; Strand=+; Position=1 -50,98-227,511-607
MFFTGIDRLIAIAFWEFHEYLALLTVISVSYAVCESVEVYQKAIMHGDQMTTGSYLDFMKIKSFSNIINVLLISMTCIIYVFLGIVVNFQKS

SEQ ID NO: 134492 - protein, 209 aa, Heterodera glycines
  Coding regions on vcDNA: vcDNA=SeqID_60915; Strand=+; Position=1 -50,96-243,296-392,606-822,872-989
MFFTGIDRLIGIAFSEFHDNLQKRLYLALLTILSVVYGFCFSVPVYQNATRDGDQMTTGSYFDFLKSAPIFDKLSFLITSITCIIYLLLGIAVRIKASGLPSADSFNRRTFRALFCIISVNIGGYFFSLICYILLIPKISSPITAWFCNVITAIPMNIGAASGGLILYFTSTEYRQAFQTAFPFVFKQISNVNQVIPLQNGAQLGTTQC

SEQ ID NO: 134493 - protein, 111 aa, Heterodera glycines
  Coding regions on vcDNA: vcDNA=SeqID_60916; Strand=-; Position=1 -109,164-230,276-435
MTFLFFMNKQYNAFSGQNFIEYRLAAMILFIPVIGLGAIVPTMFFTGIDRLIGIAFSEFHDNLQKRLYLALLTILSVVYGFCFSVPVYQNATRDGDQMTTGSYFDFLKVLV

SEQ ID NO: 134494 - protein, 53 aa, Heterodera glycines
  Coding regions on vcDNA: vcDNA=SeqID_60917; Strand=+; Position=1 -146,501-516
MNKIIAAKRYSMKFCPEKALYCLFIKNKKVIRRAKTTYSDDYSGKCVVESVRP

SEQ ID NO: 134495 - protein, 237 aa, Heterodera glycines
  Coding regions on vcDNA: vcDNA=SeqID_60918; Strand=+; Position=1 -198,252-400,446-676,728-863
MNDNNEVCDYLNITTTTNSDSNNLTAKCAVLEASQNVTIFEWFFSSMTHQFVVAKCAYQFKVAQVASDFYHDNVLIFYEKYPIISPVTAWIVLPNIFTPISIIFNLSLILVTITTMRDRKVCNWLIAFDSLCQLFVVATFGVNLVGVIFQHSTIDYCICLATLMAATVASYDSIMAMFLISVERLLIVLCPIRMNSIKKSTVCQCSLLSVILCTLFGLVMNLEVFNIWTIINIPCDR

SEQ ID NO: 134496 - protein, 339 aa, Heterodera glycines
  Coding regions on vcDNA: vcDNA=SeqID_60919; Strand=-; Position=1 -147,212-540,626-1166
  Homolog annotation: Hit_ID=NP_608540.1; Match level="QueryCoverage =98%, HitCoverage=64%, E-value=2e-26, Identity=27%"; Hit description =CG2839-PA [Drosophila melanogaster] gb|AAF51469.2| CG2839-PA [Drosophila melanogaster]
MASKTPTEEEIGEETKKREEKQEEERRKRRRNMRKTAGGIRYMRNIAIQVESDTKVADKYADFTCQFDNDNKGGTKSDEKEKQQKTMMDKWTQHKSSEANLWQNIWQSVEKENGQKRKGMATEEEDEEEGEAEKEEKVGEESSRTEKERSEQTQSEFNLKRKCKRSQTERLLLVSRPAQTQLSSTFRRSDGDGREEGKAEGESEAQIEPHFEREKEREELKRVFGLENENIEELRQRVIQMKEKRREDRQRRRREDGQRQSEESGGTERKRNTSSEEEDELDEEEKEILINEIKKMKSRRRRVEEQRKKVEEGKVEKGTEEEEEEEKDEEEEKGTEEDH

SEQ ID NO: 134497 - protein, 63 aa, Heterodera glycines
  misc_feature (55)..(55): Xaa can be any naturally occurring amino acid
  Coding regions on vcDNA: vcDNA=SeqID_60920; Strand=-; Position=1-195
FEYPKRTLEKIDFFVFGAVPPNRCAQIYGETESFRNSFPIACTLILRWIFAPHNXFEYPQTDT

SEQ ID NO: 134498 - protein, 498 aa, Heterodera glycines
  Coding regions on vcDNA: vcDNA=SeqID_60921; Strand=+; Position=1-1496
  Homolog annotation: Hit_ID=XP_320889.1; Match level="QueryCoverage =89%, HitCoverage=53%, E-value=1e-85, Identity=39%"; Hit description =ENSANGP00000012033 [Anopheles gambiae] ref|XP_313651.1| ENSANGP00000013044 [Anopheles gambiae] ref|XP_314
MLEDAQKNGTNISLKKIEEELRAIQLVKESALSLVNPPIATNAIRTRPRQWTDPAQRQSGGSNQRQTPNANSSGKPTRGQRTHPCGSCGKIDHWRSDCSFKDVTCLKCNKKGHISTICRSKKTKAPPNSHRSFHTVKIDANCLHVGTTQGRWWKLCILINGRQTSMNGDTGAQATIISLQTWRELGEPELTPSDIDAKNCNDQPFSLLGKFQCTVQFADKPPQILIAYVSGEVGHNLLGLPWIEALEIIPRQILFPTNKSDQATKMIDNFSAVKPPNKSINNVSTLKAVLQKDFPEVFEEGLGHCSKAKAHLILRSDAKPVFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDEESKQLCAINTHRGLFQCQRLPFGVKSAPAIFQHLMDQICAGIPGVFAYLDDGLIATKTLEQHITALYTLFGRIK

SEQ ID NO: 134499 - protein, 320 aa, Heterodera glycines
  Coding regions on vcDNA: vcDNA=SeqID_60922; Strand=-; Position=1-960
  Homolog annotation: Hit_ID=XP_320889.1; Match level="QueryCoverage =99%, HitCoverage=37%, E-value=3e-45, Identity=33%"; Hit description =ENSANGP00000012033 [Anopheles gambiae] ref|XP_313651.1| ENSANGP00000013044 [Anopheles gambiae] ref|XP_314
AQRQSGGSNQRQTPNANSSGKPTRGQRTHPCGSCGKIDHWRSDCSFKDVTCLKCNKKGHISTICRSKKTKAPPNSHRSFHTVKIDANCLHVGTTQGRWWKLCILINGRQTSMNGDTGAQATIISLQTWRELGEPELTPSDIDAKNCNDQPFSLLGKFQCTVQFADKPPQILIAYVSGEVGHNLLGLPWIEALEIIPRQILFPTNKSDQATKMIDNFSAVKPPNKSINNVSTLKAVLQKDFPEVFEEGLGHCSKAKAHLILRSDAKPVFCRARPIPHGAMEAVNAELDRLLQIGAIKPIDFSHWAAPILAVKKKNGKTRVC

SEQ ID NO: 134500 - protein, 100 aa, Heterodera glycines
  Coding regions on vcDNA: vcDNA=SeqID_60923; Strand=-; Position=1 -38,86-192,652-809
  Homolog annotation: Hit_ID=NP_509669.2; Match level="QueryCoverage =96%, HitCoverage=12%, E-value=9e-20, Identity=48%"; Hit description =metalloprotease precursor family member (85.2 kD) (XK564) [Caenorhabditis elegans] emb|CAB01675.2| Hypoth
MHYNSKAFAKNDKLETIETIDKNYQQTMGWRLGLSFLDAKAINHRYCEHVCDDYPWHSPDCRNNGYANPNKCTECLCPDGYAAPYCDSVEIGHVNGEAGN

SEQ ID NO: 134501 - protein, 29 aa, Heterodera glycines
  Coding regions on vcDNA: vcDNA=SeqID_60924; Strand=+; Position=1 -66,123-146
MAISFLRKFSMQQTLSNMKRSAKNGYLFF

SEQ ID NO: 134502 - protein, 29 aa, Heterodera glycines
  Coding regions on vcDNA: vcDNA=SeqID_60925; Strand=+; Position=1 -66,123-146
MAISFFEKFSMQQTLSNMKRSAKNGYLFF

SEQ ID NO: 134503 - protein, 29 aa, Heterodera glycines
  Coding regions on vcDNA: vcDNA=SeqID_60926; Strand=+; Position=1 -66,123-146
MAISFFEKFSMQQTLSNMKRSAKNGYLFF

SEQ ID NO: 134504 - protein, 29 aa, Heterodera glycines
  Coding regions on vcDNA: vcDNA=SeqID_60927; Strand=+; Position=1 -66,123-146
MAISFFEKFSMQQTLSNMKRSAKNGYLFF

SEQ ID NO: 134505 - protein, 22 aa, Heterodera glycines
  Coding regions on vcDNA: vcDNA=SeqID_60928; Strand=+; Position=1-66
MAISFFEKFSMQQTLSNMKRSA

SEQ ID NO: 134506 - protein, 152 aa, Heterodera glycines
  Coding regions on vcDNA: vcDNA=SeqID_60929; Strand=-; Position=1 -167,263-334,440-657
QDKSSNSASGSSGVQQQGSSGNGSGGNGPGGSSSAKSVGNGVAATPNTHHGHGGQSSSGRPHHHTNQQPQSSSSVQQDARAQRANAFLSTIVPRMQQMLGSTTGGGSGGSGGTTTTAALDLNIAGGAAGLIDATAMPTFHFSHTHGHHQHVS

SEQ ID NO: 134507 - protein, 194 aa, Heterodera glycines
  Coding regions on vcDNA: vcDNA=SeqID_60930; Strand=+; Position=1 -45,83-160,249-356,442-526,590-695,755-855
  Homolog annotation: Hit_ID=CAE73715.1; Match level="QueryCoverage =99%, HitCoverage=14%, E-value=9e-50, Identity=55%"; Hit description =Hypothetical protein CBG21229 [Caenorhabditis briggsae]
VQNDIYNDWTHICQKKLKLTFYNYKSSKLKLTFYNYKSSIEKYNRETFGNCFELSTASDGNFLEVLNISMNSFLAYHSDRRFETTGQQIIFLTPGSGVFNVDREMVNLTKQRIIDMGISISLDIVCLGEQPLHAVPLFVFKHKSPQQSDDYFIPHWMNYSHWMNYSYFNMPRNSSISSKFKTRINFPEDIVKVP

SEQ ID NO: 134508 - protein, 112 aa, Heterodera glycines
  Coding regions on vcDNA: vcDNA=SeqID_60931; Strand=-; Position=1 -95,160-212,483-673
MIKAGETVEFGLYSLCSIVIRILKKREKSAENLCPPISSLPDDQFNVEIDRSVLPFSYVRFAGDQSNAQHGDEGKAAANAHFGRVGHRHGAVHGICGGHLNHSYPQANSTKS

SEQ ID NO: 134509 - protein, 27 aa, Heterodera glycines
  Coding regions on vcDNA: vcDNA=SeqID_60932; Strand=-; Position=1 -60,121-144
MAISFFEKFSMQQTLSNMNEKNGYLFF

SEQ ID NO: 134510 - protein, 29 aa, Heterodera glycines
  Coding regions on vcDNA: vcDNA=SeqID_60933; Strand=-; Position=1 -66,123-146
MAISFFEKFSMQQTLSNMKRSAKNGYLFF

SEQ ID NO: 134511 - protein, 29 aa, Heterodera glycines
  Coding regions on vcDNA: vcDNA=SeqID_60934; Strand=-; Position=1 -66,123-146
MAISFFEKFSMQQTLSNMKRSAKNGYLFF

SEQ ID NO: 134512 - protein, 29 aa, Heterodera glycines
  Coding regions on vcDNA: vcDNA=SeqID_60935; Strand=-; Position=1 -66,123-146
MAISFFEKFSMQQTLSNMKRSAKNGYLFF

SEQ ID NO: 134513 - protein, 201 aa, Heterodera glycines
  Coding regions on vcDNA: vcDNA=SeqID_60936; Strand=-; Position=1 -137,570-683,740-814,1183-1431
  Homolog annotation: Hit_ID=NP_491030.1; Match level="QueryCoverage =99%, HitCoverage=81%, E-value=2e-66, Identity=63%"; Hit description =DNaJ domain (prokaryotic heat shock protein) (dnj-30) [Caenorhabditis elegans] gb|AAK93866.1| Dnaj domain
VLQLEPDTNVEDARKKYKKLSLLIHPDKNPNCRERAERAFDALKKAIATVEDPDELSRCRDMYEEAKARLAVQISEKKRKMRKDGKADAIEEETDGKADAIEEETPQGYARALWITVTKVFADREKKRRTLEERANEEKRRLAESVQEAAEKRKLEEEYKKNYEESRDERRGSWRDFVKKKERKLEFRGANFKPPAPRLET

SEQ ID NO: 134514 - protein, 102 aa, Heterodera glycines
  Coding regions on vcDNA: vcDNA=SeqID_60937; Strand=-; Position=1-306
KILSFKLMLIKLNGKRHLFHPGILLTSSKISAIGIPSLKMSESEIGILAFFFILRFGAVYEKGFDLMFLLISTLDLLQNKKVFNTNVFKEIVHKIAIRETKE

SEQ ID NO: 134515 - protein, 97 aa, Heterodera glycines
  Coding regions on vcDNA: vcDNA=SeqID_60938; Strand=-; Position=1-294
MSEHKKCAAATILALFLFLAFCSYSTTAQQQQQHQKQTPPAEAEAAEEEDENAAAASYDAPVVTVEREESLPKPPPVAHSNDDGTPGTVHSLDGRVQ

SEQ ID NO: 134516 - protein, 463 aa, Heterodera glycines
  Coding regions on vcDNA: vcDNA=SeqID_60939; Strand=+; Position=1 -41,447-1128,1546-1725,2359-2633,2966-3155,3854-3877
MSHAFRVPPPHRPQNEGQGGKNDDDDEDQSEMEIFNRQITDICQMLLAHHHNEVEKVGRLCAQMGEAIRQVLAIQQQIPNPDEVEQQHGEDNGRDNRNNCSFDEDESDGESDDPTVEHPLPAARRVLRRLKLPTILDISAATEADVQEYGTKLSDTIKQITKLRVQNGGALTSELELRSKQKQAQNLLQQIGNLMPQLVVEEEEVAEILNLAEQSADRFSIGFLNKEQKKQFEEAIRQAKKAFEILLKHNLDSLVDKFYEDCYKKLLHVGNEILKRAKLTKEFEANMLSARIIGLNMRMEMENSLAKIQPPYAENEDLAALFDFDSHVKNAFLGFGLFKCLELDKSELRNAYEWLTENRNKIGSRQHILTLQNEFEAKMLKFRMNKLLWKMKRVENGEHDFCKLAEKLANDRIQTERNLKVEAELTKKAAISAQNLGLPVVEHINGYIDAINRSQQKCMKFGS

SEQ ID NO: 134517 - protein, 81 aa, Heterodera glycines
  Coding regions on vcDNA: vcDNA=SeqID_60940; Strand=+; Position=1-244
MRGLMLQVSTGEGKSWIVAMLAVILHTFGKKEPLADQQEGAQSDQEKEKHGHGETSTDQTEKEPAHGASDIDKTKAEESPH

SEQ ID NO: 134518 - protein, 294 aa, Heterodera glycines
  Coding regions on vcDNA: vcDNA=SeqID_60941; Strand=+; Position=1 -106,168-296,334-453,546-620,664-788,833-984
  Homolog annotation: Hit_ID=NP_509807.1; Match level="QueryCoverage =99%, HitCoverage=20%, E-value=8e-59, Identity=51%"; Hit description =putative protein, with at least 2 transmembrane domains (XL442) [Caenorhabditis elegans] emb|CAA90607.1|
NSLLCISNLEAHLCKFSLVIDSMLLLRILMHKLSWDLCLVPKKRDLCLVPKKRLLGSGLAVTGAPGGPSTDPSRRAHSSCSLGSSFKFAFRRDGQNSTKNSFAFRRDGQNSTKNSSSKHFLRVDYGGSSRLSKRVHIRRSSSVESVEIPRPKRFSSGAKELRKERNRKRLGTDTSSGSSKSKKTNSSSTSSVQKRLGTDTSSGSSKSKKTNSSSTSSVQKHLPKYITNLFRGRMGTDPCKRHARPCKRHARGSRESSPESPTSGSEAVLEFTKKLQNAPPTRRETMRMAYKQSG

SEQ ID NO: 134519 - protein, 51 aa, Heterodera glycines
  Coding regions on vcDNA: vcDNA=SeqID_60942; Strand=-; Position=1 -78,583-660
MALNLTYLLTLSLYCSNSMHEVGAVQIESHPLHTGSRHSKALIGCLIHFKK

SEQ ID NO: 134520 - protein, 82 aa, Heterodera glycines
  Coding regions on vcDNA: vcDNA=SeqID_60943; Strand=+; Position=1 -186,330-392
MAIKYGPKIAKYGHKMAKIAKYGHKWQKCQNMDINFSKLNVKFLQIYWLKLHMRYISKFFDSRKINNKSEIFAFLLIFDIIY

SEQ ID NO: 134521 - protein, 51 aa, Heterodera glycines; identical to SEQ ID NO: 124998
  Coding regions on vcDNA: vcDNA=SeqID_60944; Strand=-; Position=1-155

SEQ ID NO: 134522 - protein, 61 aa, Heterodera glycines
  Coding regions on vcDNA: vcDNA=SeqID_60945; Strand=-; Position=1-268
NRNYAQKAPQTILALPIPSTIAFIHPIMSARIIRVPKIACDLSLAKNGVSKNRNYAQKASQ

SEQ ID NO: 134523 - protein, 34 aa, Heterodera glycines
  Coding regions on vcDNA: vcDNA=SeqID_60946; Strand=-; Position=1-105
GGPAVPIGAARTIFAFLMQFVNRFIHKKAKICGF

SEQ ID NO: 134524 - protein, 27 aa, Heterodera glycines
  Coding regions on vcDNA: vcDNA=SeqID_60947; Strand=-; Position=1-85
IVLKKGALKTHFCVKIFSFGRHFSSLE

SEQ ID NO: 134525 - protein, 63 aa, Heterodera glycines
  Coding regions on vcDNA: vcDNA=SeqID_60948; Strand=-; Position=1 -96,136-231
MEPVGERAPTEPQQLSSLMMKTAQNEEKIVNEIIEYKQKFRPQKHGLNKVCFEKKNAMYSMHI

SEQ ID NO: 134526 - protein, 52 aa, Heterodera glycines
  Coding regions on vcDNA: vcDNA=SeqID_60949; Strand=+; Position=1 -91,1879-1946
MAIKKRRHLLEDKQRDYQRELLHSHLIQNLLFLTISAKMSPFSSKMAQLKLH

SEQ ID NO: 134527 - protein, 150 aa, Heterodera glycines
  Coding regions on vcDNA: vcDNA=SeqID_60950; Strand=+; Position=1-704
LFEYPKRTLEKIDFFVFGAVPPNRCAQIYGETESFGSSFPIACTLILRWIFAPHKCLSTPNGHLKKSIFFVFGAVPPNRCAQIYGETESFGNSFPIACTLILRWIFAPHNCLSTPNGHLKKSIFLFSGQSPRTDAPRFMGRPNPSGIASL

SEQ ID NO: 134528 - protein, 66 aa, Heterodera glycines
  Coding regions on vcDNA: vcDNA=SeqID_60951; Strand=-; Position=1 -87,227-340
MRQHPDKLRQVVGANFEFLNNVQKLLAIQPSNISSNTYLALLKSLRYICSQYFFLKFTPKQNRTWI

SEQ ID NO: 134529 - protein, 94 aa, Heterodera glycines
  Coding regions on vcDNA: vcDNA=SeqID_60952; Strand=-; Position=1 -127,413-570
MGQYLKTELSSDQLELHLADGTASVQGVMLNTEYINETLEASGVRILSLKDGYVEELTVCVPWKRLLLDSTIVKSMICQLSFFIQIRRWNGNIY

SEQ ID NO: 134530 - protein, 47 aa, Heterodera glycines
  Coding regions on vcDNA: vcDNA=SeqID_60953; Strand=+; Position=1-142
IVFEDLFTKGSTRRTAAQKFYALLELKKWQAIEVEQRDAFDTIEISA

SEQ ID NO: 134531 - protein, 76 aa, Heterodera glycines
  Coding regions on vcDNA: vcDNA=SeqID_60954; Strand=-; Position=1 -115,795-910
MAFFSSVCAAYLFFTHLAYHKSWMFDWSPKRLQMAWTINQQTKRRFACPPAKAIKEGRKKKMRRRSRGRGEKGSKK

SEQ ID NO: 134532 - protein, 80 aa, Heterodera glycines
  Coding regions on vcDNA: vcDNA=SeqID_60955; Strand=-; Position=1 -39,89-292
MERKDEAIAFTEKYEHFIVIECKGSSHNVDKFCDFVGKRLRYELLEFVENPLAIWVDFCHVRPKMIGPTECPSADLEKNG

SEQ ID NO: 134533 - protein, 146 aa, Heterodera glycines
  Coding regions on vcDNA: vcDNA=SeqID_60956; Strand=-; Position=1 -148,191-310,350-477,762-806
  Homolog annotation: Hit_ID=NP_502882.1; Match level="QueryCoverage =72%, HitCoverage=20%, E-value=3e-18, Identity=39%"; Hit description =DNA polymerase like family member (4Q408) [Caenorhabditis elegans] emb|CAB60306.1| Hypothetical protein Y
MYQIKLGNLFFRDFWLMSQNKLSELPKTFGLDCTPKLYFPHKYNSEKNYGKINPTLPPMEDYYPDSMKKDEFEKFQKWYKENNDTPFLLEEQLKIYCGQDTEILLKAVLAMRKIFIEITRDELSPNGFDVFKDLMSILYVGNTKRL

SEQ ID NO: 134534 - protein, 185 aa, Heterodera glycines
  Coding regions on vcDNA: vcDNA=SeqID_60957; Strand=-; Position=1 -205,245-597
MANKKISYDLYCEALTDPLIIPPRDLVQNNVDVVLESFYLIQQSFSEVDLLNEQISIIITTYAIPSGTRNQLNSTNYFKIKENVRISVANDDNYCLFYAIILSRFYQIIGANESFEISYDQFRRIYKNKKRQKNHVLQLIQETRIDPNRTNYGIDDLLTVQEYYDQEFPGKFLIVAFSKVKKEKS

SEQ ID NO: 134535 - protein, 85 aa, Heterodera glycines
  Coding regions on vcDNA: vcDNA=SeqID_60958; Strand=-; Position=1 -3,303-465,625-716
  Homolog annotation: Hit_ID=EAA60264.1; Match level="QueryCoverage =88%, HitCoverage=5%, E-value=4e-10, Identity=46%"; Hit description =hypothetical protein AN8715.2 [Aspergillus nidulans FGSC A4] ref|XP _412852.1| hypothetical protein AN8715.2
MPNHQFQGPFGPPPLPPPPPALIGPQVAPPLNPPPRGNGDRMPRNGGRYRPPTPGVARLPPPPVPPVLRRWHDRHDDPPPPGVGA

SEQ ID NO: 134536 - protein, 363 aa, Heterodera glycines
  Coding regions on vcDNA: vcDNA=SeqID_60959; Strand=+; Position=1-1092
  Homolog annotation: Hit_ID=NP_001004509.1; Match level="QueryCoverage= 97%, HitCoverage=24%, E-value=3e-35, Identity=29%"; Hit description =si:busm1-180o5.3 [Danio rerio] emb|CAD60788.1| novel protein similar to DNA polymerases [Danio rerio]
MASKTTTTPDPHFNPNDRAFVSTCTHLELNAALEAGYTVRKVFHVLQYDQWSDNIFKSYVSEMMALKIHATGFPSWCSSEEEKKEYIEENRQRFGILLDKEKMKAEPGKRYIAKLCLNSLWGRFSMRNLLSKAIINNDESLIRQYTDDKKIELVDLEMMDEDNDVFMLTYRPKEEFVDENKYSNVVISLFTTSAARLYLYEALKKVADTPDCEILYYDTDSVIYVHPEENDPLPTGKGHLGELTDENPDHDILEFISAGCKNYGMKLQRKDTGEIEHDLKIRGFTLDAQTVQKIHYDTVKDQILRYGSDDPADPIIVTYPHFIRPNLIQGKVYTHSLTKHYQPIFTKGIINDSFQVLEFGYRK

SEQ ID NO: 134537 - protein, 24 aa, Heterodera glycines
  Coding regions on vcDNA: vcDNA=SeqID_60960; Strand=+; Position=1-80
RTLSTAVRQRSSKIYSMPQILWAG

SEQ ID NO: 134538 - protein, 99 aa, Heterodera glycines
  Coding regions on vcDNA: vcDNA=SeqID_60961; Strand=-; Position=1-300
MKEKGRWTNDRSRKMVEERGGGVRIANLRSRCEKSEQNDKRKLKQCPEGPIRSKEKCPMIKDNRSNTVNHGAENCENRANAEKSDDSSFGDQRVPTKGN

SEQ ID NO: 134539 - protein, 130 aa, Heterodera glycines
  Coding regions on vcDNA: vcDNA=SeqID_60962; Strand=-; Position=1 -216,267-386
  Homolog annotation: Hit_ID=CAB62280.1; Match level="QueryCoverage =100%, HitCoverage=89%, E-value=1e-29, Identity=47%"; Hit description= hydroxyproline-rich glycoprotein DZ-HRGP [Volvox carteri f. nagariensis]
PPPPSAPLPSAPGNSPGDEPSGKKPPRPSPVGRPNPPSPPVPSPPAPSPPVPSPPKVLSPPPSPPSPPERIPRPKPPPVANPGGQRPPRPSPRIPRPKPPPVANPGGQRPPRPSPPPRPHPTPGHKPPTA

SEQ ID NO: 134540 - protein, 94 aa, Heterodera glycines
  Coding regions on vcDNA: vcDNA=SeqID_60963; Strand=-; Position=1 -90,326-520
  Homolog annotation: Hit_ID=NP_506352.1; Match level="QueryCoverage =81%, HitCoverage=49%, E-value=1e-22, Identity=63%"; Hit description =transthyretin-like protein precursor family member (17.8 kD) (5O10) [Caenorhabditis elegans] emb|CAB01136
MATFTFWPISELTNIDVVFKVYHDCDDGIKPGSRKLKFKIPNSYVTDSATPKKTFDIGVLNLETVFKDEERELIVTMKKKRRSHRYQDFLDILP

SEQ ID NO: 134541 - protein, 105 aa, Heterodera glycines
  Coding regions on vcDNA: vcDNA=SeqID_60964; Strand=-; Position=1 -103,169-260,491-610
  Homolog annotation: Hit_ID=NP_492459.1; Match level="QueryCoverage =96%, HitCoverage=16%, E-value=4e-34, Identity=68%"; Hit description =pyruvate kinase (65.1 kD) (1J753) [Caenorhabditis elegans] emb|CAB02983.1| Hypothetical protein F25H5.3b
MEKYPARNNLEHLAMLKCTEEPHIVRKTGIICTIGPVCRSVEMLVQMIENGMDVARMNFSHGDHEYHGGTIKNVREAAAKCTKKRNVAIALDTKGPEIRTGLLAG

SEQ ID NO: 134542 - protein, 129 aa, Heterodera glycines
  Coding regions on vcDNA: vcDNA=SeqID_60965; Strand=-; Position=1 -149,621-861
MTTATTSLPSPGDEEEHTEEANEVPEITTDVPRPISASSSGGRRVPTSNRRRQKLAKAHQPQHGEEQHYAPPRRVFPLRRGQVPSLAIGQVGGLLPDEETDASPFDAERAEHLWHPKQAKIALKNTIFI

SEQ ID NO: 134543 - protein, 228 aa, Heterodera glycines
  Coding regions on vcDNA: vcDNA=SeqID_60966; Strand=+; Position=1 -31,81-134,186-242,293-837
MAVNSGLTETFPPTPLSSHGQNSAPLRQNAAGAGPSTGIADGGAESGGQWFRPTIENHMNRSRLRLVREEMAHRTMQQQVEHQHQQLLERAERVRQANVEQQMEEADVLQEQLQPQDEENDENRDPEMEQRRLVQVARQAQYERLVRLQLREARRFHNGVASSVVVPPPLFWEEECVICTNARANFYNRQCGHVCLCAECAVTAVIQKLTVCMMCRAPVNGYTHMFVN

SEQ ID NO: 134544 - protein, 529 aa, Heterodera glycines
  Coding regions on vcDNA: vcDNA=SeqID_60967; Strand=+; Position=1 -78,132-302,1095-1271,1391-1583,1631-1807,1912-2092,2143-2388,2517 -2664,2751-2867,2930-3030
QRKQFTDLPFDQQEKALFEDFLSVCRGINGPFIQCEQLDNNEIIWVWTAENWKQRTDNQNIERWMNVCFSKAPLFLTCFCASDADKVGGELINFLFDQKERTECYHIVSLLDEIISVTLLRYNQTVFEWISQCSLSLDMGHEFFIWDLRKQSVVKRSDFNSPALDNFGFDHTYVSIPELLPKVYESVADELLNLGRFLFTMKNQNADIEHLSTHYELDQNLFKNKTLREFCAAIHSFYGKCSTNILDLFKKRFNILQFARFAVPITWIYEFVVLLETTGLNGPILDNDFEMDDNDRFIVNTQLQLLLQEAFRVSWLQNSPFHDKIGVSLMRLSPTSDDRLAEHEKRLEHRLKNPPKLELNIVVPKDNASNKNKDLALSLAFPPVVVWSYRQMFYHLLLLNRAKHWMYRKYFALKGTNCRREEFATVHQFLRVLNVYIEYLCGIASAAYPNFSKQLDSMKYTHQLMGQMMLDQGFKQLKELLVQLATKFCEYARDSIDFHTLNREASPLVGEIKKILLQNRDGGPTGLRD

SEQ ID NO: 134545 - protein, 130 aa, Heterodera glycines
  Coding regions on vcDNA: vcDNA=SeqID_60968; Strand=-; Position=1 -58,504-587,741-991
  Homolog annotation: Hit_ID=CAE75299.1; Match level="QueryCoverage =82%, HitCoverage=32%, E-value=3e-20, Identity=42%"; Hit description =Hypothetical protein CBG23269 [Caenorhabditis briggsae]
MNHRTRLDWLFFWNALWRMEKNGLVKYKYLLHPRTVGFVHILKRMRKEKYVDFIYDVSVAYGGRIIQSEFDLVITILFSSQITLFELLLGLTPAHVHFLVQKIPISLIPEEDEQLEQWLNNKWAEKGAHF

SEQ ID NO: 134546 - protein, 98 aa, Heterodera glycines
  Coding regions on vcDNA: vcDNA=SeqID_60969; Strand=+; Position=1 -8,297-585
MESWAIEFSDCPFFLSVVKICPILWSLRGVGCGNCANANLKPWISFKFYSDVGEKAYFRGGTLGFAGVWVEILGSRKDLLNFQHHFTDKELENKGNCN

SEQ ID NO: 134547 - protein, 69 aa, Heterodera glycines
  Coding regions on vcDNA: vcDNA=SeqID_60970; Strand=-; Position=1 -124,203-286
  Homolog annotation: Hit_ID=NP_506037.1; Match level="QueryCoverage =88%, HitCoverage=15%, E-value=5e-10, Identity=46%"; Hit description =nuclear receptor NHR-116 family member (5M581) [Caenorhabditis elegans] emb|CAB07316.1| Hypothetical prot
MDAAEPIKQKRIYKKQPKTPKKCLICGRGAAFKYYNVQSCNGCKQFFRRIVNSQRTFTCTETNSCILSD

SEQ ID NO: 134548 - protein, 118 aa, Heterodera glycines
  Coding regions on vcDNA: vcDNA=SeqID_60971; Strand=+; Position=1-357
MALELLAKLQSFAVADLLSADQIADFRATADQFRVHMLEHFRRHCSTTKFHHLVHHAPEFAEKHGFWGLLSEQPVEKFHALFNDDLARKANTKDLHDILMFCARESAIRNAIFDANEL

SEQ ID NO: 134549 - protein, 88 aa, Heterodera glycines
  Coding regions on vcDNA: vcDNA=SeqID_60972; Strand=-; Position=1 -115,204-343,598-609
MSKVRVADVALEREQLAFFTKFGISTSDSVQQEKSCDLSNATKVFAWDGLSKWEFFRDKFVLEPSRDYYYRWLGIVTLAYCYNLLNQV

SEQ ID NO: 134550 - protein, 118 aa, Heterodera glycines
  Coding regions on vcDNA: vcDNA=SeqID_60973; Strand=+; Position=1 -249,325-430
  Homolog annotation: Hit_ID=NP_741831.1; Match level="QueryCoverage =69%, HitCoverage=5%, E-value=3e-21, Identity=57%"; Hit description =UNCoordinated locomotion UNC-10, Rab-3 Interacting Molecule (175.5 kD) (unc-10) [Caenorhabditis elegans] g
MVLTRPSRFSVGPCSSSSSPGPSNSSLDFGVKVVGGRSPLTGRFGAFVSRVRPGSVAESVGQLKTGDEVLEWNGHSLQNVTPEATKGDVRLELIVSRSLISGGDDFLNLGQIHEQYGL

SEQ ID NO: 134551 - protein, 114 aa, Heterodera glycines
  Coding regions on vcDNA: vcDNA=SeqID_60974; Strand=+; Position=1-345
MNGTQPTTILITGTQFISIAMNGTQPTTILITGTQFISIEMNGTQPTTILITGTQFISIAMNGTQPTTILITGTQFISIAMNGTQPTTILITGTQFISIALNGTQPSGVPITGT

SEQ ID NO: 134552 - protein, 123 aa, Heterodera glycines
  Coding regions on vcDNA: vcDNA=SeqID_60975; Strand=+; Position=1 -67,112-281,414-548
MLLWWAFLLFFHRVIFRPVDCGKFEDAKDILSSFKSVVDVPLSNDFKKSHQFIALSMSLMKRTVPFAELFATALKVGLEIVFVAFLALWCFPHQGHSSIYCICNLHFDLSYAWMNLITGMDAG

SEQ ID NO: 134553 - protein, 166 aa, Heterodera glycines
  Coding regions on vcDNA: vcDNA=SeqID_60976; Strand=+; Position=1 -138,1130-1270,1389-1610
MVQEDELGALLTLTKGIDAKVRDIASQQKYIASSNVYRDLLLEYEEKVDEKITSLIRQIRIMSRMRFKVEKSVIDAFVYDCNGGANSPGSVADKFLDPGILNYRDQSHDWKMDLGGTPGSELSFYRVPIIGLRSCNELFPHQLFPRFPLEINKPKFYLLINSYLNI

SEQ ID NO: 134554 - protein, 86 aa, Heterodera glycines
  Coding regions on vcDNA: vcDNA=SeqID_60977; Strand=+; Position=1-262
VITVLKKEERIAADKLRQYELDPTQGIRIRERKKTYRENDLAIRNLVEGFDAIENPNEDEILAHLKSLQYRLMRNDFENWDDPNGD

SEQ ID NO: 134555 - protein, 401 aa, Heterodera glycines
  Coding regions on vcDNA: vcDNA=SeqID_60978; Strand=+; Position=1-1206
  Homolog annotation: Hit_ID=CAA82797.1; Match level="QueryCoverage =65%, HitCoverage=40%, E-value=2e-28, Identity=33%"; Hit description =gag protein [Ascaris lumbricoides]
MKPNPRNQQNTSSSPFPYTSAFTTKSNSVRLAQFKSNPTQTRTQNKIFCRFCERENHASKECKIYSTPEKRNERVRELKLCLNCLNKGHMANECKSTYLCFNCKYKHNTLLCTRKQTQYKPKEQKTRVNMAKNYENHEETQTFMTMDYDKNLSNYEEEELLMTAEVNCINPDKHKVKKEIILFDNGSQKSYITEECAQTLQLSTIEEKLLAISTFNQNKPKIIKSRLVKVGIKTLKGEIEYITLQTVEKITDVTKMVNKETVDVLGIKISIANARPQILIGIDYYWHFMLPNSQIQLLPSGFYSINTKLGKILSGKGTIEDTNCNSVTEKRKKDETNQILQKFWELENIGIIDSPHMTDEDAAMIHFDKNVTFKNNRYHVRWPYKRGTQIYQQILDYAWED

SEQ ID NO: 134556 - protein, 220 aa, Heterodera glycines
  Coding regions on vcDNA: vcDNA=SeqID_60979; Strand=-; Position=1-663
MPVIKVLKYPEELNPFGSEDEADDDDGKNPFGDSASSSGESELVLPGEEKKQQRKSSNAENEEEEEPEEVQNPQDRVQTCSSAADEESSACPSPARAPPMVQIVTAGGTSPAETEEKPSSAEGKQTANTSTEGNDTMPKITETPENKTPNKTQQRKLSTCEQQDNQYQYDVSGRSEKRMFKMVISPFQYIPPLAPMLFRGGGVQLRKVLPLRVPSPSPCL

SEQ ID NO: 134557 - protein, 24 aa, Heterodera glycines
  Coding regions on vcDNA: vcDNA=SeqID_60980; Strand=-; Position=1 -39,91-126
MILKSPIVGLATEKIILAIILIYK

SEQ ID NO: 134558 - protein, 116 aa, Heterodera glycines; identical to SEQ ID NO: 127487
  Coding regions on vcDNA: vcDNA=SeqID_60981; Strand=-; Position=1-351

SEQ ID NO: 134559 - protein, 109 aa, Heterodera glycines
  Coding regions on vcDNA: vcDNA=SeqID_60982; Strand=+; Position=1 -12,208-522
MEDQRVPREKTDPVLMDQLLKFNSMKPDERMRRIWDSARALELFNDQNLVLKAFGISVDQKSNLVSMVLCARNRFDTAQQFAADRLGRMGNEKGIPIAEPEIVAFNSPD

SEQ ID NO: 134560 - protein, 201 aa, Heterodera glycines
  Coding regions on vcDNA: vcDNA=SeqID_60983; Strand=-; Position=1 -126,266-745
MERKTVSNDNNHGLKYEVINQRQGFVEKCDGCDFNVFHSNVQFPPIVWPPPENASEDVVSQHLKPFHDVLRFISANCLTIVQHPELYDQAKKTLDAVNLLNGVLDQHRRQQQGQGQQQQYTGMTVLKNSHNNRRQTNNGDEEIYISDADDDDDGIPFLVRRFLNANIADEQTVTAAEQPDYADGETSMFCDDVAEMECQQN

SEQ ID NO: 134561 - protein, 17 aa, Heterodera glycines
  Coding regions on vcDNA: vcDNA=SeqID_60984; Strand=-; Position=1-54
PVNSCIGCKCRRCCTPN

SEQ ID NO: 134562 - protein, 22 aa, Heterodera glycines
  Coding regions on vcDNA: vcDNA=SeqID_60985; Strand=+; Position=1-67
MAAKADQNYPFIRAENGGVGAG

SEQ ID NO: 134563 - protein, 21 aa, Heterodera glycines
  Coding regions on vcDNA: vcDNA=SeqID_60986; Strand=-; Position=1 -54,574-585
MRTRPIWQVKQRLLTSQKKGF

SEQ ID NO: 134564 - protein, 98 aa, Heterodera glycines
  Coding regions on vcDNA: vcDNA=SeqID_60987; Strand=-; Position=1 -54,260-406,839-932
MPTILSTVTSWNVVSRNTVEYLSAYFFKTPECDGKIFCACRQPYLVSPKRFVGRCCDSSPSCKCCLKLSPIRNTDECLKMIDGMPHCSCPLEFECVYC

SEQ ID NO: 134565 - protein, 64 aa, Heterodera glycines; identical to SEQ ID NO: 129150
  Coding regions on vcDNA: vcDNA=SeqID_60988; Strand=-; Position=1-470

SEQ ID NO: 134566 - protein, 91 aa, Heterodera glycines
  Coding regions on vcDNA: vcDNA=SeqID_60989; Strand=+; Position=1-275
LPTNPATESSAAPFRLSTIHHSFLPPADPLGSRQLNPSLSADHLRPPALITQLKSPAALLGSRQTLTESSAAHFRLSTIHHSSPSRQPPFQ

SEQ ID NO: 134567 - protein, 16 aa, Heterodera glycines
  Coding regions on vcDNA: vcDNA=SeqID_60990; Strand=-; Position=1 -37,455-468
MHLNKKEMEIFIYIEY

SEQ ID NO: 134568 - protein, 107 aa, Heterodera glycines
  Coding regions on vcDNA: vcDNA=SeqID_60991; Strand=-; Position=1 -156,229-393
  Homolog annotation: Hit_ID=CAE66729.1; Match level="QueryCoverage =100%, HitCoverage=11%, E-value=3e-30, Identity=57%"; Hit description= Hypothetical protein CBG12078 [Caenorhabditis briggsae]
GTLFISDGGIAQPFKGKERRVFLFEQSVIIAECIPPRKEYGNPTYNFKNQIMVNKMMLDEKVPDEPLRFVLQSSDPNQQATYVAQAASVDDKEQWLAKLSAQLDQQK

SEQ ID NO: 134569 - protein, 329 aa, Heterodera glycines
  Coding regions on vcDNA: vcDNA=SeqID_60992; Strand=+; Position=1 -612,677-966,1017-1104
MQEKRQRPRDEWPEENETLLSYVQRIYGPENWTSAWQRGRVLRELHELEDQGRWMIHHKSDRLLLSVSRMYRGKRPFAEFRFVEGRYYSHMVPEDVDLPPSSTNQRTAGDHNNRRHNGTGNKYGTNEAPNKTATTTIAKTRRIPHGRLQTEHAQPIQPVRAMRQHAHNLRQNSDLRFHRGQPISNGRIPKLPCQQFLRGIALQLSDTTVEEVAQMFYQQQVADNGRQIARDQHLTEVINVWRNSCDRFGELYNQPAHKQVKFRPITTENEQQSNYGEWIERLNNRTAEIFSKARTKAQHPTSIQTALLRRQMVHTFPGGRIPTHPRTEG

SEQ ID NO: 134570 - protein, 56 aa, Heterodera glycines
  Coding regions on vcDNA: vcDNA=SeqID_60993; Strand=-; Position=1-173
SANPFDMEDMLIAPLEDGGETDLLYPDMASAAGSDHLHVVAPPADLNDLDEYPPLA

SEQ ID NO: 134571 - protein, 66 aa, Heterodera glycines
  Coding regions on vcDNA: vcDNA=SeqID_60994; Strand=+; Position=1 -73,131-258
MTPIGALGIILFAYGLTILLGHCSGLKCKSGEDMDETDYSPYINATTKECIFDQRYCLTVYCFTGE

SEQ ID NO: 134572 - protein, 77 aa, Heterodera glycines
  Coding regions on vcDNA: vcDNA=SeqID_60995; Strand=+; Position=1 -89,345-489
MDMAWLRMAHAIRRTVLLCRTLCIGLQLYSKKSMMVWSCARSIPGDKYLCQCQFGEQGVNFGNEKRRLPLAMYNMYK

SEQ ID NO: 134573 - protein, 151 aa, Heterodera glycines
  Coding regions on vcDNA: vcDNA=SeqID_60996; Strand=+; Position=1 -153,205-270,327-399,446-606
TNVRRGRNRQVFLRTPDPNSNYYRNNFPLTFKVFKLKGNVEMNEADRTANEELDNEINNSVNANANNGTNAETVAAAGMSDSGANANNGTNAETVSNCGDDDRARRNKRCQCQQCPSAAEKEGQFWTNDVEVWAHVGPPLVFGVLIGLTPE

SEQ ID NO: 134574 - protein, 53 aa, Heterodera glycines
  Coding regions on vcDNA: vcDNA=SeqID_60997; Strand=-; Position=1 -151,917-927
MPTDFQQSEKLKRILALWDRGEGVISQQLFCNIHSAEAHVREGAIIDAIGGVK

SEQ ID NO: 134575 - protein, 100 aa, Heterodera glycines
  Coding regions on vcDNA: vcDNA=SeqID_60998; Strand=+; Position=1 -25,255-461,665-733
  Homolog annotation: Hit_ID=AAN05585.1; Match level="QueryCoverage =97%, HitCoverage=63%, E-value=1e-30, Identity=64%"; Hit description =ribosomal protein L22 [Argopecten irradians]
FVPNSWHKVGMRNFHVRKNHYYSPSINLDKLWTLCTERTRKQYAEVKDKAPVIDVVRAGYHKVLGKGLLPKQPLIVKAKCFSHSAEEKIRKVGGACVLVT

SEQ ID NO: 134576 - protein, 23 aa, Heterodera glycines
  Coding regions on vcDNA: vcDNA=SeqID_60999; Strand=+; Position=1-70
FSARKSKNGIYPGIGGHLRYFGT

SEQ ID NO: 134577 - protein, 233 aa, Heterodera glycines
  Coding regions on vcDNA: vcDNA=SeqID_61000; Strand=+; Position=1-702
MKFAKKMLMIPEAEYLALRSAINSGDSLQNEKASLDAKISQNLQGPGIIDDLKAKRHDWLYKERRTVKGILENRPQKVVIENHVPGPNVAPYLGINNQFNPQETEEPRKIIIPRKRLKEQTPDSDSDNDTLEEITPESQTVGSSPTLKTPVPNKTSIIHPTLLNGLFRYVKENKDLFKITAAGKVQSNMNLPIENSNYRDVLLYLAGKKDETPRGAKFLKDRLLKDPTVKDMG

SEQ ID NO: 134578 - protein, 95 aa, Heterodera glycines
  Coding regions on vcDNA: vcDNA=SeqID_61001; Strand=+; Position=1-287
MESVSLDPGEEFQEELTEELEEELLGKEEKWVTAQNSENEVEGEEKEKDEGEEVELNEDAEKKKKEWATAQNSTNNEKEVEKSGEIEVEKSEKKM

SEQ ID NO: 134579 - protein, 162 aa, Heterodera glycines
  Coding regions on vcDNA: vcDNA=SeqID_61002; Strand=+; Position=1 -199,553-842
  Homolog annotation: Hit_ID=AAN32892.1; Match level="QueryCoverage =83%, HitCoverage=61%, E-value=2e-10, Identity=33%"; Hit description =secretory protein 4D06 [Heterodera glycines]
MEKYTNTFNLDMATDQHSFCSTAHQAVVEIKNELINPTMPDCESPAGGGTKMVQQIDTHLYASNRKANDEECAYSVGFISAMFEFASAASAHADQSISDLKELTLKFDQQIGIIGELCNCLNTDIGIVLFRMPRQGKTDGLKITKKQRGRTRAARNYGLRES

SEQ ID NO: 134580 - protein, 175 aa, Heterodera glycines
  Coding regions on vcDNA: vcDNA=SeqID_61003; Strand=+; Position=1 -45,943-1144,1198-1316,1686-1847
MTNSTHFVVKISKIKVSICDAEGVPKAANKNRNKNNNNDREEEEEEQKLEEDGNEKLGSELFNDEDIVNNNNNSQKNTANLGVTEAEDDGMLTEQDKQLRKVLSDMDRKQLTLAQRRQSNMDVYLSKGPTVIGSQISHRLFFKEPEMREMFRRCALPQQFANHDSFSKVQTAKIS

SEQ ID NO: 134581 - protein, 160 aa, Heterodera glycines
  Coding regions on vcDNA: vcDNA=SeqID_61004; Strand=-; Position=1 -121,207-568
MPSSLMAGDSPRENGAEEHADIYATSSNLMKSQRQLLFITPAIGFASALCILLSLCVFLLYIQRRPDGVYKTHEHNAFVPVGSGTVSDGDDHHKQQQYGNGDEFGTARGNVRFAGVPTLMHTRLLSAAAGGDQQQQQQQQEKRHYRHVPDDETTKREYFC

SEQ ID NO: 134582 - protein, 114 aa, Heterodera glycines
  Coding regions on vcDNA: vcDNA=SeqID_61005; Strand=+; Position=1 -111,162-395
MKMQDGDEEDAYILYHRAMAIYRLISDSMTDAFKRSRDGRIFYETSGRLLSDLEKVAESLKQRFGQRQITGSTLGSSKSFSDETKVEGSLSSQSSPFQIFFKFKLGIRIDQKKP

SEQ ID NO: 134583 - protein, 18 aa, Heterodera glycines
  Coding regions on vcDNA: vcDNA=SeqID_61006; Strand=+; Position=1-54
MDKKEKGISIPFNVPLWN

SEQ ID NO: 134584 - protein, 176 aa, Heterodera glycines
  Coding regions on vcDNA: vcDNA=SeqID_61007; Strand=-; Position=1 -179,461-812
MLSKLNLLFDILFIGISFGLATDQNAGNDLKQLGQSTINVLASAANLGIRAVTTLAPVVRDQVIPGAVNCTKTVVSALPTVANATKNMVNNYAAPAATNAAPVIAGAAVAVKENVVKPIYNHGVRPTFGMAGIAMANLPEWQNQRKAGENSSRRNSTGSSGKKSGCMLACFGKGDP

SEQ ID NO: 134585 - protein, 117 aa, Heterodera glycines
  Coding regions on vcDNA: vcDNA=SeqID_61008; Strand=-; Position=1-354
  Homolog annotation: Hit_ID=BAC87222.1; Match level="QueryCoverage =94%, HitCoverage=87%, E-value=7e-15, Identity=33%"; Hit description =unnamed protein product [Homo sapiens]
MKRKGKAKEKERKSQGKGKEKPRKRKGKAKEKERKSQGKGKEKPRKRKGKAKEKERKNQGKGKEKPRKRKGKAKEKERKRKGMIWENKQKRDGKEWKGKRNGKEKEAKLGGGGEEEQ

SEQ ID NO: 134586 - protein, 107 aa, Heterodera glycines
  Coding regions on vcDNA: vcDNA=SeqID_61009; Strand=+; Position=1 -9,297-611
  Homolog annotation: Hit_ID=YP_047926.1; Match level="QueryCoverage =97%, HitCoverage=43%, E-value=2e-17, Identity=39%"; Hit description =putative transcriptional activator (TenA family) [Acinetobacter sp. ADP1] emb|CAG70104.1| putative transc
MYNQSLPVIVASMLPCYWLYREVAKWMLAERQKAGGTNTVTQYHEWIDMYCSEEYAEAVDEMLALADELAQEADQRTRAKMATVFERGFQLEWMFWKSAYQMCQWEI

SEQ ID NO: 134587 - protein, 105 aa, Heterodera glycines
  Coding regions on vcDNA: vcDNA=SeqID_61010; Strand=+; Position=1 -90,706-788,905-1013,1162-1197
  Homolog annotation: Hit_ID=AAH80439.1; Match level="QueryCoverage =60%, HitCoverage=16%, E-value=2e-12, Identity=50%"; Hit description =Serpinb8-prov protein [Xenopus tropicalis] ref|NP_001007932.1| serpinb8-prov protein [Xenopus tropicalis]
MIRLAQEYMIGIFSVIILKYKINYYRQGSRKINDFVEEATHGKIYDLIEPNLLGEMTRLVLINAVYFKGNWANKFNPNLTKKKTFHVDEINTKEAYREYNLNVQI

SEQ ID NO: 134588 - protein, 63 aa, Heterodera glycines
  Coding regions on vcDNA: vcDNA=SeqID_61011; Strand=-; Position=1-306
LTSKNNSLPKSFLQPLIANIISCRFKAIHCLPVSAQQSTNRVFDSLQKIIPYPKVFYNHILPI

SEQ ID NO: 134589 - protein, 61 aa, Heterodera glycines
  Coding regions on vcDNA: vcDNA=SeqID_61012; Strand=+; Position=1 -120,850-915
MAYNFASKSFLIRPKAWSGKMADRGLLILDTSVPAECRARNIWKNSKFQKKIQNSVLKSHS

SEQ ID NO: 134590 - protein, 119 aa, Heterodera glycines
  Coding regions on vcDNA: vcDNA=SeqID_61013; Strand=-; Position=1-359
MHIAPLELHPLARLVQGRYHKMHCLCVASWDHVLVRVLTLLARLGCGGFGVQARTCGSNSRFTDRNSGAPMLRMLWRSAWITGIPALIFRPELRREHPLNLSISVSGGKETNEDSRSNG

SEQ ID NO: 134591 - protein, 108 aa, Heterodera glycines
  Coding regions on vcDNA: vcDNA=SeqID_61014; Strand=+; Position=1 -96,135-365
MLGSVHKSSRTTCAHQRTGAFGGANASPTGQQQQVHLQLPCYDFCPVQATAIKSVPVCIPTEAGTLTVPEFLEMAQSRAATGGVYKGQGRIQSELMTRPYKEFLVHGQ

SEQ ID NO: 134592 - protein, 64 aa, Heterodera glycines
  Coding regions on vcDNA: vcDNA=SeqID_61015; Strand=-; Position=1-267
NRKKGRIFKFFISIFFYSSKFSVIFSRLIEPVKSFRMISRLFDSVNNFKSYIDSSWLRRSWPVP

SEQ ID NO: 134593 - protein, 66 aa, Heterodera glycines
  Coding regions on vcDNA: vcDNA=SeqID_61016; Strand=-; Position=1 -72,391-519
MQKMMENLFMFHRLYANMKSLRKGIYPTSYLPSFYINQLCAIECHMVTIATGFGFPLNEIFANYSL

SEQ ID NO: 134594 - protein, 55 aa, Heterodera glycines
  Coding regions on vcDNA: vcDNA=SeqID_61017; Strand=-; Position=1 -141,217-243
MPAVDCLNGYRSYINDRNAELIMGDPLDPNMETDFDFAGNLALFDKACNYYAVIA

SEQ ID NO: 134595 - protein, 69 aa, Heterodera glycines
  Coding regions on vcDNA: vcDNA=SeqID_61018; Strand=-; Position=1 -136,180-253
MNLHEMVTSTPTPNYVPILEKSFSKNETETATIIEKTYSDENTNSDNNSCSAFGFGMPMIICTILFFFN

SEQ ID NO: 134596 - protein, 184 aa, Heterodera glycines
  Coding regions on vcDNA: vcDNA=SeqID_61019; Strand=-; Position=1 -85,356-562,1257-1519
MRKAKCETPKNANNAKGEMRKAKPQPIPGNEWLTHYGCAKSPEKGACSDNVEKEMKDLYGLAVSCSFCTIGRKMDDMSNKNFPLYNTTNVVMPPSGGADGDDFSFMSTTQQLTTSYNLSEIATIVPKKMNLHEMVTSTPTPNYVPILEKSFSKNETETATIIEKTYSDENTNSGIKYYFVFHKK

SEQ ID NO: 134597 - protein, 55 aa, Heterodera glycines
  Coding regions on vcDNA: vcDNA=SeqID_61020; Strand=-; Position=1-324
LLKSCRKNFAFRISLFAFSHILAFRISLFFHFAFFSFANFACRISLFIFQFGPCL

SEQ ID NO: 134598 - protein, 94 aa, Heterodera glycines
  Coding regions on vcDNA: vcDNA=SeqID_61021; Strand=-; Position=1 -131,211-364
MQKGYGRDNKRCWLEDELFRRRMRVNIFLAIGIQILLCFALFKSLTVPWSTTQFKTQIWVKEFNYYLNTEFTTLFLFISHKYGFKVQPNASSLI

SEQ ID NO: 134599 - protein, 63 aa, Heterodera glycines
  Coding regions on vcDNA: vcDNA=SeqID_61022; Strand=+; Position=1 -138,250-303
MKKEMNLNKNKMMKKSFYEQKKKEFIERFDEFKSLYCQGKQKEFVKDGIPMRTIEKDEAIFQN

SEQ ID NO: 134600 - protein, 62 aa, Heterodera glycines
  Coding regions on vcDNA: vcDNA=SeqID_61023; Strand=+; Position=1 -175,570-583
MHFIFLIIFIAFKIESGKIQPNFGEIFGNAWDNNKREEKAIKIEQNEQNDNSATVDQMEKFE

SEQ ID NO: 134601 - protein, 23 aa, Heterodera glycines
  Coding regions on vcDNA: vcDNA=SeqID_61024; Strand=+; Position=1 -37,423-457
MTQGRSHNFGSGSTTFTGLIYRM

SEQ ID NO: 134602 - protein, 77 aa, Heterodera glycines
  Coding regions on vcDNA: vcDNA=SeqID_61025; Strand=+; Position=1 -78,140-295
MAPRRKRKAAQLVGQDEAVVNGPSAQLPTNDGQQLASAAPVTNNGTVQQAENDGTDAVAAAAAIDDTGGQVQFLYFR

SEQ ID NO: 134603 - protein, 118 aa, Heterodera glycines
  Coding regions on vcDNA: vcDNA=SeqID_61026; Strand=-; Position=1 -211,266-411
MKRRIAPLTTATAPAEQHKIIGPESPKPHEETAKNVEPKDELATKKRKVDDRELWKLAKGKFLLTTYLCHDDWNRLYNNQQKVKRLEGDRFAFGFEMCEECVWANCRATDLLAPMKKK

SEQ ID NO: 134604 - protein, 98 aa, Heterodera glycines
  Coding regions on vcDNA: vcDNA=SeqID_61027; Strand=+; Position=1 -107,450-538,1438-1538
MNLWNLNIYYIFFFIIESDKIRPNFDKIFGDGYDKIKQKEFVKELGISEATFWKWKKELVQKHQKTDHTGQLNPVISSIHSLSSGVYKDTMPVEKKIN

SEQ ID NO: 134605 - protein, 74 aa, Heterodera glycines
  Coding regions on vcDNA: vcDNA=SeqID_61028; Strand=-; Position=1 -121,170-274
NLNAADAKQRITEHRQDRRNVFIHPNYNYKTFESDLAVIKLSRPLIAPLFQPICIHCGAANKFLNGTVFVAGWG

SEQ ID NO: 134606 - protein, 37 aa, Heterodera glycines
  Coding regions on vcDNA: vcDNA=SeqID_61029; Strand=-; Position=1 -57,893-949
MTKRRKCQRQNVSAASVGAANRGHIELSNDTKSVGFG

SEQ ID NO: 134607 - protein, 163 aa, Heterodera glycines
  misc_feature (13)..(13): Xaa can be any naturally occurring amino acid
  misc_feature (16)..(16): Xaa can be any naturally occurring amino acid
  misc_feature (36)..(36): Xaa can be any naturally occurring amino acid
  misc_feature (68)..(68): Xaa can be any naturally occurring amino acid
  misc_feature (147)..(147): Xaa can be any naturally occurring amino acid
  Coding regions on vcDNA: vcDNA=SeqID_61030; Strand=+; Position=1 -21,550-1038
  Homolog annotation: Hit_ID=AAG23159.1; Match level="QueryCoverage =95%, HitCoverage=68%, E-value=4e-33, Identity=48%"; Hit description =polyprotein [Heterodera glycines]
SLSSLERTLQITXQNXMPETVVTDNGTQFSSNGFKXFVKENGINHLFSAPYNLESKGQAERFVDTFKXTCRKQKKEGAQNVVNTFLTSCRTSPDDSLHDGKNPTELFILRKSRTTLDLLRAKTQQPMEKQFKRFLRSNLINSIFSFXYTKMRSGSFSYGPFSY

SEQ ID NO: 134608 - protein, 99 aa, Heterodera glycines
  Coding regions on vcDNA: vcDNA=SeqID_61031; Strand=-; Position=1 -120,251-345,569-653
MPKKGWNRAGFRRFARLEFRGFHSFFWASGVTQRYAPAHKALFVKYELPFVRVAIALLKKGKVSWAAVEFLRLKIFGALEQCRPMVVVVFWPAVFPVIN

SEQ ID NO: 134609 - protein, 100 aa, Heterodera glycines
  Coding regions on vcDNA: vcDNA=SeqID_61032; Strand=-; Position=1-303
MIGRAVRNRPFIFEGIFKFILYPRKMSISFFEKFYTSQKRLRRDGGLCTIAILFHRGFLYLEVIPEKWLSLFLINFIHIQMLSSMRGRAVHNSHFISEGI

SEQ ID NO: 134610 - protein, 92 aa, Heterodera glycines; identical to SEQ ID NO: 125147
  Coding regions on vcDNA: vcDNA=SeqID_61033; Strand=-; Position=1-304

SEQ ID NO: 134611 - protein, 137 aa, Heterodera glycines
  Coding regions on vcDNA: vcDNA=SeqID_61034; Strand=+; Position=1 -208,565-767
  Homolog annotation: Hit_ID=AAV34860.1; Match level="QueryCoverage =100%, HitCoverage=52%, E-value=9e-54, Identity=73%"; Hit description= ribosomal protein S4 [Bombyx mori]
MLDKLGGVFAPRPMCGPHKLRESLPLILFLRNRLKYAQSYNEARMICKQRLIKVDGKVRTEMRFPCGIMDVISIEKTNETFRLLYDVKGRFVIHRIQSREGQYKLCKVKKQAVGDKQVPYIVTHDARTIRYPDPHIK

SEQ ID NO: 134612 - protein, 151 aa, Heterodera glycines
  Coding regions on vcDNA: vcDNA=SeqID_61035; Strand=+; Position=1 -220,408-642
  Homolog annotation: Hit_ID=CAE73955.1; Match level="QueryCoverage =69%, HitCoverage=16%, E-value=3e-44, Identity=79%"; Hit description =Hypothetical protein CBG21580 [Caenorhabditis briggsae]
DFLIQVIPEADRQEWAPSNTYRGIFQFCFWRFGRWVDVIIDDLLPTKNGQLLFARSKTPNEFWSALLEKAFAKLYGCYETLVGGQLADALIELSGGVAETLNVRKFLHIHKQQIQQQQQPMFSASFNACGIPYLAWDFSQSARYVAESNGA

SEQ ID NO: 134613 - protein, 300 aa, Heterodera glycines
  Coding regions on vcDNA: vcDNA=SeqID_61036; Strand=-; Position=1 -41,71-929
  Homolog annotation: Hit_ID=AAS07042.1; Match level="QueryCoverage =63%, HitCoverage=23%, E-value=8e-17, Identity=30%"; Hit description =minus agglutinin [Chlamydomonas reinhardtii]
MYQITPTINRTNIGGSWVCGLHSISYPYSWHSTIGTLDDQWIDIHFTNLHSVDEDRQRVIRVPVPQASHKKVEQLRDFLQATLKSQEKVRLKPLAHEEGYFDKPVVLGSPPHAKRLKRSTIDDLSSLPSPPRYDETDEQQSQQQQPQSPPRFDETKKEDDKVKETTPPSAAKQPIPPAPTLAPPSHPPTEAPKAPKQAAPKSATVPPQKPSVTSTITAAKTTPPPAPIPPIKQAPSAPKPSPSKTAAVPKPTPTPTPASKSTIPTPASSTKAQNIPKIPPPLAAKPKEPNVAKKSTVPTT

SEQ ID NO: 134614 - protein, 199 aa, Heterodera glycines
  Coding regions on vcDNA: vcDNA=SeqID_61037; Strand=+; Position=1 -273,315-481,523-682
  Homolog annotation: Hit_ID=XP_415979.1; Match level="QueryCoverage =95%, HitCoverage=20%, E-value=1e-14, Identity=30%"; Hit description =PREDICTED: similar to Zinc finger BED domain containing protein 4 [Gallus gallus]
MGDEKVNKVSNKFKIIYTRKLMIATVLDPNYKMDFFDREMRDMYKRWIIDELSQDLDLSQNFDNSQLVNEIAECSSQDSNPVKSLLDEFVQENSFGNNENLYLDVNETELIKHEVNAYLNKPRINSNIFNYWSINSEKWPRLTNLFRRFNSAPVGSQESERLFSIAGITLTDLRNRLTAENLEKLLFLHRNLPIYNFSY

SEQ ID NO: 134615 - protein, 75 aa, Heterodera glycines
  Coding regions on vcDNA: vcDNA=SeqID_61038; Strand=-; Position=1-596
HFKIHLVLRDAQSAMKLGTNILGCDSQDCFLHKMQLVSLCFLLVKNEKLSQSVMVLKFTRIFYRFLKKSKKSLGK

SEQ ID NO: 134616 - protein, 116 aa, Heterodera glycines
  Coding regions on vcDNA: vcDNA=SeqID_61039; Strand=+; Position=1 -57,680-840,922-1054
  Homolog annotation: Hit_ID=1SVS; Match level="QueryCoverage=68%, HitCoverage=22%, E-value=7e-15, Identity=43%"; Hit description=Chain A, Structure Of The K180p Mutant Of Gi Alpha Subunit Bound To Gppnhp. pdb|1SVK|A Chain A, Structure Of The
MASAKLSWKNEKASFFQIQNEVNIIRLHVENGLEYTEITSSVKLAIQRLWKDSAIIAAATHKTNYHVIDSASYFFENIERLTEKNYLPTNQDILMTRMPTTGVVKLVFTLKNIEFK

SEQ ID NO: 134617 - protein, 462 aa, Heterodera glycines
  Coding regions on vcDNA: vcDNA=SeqID_61040; Strand=+; Position=1 -478,542-1365,1494-1580
MDMTNVRVDGVPESDNFVLFTTQSKKVSLITPKSGEQKPEHGEYQVEIGIKKATKIRLLVNFNVDTFGNAMTLILEKINKQRQEAKRNLVIITDMGVDDQVALAMISATELAGNVLAIGTTEQGKEAALAQSLGFEKVPVYVRRSNEELEKMFFMNPNHKNQKREENEFQHFLKNLLDERLKFMGVKVNFLVLAPPTDLTAVLLRNKKLAEAVGEILITGECKNCQDLQPPTPLSLNKFLWELPREHTKPTTYNVRMDALAALYLFEMASNGEVNVLLVSSRLLAEKFGAGDNFDKRFPKLKLISKKTMGAKIIVNREEEFEQKPHIDQQFSAAGPIAVLAIMDITNVRVDGVPESDNFVLFTTRSKKVSLITPKSGEEKPKHGGYQVEIGIKQATKIRLLVNFNVDTFGNAMTFILDKSNKQWNYKISSEKQKLKCAKRKGKSQKRRGEKEFGDNYGHGGG

SEQ ID NO: 134618 - protein, 460 aa, Heterodera glycines
  Coding regions on vcDNA: vcDNA=SeqID_61041; Strand=+; Position=1-1381
MPSKQEVKRKKEQERYQRQMEKSVSPGRSPVPDGGADENGVASPRGFNTPNLSALQLSTPASSIGSKRRGRPPKAGAESITPSQNNVSSVDTQFTSATQNVESPPSKIWKVDEVDRPMSAIEAIASTPISTQRSRGGRPAKKRGGPGRSKANDSMSERSLMDHSSEATTSVALLPTVPEKINFSTVQINFATSRNFACKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPGHWTLIVHDVQFGTHFADSLPTTYGRLDPQLTDKIKNIISDILPSTVLTGIVNAINLTVQHDGNSCGYFVCLYAESWLMNNRTFVLPDLSINYEKKRILWHINELYGSDNVPYHPREGVPTPCPIVYRHTDEAQSTSKAAELMEVDEHDDIMIIEPQTSGQG

SEQ ID NO: 134619 - protein, 85 aa, Heterodera glycines
  Coding regions on vcDNA: vcDNA=SeqID_61042; Strand=-; Position=1 -183,229-303
MSEIWKFFNKNLTDGAICKLCGKRTARTDGSTKGMWKHLEFKHKHEFSQLKNKENLSQKDVDQKQIDNFMVIKKNALEEAEECIT

SEQ ID NO: 134620 - protein, 19 aa, Heterodera glycines
  Coding regions on vcDNA: vcDNA=SeqID_61043; Strand=+; Position=1-58
GPGSRSRVLKSSGPGPGRA

SEQ ID NO: 134621 - protein, 123 aa, Heterodera glycines
  Coding regions on vcDNA: vcDNA=SeqID_61044; Strand=-; Position=1 -136,194-248,307-357,589-718
MSNALSTANGIPSSQFVQNPSIMQQMAMNNHPINNKFDIGTNSLGVNQHQSVAEAPEAAHQQKKNNRKNNRHGKGGGQHKIHVSQNGHKTTNKGIKLKEKRKLRIKSSKDMGGMRSKVKKLIM

SEQ ID NO: 134622 - protein, 43 aa, Heterodera glycines
  Coding regions on vcDNA: vcDNA=SeqID_61045; Strand=+; Position=1 -10,69-190
MCDYTPQKWTKRVPIRTRGKRLPNRRKSTAFHSSTPPHCLLIG

SEQ ID NO: 134623 - protein, 217 aa, Heterodera glycines
  Coding regions on vcDNA: vcDNA=SeqID_61046; Strand=-; Position=1 -246,487-894
MCAFHVKQAINRRPQSMGFMQMYSSKEPNGLQFQRLVRKIGALQFCPPNYLARSLQLMRHLITHSPLETLQQGALSELLDYCELSHAEEETAVAVDEGRQLPARPLELTLELDRGIASAKADILASLNTDYGNDEFVEAMSNYYGRIGHLVGFNPPSNRNEAEEMIIEEDAKLLLEQSLDENGLLVDQYFEEMGLNEVQDENSHDVNSEDGEVDIMN

SEQ ID NO: 134624 - protein, 366 aa, Heterodera glycines
  Coding regions on vcDNA: vcDNA=SeqID_61047; Strand=+; Position=1 -92,141-1147
  Homolog annotation: Hit_ID=CAC84371.1; Match level="QueryCoverage =59%, HitCoverage=51%, E-value=8e-18, Identity=30%"; Hit description =hypothetical protein [Saimiriine herpesvirus 2]
NSATVQWHNKTETLELEAEEGGEGEDSDEEIIAQHSALVPLRKSKSAFADFLRPSQIGNSKQSAAFACPIIIKKLGPEKEDEQQQKEHSEGIEELIDLARGDVLRFRMSHHLKSCASPSRSCCSSSASSLSLDGRTISRWSAPAANSEKETETDDEMCEWEEGEAEAEEEGADEKEIILKKGNSGRKRSSFGMYGKRSGGSWSAPSGLSKGRGGNGGQKRERRKREAEREEGNERKEKKEKRREKEKWKNEKKKEEEEEAQRNRKREEEEKWKEEENREVTEEKHKEPREEEEEKEEDEQGQSDGEAEENASEWDKIGGQHQNMKHLEIDANGWHLHGKADGAEEMMSTSTDEEEYNDDEENEKRI

SEQ ID NO: 134625 - protein, 180 aa, Heterodera glycines
  Coding regions on vcDNA: vcDNA=SeqID_61048; Strand=-; Position=1 -147,199-342,384-440,841-1032
  Homolog annotation: Hit_ID=NP_741113.2; Match level="QueryCoverage =95%, HitCoverage=46%, E-value=5e-34, Identity=45%"; Hit description =putative protein family member, with 3 coiled coil-4 domains, of eukaryotic origin (3E731) [Caenorhabditi
MESPVYYASSPSKQITVIDVYDLAESINRDFEKLVEQFGNEPFDSVVRKVISALETLEALAKYNDKESSELVDLQKTIERFEQEKQQRLRDKDNLEKDFMDLEENYKQEIDELCKIVQKLKAENKRMHEQISTSPSAICGDCSDPMGCHQSAADEQIQALVELRKMTQSQKERIKELQRD

SEQ ID NO: 134626 - protein, 77 aa, Heterodera glycines
  Coding regions on vcDNA: vcDNA=SeqID_61049; Strand=-; Position=1 -36,194-383,484-491
MSGSGRGMSWVGVNDLCKDLDKPNGWQLLKKYNHREVPDEYNVEFPKWKDSYKSIKKFIKYCNYLQKNEKPVQENEI

SEQ ID NO: 134627 - protein, 790 aa, Heterodera glycines
  Coding regions on vcDNA: vcDNA=SeqID_61050; Strand=+; Position=1-2373
  Homolog annotation: Hit_ID=CAE56783.1; Match level="QueryCoverage =19%, HitCoverage=19%, E-value=3e-09, Identity=28%"; Hit description =Hypothetical protein CBG24593 [Caenorhabditis briggsae]
MSTSGGSSNEFPFGTSQAFGQETKMFLSGKDDESSISAIDRKLWQGKTTIKISDLEKAQNDMGKLEDGVNRAFRYLNRSLNQKVNWVKDVVANTNANFETLKVQFETLTERVDMLEQDSDGTNSGGTVSITNLNRASRAPFVTPMGNAQPNQVVPNQVPIHQLSSEDEDDGPTLFGLNMLSSGPTVGSGLEMFCEESVFAFDDWAERFKDYLSVSGKAYTEQEKVTRLKLALRDTPRALFKELLPAQTDTLDSALSELRQKLDSPQRREIAKRTLSLCKQREDETVAQFLRRLTPLVDATNSSLTGDIRIEKICEEFLDRLKPNISFLIRLVGLSRAKDLDLVRAQAEELEALLLMNKGDEASRLSQAVHALSNQSPQSNWSTEANPNNDRAGRWSSGNNVRGFRPFSGSNATRQQQRGRGGRDRSRNWGGGRQEQFSQRNWSSNPRCHYCDRAGHFAYNCHQRRANFRGNSNQSFRQGRWSNQQPRQSQGQWQNRQNPVNMMDVPNSSNTSPGFFENLAQSLLDLKIQDNRNYKNEEPRSGAMNALTHIKPKTTTMDCQVENELAKGSSSESPACGQETKTNIPKTSNWERPSVRSKVASLMFITLMLVGMILPFTTANMPHLPMHPLVCQTQNGGKIWQLPAVTGCSKLSIDHSKAPVVRTFDVFSPNLFEHSADAWACRKVRKSVRKYTSITNVPIQETLEPLMLQMTPSECNQMAENGKCSLGLLINDSGLLHIDNKLDFSPHMWLIGSFSWSTVSTENCYHFKTKIMSKYGSSVMQSPLGSVNNC

SEQ ID NO: 134628 - protein, 42 aa, Heterodera glycines
  Coding regions on vcDNA: vcDNA=SeqID_61051; Strand=-; Position=1-127
MSPYIFFVGYVVLATLLLDATKTCFHQFRLLCAKKLETYFCV

SEQ ID NO: 134629 - protein, 60 aa, Heterodera glycines
  Coding regions on vcDNA: vcDNA=SeqID_61052; Strand=+; Position=1-180
MRKAKCETPKNANNAKGEMRNLGPSLLCTTYYMINNYEVGDRKDGAQTQTNTFLGSPGLL

SEQ ID NO: 134630 - protein, 21 aa, Heterodera glycines
  Coding regions on vcDNA: vcDNA=SeqID_61053; Strand=-; Position=1-64
GPGSRSRVLKSSGPGPGPGRA

SEQ ID NO: 134631 - protein, 133 aa, Heterodera glycines
  Coding regions on vcDNA: vcDNA=SeqID_61054; Strand=-; Position=1 -3,491-772,941-1057
MAQQFQPQQAQNGFTFAPPINGGSDGGGNGGITPVPSPNAAQFGTPIQPQQPQQYFGQYNLQPQQQQQNNNNNFNGQFNGNGNGNNNNNNQHETFEPPTPVLHAVPNVADPLQRPRQIYPGVQQGPSGPGKLI

SEQ ID NO: 134632 - protein, 240 aa, Heterodera glycines
  Coding regions on vcDNA: vcDNA=SeqID_61055; Strand=-; Position=1 -20,147-849
MPKLISIELANWAVEKECETIQSLDKYLQNDKIDEYSEEMKKFGQIVLQICKQKEVTNAQLIRMTETLGPKILAQLAMLEQKIQQLTNSTNFPQKAAPLDNFGTEMMELAKEMPDQMPIKQLKALKTHLPLPSDFFQLLLTSLSLVNSENSIKHENAKESLALSDYLINTNAPVLAQRRHRRGIPSKLVKLGLILALFAIGTKTESPKIVMLACYLGCIYSLYFLYGIWKWYKEVMEKID

SEQ ID NO: 134633 - protein, 28 aa, Heterodera glycines
  Coding regions on vcDNA: vcDNA=SeqID_61056; Strand=+; Position=1-86
MNKSRIIRMKGDGSPTPPRKCPRALSAE

SEQ ID NO: 134634 - protein, 74 aa, Heterodera glycines
  Coding regions on vcDNA: vcDNA=SeqID_61057; Strand=-; Position=1 -149,698-773
QRPPTSRGGEIRFEPRQITAAAEEDQEEQPGTSGTIKMGTNGRHSSMTTRCKNDTEKSSTKSFTGQDKKWKTII

SEQ ID NO: 134635 - protein, 268 aa, Heterodera glycines
  Coding regions on vcDNA: vcDNA=SeqID_61058; Strand=+; Position=1 -299,350-743,802-915
  Homolog annotation: Hit_ID=NP_001004509.1; Match level="QueryCoverage= 78%, HitCoverage=13%, E-value=6e-16, Identity=30%"; Hit description =si:busm1-180o5.3 [Danio rerio] emb|CAD60788.1| novel protein similar to DNA polymerases [Danio rerio]
MYEMKVRKQKRRNPNIVFRDSFNLMPCALAALIPSYGLDVEDKPFFPHLANRPENYGREIHPTPEDYLASGMMPSKRQKFDECYAAHRHEPFKLDEALASYCTNDVEILMAALVAFRREFFEITRRQDYVDGIDNKENHDGIDVLRECMTIAGACMRHFRTNHLPDEHLAIVPERGYDNAQNQSLLALRFFHWYAKEHGVQVQTAHAAGGEKRIGPYSLDGWIEAERRAIEAARGTGAKGVTPTTTCCSPMGRLRDKCANGMPSGWNF

SEQ ID NO: 134636 - protein, 167 aa, Heterodera glycines
  Coding regions on vcDNA: vcDNA=SeqID_61059; Strand=+; Position=1 -91,549-650,701-795,1042-1144,1190-1302
  Homolog annotation: Hit_ID=NP_723049.1; Match level="QueryCoverage =72%, HitCoverage=38%, E-value=7e-23, Identity=41%"; Hit description =CG31650-PB, isoform B [Drosophila melanogaster] ref|NP_723048.1| CG31650-PA, isoform A [Drosophila melano
MYGFRLGINETICKKQLNLKEKQLNLKLNIVSDKEELHHERETFEQKHMNMGKHNMEMDHKAILGSEKNTHEFDELPTEESKKRLRVLAKRMDTDKDGFITLEELTDWVKNSLMTLDQEETKERFDEIDEDKDGVITWAEYTQEAFGVSDSEGDPQKLLTDPDDMKV

SEQ ID NO: 134637 - protein, 91 aa, Heterodera glycines
  Coding regions on vcDNA: vcDNA=SeqID_61060; Strand=-; Position=1 -99,232-405
MRKEFFREQQQHQFQFVRWPQPPRKKQTDISQFLLPFGSVLGTLFFIFVVGYFLNHMNVSEQSKRRRQPQNRAEEANEMGGGDTNTEDNEK

SEQ ID NO: 134638 - protein, 98 aa, Heterodera glycines
  Coding regions on vcDNA: vcDNA=SeqID_61061; Strand=+; Position=1 -186,333-443
  Homolog annotation: Hit_ID=NP_723049.1; Match level="QueryCoverage =98%, HitCoverage=28%, E-value=6e-19, Identity=46%"; Hit description =CG31650-PB, isoform B [Drosophila melanogaster] ref|NP_723048.1| CG31650-PA, isoform A [Drosophila melano
MAHEQSQSEWYQTEKTRFGEEYDKDGDGFLDGDELRAWLVPDLSQTAKQEAEHLTENADTDKDGKLSIDEVVEAYKIFVGSEATNYGEHLTSIRHDEL

SEQ ID NO: 134639 - protein, 116 aa, Heterodera glycines
  Coding regions on vcDNA: vcDNA=SeqID_61062; Strand=+; Position=1 -63,552-602,654-738,787-936
  Homolog annotation: Hit_ID=NP_497726.1; Match level="QueryCoverage =83%, HitCoverage=9%, E-value=2e-26, Identity=54%"; Hit description =phosphatidylinositol transfer protein and DDHD domain containing protein (3E612) [Caenorhabditis elegans]
MDPVAADSTLSKSITSATEYRYTRTRYSCPLISHFNVEVDTKYLDDAGTSENVFELSNSELKNRTVDVLDFVSDPIPSHDYLPEEDPKLFRSTKTQRGPLSDNWVANFVREGKPIM

SEQ ID NO: 134640 - protein, 304 aa, Heterodera glycines
  Coding regions on vcDNA: vcDNA=SeqID_61063; Strand=+; Position=1 -102,149-253,555-683,733-1047,1605-1734,1821-1954
  Homolog annotation: Hit_ID=NP_497726.1; Match level="QueryCoverage =99%, HitCoverage=25%, E-value=9e-48, Identity=41%"; Hit description =phosphatidylinositol transfer protein and DDHD domain containing protein (3E612) [Caenorhabditis elegans]
MDTVELDKSPPITPKVSSSRSLLILVFHGDLFPKTSADSKITDINTFRSTLDTLIAMHCPQLRGQIHVQCVTCGAELLQTSQVLSGVFPSGLGTFHPSFVPLMAADALLFNDAVQNATLNANRVVNSFIASQVGKSDASDLEIFVVGDFIGGILMYESLARTALTMADQQQRDGDGCASLTSPVAVDQQKSPIPSLSKSPASTLSSPFITQRPNKDKDSSLSAIRTNRSATAESLSFKPSAAFLLGCPLALLLMQRKLNEVEQQLSLFCGQLFNLFYPLDLCAARLEPVLNPSLSALPALKVPR

SEQ ID NO: 134641 - protein, 18 aa, Heterodera glycines
  Coding regions on vcDNA: vcDNA=SeqID_61064; Strand=+; Position=1-56
YREAIPEGFGLPINLGAS

SEQ ID NO: 134642 - protein, 121 aa, Heterodera glycines
  Coding regions on vcDNA: vcDNA=SeqID_61065; Strand=+; Position=1 -11,86-440
MNKIWICNDVWMDILPSFDHAQLGLKMALISPRFDALVDKHFDGKSELTIWRPITICKDAVAAVPNLAVLIDQGIQTISCHFRCQPFAAQKIRFNNLGLENTNTIKSNSFVTSFSGTWPFL

SEQ ID NO: 134643 - protein, 93 aa, Heterodera glycines
  Coding regions on vcDNA: vcDNA=SeqID_61066; Strand=-; Position=1 -102,504-596,673-759
MLRQKKYREIVYSKKTRVRRLINHFAKHARRKDGILLFRFIEGHSGPIVARELMGELFETYKKDMHEEDDEQPSEAVLVNKKDGSLDNDPKNR

SEQ ID NO: 134644 - protein, 51 aa, Heterodera glycines
  Coding regions on vcDNA: vcDNA=SeqID_61067; Strand=-; Position=1 -115,471-511
MNECGRNVPMSCRPCCPPIWALAAHSPGSAGMPAGPSRLMTKYIEEKAKKR

SEQ ID NO: 134645 - protein, 76 aa, Heterodera glycines
  Coding regions on vcDNA: vcDNA=SeqID_61068; Strand=+; Position=1 -93,566-701
  Homolog annotation: Hit_ID=NP_505722.1; Match level="QueryCoverage =59%, HitCoverage=9%, E-value=6e-14, Identity=77%"; Hit description =PRO1512 (51.4 kD) (5L81) [Caenorhabditis elegans] emb|CAA97339.1| Hypothetical protein T21C9.12 [Caenorhab
MGHRRNGTKKMQIVKSDENPLPIPQNPLPNKDLSRLNRDLSKVIYIDWDPQAFQLNPENVLRVPKWEGNMDDTTLA

SEQ ID NO: 134646 - protein, 400 aa, Heterodera glycines
  Coding regions on vcDNA: vcDNA=SeqID_61069; Strand=+; Position=1 -30,149-346,394-578,631-853,926-1036,1122-1304,1349-1425
  Homolog annotation: Hit_ID=NP_006382.1; Match level="QueryCoverage =90%, HitCoverage=29%, E-value=2e-52, Identity=32%"; Hit description =importin 7 [Homo sapiens] gb|AAC68903.1| RanBP7/importin 7 [Homo sapiens] sp|O95373|IPO7_HUMAN Importin 7
QKPQKSSKFLGILSLFLFLIHILRYKRQKEKTPLVGLMESALPLLQERLSTLLPNQSQPSCILQKQILKIFYCLNQFTINLQILSMDQFFTINLQILSMDQFSKWLHLFLAILEREVPNECNTLPEDERAETLWWKCKKWAIKIIQRIFERYGNKGNVDLSYSDFYGNKGNVDLSYSDFATQYSKDLVLPVITSLMVHVLNNFINGHFVSDEVLYFTLSHLSDAMNQAQVWQALKPHFEPLLKSVIFPLLQYSKEPLLKSVIFPLLQYSKEDEQMWADDVEEFLRFKYDVYEDLHHPSSAASTDLHHPSSAASTLLQMLCKRQGIMDSLLVFIIENLSSTSDVRQADGALHMVAIVSSQLLKLKKYRKVEKLLDAKKYRKVEKLLDAKEIARTAHEVGLL

SEQ ID NO: 134647 - protein, 343 aa, Heterodera glycines
  Coding regions on vcDNA: vcDNA=SeqID_61070; Strand=+; Position=1 -81,193-321,374-598,647-1040,1252-1454
  Homolog annotation: Hit_ID=XP_308523.1; Match level="QueryCoverage =99%, HitCoverage=64%, E-value=1e-21, Identity=26%"; Hit description =ENSANGP00000009536 [Anopheles gambiae]
MCEKTLNDEGEDGCDESTKAHAAKMLEVFVLQCQGRASHFIPDILRLVFNQLQKESADLKLGQLKPQLLIILIAALYSDFQLCSNLFGQLQFKTEIGTFEWLIRELYSNRKDFEGVHDRKMLIWLLCRILADGNLPALFINQPEKFMEWLLTLFEELQRCIKEIAERREDDSDSEDEESSEEDDDRMNGELKDSDDDVDEGEHIEETLSKRGNVKFQENSQYLMALEHERNERKERRTRRKSSTNKSMDDQTEGAPGDILSLASETTDSEEHHHFREMNTRNSPLLVSISDQQRIGEARVAKLNHLMEICTREENLERSKRLAQAGGYSFDANAPVPTTFSFS

SEQ ID NO: 134648 - protein, 107 aa, Heterodera glycines
  misc_feature (87)..(87): Xaa can be any naturally occurring amino acid
  Coding regions on vcDNA: vcDNA=SeqID_61071; Strand=-; Position=1-807
ELKDSDDDVDEGEHIEETLSKRGNVKFQENSQYLMALEHERNERKERRTRRKSSTNKSMDDQTEGAPGDILSLASETTDSEEHHHFXGVFIQRKKSTEISFSINSAF

SEQ ID NO: 134649 - protein, 240 aa, Heterodera glycines
  misc_feature (5)..(5): Xaa can be any naturally occurring amino acid
  Coding regions on vcDNA: vcDNA=SeqID_61072; Strand=+; Position=1 -111,173-237,359-521,675-818,862-987
  Homolog annotation: Hit_ID=CAE63454.1; Match level="QueryCoverage =78%, HitCoverage=64%, E-value=9e-60, Identity=60%"; Hit description =Hypothetical protein CBG07915 [Caenorhabditis briggsae]
LTFFXFYCNHLTSALGFVNLALYAGAYTPMKRIHPSCTWIGAIVGAIPPLCTWIGAIVGAIPPLMGYSAATGHLDSAAFVLGALLFSWQFPHFNALSWNLRADYSAAGYKMMCVTNEGLCKRTTLRHSVALLCLCSFAAPFTHLTTWTFAFTSLPLNLSMLYLAIRFYLNTDKKNATNLFRFTLLYLPILMALLYASKKNATNLFRFTLLYLPILMALLYASKDGCQDCRYKEIAKTIRV

SEQ ID NO: 134650 - protein, 117 aa, Heterodera glycines
  Coding regions on vcDNA: vcDNA=SeqID_61073; Strand=+; Position=1 -147,284-490
  Homolog annotation: Hit_ID=XP_395597.1; Match level="QueryCoverage =72%, HitCoverage=5%, E-value=3e-11, Identity=42%"; Hit description =similar to CG14814-PB [Apis mellifera]
GSQTVVSLPSTWKKPRKKTKKAIKFAPEDVMDKGLGYDLEDDFIDDEQAYDEWVPTTMDTAKRGHYVNKGPLEFRQIDFDQTTSEEDEEKDGEEESNGTRRETSILEADEEEAMNME

SEQ ID NO: 134651 - protein, 361 aa, Heterodera glycines
  Coding regions on vcDNA: vcDNA=SeqID_61074; Strand=-; Position=1 -105,153-428,483-900,975-1260
LFGVPMFVGCCAILWIYWDIFKKPPKPRGPHKKKIFISGNSWLAVFNLLAPSQVGQGIAMISHRFDNIVDKHFETRRWTLKSMGIGRKIEKNGTKKLKIVNSVGLPLAIPQIQLPHNVSGFKRITISFIDGKAIAFLQRFRPLFASCPLNLFIDTTSDRILESILHNIWPLLSKNIDGIGLSATIYRRLRQFVPSILNECPSLRIVSYVDDLFAEFPADDNAMASDGQAMAKWLFTPRMDDVPKVLRCWLNKDDGDLASKIEAFKAAFANASSPANSIVYLSFPSPFASVVPFDLTNESTREQLTLKRTDFSCRFLLVRCPIARDESKWTKWEKEAIGRIFFDQWNRIDIRRGWRGMKSGK

SEQ ID NO: 134652 - protein, 88 aa, Heterodera glycines
  Coding regions on vcDNA: vcDNA=SeqID_61075; Strand=-; Position=1 -207,670-726
MPNPAYGMPNPSHGMPNPAPSSMAVNNGPINCSPSKCNPCNCSPPCFVQQTAATGEGPGGGPAISLVLAAVTLSLLGLLTVHGMMVLP

SEQ ID NO: 134653 - protein, 279 aa, Heterodera glycines
  Coding regions on vcDNA: vcDNA=SeqID_61076; Strand=-; Position=1 -75,118-507,659-1031
  Homolog annotation: Hit_ID=NP_506386.1; Match level="QueryCoverage =99%, HitCoverage=34%, E-value=8e-27, Identity=30%"; Hit description =SR-related CTD associated factor 6 (77.1 kD) (5O156) [Caenorhabditis elegans] gb|AAN77185.1| SR-related C
VRERRSSDSFRLHVLYLINDWAHYCQRKKLDSIRQMLSRYVPKLYAYACSSPMAASNNTFVDKLEKLVGVWEGHKYFDDGCYKQLRNPSATMLAEQTATVAEQHQLAAEVDKEIADTLGAYTKQHKEYEQHVLTKVAEREKALRECRGWKMRAKAKAENERKRLAAERENVEQMRRRSTRFDQTIPLPSTNSPHKIPSLLEINPPPHSPAVHQQPCLGNGPSSMGTPFPPLPPTGAAPPPMAHFAPPQQRPPVDLIPKAPYYELPAGMMVPLIGIEDIT

SEQ ID NO: 134654 - protein, 126 aa, Heterodera glycines
  Coding regions on vcDNA: vcDNA=SeqID_61077; Strand=+; Position=1 -72,246-554
MDNKTDLVHTLFSYLSEKYTVFDRIFVSLQLDDVNRMAHLGQSLPANNDEMENAEQIIMRLRHKSPYFVARIDGRTQTVFFEEEAKSSKQQMAAQLQSKVDTAMADVITLASIVHSYEDAVRLNTN

SEQ ID NO: 134655 - protein, 116 aa, Heterodera glycines
  Coding regions on vcDNA: vcDNA=SeqID_61078; Strand=+; Position=1 -35,128-233,507-716
MSRYLKGNPPELNFTVESPSTLLDNYVSMSTVAFGQLWNGKMGISDGLLIIQYNAFKPRSEAGQFQNFVPHFTVESPSTLLDNYVSMSTVAFGQLWNGKMGISDGERSFLKIPLFV

SEQ ID NO: 134656 - protein, 88 aa, Heterodera glycines
  Coding regions on vcDNA: vcDNA=SeqID_61079; Strand=+; Position=1 -96,135-305
MPKQNEIVLKYSFLDLTWFLDIEAVFYAISKTKKCLVVKTIFHISLHNFVSSARIETGIRPLERAARALQEGMERKNSYFWDFFRNQK

SEQ ID NO: 134657 - protein, 137 aa, Heterodera glycines
  Coding regions on vcDNA: vcDNA=SeqID_61080; Strand=+; Position=1 -225,830-1018
GDFAVVCSVDNSGDGNVSALGSEVIPLDQCRHPAMCMLIDASSVKQCAISVPDDLVNYFVHGEDTFKMLLEAVSKSFFAGALKKVQILKDTFLLHSRQKMLLLNRHEETMKMLAAQEPPDEFFEEFEVQTAMMGLGW

SEQ ID NO: 134658 - protein, 266 aa, Heterodera glycines
  Coding regions on vcDNA: vcDNA=SeqID_61081; Strand=+; Position=1 -59,811-1089,1307-1506,1895-2157
MKRAKDDDAEEGRVGEESNVDHPEDHDATAADCEQQHLLLTSNGTLSAASSSFGVVDGCGGGGGRIYPGLFAEDDAAEHKGNTRRSAQNGAGGPAGRSNNIGPKGSGWPPIKSVTMEEQAEDDDDVNGDHKTDDDEEEEENEVAEEEPLYPTRGGTMRNNNANSVPAVAQKIVSRRSLPASFQHQPQLQKRWSPQQQQQAVQQPWQRRRHQAVVDDDEEDDQGGKSATDGGTSAGFWQFFDSNFEQFVARGHGHRRPTNGGKWEII

SEQ ID NO: 134659 - protein, 104 aa, Heterodera glycines
  Coding regions on vcDNA: vcDNA=SeqID_61082; Strand=+; Position=1-438
NGVSKNRNYAQKASQTILTLPIPSTIAFIHPIMSAKIIRVPKIACDLSLAKNGLSKNRNYAQKASQTILALPIPSTIAFIHPIMSAKIIRVPKIACDLSLEKMV

SEQ ID NO: 134660 - protein, 88 aa, Heterodera glycines
  Coding regions on vcDNA: vcDNA=SeqID_61083; Strand=-; Position=1-264
MGSAQFHAAQLHKLFMDTAGISEEDEASPVPSLHNQPQQQQHIHHQILPHHRFVDAINRSPPLPTAHALPAMQRRRMATMATTTGLAS

SEQ ID NO: 134661 - protein, 41 aa, Heterodera glycines
  Coding regions on vcDNA: vcDNA=SeqID_61084; Strand=+; Position=1 -73,205-257
MAPSHKLFFQLVILLVVASHDISNGLSLGILELVLWFVCVG

SEQ ID NO: 134662 - protein, 52 aa, Heterodera glycines
  Coding regions on vcDNA: vcDNA=SeqID_61085; Strand=-; Position=1-181
SFPIVCTLILRWIFAPHNCLSTPNGHLKKSIFLFHKYFFRKCSETHQILFTC

SEQ ID NO: 134663 - protein, 136 aa, Heterodera glycines
  Coding regions on vcDNA: vcDNA=SeqID_61086; Strand=-; Position=1 -52,104-241,290-375,438-522,575-623
  Homolog annotation: Hit_ID=NP_000251.1; Match level="QueryCoverage =99%, HitCoverage=6%, E-value=2e-24, Identity=41%"; Hit description =myosin VIIA [Homo sapiens] gb|AAB03679.1| myosin VIIA sp|Q13402|MY7A_ HUMAN Myosin VIIa
MFVPIHLTDGRVISLPIDSQSTPFELCEMLCQQICLKDAFGFGLFLAVGRRFIRSLGVGSECVIDAIASLETKSEKNWRIFFKKELFRAHQSESDDPLAIELAFRQILGGIHSKEYQCEKEDDLVTLAAQQHFIDI

SEQ ID NO: 134664 - protein, 130 aa, Heterodera glycines
  Coding regions on vcDNA: vcDNA=SeqID_61087; Strand=-; Position=1 -124,505-773
MAGRGTTIVRKGISWLEEVQPRTTGGRGATMIRKGTTLAEKGTTTEGSKRYNIDWKDNTLVCKCTTMARKGTIAGGTSITMAVTGTTMVRKEPRVEDLLPWYKEAQPWLEELKPWMDEVRQWFEKVTPWM

SEQ ID NO: 134665 - protein, 100 aa, Heterodera glycines
  Coding regions on vcDNA: vcDNA=SeqID_61088; Strand=+; Position=1-303
MFAGPDPAGLILQILFFPKNAGLRTGILQNPAQDPVLRAFQLAILATQSHYFFLDGENEIKEKKINVIVVRCENDRFGRAIQAGQWFTQTVENQMKYMIK

SEQ ID NO: 134666 - protein, 58 aa, Heterodera glycines
  Coding regions on vcDNA: vcDNA=SeqID_61089; Strand=+; Position=1 -88,571-658
  Homolog annotation: Hit_ID=NP_495470.1; Match level="QueryCoverage =94%, HitCoverage=25%, E-value=2e-12, Identity=60%"; Hit description =ribosomal protein L10 (25.3 kD) (2H403) [Caenorhabditis elegans] gb|AAA82424.1| Hypothetical protein F10E
PTFKQNSRVFFVKNNFMTVALGKSAQDEQANELHKVSALLRGQSGLMFTNAKANEVQR

SEQ ID NO: 134667 - protein, 93 aa, Heterodera glycines
  Coding regions on vcDNA: vcDNA=SeqID_61090; Strand=-; Position=1 -110,238-409
MEIFDEFIIVYEQVIGKFSDQFTGKCSFEEITQFAALEFLTTDYPALKITDIGNASSSNPSNEEPLAQIVRWDWDQNGAQQIIQVIKYKEIFK

SEQ ID NO: 134668 - protein, 84 aa, Heterodera glycines
  Coding regions on vcDNA: vcDNA=SeqID_61091; Strand=-; Position=1 -78,151-261,983-1048
MANFLKANCVIEFTVARRKKSMTERYPNSNRAIIGAIRRVLWYTLWPARGHHRIEVRINDNGQIIAKQGISGQFSNFAKGSPAM

SEQ ID NO: 134669 - protein, 105 aa, Heterodera glycines
  Coding regions on vcDNA: vcDNA=SeqID_61092; Strand=-; Position=1 -98,482-701
  Homolog annotation: Hit_ID=CAE69512.1; Match level="QueryCoverage =83%, HitCoverage=12%, E-value=9e-23, Identity=57%"; Hit description =Hypothetical protein CBG15720 [Caenorhabditis briggsae]
MSGAGGEGQADGVTQNAFAHIFDHIAKCHQDKRFLVRISYMEIYNEEVRDLLAKQSAAGAQRLDIKERADIGVYVRDLLNVTVASAEQCLRIMQLGNANSQNIQK

SEQ ID NO: 134670 - protein, 95 aa, Heterodera glycines; identical to SEQ ID NO: 128210
  Coding regions on vcDNA: vcDNA=SeqID_61093; Strand=-; Position=1-660

SEQ ID NO: 134671 - protein, 146 aa, Heterodera glycines
  Coding regions on vcDNA: vcDNA=SeqID_61094; Strand=-; Position=1 -115,165-250,293-436,671-766
  Homolog annotation: Hit_ID=AAH44037.1; Match level="QueryCoverage =78%, HitCoverage=24%, E-value=7e-20, Identity=42%"; Hit description =Cg8286-prov protein [Xenopus laevis]
MVNFNYEWLNPPLGVLGLPLPILPISYLSFISFTLIHFASSQRKEIEKHLEQGKHWLSKGQFQEALQHYHQAVALDPTDYQIYYRRATVFLASGKVNAALPDLDKVVELKPDFVATLIDHGLRHFDSRDYVSAEQMFNDAIEVSKI

SEQ ID NO: 134672 - protein, 16 aa, Heterodera glycines
  Coding regions on vcDNA: vcDNA=SeqID_61095; Strand=-; Position=1 -47,329-332
MAVGRQLLLLRLRPLR

SEQ ID NO: 134673 - protein, 141 aa, Heterodera glycines
  Coding regions on vcDNA: vcDNA=SeqID_61096; Strand=+; Position=1 -59,184-412,466-603
MVAARFRVSTGKFTNGRAKRAISFPGSHPSFLCAALADKPNLYIIPLIPPSKKENASSPRCAPIRSTLASKARFIQTHPCGDFIFIGAENKLLIWEIHSGQLLSQVEAHLRDISAMRISSCGHFLVTASLDGDAKVFMTAK

SEQ ID NO: 134674 - protein, 98 aa, Heterodera glycines
  Coding regions on vcDNA: vcDNA=SeqID_61097; Strand=-; Position=1 -78,123-195,239-439
  Homolog annotation: Hit_ID=CAE67479.1; Match level="QueryCoverage =100%, HitCoverage=10%, E-value=1e-23, Identity=52%"; Hit description= Hypothetical protein CBG12983 [Caenorhabditis briggsae]
RKTYFVFMTYGFESPGERLVWILLENNERSVSATDEVPSLELAVATKYVHGKNQNSDTLLQLRSLIANRRRTPHAGVGFWRWAITMIAGVSEIVIHFF

SEQ ID NO: 134675 - protein, 347 aa, Heterodera glycines
  Coding regions on vcDNA: vcDNA=SeqID_61098; Strand=-; Position=1 -76,558-766,841-1185,1787-1942,1988-2132,2180-2292
  Homolog annotation: Hit_ID=NP_495618.1; Match level="QueryCoverage =91%, HitCoverage=46%, E-value=1e-36, Identity=47%"; Hit description =peptidase M20/M25/M40 and Peptidase family M28 (102.1 kD) (2H992) [Caenorhabditis elegans] gb|AAA62526.2|
MVDILEVLAHSEKPLENDILFLFNAGFDIAYIRNGWVYHTEFDQPQRIEPGAIQRSGDNVLALAKALIRSPYLKQPADFNEGSNWVFFDVVGLFTLFFCTIPSVWSSLFWSGVVFSTALTQLVDLWLLSLPLSPSTYAFLLHCQAAFWHQLLALFAMVAVGAFVVCVLSVFNLTMSWYALPELVFPLYILPMLTASIAVHNAMAQRARRKNNLVYMSRRLNFMIKCMTAVFAFAFLVVATTSVGVPYKFSEDEPRIRRLIALHATRRIYNFDKKIVENRISSLNSTDSGLFVQTLDYRGPDDLPEHTFLQGAGQPDCSHTSDEYCQLPYYTAIHELFPPEYVEEYFL

SEQ ID NO: 134676 - protein, 146 aa, Heterodera glycines
  Coding regions on vcDNA: vcDNA=SeqID_61099; Strand=-; Position=1 -194,580-770,811-863
  Homolog annotation: Hit_ID=NP_496147.1; Match level="QueryCoverage =85%, HitCoverage=14%, E-value=3e-18, Identity=40%"; Hit description =phospholipase protein (93.6 kD) (2K235C) [Caenorhabditis elegans] emb|CAA88206.1| Hypothetical protein C0
MDLPNGQQDLQASTSKSSEHLLEKFTISAIIEAHQPNDAKCVAEMPDGNLVTGGRDGLMKIWRKRDIYENCETIPQKDCLSINSVAVAAKSVKGFLVFVGRKDGSIAIFSPSNAFKEPLKVLQGHKSNVCTLLYDENTGLLMSGSW

SEQ ID NO: 134677 - protein, 94 aa, Heterodera glycines
  Coding regions on vcDNA: vcDNA=SeqID_61100; Strand=+; Position=1 -140,187-272,673-731
MTSRILVIGSTNIDDAEAHNMVFDMSIFGKCVETNLPIFSERVQLVRKYALVKEIYLTENDEKELAHDTNSLSGLTLPSLGRLGHVRYKCLCFC

SEQ ID NO: 134678 - protein, 290 aa, Heterodera glycines
  Coding regions on vcDNA: vcDNA=SeqID_61101; Strand=-; Position=1-873
  Homolog annotation: Hit_ID=XP_313035.1; Match level="QueryCoverage =88%, HitCoverage=30%, E-value=9e-31, Identity=31%"; Hit description =ENSANGP00000011760 [Anopheles gambiae]
MDPNQLKLILEAVLKASAEQNNSSAALATSIDARLSTFEYDPELGHTYDVWLKRYGQTIAQDGQALSGQSKVQLLIGKLGEAEYKRYCDSIAPKTQNDFNWDETTAKLKKLFGETRSLFLRRFDCFQIRQEAQQDVPSLIAQINSSCENADLSLSKEELKCMILIIALRDEFTDLRQKCLQRLEDSRTSGRSTSLQELGEECRKYQILKESALSLGSNPCSTSAIRAKPQQIKDKQKPKTKPQQSHKGQNFLPKNSTAPKGKVDQRDQPCYSCGGKSHWQKDWWFQKLDV

SEQ ID NO: 134679 - protein, 152 aa, Heterodera glycines
  Coding regions on vcDNA: vcDNA=SeqID_61102; Strand=-; Position=1 -154,204-280,591-742
  Homolog annotation: Hit_ID=CAE62038.1; Match level="QueryCoverage =99%, HitCoverage=8%, E-value=4e-52, Identity=64%"; Hit description =Hypothetical protein CBG06054 [Caenorhabditis briggsae]
QIQTASCTVLNPAMARCNIPKIYDWGTKTVYFQPQSQGANDERAFVGYIYFVPPTLDPMRLDIGNIYDWYKNIYFVPPTLDPMRLDIGNIYDWYKNPMPYQVMPITWYPRNFTNPDLNYMDQTWHISDDALYGVQLGLYVIGYKEAKDDQVL

SEQ ID NO: 134680 - protein, 20 aa, Heterodera glycines
  Coding regions on vcDNA: vcDNA=SeqID_61103; Strand=+; Position=1-89
LGTLMLFLSKREMNKIFKNF

SEQ ID NO: 134681 - protein, 51 aa, Heterodera glycines
  Coding regions on vcDNA: vcDNA=SeqID_61104; Strand=+; Position=1 -117,176-214
MALKKWAANVQDANVGTQMSGRKCPNLAGAANVRAAKAGILVSTSTAKAAI

SEQ ID NO: 134682 - protein, 61 aa, Heterodera glycines
  Coding regions on vcDNA: vcDNA=SeqID_61105; Strand=+; Position=1 -180,245-250
MDTFMDIEKVSEFAREIIINERVNESVTYIKGLPWKIWAQINKKMKALTIMRNVWPFSFII

SEQ ID NO: 134683 - protein, 92 aa, Heterodera glycines
  Coding regions on vcDNA: vcDNA=SeqID_61106; Strand=+; Position=1 -99,976-1155
METGRLFCNLLRKGYIIGDRQFNGDWHIKRANTVYDHDVNRQRVSRAQLPAVIDEIMNEANEGARAFILANLENVRKVNMGLNGREGSVKKN

SEQ ID NO: 134684 - protein, 174 aa, Heterodera glycines
  Coding regions on vcDNA: vcDNA=SeqID_61107; Strand=-; Position=1 -74,121-254,290-603
MLEKLFKDQDKGTVFISQKNTVQTAKTFVDFYKQSMRNGEEGIVVKAFNSLYRPGSRAERNGWKGRGGGRWFKIKPDYGVQSALDLALVGIRYENNVFSHIKSFLVAARLPGPSTNFHLKIVAGITSRLKALDFKRLTELLGPKKALLHKMPTWLERNNGAGKYDLFVPKHNIQ

SEQ ID NO: 134685 - protein, 252 aa, Heterodera glycines
  Coding regions on vcDNA: vcDNA=SeqID_61108; Strand=-; Position=1-756
MLFSFFLFQFYSVVYSIASKRSPEPWGDTLKSIDDNARDFKWPDRHEKGTWAAVAATGEGSRARAETGVNREEGSGMEEEEEEDSHIVRAEALSEREGGVAVAAANKGQTQKTSDDNNDDRDGAHQQVVVMARGGEDARAKAEASGGPRSVVETRISDNQRGGERLALGSAIIHRQGRRRGGGGGVGGRNRNRQRGKEEQGEDEDLLPTIISPPPPAYMELNNRQKGNEQVTLHNNVHTMSPVSYPYLLRNQ

SEQ ID NO: 134686 - protein, 365 aa, Heterodera glycines
  misc_feature (8)..(8): Xaa can be any naturally occurring amino acid
  misc_feature (363)..(363): Xaa can be any naturally occurring amino acid
  Coding regions on vcDNA: vcDNA=SeqID_61109; Strand=+; Position=1 -279,339-439,496-727,788-976,1430-1609
  Homolog annotation: Hit_ID=CAE73313.1; Match level="QueryCoverage =92%, HitCoverage=94%, E-value=1e-67, Identity=43%"; Hit description =Hypothetical protein CBG20740 [Caenorhabditis briggsae]
HGPGTSIXRFPISEVIHRMSSASSPVPSLILNSGFPMSQIGFGTWMCKPTEVNEIVKSAIRNGYRHLDCAFIYQNQSEIGAALKDMLQHGEIKREDLFITREDLFITSKVWNTFHSFDAALANVHKSLEQLGLDYLDLCLIHWPMGYKYLDLCLIHWPMGYKEGTELFPKDAEGQKVFLSDVDFLDTWRALEKAVALGRVRSIGVSNFNSAQIQRIIDNCNIRPSTFQTECHVFFQQKKLRTTFQTECHVFFQQKKLRTFCKNNGIHFVASCPLGSSADNAFRKSEYPSVFEHPTISEIASLLQKSNAQVALRFLTQFGVVVVPRSSDAQRQRQNLDIFGFSLNDQQMAQIEALDTGKRILYXLS

SEQ ID NO: 134687 - protein, 48 aa, Heterodera glycines
  Coding regions on vcDNA: vcDNA=SeqID_61110; Strand=+; Position=1 -99,562-609
MKLDYLSQSKKRMVLNFLFSLTGLLFQLSRVFKRPDDWGRRDPSRDPD

SEQ ID NO: 134688 - protein, 78 aa, Heterodera glycines
  Coding regions on vcDNA: vcDNA=SeqID_61111; Strand=+; Position=1 -68,150-253,668-732
MLFVRFRSVFGPYRAFSEFLSANRTCLYDFHVKNGAKMVEFAGFSMPIQYDLSVSASDNFKNGPRITLFGDERRKDWN

SEQ ID NO: 134689 - protein, 56 aa, Heterodera glycines
  Coding regions on vcDNA: vcDNA=SeqID_61112; Strand=+; Position=1-168
MGYGSQAVRLLLNFYGRRPRHVSTTTAAAQCQNGEDKNGGNDKEEDEEMSRVQLVD

SEQ ID NO: 134690 - protein, 21 aa, Heterodera glycines
  Coding regions on vcDNA: vcDNA=SeqID_61113; Strand=-; Position=1-64
TTNSQLCAVRALSASLSTQTS

SEQ ID NO: 134691 - protein, 296 aa, Heterodera glycines
  Coding regions on vcDNA: vcDNA=SeqID_61114; Strand=+; Position=1 -179,553-1263
  Homolog annotation: Hit_ID=NP_504187.1; Match level="QueryCoverage =80%, HitCoverage=18%, E-value=1e-38, Identity=40%"; Hit description =predicted CDS, integrase, catalytic domain containing protein family member (5E782) [Caenorhabditis elega
MISAGQNLCPLTAMIIENEEKEPEKYWDLEMIGVKDNPVEKDDDVTLKMFQDSVYRKDGRFKRVPFGVISSPFLLGATVRYHLENEQSELAREVKRNTFVDNIFVGCHDFDESIEKYKNLKVLFEKARMNIREFISNSERVNNEIPEKDRLVKENPKVLGINWDIKTDTYQIKFPNVHETERISRRSVLKELNSVFDPCGWLSPCLLPAKLFFQSLWEEDRKWDDKIGEEKQKEWKYITSLWENKSIKCIRRIVPDKFNRAELHVFVDASKDAYAACVYLRIESEKTQINLLYARS

SEQ ID NO: 134692 - protein, 774 aa, Heterodera glycines
  Coding regions on vcDNA: vcDNA=SeqID_61115; Strand=-; Position=1 -264,365-1258,1423-2589
  Homolog annotation: Hit_ID=CAE73290.1; Match level="QueryCoverage =49%, HitCoverage=88%, E-value=3e-54, Identity=32%"; Hit description =Hypothetical protein CBG20709 [Caenorhabditis briggsae]
MIENALDQQLLCFVEMCFNVLKGRVPLGKRQIQRLGELKHQLRSLARARCAKTARRVLLLNHQQQQQQQQTGAGFPMVASMLASVLLPESAKKMRHAMRMFLVPEDVFQSVFVQPQAAAAAAAAADGADGTPIGLLRSRIQQIERSRELNEEQKAAQYHQEFKRLNKLVREQEEQPINVRLQHEKEREKNAATPPPPPPPQTIDHSTPKRLEKNIVPSAFGLRRQRHHYTQKAGALSNRRPAQKQQRKAAAAAAETPNSSGNGETEKEEGDVDDGEQWDDAQSSSSTASTGGAAAKRVLRARDGEAGKGGGGGGGETADRLQPKHNYQMTKNALITHIRKKGHSLGVSDQGKVLRADGSEFKTSNVEAIVSHLLNRDKRSEFKGPPVQTDTMVIDRKKEQLLDQLYKDVNSSVSFTSVEPLLREAKKVNNQMSRKDVVDYLATQRTYTIHRQAKRRYKQLPTLASGLHTEWQADLSVFDKLSRENHGYKYLLVCIDTLSRQLFVEPVKSKKSSDMVAAFERLFKRSKYIPWTLLTDQGLEFKAKEVQEYFKNKNVKNFFMYTSPRIHAGMAERANRTIKERLYRYFTERGTQKWVDVIQQIVHGINHSYNSSIKMRPVDVNFENAEKLRKKLKQNAIGGTAELKRKQPLPRFQVGDRVRIEKYKHVFQKGYTGRFTNEVFTVAEVHTDRFPVTYRIRDDDGSLIKGRFYANDLCRVLVRKNDDDDDDDDTLYDIEKVVRKRKKQGVEYVLVKWKGYSQRHNSWIPASSMTWKNI

SEQ ID NO: 134693 - protein, 217 aa, Heterodera glycines
  Coding regions on vcDNA: vcDNA=SeqID_61116; Strand=+; Position=1 -126,194-287,329-627,687-821
MDAILATDWLHNAFPERKTTTTTTTTTTISSVGEELDDAVKADEQISWLKIIEEEEERGNELQTGEMEVERAKEIEPPKRQHLQSKCSCNEKQKSVPLIDFLCQHYKCSVKELHVLLQTLNKRREISEMLRSQLQLRTNHLRPAWKNFRVHCNELTIHPAQTAYAMRGYLGITVRIYYYVKHGVKLVYPQLPCVHQFGGGDHCSLFPLECLSVIKDA

SEQ ID NO: 134694 - protein, 31 aa, Heterodera glycines
  Coding regions on vcDNA: vcDNA=SeqID_61117; Strand=-; Position=1 -69,1150-1176
MAPVNQRHEQKGQKEGENGGAEHTNLDVWEE

SEQ ID NO: 134695 - protein, 244 aa, Heterodera glycines
  Coding regions on vcDNA: vcDNA=SeqID_61118; Strand=+; Position=1 -178,235-347,409-462,514-769
  Homolog annotation: Hit_ID=CAE68558.1; Match level="QueryCoverage =83%, HitCoverage=23%, E-value=4e-51, Identity=53%"; Hit description =Hypothetical protein CBG14393 [Caenorhabditis briggsae]
VWLLLVTMPISCIIGNTLVVAAVLSNKSLQTPTNYLLLSLACADLMVGTLVTPFHIYMTINSLHWHLPVFTINSLHWHLPVFTCYIYCVLDVLASTSSIVHLLLISMDRLVAATKPADYKTHKLVAATKPADYKTHKHRRRVYLAIAFCWLFSLCLSLPLVYLAIAFCWLFSLCLSLPLVFGFNADTERYLLEEHHCGIYSPTYMFGSSIRLLFAPFVHVFDLRVPLFQLNNPSDQLTFSYIFF

SEQ ID NO: 134696 - protein, 64 aa, Heterodera glycines
  Coding regions on vcDNA: vcDNA=SeqID_61119; Strand=-; Position=1 -50,92-220,368-486
MYDSPSYGSGYSPSYYGGYYGRNGGLGYGGMYPGYGGYSTASYYGGWPYTAGYGAQNGYTSPWR

SEQ ID NO: 134697 - protein, 550 aa, Heterodera glycines
  misc_feature (130)..(130): Xaa can be any naturally occurring amino acid
  misc_feature (180)..(180): Xaa can be any naturally occurring amino acid
  Coding regions on vcDNA: vcDNA=SeqID_61120; Strand=+; Position=1 -72,120-301,589-627,881-1130,1489-1637,1718-1746,1795-1849,1892 -2061,2116-2293,2633-2734,2796-2991
  Homolog annotation: Hit_ID=CAE68558.1; Match level="QueryCoverage =99%, HitCoverage=69%, E-value=1e-106, Identity=44%"; Hit description= Hypothetical protein CBG14393 [Caenorhabditis briggsae]
GGQFLGFGADLGNIATSAMETVIGIDQKNRNMITWEKPLLKKIEETVIGIDQKNRNMITWEKPLLKKIEETAAEHASSLNESEREQVRSAIYGTGGGGSNHFTESFDQAPPSSVILDAVTTKTDKDGSQXSVAVPIWWWTRGKGRSNTDAFHTTAQGQRKRREFVESAEQNCRERERKKXGGGRERETRGERQRGGKERPGRESKKSMRRLSELISGWERPSRSSLGQLLTFARRDSVYIARKKLAGLKDWALDLIAKLKLIAKLKSKQGLAIRREARATKLVATVMASKQGLAIRREARATKLVATVMAVFLICWAPVFLICWAPYFSMNLYKIYKLYNDQWSHQSEFTFHWLSALGYLNSSLNFFIYSAINKKFRITFWRLLGLRRKFRITFWRLLGLRRSQRKKAWLLPPAQHKKKPKEDGQRQRATTEPNGAEPKNAAKQRNRHLSIRKPQIVVEDLANPIQTSMTISAGGETTYRRSSDDRSSDDCIQRSCSEVFGGGIVFPSGAHHNSRRGSDMSNSSASLQLHDIHQIEAQSAEEMAQAEVKP

SEQ ID NO: 134698 - protein, 28 aa, Heterodera glycines
  Coding regions on vcDNA: vcDNA=SeqID_61121; Strand=-; Position=1 -82,509-513
MKVKLISGNKARWCSWLSRESHTLEVAA

SEQ ID NO: 134699 - protein, 120 aa, Heterodera glycines
  Coding regions on vcDNA: vcDNA=SeqID_61122; Strand=+; Position=1 -204,405-562
PIGPPIRSRPSEVIVHLRANSYNISAFVPNHPGGESVLRLVNGQDIEQYIEGRKCVLGICHRHRYAYQVLRQFEMPSDVIVGVKGKFYNISAFVPDHPGGSFVLRAINGQQNVEQYLEGR

SEQ ID NO: 134700 - protein, 68 aa, Heterodera glycines
  Coding regions on vcDNA: vcDNA=SeqID_61123; Strand=-; Position=1 -176,276-306
MPMANAQNALSSLNVLLNVLTIDQPKNGFSARVVWHKCADVVGIGTEMNDHFGGTASNRKFSEKTMKI

SEQ ID NO: 134701 - protein, 67 aa, Heterodera glycines
  Coding regions on vcDNA: vcDNA=SeqID_61124; Strand=+; Position=1-205
FFPVLPGPGPGFFSHLTWTWISWTKIQENPGPGKIQVVKKCLDLDPGKIQAWIQVQVELYKGAAESL

SEQ ID NO: 134702 - protein, 52 aa, Heterodera glycines
  Coding regions on vcDNA: vcDNA=SeqID_61125; Strand=-; Position=1-158
MRFASIRFALFLFLFLAHFGANETTENGEGQLESEEENRNELRKMPFEEQEK

SEQ ID NO: 134703 - protein, 69 aa, Heterodera glycines
  Coding regions on vcDNA: vcDNA=SeqID_61126; Strand=+; Position=1-293
LPFPRPNCAPPPIFQRFEAGARLESVKPRPTHRAAVRPLQAQMELEQFGLGVRRTMGMKEQRNGRREKQ

SEQ ID NO: 134704 - protein, 77 aa, Heterodera glycines
  Coding regions on vcDNA: vcDNA=SeqID_61127; Strand=-; Position=1 -104,395-524
MNLRYNFALFLLFILAFAAFSDGLSVDEGIDEEGLDLKPAPASKVLSRAQRIARRCVRCKRKWSWSSSDWGYGGPWG

SEQ ID NO: 134705 - protein, 152 aa, Heterodera glycines
  Coding regions on vcDNA: vcDNA=SeqID_61128; Strand=-; Position=1 -190,465-638,840-934
MYLPFPLICPFLIGLIVSLVMCAASEVTQQEAAFVSFYSTLILNCVSPAVYCVLAICLYVRRPKNNNTQSLSLSQLSLFRSIFVLMLLQLLGWTSNSLSLFFFQNLFAIASLSDLTKWAINFLNTKKPFKSNSVHFVEVLATPKEAKTRGWW

SEQ ID NO: 134706 - protein, 98 aa, Heterodera glycines
  Coding regions on vcDNA: vcDNA=SeqID_61129; Strand=+; Position=1 -158,274-412
MTNLSRSNPMATIKAEETFLEKTGRSIGQKHWSKRIRFWPVKTMKNIGKKPNCKDTDRFEIVTKTKSKFNTMPTEAIKVRTVIRMTSKGTKPEEERNE

SEQ ID NO: 134707 - protein, 174 aa, Heterodera glycines
  Coding regions on vcDNA: vcDNA=SeqID_61130; Strand=-; Position=1 -73,128-172,372-508,582-685,743-829
  Homolog annotation: Hit_ID=NP_998791.1; Match level="QueryCoverage =97%, HitCoverage=7%, E-value=5e-38, Identity=50%"; Hit description =kinesin 13B [Rattus norvegicus] emb|CAE53838.1| kinesin 13B [Rattus norvegicus]
SVGAEVVDNAFLGLNSCVFAYGQTGSGKSYTMMGTSEEPSGKSYTMMGTSEEPGIVPRLCTELFERLARETSEEKKFKLEVSFFEVYNERIRDLLGSPKRIPKRIPSLKVREHSLLGPMVEGLSVYKVTNYDQIERLINAGNGARTLINAGNGARTTAETLMNERSSRSHRWGQ

SEQ ID NO: 134708 - protein, 16 aa, Heterodera glycines
  Coding regions on vcDNA: vcDNA=SeqID_61131; Strand=-; Position=1-49
EAIPEGFGLPINLGAS

SEQ ID NO: 134709 - protein, 48 aa, Heterodera glycines
  Coding regions on vcDNA: vcDNA=SeqID_61132; Strand=-; Position=1-284
LLFCPFIPIAYCFKVLSLTLLFCPFIPIDHVNSFSIHLVSYFMKLYII

SEQ ID NO: 134710 - protein, 93 aa, Heterodera glycines
  Coding regions on vcDNA: vcDNA=SeqID_61133; Strand=-; Position=1 -114,173-340
  Homolog annotation: Hit_ID=CAE67355.1; Match level="QueryCoverage =67%, HitCoverage=18%, E-value=1e-12, Identity=50%"; Hit description =Hypothetical protein CBG12818 [Caenorhabditis briggsae]
MYLFYQNLFFVFSRIDVLNSLTTEDRKLLVRLHSLEILGVSKVFDGIKTAYLALKHRKNRNHRQRIVVFVGSPLDPLLAEKEMVNTYWALYEK

SEQ ID NO: 134711 - protein, 153 aa, Heterodera glycines
  Coding regions on vcDNA: vcDNA=SeqID_61134; Strand=+; Position=1 -114,548-745,1506-1652
MCRLRMALPPSPAPPVEAAHSYARQPQIIWPISTTFSASTAAQLLLSSAALDDAFATSRSVGDVQHQPLPTTTATSASNAVPAQPLHQLVRSRWAGMRATLANMLADKYLCIRLLDHLLQSGKASRFITGHTLRLFLPLVLSVPTVGDGGGLS

SEQ ID NO: 134712 - protein, 142 aa, Heterodera glycines
  Coding regions on vcDNA: vcDNA=SeqID_61135; Strand=-; Position=1 -204,468-692
MCRSSSTGRHCPGRISADRNWHRLSMPRLPSSQRSNGQRKVNHRLRVNGQRKNRTLDSTKNCPSLGTASLKSGCSQNFKSVLQKTQNEIIVKAKLNFPTMEMDVHGKSQNQRIGTLTCIFWTKIQDKQTLLFIPWLILTICS

SEQ ID NO: 134713 - protein, 87 aa, Heterodera glycines
  Coding regions on vcDNA: vcDNA=SeqID_61136; Strand=-; Position=1 -37,119-345
MVKLGLGGGGGGDVHSKEQKMSKMIDYYKLKKANPSFCDKEIAGFLKISSATLKRWNKLMLRYNDDLFCALSISCFSKNLSAKNVIK

SEQ ID NO: 134714 - protein, 199 aa, Heterodera glycines
  Coding regions on vcDNA: vcDNA=SeqID_61137; Strand=-; Position=1 -147,194-217,324-373,471-701,1006-1154
  Homolog annotation: Hit_ID=AAH77639.1; Match level="QueryCoverage =100%, HitCoverage=45%, E-value=1e-49, Identity=46%"; Hit description= Acy1-prov protein [Xenopus laevis]
EEIGSHDGMEKFIHTDKFRSLNIGFALDEGLASETDTHSVFYGERCAWWLQITCPGAPGHGSRFVENTAGPKLTSILANFNAFRERQRHLLLADPNLRLGDVTSVNLTKIEGGVQTNVIPAQFVACTFFRTNSSICMITDRVDLVYEIHEQMEAMIANWCKEAGPDVTFEFVQKGMCKSLTPTDASSPWWHAFSSALSE

SEQ ID NO: 134715 - protein, 133 aa, Heterodera glycines
  Coding regions on vcDNA: vcDNA=SeqID_61138; Strand=+; Position=1 -289,889-1001
MEKEGNGKRGEWKKRGMEKEGNGKRGEWKKRGMEKEGNGKRGEWKKRGMEKEGNGKRGEWKKRGMEKEGNGKRGEWKKIFQFFGVYFQKFFCSFLRATVYSVYGINLQKHEKQCLLQIDVLHWHIGHGHLLTE

SEQ ID NO: 134716 - protein, 146 aa, Heterodera glycines
  Coding regions on vcDNA: vcDNA=SeqID_61139; Strand=-; Position=1-439
NGISNNRNYAQKASQTILALPIPSTIAFIHPIMSAKIIRVPKIACDLSLEKNGLSKNRNYAQKASQTILALPIPSTIAFIHPIMSAKIIRVPKIACDLSLEKNGLSKNRNYAQKASQTILALPIPSTIAFIHPIMSAKIIRVPKIA

SEQ ID NO: 134717 - protein, 111 aa, Heterodera glycines
  Coding regions on vcDNA: vcDNA=SeqID_61140; Strand=-; Position=1 -72,116-379
  Homolog annotation: Hit_ID=NP_741734.1; Match level="QueryCoverage =74%, HitCoverage=4%, E-value=3e-21, Identity=60%"; Hit description =UNCoordinated locomotion UNC-2, voltage-gated Calcium Channel Alpha subunit (unc-2) [Caenorhabditis elegan
IFYWSVITLVFLNTVCVASEHHGQPEWFTEFLSNFLFVIYLNFITNPKLFVEYAEFTFLAIFISEMLIKIFAMGYRTYFTSKYCIDTFKFIDFFFILFVCILSDLIVLIAL

SEQ ID NO: 134718 - protein, 130 aa, Heterodera glycines
  Coding regions on vcDNA: vcDNA=SeqID_61141; Strand=+; Position=1-390
FFLIFLTQNWYQQLPSLVWPYQTILRYLKRKQKKFLTKKWLSLFSHFFTANLVPTVAFSCLALSNNLTIFETQTKKILDQKWLSLFSHFFTAKLVPTVAFSCLALSNNLTIFETQTKKILDQKMAISFFS

SEQ ID NO: 134719 - protein, 30 aa, Heterodera glycines
  Coding regions on vcDNA: vcDNA=SeqID_61142; Strand=+; Position=1-90
MSSLSLSLSLSLSLSLSLCSLVCLLLSLFS

SEQ ID NO: 134720 - protein, 30 aa, Heterodera glycines
  Coding regions on vcDNA: vcDNA=SeqID_61143; Strand=+; Position=1 -53,339-378
MGSEEFVKGTPRVREEAEKGYETHQILFTC

SEQ ID NO: 134721 - protein, 94 aa, Heterodera glycines
  Coding regions on vcDNA: vcDNA=SeqID_61144; Strand=-; Position=1-769
LFEYPKRTLEKIDFFVFGAVPPNRCAQIYGETESFGNSFPIACTLILRWIFAPHNCLSTPNGHLKKSIFLFHKYFFPENALKRTKFYLQLNLAL

SEQ ID NO: 134722 - protein, 361 aa, Heterodera glycines
  Coding regions on vcDNA: vcDNA=SeqID_61145; Strand=+; Position=1-1105
  Homolog annotation: Hit_ID=AAF76983.1; Match level="QueryCoverage =98%, HitCoverage=97%, E-value=3e-66, Identity=43%"; Hit description =fibroin heavy chain Fib-H [Bombyx mori] sp|P05790|FBOH_BOMMO Fibroin heavy chain precursor (Fib-H) (H-fibr
ARVLKWYGSGKGAERGGLAADGDGSYGAGKGADSGSGKGAERGGLAAPGAGKGAERGGLAAAGAGKGAERGGLAAAGAGKGAERGGLAAAGEGSDGSLGLSAGSGGSGKGAERGGLAAAGAGKGAERGGLTAAGAGKGAERGGLAAAREGSDGSLVLSAGSGAGKGAGAAAGEGKGAERGGLAAAGAGNGAERGGLAAAGEGSDGSLGLSAGSGGSGKGAERGGLAADGDGSIGAGKGADSGGSGKGAERGGLAAAGAGKGAERGGLAAAGAGKGAERGGLAAAGAGKGAERGGLAAAGEGSDGSLGLSAGSGGSGKGAERGGLAAAGAGKGAERGGLAAAGEGSDGSLVLSAGSGAGKGA

SEQ ID NO: 134723 - protein, 60 aa, Heterodera glycines
  Coding regions on vcDNA: vcDNA=SeqID_61146; Strand=-; Position=1 -71,482-593
MRRNSVQQLQQNEQKSPLHSPMANKSVPFYECLPPQREKVLREKQQIALINYAAFDRAVF

SEQ ID NO: 134724 - protein, 55 aa, Heterodera glycines
  Coding regions on vcDNA: vcDNA=SeqID_61147; Strand=+; Position=1-394
QLINERGRGQTARIWLGKPRESGQIEYGRRRGGRRPLPLGRAKRIRRRPDQKQHN

SEQ ID NO: 134725 - protein, 203 aa, Heterodera glycines
  Coding regions on vcDNA: vcDNA=SeqID_61148; Strand=+; Position=1 -121,550-1040
  Homolog annotation: Hit_ID=NP_500013.1; Match level="QueryCoverage =66%, HitCoverage=9%, E-value=4e-11, Identity=30%"; Hit description =predicted CDS, polyprotein family member (4B673) [Caenorhabditis elegans] gb|AAC02594.1| Hypothetical prot
MKLPKVNTLFAKVGLDLAGPIPNHEEGRPARFFVLFAGSQVSDLSEFKQKLVNSLRTAWEAAAGESKQAQQRAKAQYDKLIRCLEIKVGDRVLLRNYAGKVGTSKKFHLPWKGVFRVIKIEEVMVTIVSCNAPQANPKVVHINQLKKCVEILGPACTAPNVSDEEKLSLEKADAVEVFDMPGFNHLNSDNPNKSETDPNTEST

SEQ ID NO: 134726 - protein, 91 aa, Heterodera glycines
  Coding regions on vcDNA: vcDNA=SeqID_61149; Strand=-; Position=1 -222,1030-1083
MSEKSDVWSLGVILYQMVYGHSPYSALLHQFDAVEDETERMERADAALRPAILHGTEPIHFGQYEDEAMLNILKLFNKINLFFALFSFAFS

SEQ ID NO: 134727 - protein, 89 aa, Heterodera glycines
  Coding regions on vcDNA: vcDNA=SeqID_61150; Strand=-; Position=1 -177,316-407
MFNCLINLLSNLIATHLSPNGAYGLVFGINSFVALLLQSVVTLLIVDVNGAFALSLEAQIIKNAFLYHSLNVHFNLICFFSSSPIAYAC

SEQ ID NO: 134728 - protein, 41 aa, Heterodera glycines
  Coding regions on vcDNA: vcDNA=SeqID_61151; Strand=-; Position=1-125
ASCRALRAPFFNFFGGYSAASRPQDGRFAPVFKLCREIRTL

SEQ ID NO: 134729 - protein, 49 aa, Heterodera glycines; identical to SEQ ID NO: 130195
  Coding regions on vcDNA: vcDNA=SeqID_61152; Strand=+; Position=1 -110,200-239

SEQ ID NO: 134730 - protein, 93 aa, Heterodera glycines
  Coding regions on vcDNA: vcDNA=SeqID_61153; Strand=+; Position=1 -21,174-434
MADSEMELDDQEGFIGKGIDLVPANDHVIAAYHAAAQQHNHERLQNAGGADNPRQTDEEENAENVLQAWNVAEQQGGQYLDYPPQRIPPNEFG

SEQ ID NO: 134731 - protein, 74 aa, Heterodera glycines
  Coding regions on vcDNA: vcDNA=SeqID_61154; Strand=-; Position=1 -138,355-437
  Homolog annotation: Hit_ID=CAE61609.1; Match level="QueryCoverage =100%, HitCoverage=7%, E-value=2e-25, Identity=72%"; Hit description =Hypothetical protein CBG05529 [Caenorhabditis briggsae]
LSSLLFSYIPCLQNIFGVLFFIRLPWIVGTAGILEAFMVVLLCCSVTFLTSISLSAIATNGVVSGGGPYYMVGR

SEQ ID NO: 134732 - protein, 147 aa, Heterodera glycines
  Coding regions on vcDNA: vcDNA=SeqID_61155; Strand=-; Position=1 -222,589-810
MTSPARRRVPTTKCAYNNKHKNNSSNHRHQHNGSSAKTPTAPPPTATRLATETTEKEPLCAKQQQQQHNMALYEDDCSKGGQNIGQMLRSLSLYNAILPTAVDEEDKESTAKGATNGGVKNGEKERNGGTKGAPKRQTAKLGTIMGV

SEQ ID NO: 134733 - protein, 18 aa, Heterodera glycines
  Coding regions on vcDNA: vcDNA=SeqID_61156; Strand=+; Position=1-56
PYRDRDLRFSKPGTGNRD

SEQ ID NO: 134734 - protein, 503 aa, Heterodera glycines
  Coding regions on vcDNA: vcDNA=SeqID_61157; Strand=-; Position=1 -272,516-1065,1284-1722,1989-2239
  Homolog annotation: Hit_ID=AAO85457.1; Match level="QueryCoverage =43%, HitCoverage=98%, E-value=5e-13, Identity=28%"; Hit description =putative gland protein G19B10 [Heterodera glycines]
MDNQKLLLFIVFLVNYHFCFALSAEPQNKRNNHHQIANEFVALKQISEALSQQSNGENRKLIIKYPLIKYHFIYHTNTEELTNGEKIDNANKSLELVLELLKTECQLAKIASKNSSSSYPTNGYLAKFCDKKTGQNLDTIEKLTEHLTDFIEKDLPKIVEAMKKTETTEIISTGRVYGTMAEILPRAKQYPNDASLLLYAQAMKALSRISQEIEPGTTIDALTKTLKKHTVASDDGDTVTLMPSELTQIIMELWTNTILKGIANAGQEKYNYLQPQLNGTGADRSQDRRHRRAPPVFHIHSNIIMMILLIVQMSLIAVVGIDASRSDANWVTVFTAFFTMFFIWRVQIPGQPPPPSIHFSLNFNLILPVVQTRIGAGMPFGGAAQRPTAAGDDDRAQHLHAMLRMFNAMNGRANTAAPSAGSNRDRSQNITTTTTPAPPTGDNGNDDRKQVEHYDPVSDTFVGAEETFVTTTTESPINWEGEGTEDSNGDTDDSLAREYGRPN

SEQ ID NO: 134735 - protein, 70 aa, Heterodera glycines
  Coding regions on vcDNA: vcDNA=SeqID_61158; Strand=+; Position=1-213
MITDLSLFSHGWPTNGTNTWISDEALLAKNGLGLNFCQRRAAVLRLANFSTVLALHQLPKLASTGLRPPE

SEQ ID NO: 134736 - protein, 43 aa, Heterodera glycines
  Coding regions on vcDNA: vcDNA=SeqID_61159; Strand=+; Position=1 -67,389-453
MALEAMGLDSSTDGNDSEPSLAARLFKGVDTKATQQVPATTIV

SEQ ID NO: 134737 - protein, 44 aa, Heterodera glycines
  Coding regions on vcDNA: vcDNA=SeqID_61160; Strand=+; Position=1 -52,171-253
MEKNLQQMKKGQKKIIGSFAVQIEDLQNGQKALVEKPPPEVETE

SEQ ID NO: 134738 - protein, 92 aa, Heterodera glycines; identical to SEQ ID NO: 127421
  Coding regions on vcDNA: vcDNA=SeqID_61161; Strand=+; Position=1-304

SEQ ID NO: 134739 - protein, 149 aa, Heterodera glycines
  Coding regions on vcDNA: vcDNA=SeqID_61162; Strand=+; Position=1 -98,199-291,347-463,819-914
  Homolog annotation: Hit_ID=CAE67205.1; Match level="QueryCoverage =85%, HitCoverage=21%, E-value=7e-38, Identity=59%"; Hit description =Hypothetical protein CBG12641 [Caenorhabditis briggsae]
HYLTLLCFFRMVQMESQQNAKFDLLICCGDFRSLSLRNHGDLHHFHAPFHHRKLGTFYKYYSGEKVAPLLTLFVGGNHVAPLLTLFVGGNHESSGFMAELPNGGWVAPNIFYMGYASVVRFAGLRIGGLSGIFKPGDFNRGKQFTMLVG

SEQ ID NO: 134740 - protein, 124 aa, Heterodera glycines
  misc_feature (8)..(8): Xaa can be any naturally occurring amino acid
  Coding regions on vcDNA: vcDNA=SeqID_61163; Strand=-; Position=1 -24,1266-1525,1576-1640
  Homolog annotation: Hit_ID=NP_498468.2; Match level="QueryCoverage =98%, HitCoverage=11%, E-value=5e-31, Identity=54%"; Hit description =yeast Imitation SWI homolog (116.7 kD) (isw-1) [Caenorhabditis elegans] gb|AAA50636.2| Yeast isw (imitati
DESLTFGXAAPTAKREGALVKSAALGDHRHRMTEKEEDEQLLQQSVRSDDSLIFENSPPFIKNGEMRDYQVRGLNWLIQLEHNRINGILADEMGLGKTLQTIALGKTLQTIAVLGFLKFYRDSR

SEQ ID NO: 134741 - protein, 142 aa, Heterodera glycines
  Coding regions on vcDNA: vcDNA=SeqID_61164; Strand=+; Position=1-429
MCKICAKPRNMCDMFLWVGGVWAPVFGPPRLGPRFWAPGSFGPQAPPLDSSTQRFGKPTIRQLDDSSTQPKCDDSSTQPNVNDSSTQRFVNSTIRQPSQNVTIRQLSQMSTIRQLNDSSTQPKCDDSSTHPKIVLKSSFKSF

SEQ ID NO: 134742 - protein, 359 aa, Heterodera glycines
  Coding regions on vcDNA: vcDNA=SeqID_61165; Strand=-; Position=1 -238,280-433,634-745,843-919,1160-1395,1470-1732
MKSIRKQIEQQHRRKTPKRFGEPSADYDDSNIFPTQREDAEQIEQAEYTASDEDDEENRPLIEFQQGKTERGSLCIWHQGFRFTRIRGRWYRCSNRDCEATAALSKEGGTNGVLGRKSTTICRTQRASTRRQKRKIYGNMDRVNPLNVVLPDALLMKDGESTLLYDSRLLDVLKRARKISVDGTFKVAPVLRSYKFGPYLWKQFHPIRRPFTCSINANNPVVNNSFRRAALGAANCASTTVPRALLECPRPCEVSSGEDEQCYGGVTPPIFGNFLAAILDSVDKQMDIARSARVFPHKRRIKYILKEQLIGDALDEAEYNTDEDVLNILSLLSLQMQGYVGGLRARGAQEHEDYAEAED

SEQ ID NO: 134743 - protein, 24 aa, Heterodera glycines
  Coding regions on vcDNA: vcDNA=SeqID_61166; Strand=-; Position=1 -52,295-317
MEKACKIWRDYIDFSALELLELAS

SEQ ID NO: 134744 - protein, 35 aa, Heterodera glycines
  misc_feature (7)..(7): Xaa can be any naturally occurring amino acid
  Coding regions on vcDNA: vcDNA=SeqID_61167; Strand=-; Position=1-107
CFSIKGXMNKYFKILNSFLNRPKSLGLYFKKFHRT

SEQ ID NO: 134745 - protein, 31 aa, Heterodera glycines
  misc_feature (19)..(19): Xaa can be any naturally occurring amino acid
  Coding regions on vcDNA: vcDNA=SeqID_61168; Strand=-; Position=1-129
FISIFSESALKHTKLYLQXSLGTLMLFLSKR

SEQ ID NO: 134746 - protein, 41 aa, Heterodera glycines
  Coding regions on vcDNA: vcDNA=SeqID_61169; Strand=-; Position=1-182
FFIDFLKCWIFLAYQNFIEPWFFYFSFKSPQIFFYSLTSPY

SEQ ID NO: 134747 - protein, 38 aa, Heterodera glycines; identical to SEQ ID NO: 130624
  Coding regions on vcDNA: vcDNA=SeqID_61170; Strand=-; Position=1-438

SEQ ID NO: 134748 - protein, 42 aa, Heterodera glycines
  Coding regions on vcDNA: vcDNA=SeqID_61171; Strand=+; Position=1 -22,270-376
MTKQIEQEFFSKNGFGMVENERKLKIDLAIERIERVVKEWVN

SEQ ID NO: 134749 - protein, 42 aa, Heterodera glycines
  Coding regions on vcDNA: vcDNA=SeqID_61172; Strand=-; Position=1-129
VQAWIQFEGPGFFLDLGFPGFRPGNPGPTWSLGLGFFQNVEL

SEQ ID NO: 134750 - protein, 29 aa, Heterodera glycines
  Coding regions on vcDNA: vcDNA=SeqID_61173; Strand=+; Position=1-93
NTVYALIIAQSLLIPQSPIIPQSTRCFER

SEQ ID NO: 134751 - protein, 290 aa, Heterodera glycines
  Coding regions on vcDNA: vcDNA=SeqID_61174; Strand=+; Position=1 -30,80-141,333-375,421-454,661-857,944-1076,1152-1235,1286-1311,1363 -1478
  Homolog annotation: Hit_ID=NP_492427.2; Match level="QueryCoverage =98%, HitCoverage=29%, E-value=3e-95, Identity=63%"; Hit description =abnormal ThermoTaXis TAX-2, cyclic nucleotide-gated channel (92.4 kD) (tax-2) [Caenorhabditis elegans] gb
YVLSAWQAFGKFPYFYKGKWYLNKWVYNNEKFPYFYKGKWYLNKWVYNNEGNAYIRCFYFTAAVATSTGNNTSTGNNPMPTNVVEYLYMTFSWMMGVFVFALLLGQIRDIVSNANKNNEEFRTTMDKALSECKRLDLPEHLTARVRSWFLYTWERQRTLEEKKLVEKLPLKLQTDLALSVHYSTLGKVKLFQDADDADRAFLRDLVLRLRPAIFLPGDMICRKGDVGKEMYIGDVGKEMYIVNNGILEVVGGEVNNGILEVVGGEHNELVFATLAEGSVFGEIAIVGDDS

SEQ ID NO: 134752 - protein, 38 aa, Heterodera glycines
  Coding regions on vcDNA: vcDNA=SeqID_61175; Strand=-; Position=1 -32,162-246
MTHFVPWITQRFAHGVVEGEQKLCNNLIIAMLLTGFIL

SEQ ID NO: 134753 - protein, 77 aa, Heterodera glycines
  Coding regions on vcDNA: vcDNA=SeqID_61176; Strand=+; Position=1 -84,311-460
MPAPRRPLPTRLVRPIRPEHRCHPRPAKDEEEDEEEEEEDHEEGEEWADGGGEMEYLEREEEEECENNEQRKRVWIN

SEQ ID NO: 134754 - protein, 251 aa, Heterodera glycines
  Coding regions on vcDNA: vcDNA=SeqID_61177; Strand=+; Position=1 -47,114-392,445-871
  Homolog annotation: Hit_ID=AAL78214.1; Match level="QueryCoverage =59%, HitCoverage=77%, E-value=9e-13, Identity=33%"; Hit description =putative esophageal gland cell protein Hgg-20 [Heterodera glycines]
MSDNRKEAEEKMAKAIFISGDGWLCVFDLLSPRQLGLGIALISHRFDFYVDEHFKTRKRALAFIRIRRKNGVNGTKEMEIGKYYDWKPLPIPQIQLPRKVSGFGLISIAFIDQNVIAFLRRFRQLFAKCPINLSIRTNTSDYRILKSILNNIWPMLNKNIHGLRLSATFFHRLRQFVPSILNDCPSLRVFSIDYDNLFTEFPCDDSAMASDGQAVAKWLFTPRPDDVPKLFKCLLLCDRGHLASRIEAFKA

SEQ ID NO: 134755 - protein, 287 aa, Heterodera glycines
  Coding regions on vcDNA: vcDNA=SeqID_61178; Strand=+; Position=1 -197,539-1205
MKRRKRCGDEHFKTRKWTLDFVRIWRKFEADGTQEMKIVNCLWKSMQIPQNPLPKKVVGFEAITISFISADCWLCVFDLLEPSQLGHGIAMISHRFDFYVDEHFKTPKESRRIRSHHNKVKRMIFWCFLCVKRFLPLFYRYINDNVITFLHCFRPIFAAFPINFSIVDTFVIINSTLDSVLRNIWPMIATNICAIQLSAEVFRRLRLLVPSILDDCPSLRVFNAYNDGFFVEFPCDDSAAASDGQTVAKWLFTPRPDNVPKVFKCWLQWDDGHLASSIEDFKRVIIV

SEQ ID NO: 134756 - protein, 51 aa, Heterodera glycines
  Coding regions on vcDNA: vcDNA=SeqID_61179; Strand=-; Position=1 -109,162-208
MKANGQNGKRKRLDGKFMISGTKLAFKLIMRTKSEMGFLTQLPAQVIRRSE

SEQ ID NO: 134757 - protein, 40 aa, Heterodera glycines
  Coding regions on vcDNA: vcDNA=SeqID_61180; Strand=+; Position=1 -59,332-395
MFTQHFFSYFNSNIDINFYEFVSARRKTLSESLTKGDRFK

SEQ ID NO: 134758 - protein, 141 aa, Heterodera glycines
  Coding regions on vcDNA: vcDNA=SeqID_61181; Strand=-; Position=1 -93,641-924,979-1027
MDIVNCYGIPIPIPQIQMPLKGHRIRRDQHQAFTNASSPANFIAIISCPLPFADSVVPFALTNELTREQLALKVIDNSHRFLFVRCPISRDESKWTKWEKEAIGWRISYLWNRIDIEINKDDIGDGLLNATPGPSDQQQSE

SEQ ID NO: 134759 - protein, 28 aa, Heterodera glycines
  Coding regions on vcDNA: vcDNA=SeqID_61182; Strand=-; Position=1 -50,280-316
MKKLEKSYIYSLMGVINFYRNLHIYHWI

SEQ ID NO: 134760 - protein, 21 aa, Heterodera glycines
  Coding regions on vcDNA: vcDNA=SeqID_61183; Strand=+; Position=1-64
ITGVSIIAVLFLMFLMPSQNL

SEQ ID NO: 134761 - protein, 202 aa, Heterodera glycines
  Coding regions on vcDNA: vcDNA=SeqID_61184; Strand=+; Position=1-609
MEAKKKKLEQKTLEEIFGEKWEEKENEQKKREIVQKFNKIKEKIKQKERKYSTKEWHKIELKIAKKLGTNRTKIYQWIKELGIYKGHNKSKTDVQKIEIVQKFITMKNEYKQKGRKYSRKEWKRNYAVIGKKIGVCHDAIKKWKKQFGMNGRRITEKEKMEKMKMYWQMKGENPKMSDEKISKMLKFNRRTIFNWRKQFEKN

SEQ ID NO: 134762 - protein, 263 aa, Heterodera glycines
  misc_feature (157)..(157): Xaa can be any naturally occurring amino acid
  misc_feature (182)..(182): Xaa can be any naturally occurring amino acid
  misc_feature (198)..(198): Xaa can be any naturally occurring amino acid
  misc_feature (223)..(223): Xaa can be any naturally occurring amino acid
  misc_feature (227)..(227): Xaa can be any naturally occurring amino acid
  Coding regions on vcDNA: vcDNA=SeqID_61185; Strand=+; Position=1-815
  Homolog annotation: Hit_ID=T02995; Match level="QueryCoverage=100%, HitCoverage=49%, E-value=1e-56, Identity=53%"; Hit description =unspecific monooxygenase (EC 1.14.14.1) - common tobacco dbj|BAA10929.1| cytochrome P450 like_TBP [Nicotiana
CTRSQTRLTLSSVRVGVARLNTKMDTLAGALPFTLSKESMKVVVFHWRLAAPTYATPLMILHVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRRNSKQPRAKAACFTQQPGXPDLXSQFFSRSYESNLPTSLTYIILSTRGCSPWRPAADIG

SEQ ID NO: 134763 - protein, 21 aa, Heterodera glycines
  Coding regions on vcDNA: vcDNA=SeqID_61186; Strand=+; Position=1-64
ITGVSIIAVLFLVFLMPSINL

SEQ ID NO: 134764 - protein, 106 aa, Heterodera glycines
  Coding regions on vcDNA: vcDNA=SeqID_61187; Strand=+; Position=1 -94,185-241,595-651,1005-1117
MLAFCARAIYHRACQSKAKQQRCCFERIKGIESVHRLLEKYICNLSTILRKSVNRLLEKYICNLSTILRKSVYRLLEKFICNLSTILRSELEMINFTIQTSFRCSN

SEQ ID NO: 134765 - protein, 77 aa, Heterodera glycines
  Coding regions on vcDNA: vcDNA=SeqID_61188; Strand=-; Position=1 -64,404-573
MKLCALLRPFAEKFDRENWTETPMLPPLCAKIRHRRALARIFAVPSLPCRPPLSNGICALRMVDNLGPLKHLIIFVV

SEQ ID NO: 134766 - protein, 119 aa, Heterodera glycines
  Coding regions on vcDNA: vcDNA=SeqID_61189; Strand=-; Position=1 -50,97-291,344-457
  Homolog annotation: Hit_ID=BAB84191.1; Match level="QueryCoverage =96%, HitCoverage=17%, E-value=3e-43, Identity=68%"; Hit description =flavoprotein subunit of succinate dehydrogenase [Ascaris suum]
DNAKNAAVFRTGPLLQEGIEKVRSLFAQQKRLRVSDRGLIWNSDLIETLELQNLLINALQTIVAAENRRESRGAHAREDFPVRVDEFDYTKPTEGQSKKKLEEHWRKHSIIYQNVENGA

SEQ ID NO: 134767 - protein, 190 aa, Heterodera glycines
  Coding regions on vcDNA: vcDNA=SeqID_61190; Strand=-; Position=1 -174,222-387,563-795
MPISLALLFISGLELFIWPHVKTLKILMIQPSYAMIQSHFTFGLNLAKLLVKNHGHEIHLLVPIRDENDKLPDRNDEKLLNVRYFIEKNDYNKTTPIERSRKIGTPPNDTTYFAIANNSSLMDDLCAEQFDVGIAEAFMMTEYSMTIFHFLRIPVTIATSAMPISPHQFYLLGILSKMAAGNVPGMKTIH

SEQ ID NO: 134768 - protein, 64 aa, Heterodera glycines
  Coding regions on vcDNA: vcDNA=SeqID_61191; Strand=+; Position=1 -21,367-539
MNTWPNLIEDAIASAINGGGSAKVGEGGGHCAATQRATERRVVAAGANDDFVRRLVDVVRREPA

SEQ ID NO: 134769 - protein, 199 aa, Heterodera glycines
  Coding regions on vcDNA: vcDNA=SeqID_61192; Strand=-; Position=1 -345,486-610,664-793
  Homolog annotation: Hit_ID=CAE71172.1; Match level="QueryCoverage =98%, HitCoverage=8%, E-value=1e-32, Identity=38%"; Hit description =Hypothetical protein CBG18029 [Caenorhabditis briggsae]
MRLYDFLADDLFCVSPNNSLLSPASSIVRRTHTVLTLMHTLKQFYWVVRPTTAPNSAQMAMEPMDRLTVVHIRGCILQIVNRLMFNTVPADISEKEVSRDEEFQCMLNFVNTVQEVPAFDRKKALCVIFKMISSGNELIRIPTLKMLSYFLCRSTQKRKNEAINQKNLFHLLTENLLLNCRSLSLATYNALFEMLVEPI

SEQ ID NO: 134770 - protein, 331 aa, Heterodera glycines
  Coding regions on vcDNA: vcDNA=SeqID_61193; Strand=-; Position=1 -213,289-414,954-1043,1093-1314,1485-1828
  Homolog annotation: Hit_ID=CAE71172.1; Match level="QueryCoverage =80%, HitCoverage=33%, E-value=2e-32, Identity=41%"; Hit description =Hypothetical protein CBG18029 [Caenorhabditis briggsae]
MANSKAVAFYNCLNLIGFKFGHTDCGPSEQRGQPGVHRQHHPSAQPTRRQSDNGMRWTASTVGRRNGTECKSELEINDTTQQELDIEDAARFIATFAELSDVFVFASGVSLNECESSKPISDFDRLLQNVDLQRLKGVIYRDMEETKQAQFLALAVVYFLSVLMVSRYRDILEPPLPPPASQAISPPLVTALLYLGVSYQSQFKHEAESNLPDTYRKQLFDGRLHDSLVFAYCPKNCHDQLCLFQQQTPKGGQLHSSAASYFVQVPHAVMKNVECPTIGMPMTHQISFQGVKLVKTHSVHCSLHSIGGIQVLVPLFSQIDAKQHEPVDNDI

SEQ ID NO: 134771 - protein, 144 aa, Heterodera glycines
  Coding regions on vcDNA: vcDNA=SeqID_61194; Strand=-; Position=1 -189,299-544
MGDAAQKQKKQLDALVADMAPVIVDMVIAWASRTAWVHRALGAFVLCRFAKWLNYGHFEPILKAFVDKDAELLKEEGEEEEEDDENEEEDESEDDKEEEDEGVEEEETPDVDPKLVADVRRAMGKAATPKNATEVPSDEDNWVI

SEQ ID NO: 134772 - protein, 120 aa, Heterodera glycines
  Coding regions on vcDNA: vcDNA=SeqID_61195; Strand=-; Position=1 -68,113-238,287-353,415-474,524-563
SKASSSFTIFLLMADENLSAIDEGCLRIDTNSPNGEVPAPPLPTMMARCLPGANAEDTFVVDVENISHSINLVNYSDTSSNETTFTCTTDRPKRKAAEKAMMLLIKPKRQRKNTSAEEKE

SEQ ID NO: 134773 - protein, 59 aa, Heterodera glycines
  Coding regions on vcDNA: vcDNA=SeqID_61196; Strand=+; Position=1-181
EPNEVDELWDYDMRLVYFVAKKRVLKDQIEQAKKGGHGTVDLETDLINIEASRGTENAR

SEQ ID NO: 134774 - protein, 25 aa, Heterodera glycines
  Coding regions on vcDNA: vcDNA=SeqID_61197; Strand=+; Position=1-78
LPIPSTIAFIHPIMSAKIIRVPKIA

SEQ ID NO: 134775 - protein, 169 aa, Heterodera glycines
  Coding regions on vcDNA: vcDNA=SeqID_61198; Strand=+; Position=1 -269,332-572
SLCACSPAFSARVQLLLRRALPRKWRRRPLRLRCRSQFAFAHRVPTKKYIRPLYHCFSSTGPVLFSAAPANGAAAPSASDVSTNLHLHTAAAGPVLCRDGPSAAPSAANGAARPSPSGADVLHSDVLLAPVLPSSAPNGTAAPFGPSADGNPSQSVVMGTNSRVELNEC

SEQ ID NO: 134776 - protein, 116 aa, Heterodera glycines
  Coding regions on vcDNA: vcDNA=SeqID_61199; Strand=-; Position=1 -185,261-423
MFDEPRGAKVEMARRGGKGEQKQRNTERTIPSPLIYQIEAGSIVYECRGAKMVPIGCLDEFGQQIRLNETTVAKGLLMRCSLSRWATDLQLKIIGCVPKGKANETILVGEKWTEKE

SEQ ID NO: 134777 - protein, 547 aa, Heterodera glycines
  Coding regions on vcDNA: vcDNA=SeqID_61200; Strand=+; Position=1 -364,405-774,820-1024,1069-1770
  Homolog annotation: Hit_ID=AAO51424.1; Match level="QueryCoverage =10%, HitCoverage=4%, E-value=4e-11, Identity=50%"; Hit description =similar to Plasmodium falciparum. Hypothetical protein [Dictyostelium discoideum]
MRNTLRNTRGEVCEIRFLPLEDNERPDLVMEILIQHLLDRVLDGHPSPILVGLQLQPPGFDRPYVIRLRPPEQNNAAALAAAIERLNEQSAAGIDLLSGTTVTKVLAVWPLESVRVDAQRGGACDLDNEHHLSHNVQSIVRVVNPNDRYCLARAVLLGLCDRETQMPNGGGRGAFNTYASRQYQHGTQAVHLLTRAGVSVDKHMYTLEDVAQLQQYINNENGVGQIRLVIFEKEQEYRIVFKGEGTAAQFNLCILLERGHFNYIGRIAQLFKVPGYCIDCERRADARYHAIGCKAACRLCFRFGGGYPCQRERLSDGQISSRKCTECGFIFPNDNCYEYHLANDAPAPIDGRGHRQRRSLCQWRRFCPTCGRVAYFGIHQCPSIRRAIGPVDCFRCKGPHMLDEPCYIQPIGVAPPLPMLGPVHNNDDDNNNNNNNNNNNEDENDIDFIINNLGGEGDEDEDDVENGDDINDDDDDERDELLPLRLCFFDAETSQERPLQLNNQVAHKHVPLLIVAEFICEPCIRAGININDGQGQRAPGCVCLCGR

SEQ ID NO: 134778 - protein, 559 aa, Heterodera glycines
  misc_feature (8)..(8): Xaa can be any naturally occurring amino acid
  misc_feature (472)..(473): Xaa can be any naturally occurring amino acid
  Coding regions on vcDNA: vcDNA=SeqID_61201; Strand=+; Position=1 -268,310-357,397-651,691-920,966-1249,1292-1523,1620-1815
  Homolog annotation: Hit_ID=NP_001004509.1; Match level="QueryCoverage= 99%, HitCoverage=35%, E-value=9e-59, Identity=28%"; Hit description =si:busm1-180o5.3 [Danio rerio] emb|CAD60788.1| novel protein similar to DNA polymerases [Danio rerio]
KDDAATLXTRHYWMELHVVWGCEWKERLRRGAQAAFRTVFVPCPLDPRNALRGGRTEPFKLHHVCSDDEEILCIDIVSLYPYVMKVNPFPVGNPRVLTREKVNPFPVGNPRVLTRECSSNNMFRGCSSNNMFRGLLLVRVLAPRLIRVPLLGYRTNGRFTFPLCAWCADRRQQRPCQHGDEKRSWVCAYTHMELNKALQLGYIVVDLFEVWNYDEWDDDVWNYDEWDDDLFSKYVNTFVGLKVQATGWPEGCETDEQRKEFVDNFMRTEGIQLDSTKMTPNPGLRLIAKTLANSLWGKMAQRVGFTQIKYTRTPGKMAQRVGFTQIKYTRTPAEFHQLLDDPTLDKLDFVHVSEHMDRVVVRKRPEFAKAPLTNCLPVAIYVTSYARLHLYSYMEKVIALEGAELLYCDTDSIYYVNKTDSIYYVNKMGGRCVPEGEALGQMKREHVDRRIVEFVAGGPKNYGIRHSTRRNXXRANLKIRSFRLSYATQQLLNFDDVIDNDDLYVYGGGGAHRCIRVTFPQIDRNVRSDVYTCEAHKDYRPFYAKGRVRPGMQTRPFGY

SEQ ID NO: 134779 - protein, 193 aa, Heterodera glycines
  Coding regions on vcDNA: vcDNA=SeqID_61202; Strand=-; Position=1 -178,218-492,536-664
MDLILATDWMNNAYPEMEQDKANMSPKEDPSWISLIDEEEKREPIAIVQIDEEEEKQRKNPPGNCDCREKRRCFIPLVDHLCKKFECSAHELHVLFKDLGKRRAIVEHLRSSQLCTSHLRPSIRNFPVRCNDLSILDAHSVPAYRGYLGITVRMHYYIKHGIRLRHSNLPCVVEFGGGDHKTFFPLEALNIVI

SEQ ID NO: 134780 - protein, 399 aa, Heterodera glycines
  Coding regions on vcDNA: vcDNA=SeqID_61203; Strand=+; Position=1-1200
MPSNSFYIVLPSNTNVEGNKTNSFRVRLPRKLQFNSEWEVGLAVIVYPHTWPSIGTVEQQFVEVEWQTGNTVRIEVPPSNVTNPIDLGKTLYRLLGEGSEPLAKKVRTAQNSFSHATNSARRGAREEYIKRKTREKRSIRDEEKLLEALLTDIETMVDLFGVTQGLLAREKRAETSKIPLRMSADDNESYQHKLDEYFSNLSGPDLDILEEMIRAKLNEEIKNMVEEDRTILDATKEMGMEAWVQAYRKVRLVCRFIFDINKNRFELIFDQRYVRRVKISSQLAYILGFDSTDFTTSENEAKFMPDMNGGVSSFQVYTPDLIEPMMIGDVTAPVLRIVTIRGKPDEIVEEQFLAIQYHKILIKEISELLIEIRTNSGSLMPFQYGICTLTLHFRKLSYF

SEQ ID NO: 134781 - protein, 89 aa, Heterodera glycines
  Coding regions on vcDNA: vcDNA=SeqID_61204; Strand=+; Position=1 -82,258-445
MKTPNFLAISIFISIGFGIATPSNEDESAMMTISSRSNIVCPTLSRTPKFCMSNAWMPKSGPCPTDWSNLFNKKCEGFQKKTKKVAKMH

SEQ ID NO: 134782 - protein, 33 aa, Heterodera glycines
  Coding regions on vcDNA: vcDNA=SeqID_61205; Strand=+; Position=1 -37,123-187
MLFKQTEIFIFKGIICFLNRQKFLFLRVFLRNY

SEQ ID NO: 134783 - protein, 38 aa, Heterodera glycines
  Coding regions on vcDNA: vcDNA=SeqID_61206; Strand=-; Position=1 -105,360-371
MPMKVLVPPATKALPITVPLATKKVVCLAVLVVKMFAQ

SEQ ID NO: 134784 - protein, 189 aa, Heterodera glycines
  Coding regions on vcDNA: vcDNA=SeqID_61207; Strand=+; Position=1 -21,1146-1196,1294-1398,1629-1738,1783-2056,2344-2352
MIPGQQNLAPALRANNNQMITHAMPTNWSNHLPGTQQNVGPHLSNNFQSQQQQNCQNLQQSRQLSEQMVVPGLSENGTTSFDFMVKSVSNFNQILPPIQLFVSSLDFREAQLTPNGPMRVCNAILINGEGKTVEVSAWRLQADVLASAMRGYLYIFVNCRAKPPRERTNCWFRLNIDAMSSYMVQVQTI

SEQ ID NO: 134785 - protein, 140 aa, Heterodera glycines
  Coding regions on vcDNA: vcDNA=SeqID_61208; Strand=+; Position=1-423
MARQNLNECFVLERTTPMRNVMRNTRGEICELRFMPLEEAHRPDLVLEALIQHLLDRVLAGHPRPLMVGLQLHPPGFDRPYVIRLRPPEQNNAAALAAAIERLNEQSAAGIDLLSGTTITKVLAVWPLDPIRGDPQRGGF

SEQ ID NO: 134786 - protein, 1224 aa, Heterodera glycines
  Coding regions on vcDNA: vcDNA=SeqID_61209; Strand=+; Position=1 -239,320-464,531-2112,2156-2490,2538-2803,2965-3156,3202-3485,3529 -3811,3857-4205
  Homolog annotation: Hit_ID=NP_507780.1; Match level="QueryCoverage =84%, HitCoverage=65%, E-value=9e-79, Identity=25%"; Hit description =predicted CDS, DNA polymerase type B, organellar and viral family member (5T899) [Caenorhabditis elegans]
MPNGGGRDALRAYVRHQNQHGPEAVALLRRSGIPHHKDMYTLQDVGQLQRWLNNAYGIGQIRLVVFEKEHEYRIVFKGEGEATSIILAVLSKFLTCQTTALIVSAELTRVIIRQGAKLCAVFVCDLDLLPNGVTSARQCAECLFIFPNDDCFNYHLVNRGPDQIDGRGNQQRMPICQWREVCRLCGRVSYIGKHRCPQVQLGDVCRHCRGQHNADLPCFIQPLMDRPQPINIIDDQEAHDNDLVIDDDENDDELPLRLCFFDAETSQERPLQLNNQVAQKHVPLLIVAEVICDPCIKAGISVNDGFERRAPGCVCLCGRVRGQQMRQWSSPPFANAHGDNTPTPDGAPTFNQRRFYFHSFDNGEAEDPVEQFLVFLMNHGSRKAHTVCIAHNGGKYDFHLVLEALHRRSYPPKRLCTTGLKIYSMKLCGRNQRRITFKDSINYFFCELDGLVKSFDLPAHLATTKPFFPYLYIQRQNLVNRLQGLPGIEFYSPNTMKEEKRQKFLRWHADNNEGAQFQLREQLIMYCVNDVAILRESVLRFRQLIGEHTQGLDPFLVSTTAAGLALATLRRCFLPPNRLVHSPEGGYLRGRRASAESRRYIRFFEMEHPGAQVQCADWSVGEAHVDDSGYRLDGLWRRDPPLRPLAIEWMGCYYHGCPKCFPNRWQKLAAGRTAEDLFERTTRRLWELEHQHGFELHVVWGCAWKEQLRHDPALKQRFEQVFVPYPLDPRSDGLRGGRTEPFKLHHVCADDEEIICIDIVSLYPYVMKVNPFPVGNPQVITREVLLQPPTVPLPWNCAENNTFRGLLLIRVLPPRHIRVPLLGYRTKDGRFTFPLCAWCADRRQQRPCQHGDDKRSSYMNTFVGLKVQASGWPEGCETDEQRRAFVDDFMHTEGIAIDPTKMAFNPGLRLIAKTLANSLWGKMAQRVGYTEIKYTRTPAEFHKLLEDPTYDKMDFVHVSDNMDRVVVRKRPEFGKAPATNCLPVAIYVTSYARLHLYNYMEQVLALGNAELLYCDTDSIYYVNKIGAPFVQEGEALGQMKRELVDRRIVEFIAGGPKNYGIRHTARDGTDERANIKIRSFRLSYATQQLLNFAAVKELTLATYNIDGPIDDVLDNEDLYVYGGAEHRAIPISFPQIGRNVYADLYTHEARKDYRPYYAKGRVRPGMQTRPFGYVEEEARLIRQTQMVHQQLPPASSPPQPRPERRKRRLIEPDPTQAGHSGWFS

SEQ ID NO: 134787 - protein, 324 aa, Heterodera glycines
  Coding regions on vcDNA: vcDNA=SeqID_61210; Strand=-; Position=1 -157,200-474,645-1187
  Homolog annotation: Hit_ID=EAK91511.1; Match level="QueryCoverage =48%, HitCoverage=65%, E-value=2e-18, Identity=40%"; Hit description =hypothetical protein CaO19.9395 [Candida albicans SC5314] gb|EAK91473.1| hypothetical protein CaO19.1837 [
MDLILATDWLNNAYPEMEQDKEPPKEDPSWISLIDEEEKREPLGAIGEEPITNTPKKCSCNEHRQRPIPLVDHLCKKFECSANELHVLFKDLTKRRKIVEHLRSAQLRTSHLRPTIRNFPVRCNDLSILDAHSAPAYRGYLGITMISISNCTAVFKINVRPFTPEQFLTIAQRGINTEYNPRRFHAIIMRVRTSAKTVAALIFQSARVVLTGVSHPDRANYFARKILRRIQHTQNNTLKIHQLRVVNIVGVKTFAQRIRVERLLTTLGGIYDPSIFPALRCKMENGTTCLIYISGKVIVTGAKNIEELSDAFKFLSNIIPNYFR

SEQ ID NO: 134788 - protein, 237 aa, Heterodera glycines
  Coding regions on vcDNA: vcDNA=SeqID_61211; Strand=-; Position=1 -206,256-328,382-580,822-1058
  Homolog annotation: Hit_ID=AAG23825.1; Match level="QueryCoverage =88%, HitCoverage=20%, E-value=9e-68, Identity=53%"; Hit description =guanylyl cyclase [Heterodera glycines]
QIADRLKIGQTVEPEQFDTVTVFFSDIVQFAALSNQMRPLQVVNLMNELYTTLDAIIGEHDVYKVESIGDGYLCVSGLPKRNGNLHAKECADMSLDFLKAFHTFRIPDLPNERVRLRIGLHSGPCVAGVVGIFYENGIKTADDLIKGLAMPRYCLFGDTGKGVMETFWLLGHAESGTLPAHNSHEGQSMAQRNAEEDEREMYRTYRKTMTGQDKDGEQKNGDEQQKKQQQNGGGVIY

SEQ ID NO: 134789 - protein, 214 aa, Heterodera glycines
  Coding regions on vcDNA: vcDNA=SeqID_61212; Strand=-; Position=1 -93,246-390,436-840
  Homolog annotation: Hit_ID=AAG45917.1; Match level="QueryCoverage =87%, HitCoverage=18%, E-value=8e-51, Identity=59%"; Hit description =guanylyl cyclase [Heterodera glycines]
MRGSIRDVILSENAMVKDVMFIQSAVKELCEGLQFLHNSPLQFHGRLKSSACLINERWQVKISYFGLRWLKSPQKMQAKDLLWLSPEQLRKATDGAEINVAVGSKQSDIYTMALIFTEVHKMDINSLSKFAHLFAISDGEHGPVLGGGPRLGGGLRRGARLGRDGAEQKHRDAAHRRRNARTQRGRNCLFGEAGRIGAIETDDTARVGQFAPGI

SEQ ID NO: 134790 - protein, 368 aa, Heterodera glycines
  Coding regions on vcDNA: vcDNA=SeqID_61213; Strand=-; Position=1 -11,73-808,905-1191,1252-1324
MNRRWICADVWMDILPSFDHAQLGLKMALLSYRFDVLVDTHFDGKSELTIWRTIRIVKDEGPNANDNGPKPKVSVRIDGSFVDFPLSDRQLPNKICFKNLHIQSVLTFVYAKALFSCFSYIDHSVIKFFRSKKRFFDKSGTKLEVFVHSIDTDVQPIWDVFTREIWPIFAKSIRHFGFHDGDDLDNLRSRISPTLLTDLDQLISIDSGYLCPDGIADDGPNGNAGQALTKWLHTPTKNGQPKQLRFRAYTFRRATTSVSYQIQLYFRVETMPIAPFELMNEVTKEKLTLKQEIDEFDLNVYNWLLQRCPIGETATAPVKWENRENPSANLNNVRFDLWSFDKSIGPLSPPAEEKEGEEEADQSNKNVV

SEQ ID NO: 134791 - protein, 371 aa, Heterodera glycines
  Coding regions on vcDNA: vcDNA=SeqID_61214; Strand=-; Position=1 -11,59-361,437-866,923-1233,1413-1473
  Homolog annotation: Hit_ID=AAL78214.1; Match level="QueryCoverage =43%, HitCoverage=78%, E-value=2e-10, Identity=28%"; Hit description =putative esophageal gland cell protein Hgg-20 [Heterodera glycines]
MNRRWICADVWMDILPSFDRPQLGLKMALISDRFDILVDKHFDGKGELTIWNDITIRKGMEDEEKIGAKAKLFMQIKDNKDKFVEFPMQDHPLPNKIRFMDLMIMYIDHSVLAFIRVNKQIWDRMGTNLELEVYSYETDQIWDVFVREIWPIFATNIRHLAFHGADALDNLRRRISPTLLTDLDQLYSITSYGLCPDGISDDGPNATAGQALSKWLHTPSKNGKAKRLRCNVFSNSECVIRSINNFRETFLRATASVGYKIRIVIRSVSYHIQLFIHVETTPIEPFELVNERTNEKLTLTKDENGTGEFNWLLERCPIIGETAAVQKQQQKKDENSDANLNKVFFRLYDDIGPLSPPAEEEEEEADQSNGD

SEQ ID NO: 134792 - protein, 158 aa, Heterodera glycines
  Coding regions on vcDNA: vcDNA=SeqID_61215; Strand=+; Position=1 -14,717-1179
MFLACYIDHSVIKFLRANKQIWDSKGTKLELVVYVDEFENDEQPVWHCFSYEIWPIFATNIRHLSIYNADALDNLRRRISLTILTDLDQLDSINSGDLFPDAIADDGPNANSSGQALHKWLHTPRKDGQPKRLSSWSCSCFSLTRINTWFYNHKQVDD

SEQ ID NO: 134793 - protein, 68 aa, Heterodera glycines
  Coding regions on vcDNA: vcDNA=SeqID_61216; Strand=+; Position=1 -203,831-834
MLTTQVEPFELVNEWTNEKLTLMKKGPYHSLLKRCPIIGETAAVKWEDDENSDHLNAFFIRLGENCIG

SEQ ID NO: 134794 - protein, 95 aa, Heterodera glycines
  Coding regions on vcDNA: vcDNA=SeqID_61217; Strand=-; Position=1 -11,75-351
MNRRWICADVWMDILPSFDHAQLGLKMALLSDRFDVLVDKHFDGKSEFTIWRTIRIEKGEGPKAKLSVLIDDKCVAFPLPDHPLPNKIRFKDLQI

SEQ ID NO: 134795 - protein, 19 aa, Heterodera glycines
  Coding regions on vcDNA: vcDNA=SeqID_61218; Strand=-; Position=1-59
AWPAVAFGPSSEIPSGHSP

SEQ ID NO: 134796 - protein, 249 aa, Heterodera glycines
  Coding regions on vcDNA: vcDNA=SeqID_61219; Strand=-; Position=1 -11,72-347,398-860
  Homolog annotation: Hit_ID=AAL78214.1; Match level="QueryCoverage =73%, HitCoverage=94%, E-value=4e-11, Identity=25%"; Hit description =putative esophageal gland cell protein Hgg-20 [Heterodera glycines]
MNRRWICGDVWMDILPSFDHAQLGLKMALLSDRFDVLVDKHFDAKSELTIWRRIAIRKDKGPKAKLSVLIDDKCVAFPLPDHPLPNKIRFKDLQIYYVDHSVLAFLRSNKQIWDRSGTILDLNVYAFDTDVQPIWDVFTREILPIFATNVRHLCFPNANHFYNLRRHTSPTLLTDLDQLNFINSGGLLPDGISDDGPKATAGQALSKWLHTPSKNGKANELYCCAYFCEITWINTFKEVIELLNCSLND

SEQ ID NO: 134797 - protein, 289 aa, Heterodera glycines
  Coding regions on vcDNA: vcDNA=SeqID_61220; Strand=+; Position=1 -578,812-909,1696-1889
MEYFSSFVDSSAMEMQILSKQRENYEDFFYFLAKVLSKFGGKLTKNENREQIEIGIDGANKILESLKNYAEKMLIKKAREWHPYYECQAKKKLEQQNLQMAAVEIMCPNFVDSAEIFEILNGQNELFKSVPKSEGNDEKVDPKLVNNSQLFNLLYSFVTRIEAIIYGKNADGTIIREEKAAKKREKNGSRKTCTFDSSIEMHQINSKKLVVAIKKEQKDVNNINQNLYERADDLLKLLSEININENDDEKNADGTTIIFGTVKQINSFGQRKWPNAKGKKKRIGQIAGR

SEQ ID NO: 134798 - protein, 220 aa, Heterodera glycines
  Coding regions on vcDNA: vcDNA=SeqID_61221; Strand=+; Position=1 -26,67-344,674-1032
  Homolog annotation: Hit_ID=CAE66170.1; Match level="QueryCoverage =95%, HitCoverage=44%, E-value=3e-44, Identity=43%"; Hit description =Hypothetical protein CBG11408 [Caenorhabditis briggsae]
MRNSYDRYGGGNRSGGGFGGGGGAYGRGASGGGYGARGGSGGYGGGGGAPRGGYGAGGGGFGPPPSGYGAPEPYYGGYGAPPPFGSGGGGYGGGGRGGGGPDPIVHLLSVHYHIPTTIQSISWPVALSGRDLISIAKTGSGKTLGFILPAIVHTMAQPPRRPNDGPGVLVLLPTRELAVQVEQVAREYCKLMKLDVTCCYGGAPKAGQANDLRRGFPKKP

SEQ ID NO: 134799 - protein, 215 aa, Heterodera glycines
  Coding regions on vcDNA: vcDNA=SeqID_61222; Strand=+; Position=1 -194,413-470,547-903,1003-1041
  Homolog annotation: Hit_ID=NP_872170.1; Match level="QueryCoverage =49%, HitCoverage=10%, E-value=2e-16, Identity=41%"; Hit description =ankyrin and patatin family member (5V188) [Caenorhabditis elegans] emb|CAD54162.1| Hypothetical protein W
MVMCLLSYGAGLDEQADSGKMTALHFAVSKRNLQITRLLLCLGADPNVANAHGDTPRHLAAKLNEVDLLKSLIICDARRCPLTKVGCVSGCVNEKQLNKLKRPSTSSMPSSATGNTTSTSTSASSTASLSSSSSSTTLAASAAAAAATAPPTQPANSSQPTAGASTTAPKPASYTSVMVEDFENRAFDKEQFRFNKLLDIQHNEIFKKLIVRKFL

SEQ ID NO: 134800 - protein, 105 aa, Heterodera glycines
  Coding regions on vcDNA: vcDNA=SeqID_61223; Strand=+; Position=1 -79,131-369
  Homolog annotation: Hit_ID=CAA88558.1; Match level="QueryCoverage =94%, HitCoverage=74%, E-value=2e-24, Identity=56%"; Hit description =glycine rich protein, RNA binding protein [Hordeum vulgare subsp. vulgare] pir||S53050 RNA binding protein
MSYQQREQGGYDRRRGGGGGDYGNRRDDRNGGGSYGRNSGGYGRDGGGGQGRDGGGGYGREGGGGYGRDGGGGYGRGGGGGYGRDGGGGGGGYGRDRGGGGGGGF

SEQ ID NO: 134801 - protein, 180 aa, Heterodera glycines
  misc_feature (30)..(30): Xaa can be any naturally occurring amino acid
  misc_feature (38)..(38): Xaa can be any naturally occurring amino acid
  misc_feature (77)..(77): Xaa can be any naturally occurring amino acid
  misc_feature (157)..(157): Xaa can be any naturally occurring amino acid
  Coding regions on vcDNA: vcDNA=SeqID_61224; Strand=-; Position=1 -250,1296-1536,1979-2017
  Homolog annotation: Hit_ID=CAD22154.1; Match level="QueryCoverage =96%, HitCoverage=52%, E-value=2e-46, Identity=53%"; Hit description =pherophorin-dz1 protein [Volvox carteri f. nagariensis]
PPPPPQKPPPPPPPLSRPYPPPPPPPSRPXPPPPPRPXPPPPSRPYPPPPSRPYPPPPSLPCPPPPSRPYPPEFRPXLPPPLPPPPPPPPPKKVSGRGPKKKPGKRPPKGPPPPKSPGKGPKNKFPFKGPLQGGPPHPKPPAGGPKAKVPEKVPQIXIYTQIFIILYLIPKAFDKNFPVD

SEQ ID NO: 134802 - protein, 57 aa, Heterodera glycines
  Coding regions on vcDNA: vcDNA=SeqID_61225; Strand=-; Position=1-175
ASSRVNFIIVIFRLSDSVVPFDLVNELTGEQLTLKSANNDGAFLLIRCPISRDEKNG

SEQ ID NO: 134803 - protein, 141 aa, Heterodera glycines
  Coding regions on vcDNA: vcDNA=SeqID_61226; Strand=+; Position=1 -213,293-504
MPHVHICLILDWEAMRVGGKTRTPEDYIDEYICAEIPPKPDESSRDEHQQRNLYTTVTTKNIHTCAQNRCLKPYEYDNVYSENAYPRYRRRPPPPSAEEAQQNPEQFGRVFEYKDRYGKLIKKDNAHVVAFNPFLSAKYKS

SEQ ID NO: 134804 - protein, 118 aa, Heterodera glycines
  Coding regions on vcDNA: vcDNA=SeqID_61227; Strand=-; Position=1 -61,600-895
MKNDLFFFLLTIPVLTWSCYAGLNGLSAIFWACASMDMKESKEKWFEDYYEKNLSVPNVHCHAEFGEKDKDFGNTHFKRPRVPDGLLCFAGEEFIKLDFCEDDDHFCYLAKCTKGWCY

SEQ ID NO: 134805 - protein, 38 aa, Heterodera glycines
  Coding regions on vcDNA: vcDNA=SeqID_61228; Strand=+; Position=1 -65,125-176
MPSFEPCTTVETHKELFGIVLITAPFRDDFRLMAILID

SEQ ID NO: 134806 - protein, 84 aa, Heterodera glycines
  Coding regions on vcDNA: vcDNA=SeqID_61229; Strand=-; Position=1 -34,227-447
MKINEIIMSKIAANKSFDLEFGLLTKWGCTDKQSNESPLTDPKELIDQNDTIKIMDHFCAHNYSEADVSMSNAAMAVPIPGKLI

SEQ ID NO: 134807 - protein, 28 aa, Heterodera glycines
  Coding regions on vcDNA: vcDNA=SeqID_61230; Strand=+; Position=1 -25,163-224
MATFAPMGGGLEGRAFEPIVPFFKIIIK

SEQ ID NO: 134808 - protein, 132 aa, Heterodera glycines
  Coding regions on vcDNA: vcDNA=SeqID_61231; Strand=-; Position=1 -35,113-218,1131-1388
MVHGSRHFAPEGNCHPGKIICVLLEEEGDDECCSPNYETICYQNYNFKYELYKNSEKMVPHVEGAFKIVDEQSKNREVKEGCNPERDCKQCGGLYSCIPIPEVWMTYSGCCGPGYEMKCCVTVRFISCNTVV

SEQ ID NO: 134809 - protein, 96 aa, Heterodera glycines
  Coding regions on vcDNA: vcDNA=SeqID_61232; Strand=-; Position=1-290
MLVKCKPFIFGILFACLIPSIIKTESEYVKAAFKFKNDDDGKLFEGAELGASIGGAIGSLAGPVGTFFGVVIGIAAGAVDAAVQSDKRYESCLAKL

SEQ ID NO: 134810 - protein, 217 aa, Heterodera glycines
  Coding regions on vcDNA: vcDNA=SeqID_61233; Strand=-; Position=1 -222,463-756,844-981
  Homolog annotation: Hit_ID=NP_491486.1; Match level="QueryCoverage =100%, HitCoverage=19%, E-value=4e-39, Identity=37%"; Hit description= SMC protein, N-terminal and structural maintenance of chromosome protein SMC, C-terminal (1F522) [Caenor
MISIVCDNAETGRECIAYLREQHYPPETFLPLSELRMEQIKEHLRDIRDPPGVKLVFDVINVLGNAQHVRKALQPNGVISGGGADLKAKAKKWDENAIRKLKDRRTALQEELQKLHRTGKRELDVEMKREQITSLEARLRFTQQELKKSENETLRRLEQDAEVESAEPETIETRIESRRIEIEERKIEIERLEQNKNAIADEIFTEFCAKIGIKHIR

SEQ ID NO: 134811 - protein, 76 aa, Heterodera glycines
  Coding regions on vcDNA: vcDNA=SeqID_61234; Strand=-; Position=1 -87,693-836
MDDDIEYGTEQKILRPNPHKERVNKNIYIIMQKLFFPLVNLYKDNCIKLMHEKLKNQQLDTWEQLQNAILKEKEAR

SEQ ID NO: 134812 - protein, 87 aa, Heterodera glycines
  Coding regions on vcDNA: vcDNA=SeqID_61235; Strand=+; Position=1 -94,185-241,595-707
MHTFCARAIYHRACQSKAKQKRCCFERIKGIESVNRLLEKYICNLSTILRKSVNRLLEKYICNLSTILRSELEMINFTIQTNFWCSN

SEQ ID NO: 134813 - protein, 25 aa, Heterodera glycines
  Coding regions on vcDNA: vcDNA=SeqID_61236; Strand=-; Position=1 -54,446-469
MRTRPIWQVKQRLLTSQKGYSPVKD

SEQ ID NO: 134814 - protein, 1164 aa, Heterodera glycines
  Coding regions on vcDNA: vcDNA=SeqID_61237; Strand=+; Position=1-3494
  Homolog annotation: Hit_ID=DAA04499.1; Match level="QueryCoverage =11%, HitCoverage=9%, E-value=8e-23, Identity=43%"; Hit description =TPA: pol polyprotein [Schistosoma mansoni]
MENQSNASVHSRSEREENGADAERNAENGGNGGLDGGNEHAPILGQNLNRGADPRHPQPGRHRYNLRPRQNNLFYGLNPNESADSFQPHGENRQPNRRQQAPIQNPGFFENVEMGNPLFAQNQIVEQVVENSHSGIRNEIQHPIGLEIERYGRPIANSSPITRMGSSHNEPHNSFENVEFEEIRQFRARQLYENPRGFREQNFVGEQRERMNEFEQNHAPVPNFERRNVFVGDPHGNQLIFGNFGRNMERNFGHFENFPGLARGGNQNLNVGGPRMEQIRDPHRERNQYEERQFMPIPEPNMRQIDGQNQNLAFRQVQSQNFQENMARVMPYTEGIPDIILELHKVTLSNQYANVLREIPTLFGTEGRDKINDFFTTLELCTGDWRPEKKLEILRAKLKGKASKALNLSLRKFGHQVPFEVIKREIKTILRETDYKEASAFTELTQFGKQKVGEDIVKFGERIQQLVSCAYYGIEEEQLDEISKKFFISNVSDPNMSRFLECQTKQSQTFDELLMVANRLSLIESKRNVNQSLNQNYRENNSQFSHPRNQFNQNRFFQNQSFEPRPQNNQVRFFADRNFTRQNFTDRQQPNTNENRNSGWNRGGYQNSNFQNRQNFPNTDNRTQNVPNPQQIQSSSGTRTNTNTITVTEKNQNEQNELVFCNNISQKEVQDFEIFFNCLTTKAYDFPSKNPAQPKTYECLKLVMKVEGQNAKTLGDSGAETNIVNPEFLYNLAKKLKLDLINWGFNPNKGLTRIPFDVASFSGSRISIIGVINIPIETSGFKTNVPCLISKERFNFDLVLGTGAMETLGFYLANSFTNEITYFTSKEQQEMSIPLINSVKVASFTVIPPMSSCFVDSRIENHSNLPKNSHFLIENSEKSILLKMQSDEDLMDYDETDKVEMERLRKLDKVAEQKELEKLGIIVPETNIGQKWNGKRGHSEPPIHCTDAKIPVHELPIIEMALATSEPGSFKILVHNKNLTPIFLKSGIEIAKAEIVEEIYDPHIELLPERFWKSQRFIRNFGVQKNGERISQLLSVIKPNFGPLNNEEKSLLEEILVEFSDVLALEESELTQTNLTEHKIDTGNTQAIKIPPRPMPFGVRAKVNEMLDDYLNRGIIRPSNSPWASPIVLAVKKDKSIRLCIDYRKLNSVTKRDSYPLPNIDGIL

SEQ ID NO: 134815 - protein, 39 aa, Heterodera glycines
  Coding regions on vcDNA: vcDNA=SeqID_61238; Strand=+; Position=1-118
MLFILVLLLIEKLLLANGAPLSTKNDGIEAKQNKFKEMT

SEQ ID NO: 134816 - protein, 153 aa, Heterodera glycines
  Coding regions on vcDNA: vcDNA=SeqID_61239; Strand=+; Position=1 -171,1031-1179,1409-1550
  Homolog annotation: Hit_ID=XP_394369.1; Match level="QueryCoverage =95%, HitCoverage=35%, E-value=3e-25, Identity=38%"; Hit description =similar to ENSANGP00000019163 [Apis mellifera]
MSLLSSTTKYKVSIGEIQRRINPPECLNASLIGGILRKSVILGVTNFVNIIPPSKFSANDFNAVLQHDFPAKDIGFFLNAQFLRYVGQSPMDSELVARRRTILNCSRIFIKEITSLLAADRSPICDRRPELMLDPSIQKQLTHFSMAIFMGFL

SEQ ID NO: 134817 - protein, 127 aa, Heterodera glycines
  Coding regions on vcDNA: vcDNA=SeqID_61240; Strand=+; Position=1 -176,348-555
VGISTNGWTLVLSVSHFSYYLSLPTQFGKLLINSWLMVQFFLVFGLCVQFIYRFLVLNRGLKITMKKYVAMLSFAFSIAILTWTYDFIVSNDHINLSLLKAEEIFQIEQLLGGNLNDFVTYCQRNVS

SEQ ID NO: 134818 - protein, 91 aa, Heterodera glycines
  Coding regions on vcDNA: vcDNA=SeqID_61241; Strand=+; Position=1 -173,1019-1121
MAVLRPVDAVVALFRLHIVRRSTPSFGRQQNATATIGGGNCATNPWKTGPGAVVETETQYADQICKNVRPFYEGGGFFCLAFAQMVGGTNW

SEQ ID NO: 134819 - protein, 98 aa, Heterodera glycines
  Coding regions on vcDNA: vcDNA=SeqID_61242; Strand=+; Position=1-297
MEPVTVSKSNAEPVTVSKSKAEPVTVSKSKAEPVTVSKSKAEQERYRNPKLNLLRYRNPKLNLLRYRNPKLSKKLYRNPKRNDSGGGRTIESTFSNEK

SEQ ID NO: 134820 - protein, 62 aa, Heterodera glycines
  Coding regions on vcDNA: vcDNA=SeqID_61243; Strand=+; Position=1-186
MGTDKQNEKKAIDVQNDKASTDKQIHKVGTDRQNDKISDGKDAKVDTDTQSAKSGINGLNAK

SEQ ID NO: 134821 - protein, 64 aa, Heterodera glycines
  Coding regions on vcDNA: vcDNA=SeqID_61244; Strand=-; Position=1 -10,144-328
MRDHIASYFRLDNSFGLTEVQFRGELTPEIFEIQFDAIFATIDRNNLQDISWAQQCKKMPINER

SEQ ID NO: 134822 - protein, 204 aa, Heterodera glycines
  Coding regions on vcDNA: vcDNA=SeqID_61245; Strand=+; Position=1 -150,215-364,941-1159,1202-1294
IFLIFPNYRRNVCFRILFTNGVTDCLQLAPLLIFAVLNLITDQIPIWFQMFGSSIVLNAWNLLVMQHFLLAINRLIVILRARYLGSKFIPDEDTEAMCFNIAHVFCWTVYFVIVGLHQTNLMGGLFHSGTSQFVFDIGKPWTQTMREVFKYLTIAMPIICLVIYIVIIAFAKLSRAGTRRGDDFTKAKTTAPLLNDYEQRLLIQ

SEQ ID NO: 134823 - protein, 29 aa, Heterodera glycines
  Coding regions on vcDNA: vcDNA=SeqID_61246; Strand=+; Position=1-90
LFSILNSNYNITKCIWPILLIKIFIMSLN

SEQ ID NO: 134824 - protein, 278 aa, Heterodera glycines
  Coding regions on vcDNA: vcDNA=SeqID_61247; Strand=-; Position=1 -197,626-756,810-963,1013-1050,1098-1331
  Homolog annotation: Hit_ID=NP_498086.1; Match level="QueryCoverage =67%, HitCoverage=54%, E-value=4e-42, Identity=41%"; Hit description =collagen alpha precursor, DumPY : shorter than wild-type DPY-17 (34.5 kD) (dpy-17) [Caenorhabditis elegan
INLHMTYKGCQTEIIPFIPSFERAVNSLELVGIQNSSFTVSFALSRHANPENAQIHPVLCFVPPPWTDRSATQQSPMAKCNCAERKCPAGPKGPRGAPGEKGEAGAAGQDGVAGVSDGVAGVSAEDVLAQVQQLEKCFHCPMGPPGPLGLPGRPGPRGMRGGKGQPGVPGRDGQPGFPGGPGRDGQPGFPGGLGPQGKAGSIGLGPQGKAGSIGTVGEQGIPGEDAKLVHGRPGLKGPPGAVGDQGDAGPQGPQGGVGAPAESEAWINIHFKGPEGEK

SEQ ID NO: 134825 - protein, 107 aa, Heterodera glycines
  Coding regions on vcDNA: vcDNA=SeqID_61248; Strand=-; Position=1-324
MDLQIDKNEYSGIISLKYDNYWVFYLVSRHLRTDICGPTFADRLLRTDICGPTFADRHLRTDICGPTFADRHLRTDFCGPTFADRHLRTDFCGPTFADHYFSIELSK

SEQ ID NO: 134826 - protein, 26 aa, Heterodera glycines
  Coding regions on vcDNA: vcDNA=SeqID_61249; Strand=+; Position=1-78
MNDWLLSSAALHENVVQNGDTAENGT

SEQ ID NO: 134827 - protein, 79 aa, Heterodera glycines
  Coding regions on vcDNA: vcDNA=SeqID_61250; Strand=-; Position=1-240
MATETMSAQIRTQNAESAAMLDTGLRFVRQSRAQLAKKQGKPVNQVNAESQKAYDIGTLVKSEEIKYISVPPAMITKNA

SEQ ID NO: 134828 - protein, 38 aa, Heterodera glycines
  Coding regions on vcDNA: vcDNA=SeqID_61251; Strand=+; Position=1 -54,294-356
MWPTDGQCVCCLVMMVVRVYQALTLVFKVLLEWGLCLS

SEQ ID NO: 134829 - protein, 34 aa, Heterodera glycines
  Coding regions on vcDNA: vcDNA=SeqID_61252; Strand=+; Position=1 -76,1273-1301
MVALCITPQIIAVVFMVLFLSGFFNESDREQKTT

SEQ ID NO: 134830 - protein, 99 aa, Heterodera glycines
  Coding regions on vcDNA: vcDNA=SeqID_61253; Strand=+; Position=1 -160,460-599
MARTTYAKTAKAAHCCNKVFTSPYVQCQIPGWRAKGYKGNVPVIIGVPKKRDVGCSNSNPCAGNGYKCVAYKKGDDKLLLEGPYRFGADVLAPARVFGL

SEQ ID NO: 134831 - protein, 91 aa, Heterodera glycines
  Coding regions on vcDNA: vcDNA=SeqID_61254; Strand=-; Position=1 -192,276-359
MPFAPCFSLLYLLSSKEHCPRYIKWLDEEKRSSVSLGTGPDEKWQKNIFSPKISGIFKLIDSKIEKFEKTAFIIRFRKTLVWTTGKKIAFE

SEQ ID NO: 134832 - protein, 262 aa, Heterodera glycines
  Coding regions on vcDNA: vcDNA=SeqID_61255; Strand=-; Position=1 -178,488-710,910-1297
MANTILQTLAIEHQKHLQLQQQQQMQQEDDGEFGAQQRKRKTSCRASIALNMEQKMRLIGIQIQEEWGKLRYCFTRIMKKLLEEGGGRTVDEGQLNTISWPYWKRMEFLLPGVRAQLAHQPTSTESECGNQEQGVQTNGPTTATRAKTPPQPFTTQDFLMANFAALKTSQNLLGQFQQQQQMLNNCHASTAIQRQRSIDYDTEREKNSEMGPMTGGVGTAMSTADLVTALGTIKAQNNSSNIGTDKCEDNEKTRRNLRNFVK

SEQ ID NO: 134833 - protein, 143 aa, Heterodera glycines
  Coding regions on vcDNA: vcDNA=SeqID_61256; Strand=-; Position=1-432
MVKQLQNLTFTAGAFEGNSANKWLQKSAIEFLCNTKIEKNLQKLESDNKTYGKFVVKMENFKAIFCHQLENGKSFEEISQNLVQPIIKELQNLNIFDPNLIGSLRRIADFQAFNDENREQMAKLMDHFMAGLRSLWHIIKSRE

SEQ ID NO: 134834 - protein, 72 aa, Heterodera glycines
  Coding regions on vcDNA: vcDNA=SeqID_61257; Strand=-; Position=1-220
IKKEDGEKIFPYILVISFCFWWGAWNSGIMRTRPIWQVKQRLLTSQKVRCRDETNQHCLPRGTRHGPPKEWI

SEQ ID NO: 134835 - protein, 255 aa, Heterodera glycines
  Coding regions on vcDNA: vcDNA=SeqID_61258; Strand=-; Position=1-767
  Homolog annotation: Hit_ID=NP_001004509.1; Match level="QueryCoverage= 93%, HitCoverage=14%, E-value=4e-29, Identity=33%"; Hit description =si:busm1-180o5.3 [Danio rerio] emb|CAD60788.1| novel protein similar to DNA polymerases [Danio rerio]
MKYRAFPVGLPRVLSAEQLDRDAGVRLPWTSAEQNPFRGFLHCRVLPPLPAELGDRHALLPYRTRTGRLTFPLCAACAEWANADKKVQRHHRTVPRCRHRAAQRAWTHAYTDVELNAALQLGYRVLALYEVWHYDRWASLEAGKSLFAGYVDTMLRLKVEASGWPADCQTVEQRARYVARYADREGIRLEAGRVQPNPGLRAVAKALLNSLWGKLAQRAERDDVCYTGSAREFHELLGDPRQDVVDFVHLNEQLD

SEQ ID NO: 134836 - protein, 89 aa, Heterodera glycines
  Coding regions on vcDNA: vcDNA=SeqID_61259; Strand=+; Position=1 -212,1200-1257
MLESDTLAQNQSASVSPGWNDPPPLANPATTTAAAHAGLTNGVANGAGRLHLQRQRRPVDPSVQVFGDQFCCLVFNSRSALVFLQGKIP

SEQ ID NO: 134837 - protein, 21 aa, Heterodera glycines
  Coding regions on vcDNA: vcDNA=SeqID_61260; Strand=-; Position=1-65
MKLVGLDSHCLFRKTSKESLK

SEQ ID NO: 134838 - protein, 82 aa, Heterodera glycines
  Coding regions on vcDNA: vcDNA=SeqID_61261; Strand=+; Position=1 -26,349-571
MESPIGLDQEPSLQCTHQGWAKLKNKKRNAKSEICETEKCEMKKKAKCEKPKYAKMRKAKCEKRNFFYKFLIVKIIKQKSFF

SEQ ID NO: 134839 - protein, 42 aa, Heterodera glycines
  Coding regions on vcDNA: vcDNA=SeqID_61262; Strand=-; Position=1 -36,343-435
MCFSSSWTSMTTYLVPLTAVVAQQLEYLAREQTVAEQRAAQA

SEQ ID NO: 134840 - protein, 76 aa, Heterodera glycines
  Coding regions on vcDNA: vcDNA=SeqID_61263; Strand=+; Position=1 -53,222-399
MLLLLLLLLLLLFVLLLENGRDISISMFIRPPADRMGGEYGHNSAVFPGSTLLSAFPSKEFSILCFYIIISEIEIH

SEQ ID NO: 134841 - protein, 226 aa, Heterodera glycines
  Coding regions on vcDNA: vcDNA=SeqID_61264; Strand=-; Position=1 -370,430-740
  Homolog annotation: Hit_ID=XP_318550.1; Match level="QueryCoverage =99%, HitCoverage=25%, E-value=1e-15, Identity=26%"; Hit description =ENSANGP00000020240 [Anopheles gambiae]
MIKLQLSKKATDFELDCGADVTLITKNDWMSIGRPKLGQTSGLMAYGKKPIKVLGSFKTDVVYNGKEVNAEIYVVDGEGKNLCGRDLIGELQIDLNKAFGIRSINEVKCKAVDRELEAVLLKYAGSAIEEVQTASRAFCIETRSGESHRQVGQRWSVGAGDNFRLGNIVVIIPKAGNKIRLCCDYKVTVNQWLDIHQYPLPRPEELFSVLNGGEKFSKLDLKEAYL

SEQ ID NO: 134842 - protein, 211 aa, Heterodera glycines
  Coding regions on vcDNA: vcDNA=SeqID_61265; Strand=-; Position=1 -226,326-401,565-693,825-1030
  Homolog annotation: Hit_ID=AAR97529.1; Match level="QueryCoverage =98%, HitCoverage=45%, E-value=2e-44, Identity=42%"; Hit description =Rhesus protein 1 [Caenorhabditis briggsae] emb|CAE75309.1| Hypothetical protein CBG23279 [Caenorhabditis b
LPDFLQAACTTLFLLSSLADHLGRSNMAHIQSSSLAGGIAIGAVANVILYPHHAIIVGAAAALTSVLGHVYVTVRLEKRLSINDTCGAHSLHGLPSLLAGFLSALFVLLYEPEEYGENFVEQYSAIYPKWQGCQCIEANISQSFFQLAGLALTFLMAVMGGLFSGWVMNWSMLNQVQPRPSYEDTNYYLHAEMNLFAKASHCQMNKMNEEK

SEQ ID NO: 134843 - protein, 77 aa, Heterodera glycines
  Coding regions on vcDNA: vcDNA=SeqID_61266; Strand=+; Position=1-291
ATKHFDLCRFASVQKFGRRERFAHSNGTHPIHSFAGFNLQGLNGHQTIRRDWEFPPKHIFNKLDELFNRFFNRYYLL

SEQ ID NO: 134844 - protein, 84 aa, Heterodera glycines
  Coding regions on vcDNA: vcDNA=SeqID_61267; Strand=+; Position=1 -66,329-517
MTRNKKISKMLKFCAKEIAKRRSAESATSYSMIEDIGIATVTLGPWDKDILEMFLQEHFFNKLIFDTQKGKFHCCRMDYLFLLI

SEQ ID NO: 134845 - protein, 54 aa, Heterodera glycines
  Coding regions on vcDNA: vcDNA=SeqID_61268; Strand=+; Position=1 -67,302-399
MRLSQTNKESFLSPKDVIERTARAVHGNMDINREIWKNMENMDIETHPRSFKPS

SEQ ID NO: 134846 - protein, 290 aa, Heterodera glycines
  Coding regions on vcDNA: vcDNA=SeqID_61269; Strand=+; Position=1 -231,277-526,859-1250
MSINETILQLAIDTANEYPKKETLDGIIRHKFEKKLKDLFKKAEEKAKKDNPRRANEINDDINKILLGSKFNDSYTWLSDALLSVFVKGNVTKFNKFLKRLKHYQAAAFYQDESDLCIGYENWQCDKIGEKFEGYEQTETQKYNKYLDIIFEYLFRLNVQGKNAELAYHLPAVKPIFMTDDGNVSLIQFIRSLNEKLKYKSVDKLDLDYHPRVNIYLLNELDLNYAIKEDEKKKEKPLKNALDTKIAKIREEFEGKMKNLCDNVKERTSEEREKFVEAFYFGTFDSSPFS

SEQ ID NO: 134847 - protein, 259 aa, Heterodera glycines
  Coding regions on vcDNA: vcDNA=SeqID_61270; Strand=-; Position=1 -114,160-502,554-876
MYKKAEERAKEYGYWSAKINDDKHRIIVGSKFDDQLTWTEDAFFSEFVKGLTTNSKKFFKMAKEYSNYLRLKKEKGYYIFSDENTMISFGLYEIEKMKMHLTQKYKAHLGIMYQMKENWHCDKIGKEFEEECQKYRKYLDILYEYLFRLYAEAKDPKVSKQLSPLVKPIFMYGNSSPYCLIDIVRWLNAISKYFWEKEEKVYIWSINLVNEEELNYEIKEEKNWFDKNKQLNGPTDIQSIWEQFEQKMGEIAENAKENA

SEQ ID NO: 134848 - protein, 141 aa, Heterodera glycines
  Coding regions on vcDNA: vcDNA=SeqID_61271; Strand=-; Position=1-425
  Homolog annotation: Hit_ID=CAG83749.1; Match level="QueryCoverage =91%, HitCoverage=25%, E-value=8e-13, Identity=42%"; Hit description =unnamed protein product [Yarrowia lipolytica CLIB99] ref|XP _499823.1| hypothetical protein [Yarrowia lipol
MHFCTSSAICCTYFSLLITVVPLLITVAPLIITVVPLIITVVPLIITVEPLLITLLIAVVPLLFTVVPLLITAEPVLNTLLIAVEPLLITVVPLLFTVVHLLITVVPLLITLLITVEPLLITLLIAVVPLLFTVVPLLITK

SEQ ID NO: 134849 - protein, 44 aa, Heterodera glycines
  Coding regions on vcDNA: vcDNA=SeqID_61272; Strand=+; Position=1 -90,243-287
MSHEEAIIYGKIDRYLRIGLYDNACRDLPTSLEVKKAVLKGGPF

SEQ ID NO: 134850 - protein, 43 aa, Heterodera glycines; identical to SEQ ID NO: 131356
  Coding regions on vcDNA: vcDNA=SeqID_61273; Strand=-; Position=1-503

SEQ ID NO: 134851 - protein, 26 aa, Heterodera glycines
  Coding regions on vcDNA: vcDNA=SeqID_61274; Strand=+; Position=1-78
MQSPLVISIISIELRNEFPFSAHQAE

SEQ ID NO: 134852 - protein, 282 aa, Heterodera glycines
  Coding regions on vcDNA: vcDNA=SeqID_61275; Strand=+; Position=1 -84,887-1651
  Homolog annotation: Hit_ID=CAC37683.1; Match level="QueryCoverage =65%, HitCoverage=48%, E-value=3e-10, Identity=26%"; Hit description =putative recombinase [Chironomus tentans]
MALLRFAETKTNRGKILLSRSGYDYTFETCPRGFTQVYTLAVVIDHCAVPAVYGLLPSKTLATYTRFFETIRQSVGNNWFPYRIMSDFESGAITAAGNVFPNSIRTGCLFHFGQAIWRRIQRLPNLLTRYRDDEVVRTSLRSLQALAFVPVDFVYNYFCIAMSILEPTPELQELIIYFINTWIGPRRIMQNEEVLVHDAGGVADNWIRGRIEALNLAQTDALFPIELWNVVDRVAEGLGRTNNSLEVWWDVTIFSCLFFRVGIQLGMCTLGGTNDRVHLLGK

SEQ ID NO: 134853 - protein, 64 aa, Heterodera glycines; identical to SEQ ID NO: 129150
  Coding regions on vcDNA: vcDNA=SeqID_61276; Strand=-; Position=1-663

SEQ ID NO: 134854 - protein, 74 aa, Heterodera glycines
  Coding regions on vcDNA: vcDNA=SeqID_61277; Strand=+; Position=1 -79,173-319
SKGDADFEECLFSTSIERIERLSREEVNRELLLADRDNRMLKQRVTLLRDSYQQVQEENRKLKSLLNDNGMNSL

SEQ ID NO: 134855 - protein, 237 aa, Heterodera glycines
  Coding regions on vcDNA: vcDNA=SeqID_61278; Strand=-; Position=1-716
VQSLGLYSPAFQSLGLNPPAFQSLGLNPPAFQSLGLNTPAFQSPGLNSPGLQSLGLYSPAFQSPGLSFYAFQSPGLILLHFNHWDSTLQHFNHWDSILLHFNHWDSTLQHFNHWDSILLHSNHWDLTSPVLRHSNHWDSILLHFNHWDSTLQHFNHRDSILQDFNHGDSVFMHFNHRDSTHQHFNHRDSILQDFNHGDSILLRFNHPDSVFMHSNHRDSFSCISITGQFSCIPITGT

SEQ ID NO: 134856 - protein, 29 aa, Heterodera glycines
  Coding regions on vcDNA: vcDNA=SeqID_61279; Strand=+; Position=1 -34,534-589
MFLFAISRRILIRFKDGTNPSLEARTLSI

SEQ ID NO: 134857 - protein, 137 aa, Heterodera glycines
  Coding regions on vcDNA: vcDNA=SeqID_61280; Strand=-; Position=1 -202,242-346,666-772
MQLSQALRLVNERTLVSFVQQLPLVAQLFGDGRIVHFRIVRRHSLSLPARPHHKGTDKWAHFSMINSEKPNKNYKFCYFIGLFTCSSASSLQRWLTTAAVAGALSGSLITFSIAKLYSCAATDRRQWNLFLMLCNEW

SEQ ID NO: 134858 - protein, 80 aa, Heterodera glycines
  Coding regions on vcDNA: vcDNA=SeqID_61281; Strand=+; Position=1 -71,179-346
  Homolog annotation: Hit_ID=XP_309771.1; Match level="QueryCoverage =82%, HitCoverage=30%, E-value=2e-24, Identity=77%"; Hit description =ENSANGP00000012491 [Anopheles gambiae] gb|EAA05566.1| ENSANGP00000012491 [Anopheles gambiae str. PEST]
PATAAVVSHRCSEEADEHVKRPMNAFMVWSRGKRKRMAADNPKMHNSTISKQLGHEWKLLDEADKRPFIDEAKRLRQLHI

SEQ ID NO: 134859 - protein, 77 aa, Heterodera glycines
  Coding regions on vcDNA: vcDNA=SeqID_61282; Strand=+; Position=1-234
KISHFHGVAFDHVELHFYKGGVPIWTGPIKASAVGLVFYPCLCIDENCVLDICFSAAKFSPKAPLGYQEIMSEQTLL

SEQ ID NO: 134860 - protein, 121 aa, Heterodera glycines
  Coding regions on vcDNA: vcDNA=SeqID_61283; Strand=-; Position=1 -183,904-1086
MNFHLSFLFACFKYLAALCYLIIAVLPKFGITNLKWMELCFVGITASLVLSLIGAAKCTQIWSSIFKYSAVSLVVGATVFNLTLRVEPRPWTEMDFKKESKSDVKNSKNEPIDEEMKEFLS

SEQ ID NO: 134861 - protein, 78 aa, Heterodera glycines
  Coding regions on vcDNA: vcDNA=SeqID_61284; Strand=+; Position=1 -70,286-452
MAPETSTKTMEVVTTAKMENDSIDDDEISTLIIFNCFYITLLNENLTNILCEALKNISQIKKMVLCAQPSRTYPLLSC

SEQ ID NO: 134862 - protein, 87 aa, Heterodera glycines
  Coding regions on vcDNA: vcDNA=SeqID_61285; Strand=-; Position=1-261
MYGFITMRVVRHPVHNVLFARFALRIATRNATHFYWRSLASDTKNSMVPPESTKTPAMPSENLIKMLRKDLEEQLKLQKKERERLQL

SEQ ID NO: 134863 - protein, 113 aa, Heterodera glycines
  Coding regions on vcDNA: vcDNA=SeqID_61286; Strand=+; Position=1 -3,160-286,479-569,622-739
  Homolog annotation: Hit_ID=CAG06976.1; Match level="QueryCoverage =69%, HitCoverage=12%, E-value=6e-21, Identity=59%"; Hit description =unnamed protein product [Tetraodon nigroviridis]
MKIAVLVALFWRIASIFLFCKLFATAQVQATLPKFSSHKSEFAEKYSYIEPEDVEMARDQAREMFFFGYNNYMKHAFPMDELDPIHCIGRGPDYENPANWNINDVLGDYSLTL

SEQ ID NO: 134864 - protein, 29 aa, Heterodera glycines
  Coding regions on vcDNA: vcDNA=SeqID_61287; Strand=-; Position=1-93
FFCYLTNNFFSTAGYQLDFFTKNDQILAV

SEQ ID NO: 134865 - protein, 113 aa, Heterodera glycines
  Coding regions on vcDNA: vcDNA=SeqID_61288; Strand=-; Position=1 -68,471-744
MTNLIEMTHNFEWKKLLHEQNNGPNFCKVWLIGISSNVNSAQMNPLLAQFDATIRKDFLKFNPLENAEENGGKNKSNKKFKMPKMEEISAKFDEFKLAFKSILVNKWKMFEAM

SEQ ID NO: 134866 - protein, 97 aa, Heterodera glycines
  Coding regions on vcDNA: vcDNA=SeqID_61289; Strand=-; Position=1 -83,185-395
MVSKIVLLYPNASLPFLIQKFFLFYSTRPNFMPVQLSELDKSNIVNPFFVQNPEEQEMPVYTPIFPELNVASLVTNCSAKVIQNEMIKGKKNFYKIF

SEQ ID NO: 134867 - protein, 98 aa, Heterodera glycines
  Coding regions on vcDNA: vcDNA=SeqID_61290; Strand=-; Position=1 -32,115-379
MANEFLALAFKPNFCKVWLIGISSNVNSAQMNPLLAQFDAAISKDFLNFNSINGNKQTQSEKMPETFEIVGKFENFKLQLKSILVNKWKLLDFQFLCG

SEQ ID NO: 134868 - protein, 419 aa, Heterodera glycines
  Coding regions on vcDNA: vcDNA=SeqID_61291; Strand=-; Position=1 -59,280-549,1290-1447,1687-1928,2836-2937,3035-3238,3540-3756,4036 -4043
MMVFWPFENLGKSGSGRSVSGGEEFEDLKALIHFAWRRGIVSTNANECWQNANFDEALAPVRWRWLRLIILYKQIKDLSENHPIWVDSVDDNVRNAGDQLVEDYANKMISNYLKNAFTRENGAEGIRSFFKSKFNENPIFYEGFVEKFPEIGPVKLRQTFENAFLDDSFLYGKYAEFLSSPWADYQIVLLDIGAYVNEIEKRIQMWEQLQKMERKIFPKFDTFDQSNSLILIKIEWTNSLTLQQKNYLTEIEHETMAEYNIKIKNSLKIIYTIVKSWSKRKARLLISGSYFLNSHSIDSGIDLLCIVPEKTIRMNAFFGNEKTKCQKNVCSSTANKTSLYSLLFENNEVTNLRKIINGTIFLITFNLNGINFDLSFAAISDNSELPLVINHQILDNFIQILWPFTDETHQKMIRALSIY

SEQ ID NO: 134869 - protein, 328 aa, Heterodera glycines
  Coding regions on vcDNA: vcDNA=SeqID_61292; Strand=+; Position=1 -105,426-564,617-700,986-1136,1309-1483,1668-1763,1816-2052
  Homolog annotation: Hit_ID=NP_492109.1; Match level="QueryCoverage =14%, HitCoverage=7%, E-value=1e-09, Identity=51%"; Hit description =metalloprotease III family member (1I107) [Caenorhabditis elegans] emb|CAA96596.1| Hypothetical protein C2
MSVAAGHELLHALGFDHEQSRSDARNYVILREDDGEIFICLDSCKDHDNKCQNGGYLNPNDCTKCHCPDGYGGEYCKELEENLNCEDLSGIPRELVANQSAVLLKTKAKCAKLCCAASLTDLKANEYKNWIEAEKPDMDIVISAHLSPKWTVPSTVFELTKCVNTDNLFAEKRNPGTSGLKCYDGVKHQFYDCSCHGDKKCLAEEKWAHDAFLCPIIKVNGIQIQGSRQRVFTDPKDFRYDWTRIEVNCYKAEAGTVSFWGYSKPETNEIIRVDEIHCLTYKAAGVPKRFKSLQVEEQPPMKKLSPSPFLANNASSLIHVFVPFVGHP

SEQ ID NO: 134870 - protein, 85 aa, Heterodera glycines
  Coding regions on vcDNA: vcDNA=SeqID_61293; Strand=-; Position=1 -218,274-313
SIASFKRTNELTGDQLTLAPIHEGANVFKLIRCPIAAEGSEETLEKAMNDAMLCTARQNAIDIFIADDGVDDGLLDGLPGPSGDH

SEQ ID NO: 134871 - protein, 71 aa, Heterodera glycines
  Coding regions on vcDNA: vcDNA=SeqID_61294; Strand=+; Position=1 -45,1284-1379,1434-1508
MSLFKFGDGSIKMKMSLNVTRNTLSAKAFDLHSVTSCIPIEWVCDGQADCLDMKDEANCTAKETKPECEKD

SEQ ID NO: 134872 - protein, 218 aa, Heterodera glycines
  Coding regions on vcDNA: vcDNA=SeqID_61295; Strand=-; Position=1 -92,258-406,587-732,1141-1409
MPKSWGNANIGGGAAPTPIPSPKNQKQKQQKQPSKTGQKNAPKADQKKVAPKNQQNGKPKSDQNGGPSPMSKKEKKKQQKQKKNHMKLARESAERLEEAVKMIQARKEGSEKATGEENVKKDKDAVYNMVASSLETLLPVRFVFGRLRSSARLVAKQHSSNIVQAATLLEPKKFKQFVQLLDSSNVAKKGGVAEATEDDEEKAERKEAGEEDEQRVLA

SEQ ID NO: 134873 - protein, 402 aa, Heterodera glycines
  misc_feature (401)..(401): Xaa can be any naturally occurring amino acid
  Coding regions on vcDNA: vcDNA=SeqID_61296; Strand=-; Position=1 -121,173-284,577-654,707-760,858-883,928-971,1116-1247,1642-1718,1783- 1869,2233-2343,2405-2552
  Homolog annotation: Hit_ID=NP_499323.2; Match level="QueryCoverage =96%, HitCoverage=61%, E-value=1e-105, Identity=57%"; Hit description= UNCoordinated locomotion UNC-49, ionotropic GABA receptor subunit family member (58.3 kD) (unc-49) [Caen
FKTLVPFAVDVGITIHVTSISAVSEVDMDITLDFYLRQTWYDPRLAFQQLDPYDPRLAFQQLDPELARRIKKLTVGVDYLERLWKPDTFFPNEKTAVFHLATTHNSFLRIEPDGRIYTSQRLTVKAMCQMIYTSQRLTVKAMCQMELQLFPMLFPMDSQTCKLGLESYGYDVEDIDDSQTCKLGLESYGYDVEDIDYYWGERRSDGRRPEDAVAFDVFFLPQFRRTGYRVTGTHITTASGKYARLYFEVILSRNLGFYLMNIVIPSMLIVAISWVSFWLSRSMLIVAISWVSFWLSREASPARVGLGVTTVLTMTTPITTTNNTMPKVSYIKGLDVFLNFCFITVFALWVEFAIVLWVEFAIVSYWNKRQSRRRQNKFNFLEKQLINKHKNKNQSFNNAKXN

SEQ ID NO: 134874 - protein, 113 aa, Heterodera glycines
  Coding regions on vcDNA: vcDNA=SeqID_61297; Strand=-; Position=1 -98,410-585,1070-1136
TKIGGMLRHKYNNSSSSFSIVLLFILVRSEFGGVTGTLLSTENEQTNGVGESQQQQQQQPMVQWSDAYQNQPQHNQQQYDNNGFNTTYISQILNRLTDSKKYDKRLRPRYGEG

SEQ ID NO: 134875 - protein, 255 aa, Heterodera glycines
  Coding regions on vcDNA: vcDNA=SeqID_61298; Strand=-; Position=1 -289,398-483,537-581,641-708,762-876,1345-1449
  Homolog annotation: Hit_ID=CAE65761.1; Match level="QueryCoverage =88%, HitCoverage=75%, E-value=2e-45, Identity=41%"; Hit description =Hypothetical protein CBG10850 [Caenorhabditis briggsae]
RVGRNRNNNEGAFGLKRMGRHGMKARSISIRSRRRSDVSSARIVLTLRMANVVLLLLVNLLIFSGIGHYQDKNGNRISLLLTMDKWSNAFPSDKLAFTSLSLKISAQFCASALSVAMLLTSISLQIIHCLRLQIIHCLRLKHSKFLCVCHSFGCVPISLCVCHSFGCVPISLFVFGLEMHYSACPWLDDFLIACPWLDDFLIATMEKYFDTQCGINGWALAGIFSLLSCGLFISDGLIVTFFNESHSTEPEKQQQ

SEQ ID NO: 134876 - protein, 128 aa, Heterodera glycines
  Coding regions on vcDNA: vcDNA=SeqID_61299; Strand=-; Position=1 -105,610-672,744-960
  Homolog annotation: Hit_ID=AAF71303.1; Match level="QueryCoverage =95%, HitCoverage=6%, E-value=6e-16, Identity=38%"; Hit description =dual oxidase [Caenorhabditis elegans]
MAEDEADNDVLLEAAETKDKRHAKLDHFFREAYSRAFNMPQLSDHTTDFNTYASAQAKFRALSLGKFHCFIAKVMNMTLTKAEFAEALGMRANDLFVQRMFACMAHDAQNDTTVTFQEFLEVLRKFTQ

SEQ ID NO: 134877 - protein, 458 aa, Heterodera glycines
  Coding regions on vcDNA: vcDNA=SeqID_61300; Strand=-; Position=1 -10,102-254,520-1731
  Homolog annotation: Hit_ID=NP_500013.1; Match level="QueryCoverage =28%, HitCoverage=9%, E-value=7e-35, Identity=54%"; Hit description =predicted CDS, polyprotein family member (4B673) [Caenorhabditis elegans] gb|AAC02594.1| Hypothetical prot
MGADFLIRFGLMIRDEYVGRGTTRRMTFGGNKTQKIVKSPARLNMMDLNASVEVVLLRSKRNSDLPMLPNLNAISPHHAVVQTLINSTHVRCLMDTGASLTVAPRSVADELNCQTYSSDLEAMSASGHVIRLKEYAQVNLNIAGYTVRSLIYFVDDSEFTVARDYSVIVGWDVFEKLPPIKFDHLNGKFFVGENEANLCYRSVLLLNDLRVSAEKNTLIPADSQILVDASIESSPNPKNSFCIDRPDISLIKKGLSVINSVSPAGQKQIKVAVVNPTMEPKWIWKGTHLAFANELLCDRNGLLKENSTKEILALISERKKMEIDPTFVVDFSKAMVEGKDLEQLKALIEEFSEVFSKFRYDLGLFTAAEHHITTTTEEPIASAPRRMPYKYKEELKKHINQLLEAGVMVESDTPWVTPIVIVQKKDGGIRPCLDFRKLNEVTVPDKYPLPRLDSIMEK

SEQ ID NO: 134878 - protein, 92 aa, Heterodera glycines
  Coding regions on vcDNA: vcDNA=SeqID_61301; Strand=+; Position=1 -37,230-471
MPICKFDSVGVSEERKGKASTTRGRRKEQQTEQKKQQMVRPTTGGGDEDEAETTAGGGGEKTAAGEESKEMEMSQGWEEGAGAVIEPMEGQK

SEQ ID NO: 134879 - protein, 37 aa, Heterodera glycines
  Coding regions on vcDNA: vcDNA=SeqID_61302; Strand=+; Position=1 -61,104-156
ICCCVEDDKVSTDWLEEQITDFEDLVQSVDVVAFNKV

SEQ ID NO: 134880 - protein, 66 aa, Heterodera glycines
  Coding regions on vcDNA: vcDNA=SeqID_61303; Strand=+; Position=1-259
KKFFLIFWLPFFCFWWGAWNSGIMCTRPIWQVKQRLLTSQKVRCRDETNQHCLPRGTRHGPPKEWI

SEQ ID NO: 134881 - protein, 506 aa, Heterodera glycines
  Coding regions on vcDNA: vcDNA=SeqID_61304; Strand=-; Position=1 -189,469-685,726-996,1045-1451,1500-1738,1782-1977
  Homolog annotation: Hit_ID=NP_740808.1; Match level="QueryCoverage =55%, HitCoverage=32%, E-value=1e-23, Identity=30%"; Hit description =dot1l Histone Methyltransferase (1C952) [Caenorhabditis elegans]
RSDGPLKTKSREILHQIVTRCYNRAVDNEKALNKHYEAFSSQTYGETSFERMRMIIDELRPTELKHGDFLNEQHRSLITEEATIIFINNFAFQSDLEMRIKRELLSDLKQGTRIISTKPYVPLNKQGAITDRQLNDISVITDVVEMKACPNPCSWTSAYVPYYLHTINRKKLEMYFTQKNSSRCKSSDFGSRRSSTPNSKASNSRESSLDLRDKSENGRTNGEDICFGPTTRRKWHEYVSDLEQQKKRKGGAGSSTTPDERSVTNSSSGTPTPVSASSAPPFVSTALPNNANANTPLPQKTICVNNLRRPSSIPELINSVKEEPLVESSPVVDISVGPANALVVNPIHQQQNHLINEVSKFEPITPVANRKNDEGDGKKNVAKRSNERKEKVQPTVGGKRGRPSKADKMLGTHASPKMPRLSDDAKDGMEVMHQMTLSVQAGKPIDPASILADMAEAKRRSVPMDTINMALPFPNLSKPFTDQTQSGGDIQSHHYTERYPGLSKFL

SEQ ID NO: 134882 - protein, 56 aa, Heterodera glycines
  Coding regions on vcDNA: vcDNA=SeqID_61305; Strand=+; Position=1 -142,320-348
MYNTVPCLHGICGPGRRLLHTVIIGYTVDCGQKNCTLNNAYGNIDCDSSITTRTRI

SEQ ID NO: 134883 - protein, 129 aa, Heterodera glycines
  Coding regions on vcDNA: vcDNA=SeqID_61306; Strand=-; Position=1 -144,224-342,622-745
MESYVQVEDQDSRDSGIRLAQSTTSQQSCLAKIYFPTLFDFGFKVRELQYSLDTVERPQVPHKAFRSINADTMANLLGSLTEEQFQRRALALREFDRVRNESRYPYVDYKEIYLLDRGYRYFFKERKFG

SEQ ID NO: 134884 - protein, 126 aa, Heterodera glycines
  Coding regions on vcDNA: vcDNA=SeqID_61307; Strand=-; Position=1-381
MPMETVCRRKRGKRRGEDMARNTSDGEVTSDGGMPLVKKRMVTRRQAMKEATTTAARPHRMKRFSSPTSPVAFVSSNDLLHQLDFGIVSIQPPLFSLNDAATFSVLKRIGEEQKLSLEERRLISGD

SEQ ID NO: 134885 - protein, 36 aa, Heterodera glycines
  Coding regions on vcDNA: vcDNA=SeqID_61308; Strand=+; Position=1-180
GLSCRNLMRGNITVCEAVARTRTNSNYQFLFFQAFP

SEQ ID NO: 134886 - protein, 640 aa, Heterodera glycines
  Coding regions on vcDNA: vcDNA=SeqID_61309; Strand=-; Position=1-1923
  Homolog annotation: Hit_ID=AAS07042.1; Match level="QueryCoverage =59%, HitCoverage=23%, E-value=1e-39, Identity=30%"; Hit description =minus agglutinin [Chlamydomonas reinhardtii]
MSNSFFVFLPSNVSDYPDNQPNKFRVRLPKPLHFNGTWVCGLHSISYPYSWSTIGTLDEQWIDIHFTDRSAIDEDRQRIIRVPVPKASHSRVEQLRDFLTATLRNHSGAKMLPLPRELEENRNRTKPLNSPPPAKRNKRDESPPVFDENGNELGSPPSYNGDKEDEEEEGIISESPPHYEGNETVTIDFPSSYNEDYEGVIADSPPRYVETQNETVKTSKATSPQPPPTPSTAKPAPPPPPPPSTNSTPISIKTPAVQPPKPTVSTPPPQTTITKAPPPPPPTKSAPIVNPSITTTTKTIPTPPVTKPTTPTPPVAKPTTSTPSVTKPTTPTPPVTKPTTPTAAPKPIKPASPAPQPPKPSTPAPLTTTTKPPVPSPSVKPTISAPPAQQPKSPTPSTKPIVPKTDAPPKPPPPVSLSAKLIPSAPTPPLDSPPRFEGEENKNVKSFAKPPPPPTSAAQIDPSRLIHTLDPPRIYFKTPPANQNPLNYVPNSVIVLFNNDVERFKVVFNEEIISHLSFSPQLGYVLGFENPQHVVSNEVAKYGHDLRGGISSFAVYSKGLTENMIIGNTLSSLLRVVSISGATPGDYTEKIYDSPIFARVLPREINEIEIELRTMDKGRLVPFAYGTTMVVLIFKKVINF

SEQ ID NO: 134887 - protein, 27 aa, Heterodera glycines
  Coding regions on vcDNA: vcDNA=SeqID_61310; Strand=-; Position=1-81
MHRIIAAVKKLVVGSVLAVRCTLCVLL

SEQ ID NO: 134888 - protein, 318 aa, Heterodera glycines
  misc_feature (29)..(29): Xaa can be any naturally occurring amino acid
  misc_feature (181)..(181): Xaa can be any naturally occurring amino acid
  misc_feature (238)..(238): Xaa can be any naturally occurring amino acid
  misc_feature (251)..(251): Xaa can be any naturally occurring amino acid
  misc_feature (255)..(255): Xaa can be any naturally occurring amino acid
  Coding regions on vcDNA: vcDNA=SeqID_61311; Strand=+; Position=1 -208,240-282,340-643,822-1003,1042-1130
  Homolog annotation: Hit_ID=EAA17111.1; Match level="QueryCoverage =89%, HitCoverage=65%, E-value=2e-38, Identity=40%"; Hit description =hypothetical protein [Plasmodium yoelii yoelii]
LRASQTCYCSISCFNTENPSKKLCPQMQXANYLVGRVSLVIGINQTNRHELRTAMHHHPPNHEKAINLFPVLSQIKPQAPFPVLSQIKPQAPLLNRKTFVSGKLPTRANKSNRKTFVSGKLPTRANKSRRIASWHRLRSELGRYLIAFEPLTFFLINEDILAKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPESNPYPPLPVISQAPSPESNPYPPLPVITMVVRYTTIES

SEQ ID NO: 134889 - protein, 64 aa, Heterodera glycines
  Coding regions on vcDNA: vcDNA=SeqID_61312; Strand=-; Position=1 -144,283-333
MMDDLYTVFERRPDEKIFKFNLTFVKFASEIASLRVINGNPDTNFNDHMLHHNLARNAATDFDG

SEQ ID NO: 134890 - protein, 92 aa, Heterodera glycines; identical to SEQ ID NO: 125147
  Coding regions on vcDNA: vcDNA=SeqID_61313; Strand=+; Position=1-304

SEQ ID NO: 134891 - protein, 193 aa, Heterodera glycines
  Coding regions on vcDNA: vcDNA=SeqID_61314; Strand=-; Position=1 -109,170-219,516-681,737-993
MASSKSPIFLLTVLLIMLLICPCFNNNVNNSLFNPASDDCVVAVRNRSEIPDGLYEYVYGTLRTPELREAAKKADIFRNTFTTDCVPYGEFGTIWGGFWGCLTYTCKDMFGKDIFRVNGCFPKSDKKCPAIFHDYCWLATGDLWKCRHCDELVDGKVCNSFDQLIKLDQPADDLKSNSNSYSTSKAEKLGPAP

SEQ ID NO: 134892 - protein, 140 aa, Heterodera glycines
  Coding regions on vcDNA: vcDNA=SeqID_61315; Strand=+; Position=1 -166,435-691
LYEYVYGTLRTPELREAAKKADIFRNTFTTDCVPYGEIGTIWGGFWGCLTFTCKDEHGKDIFRMNGCAPESGKKCPKFFNTFCWEAGGTSSNCRHCDELVDGKVCNSFDQLIKLDQPADDLKSNSNSYSTSKAEKLGPAP

SEQ ID NO: 134893 - protein, 39 aa, Heterodera glycines
  Coding regions on vcDNA: vcDNA=SeqID_61316; Strand=+; Position=1 -27,238-330
MALNWRRMKSISHLYKGILFCKIQFYPCKIRLLGLKQAV

SEQ ID NO: 134894 - protein, 78 aa, Heterodera glycines
  Coding regions on vcDNA: vcDNA=SeqID_61317; Strand=-; Position=1-237
MDGEHTGSTDWAGGTWISKSKEQALTFSKEAKMKTACNGKPIRLSDQSFGILEDDYLKIVNDCGLGKRAIQEEQLAHN

SEQ ID NO: 134895 - protein, 57 aa, Heterodera glycines
  Coding regions on vcDNA: vcDNA=SeqID_61318; Strand=+; Position=1 -81,285-377
MFYFFSVISFTIIVHPCLIRILNASPSNLNGQNAKNIANIWTFCTNICSENTSVFTQ

SEQ ID NO: 134896 - protein, 85 aa, Heterodera glycines
  Coding regions on vcDNA: vcDNA=SeqID_61319; Strand=-; Position=1 -120,163-300
MNWLIGPGWSSDRHMREILLGLSTLLEEPNFESPFNEDARTQHTLDQNAYFESVRRTAEKARTKNMVKRFYFFVNLKNQIPLVAY

SEQ ID NO: 134897 - protein, 46 aa, Heterodera glycines
  Coding regions on vcDNA: vcDNA=SeqID_61320; Strand=+; Position=1 -67,780-853
MSHHLANRSFFRIKEDSADCLEYLFIPNLDFDFQKSALYSNAYLIA

SEQ ID NO: 134898 - protein, 76 aa, Heterodera glycines
  Coding regions on vcDNA: vcDNA=SeqID_61321; Strand=+; Position=1-230
MWKVFMHSLRVDYLGNCDRNETNAMIKITKTGTNETVGLFCMCQGRHSEGQKIFGNWNSESPEHFGGTKIGLPCHS

SEQ ID NO: 134899 - protein, 259 aa, Heterodera glycines
  Coding regions on vcDNA: vcDNA=SeqID_61322; Strand=-; Position=1 -120,282-943
KRKSTEEPKPDTDTKQSKPEQQPAQQKEGKSEEGQKPKTDTSSLSKETQFVLQKLRQQEAIAQAKELSKVIREVQATINFNRNTDLISYSRALQKASQIPEQDEATDNLNFHSNFSPEINNKFLEELNSLESTHDDIYNRAVADCERAEQKRINSVTKQTQNIFEAVGKAIKAENFNKGLLTELAKAINSPSYNSRAGKDKALIIVNKLQDNLTHHHRFLIGQQKTAEFLRKTFKIPLEDEPSTSANNLEKKDFFFNII

SEQ ID NO: 134900 - protein, 57 aa, Heterodera glycines
  Coding regions on vcDNA: vcDNA=SeqID_61323; Strand=+; Position=1 -8,599-744,816-835
MKKLENLFAFGKANRAYVKSFRMIPTMLDLDVKEKSYRGKTSWRRNASTETQNFCLF

SEQ ID NO: 134901 - protein, 28 aa, Heterodera glycines
  Coding regions on vcDNA: vcDNA=SeqID_61324; Strand=-; Position=1-88
AGQQRVQVALNADVTGDTARHQETKVAE

SEQ ID NO: 134902 - protein, 66 aa, Heterodera glycines
  Coding regions on vcDNA: vcDNA=SeqID_61325; Strand=-; Position=1-198
MPSPSYSNFGRFGGGGRGGAYGGGGREESPEEWEDELSEEEEERRKWDKSKGSAECHFGWVAQWRQ

SEQ ID NO: 134903 - protein, 108 aa, Heterodera glycines
  Coding regions on vcDNA: vcDNA=SeqID_61326; Strand=-; Position=1 -171,458-613
MAFAQFFVNCKLKSIESTESTITIAWKSQSITDVEIECYEVQYKNVNEVWKTIKCPQHAFVPKKSYTAVVKNLKPATLYALTVVALNKHGNTVDVLTMSPVATKPRFT

SEQ ID NO: 134904 - protein, 24 aa, Heterodera glycines
  Coding regions on vcDNA: vcDNA=SeqID_61327; Strand=+; Position=1-72
MSPPDFLVSVVLLGASSLLCLGPA

SEQ ID NO: 134905 - protein, 133 aa, Heterodera glycines
  Coding regions on vcDNA: vcDNA=SeqID_61328; Strand=-; Position=1-595
CFLQLHHLPFSFQFFCHSHLPPNFCLFVHTFSDHIFPFGHSFISFFPLFGIFSPRRFLYPSASLFCILIFAPPQGENVLVPFHSIPFHLDTHSPLALHSFSLLTIFFLFAESFPIFDPLNNPYRPSLPPIFTI

SEQ ID NO: 134906 - protein, 53 aa, Heterodera glycines
  misc_feature (42)..(42): Xaa can be any naturally occurring amino acid
  misc_feature (44)..(44): Xaa can be any naturally occurring amino acid
  Coding regions on vcDNA: vcDNA=SeqID_61329; Strand=-; Position=1 -52,168-931
  Homolog annotation: Hit_ID=XP_485323.1; Match level="QueryCoverage =75%, HitCoverage=27%, E-value=5e-12, Identity=82%"; Hit description =similar to putative senescence-associated protein [Mus musculus]
CLPTPGSKNIAILPRRDSDLEAFSHNPSDGSFAPLVYRPSTXTXCLNLRFLSY

SEQ ID NO: 134907 - protein, 1250 aa, Heterodera glycines
  Coding regions on vcDNA: vcDNA=SeqID_61330; Strand=-; Position=1-3750
  Homolog annotation: Hit_ID=NP_920205.1; Match level="QueryCoverage =93%, HitCoverage=76%, E-value=1e-106, Identity=28%"; Hit description= putative DNA helicase homolog [Oryza sativa (japonica cultivar -group)] gb|AAP52492.1| putative DNA helic
MAAFMQRTKNTEYGGDRVNEKTIRKLDFIIRKYHPLAKELMNFHTQYQKTLDELGPEAVLNFRLTLVESREAPLNIRDPSLHPRQANLPDEGNSLFAIWAESDQPPLLKGIWITTDEGKLQKFQPHHPQTDSLCYPTLFPHGDDGFHTKIPYNYKNKKRDDEAMEVNVESDENAFDSDENGPDDDLSVTSSLDSVDKSGTRQFLSVRTYIRYRMALRKDNNFHHIWSAGGGLSQKFILDYSARIDTNVANYLRKPELNLRSTLPENALRWLSRNAGLNSTEELGSVVMFRRSEPGTRAYFQHKFYDATTIMSRFKRPGFASFFLTFTTNPRWPEISRNFLHQGQRTVDRPDLICRIYEDKLRHLHYLLDKKNILGKMIGQECREFQKKYGGPHAHRVYHTDLLAIPENVDGLIWAHIPPEPNKNDKSDWAIFICKVRELLPKYQFHDCGRHCLNHKGKCKKGFPKPFSKFTILHDDRPAIYFRPSTEDGGQTLTVKRGKTQITYDNSRVSAYNPYILVHFETHHNLEYAYGQSTNLKYLYKYPFKGPSFSYVKTNEENGKTGIDEPAYYARMLYRSSPEAYCRIMSLKYAKLSHTVIALSLHLPGQQKIYYKPSEKASVAQQVQAGILPETPLTAYWKMCETDPDVRKIVFERMPEQYSFNKSGKFWKKRTFSARPDNIKNRKPIIGRIYPVSPRNPELFALYLLTKHFPGNPQQLKMVNPTHICQTFLETARLKGLIDDNDVWVRTMEEGAASLTPAQMRQLFANILIFGATEKCLIDGALLWEKFKSQMYDTRCTDAERTARIDHALALLEKLLVAQNKQCKDYGLPTPVISIMNDPQRGLNEFFFPQQLNDDDDDDPVDTTAFERGKLNAEQQKFFDMVKNAFLKTSNSRLFYLCGDGGTGKTFLLNYILFQLRKIGAKIIPTASTGMASTRFYVGGTTVHSAFKFGINVEPGKLPAIPFDSFFGRRIIESDIIIIDEMTMLERTVFENIDLLCRQLCMQKRHLPFGGKCVIISGDWKQSLPVVINSYGSAAQVAACIQSSPLYPIFSKYKLTQSMRVNPNEIEFLKWLDDIGRGLNGDTVAIPKGMLVDSREDLIAWVFDQGLNMPSSEMLKRLLLATTNRIVDLNNSQISQSMLGNFIEYFSVDKATDENPFAVNAADFDVAQLNQLNPMGMPTHLLRLKIGSIVVLLVNLNTSKGLCNGTRLLIKKLTDNLIECETIGSGSSGNGIIIGIPRNRHTFKDKRPDG

SEQ ID NO: 134908 - protein, 203 aa, Heterodera glycines
  Coding regions on vcDNA: vcDNA=SeqID_61331; Strand=-; Position=1-609
MPLNFPGHWTLLIYDINYGTFFMDSLQISELNFARVLRVKDIIGELCQINSEDIIIQKLPPSKLTLQHDGCSCGYFVCLYAEAWLMNNQSLILPNIDINLEKRRILWHINSLYNRDNVVYHPCSLFVAGENDNLGSLHHSRDSSMSIDSNINQTPVKRRGRPAKNRSGSGRPKKTENNQILMPVFSHESFHFTELDYSGCSDS

SEQ ID NO: 134909 - protein, 68 aa, Heterodera glycines
  Coding regions on vcDNA: vcDNA=SeqID_61332; Strand=+; Position=1-208
DANFGEYHRKASTNERQKEEAAEGAADEADQCSHISIPVQYRKHSSTSETSSLYDQIVEAEGKALINK

SEQ ID NO: 134910 - protein, 335 aa, Heterodera glycines
  Coding regions on vcDNA: vcDNA=SeqID_61333; Strand=+; Position=1 -207,253-604,673-1121
MILELAIDTANECQTNESLDGIIRQNYDKNLEEMFKKAEKKAKKDSPWKAYKYKHKIIIRSKFNDESTWTDEALFSEFVKGLATNFENFFKMAKEYANYLWRINEKGCIYGYNRQMINFGLYKIKNMKMYLMQKYEAYLGLMYLMRENWHCDKIGEEFNEYKRNICQKYRKYLHILYEYLFRLYAEAKNPKMSKQLPPFVNPIFIGRSYLYCLIFVINTLNDYSKFFWRNDDLWDDENVEIWGSFLVNEEELNDEIKLQIAEKARKNKIKKNISKLRKQFERKMKRLSEKATEKAKVAKEKLEKAISKATDDEAKKNLEEEYDYIFGSLNSSPFS

SEQ ID NO: 134911 - protein, 16 aa, Heterodera glycines
  Coding regions on vcDNA: vcDNA=SeqID_61334; Strand=-; Position=1-49
EAIPEGFGLPINLGAS

SEQ ID NO: 134912 - protein, 30 aa, Heterodera glycines; identical to SEQ ID NO: 130616
  Coding regions on vcDNA: vcDNA=SeqID_61335; Strand=+; Position=1 -52,459-499

SEQ ID NO: 134913 - protein, 18 aa, Heterodera glycines
  Coding regions on vcDNA: vcDNA=SeqID_61336; Strand=+; Position=1-95
LLINIWCVSEHVLKNIYE

SEQ ID NO: 134914 - protein, 31 aa, Heterodera glycines
  Coding regions on vcDNA: vcDNA=SeqID_61337; Strand=-; Position=1-100
NYYFFSFRGSDGNVRPLYSDQLHISANQPSK

SEQ ID NO: 134915 - protein, 68 aa, Heterodera glycines
  Coding regions on vcDNA: vcDNA=SeqID_61338; Strand=+; Position=1 -18,290-445,569-601
MEGKLLVIAVCLFLHSFVPKEYYQHLRNASSSQNANSFVDKQLPSQQHSVLTNTARNTEASVLAKNSN

SEQ ID NO: 134916 - protein, 317 aa, Heterodera glycines
  Coding regions on vcDNA: vcDNA=SeqID_61339; Strand=-; Position=1 -92,174-328,377-547,716-849,1007-1071,1360-1424,1482-1542,1610 -1670,1991-2140
  Homolog annotation: Hit_ID=CAE57468.1; Match level="QueryCoverage =76%, HitCoverage=53%, E-value=7e-46, Identity=37%"; Hit description =Hypothetical protein CBG00434 [Caenorhabditis briggsae]
MEIFNFFLLFFFVGQNLIIAEEEVKPCKKKSFGHDSFVCVCSSDYCDSPEPLGDVSGNKMVYYVSDKLAHRLAKFKNAENKNEGASDDTEFEVRVDASKKRQRILGFGGAFTDAAGVNLNALSERSREALLKTYFDKEIGIGYSVGRVPIASSDFSTREYSYLDTPDDFNLTTFALAREDFEEKIPHILKAIQLTGGDLRLYASPWFFEEYAKQNVTFWGLTLQNEPFIVYNGNLSWQAHWFDSKSQCDFASQLLLPALKSSEASKNLACAGFFDWEHTPLLGDWIRGWSYGHDILNQLRNWVVGWTDWNLCEGKHS

SEQ ID NO: 134917 - protein, 206 aa, Heterodera glycines
  Coding regions on vcDNA: vcDNA=SeqID_61340; Strand=-; Position=1 -79,136-346,398-468,519-615
  Homolog annotation: Hit_ID=NP_497227.1; Match level="QueryCoverage =94%, HitCoverage=77%, E-value=1e-40, Identity=47%"; Hit description =cysteine-rich hydrophobic protein similar to CHIC1 and CHIC2 (19.8 kD) (3B256) [Caenorhabditis elegans] g
LEIFPHPDWAMTEPIVIRGVGHLAMFGLNSHFSTFGLNSHFSTEFPSALTGKLAPEEFDDTLRRVNYVLQRNVSRNLRWLICGLLFCCCSFGISLWPVVCLNRRTISALEKTLDHENQQLYDKLGLRTISALEKTLDHENQQLYDKLGLHWKLARLPVEPSNRLTEYVLLLEHWKLARLPVEPSNRLTEYVLLLETLPRIPLSMPD

SEQ ID NO: 134918 - protein, 58 aa, Heterodera glycines
  Coding regions on vcDNA: vcDNA=SeqID_61341; Strand=+; Position=1-175
  Homolog annotation: Hit_ID=CAF99849.1; Match level="QueryCoverage =98%, HitCoverage=5%, E-value=7e-17, Identity=64%"; Hit description =unnamed protein product [Tetraodon nigroviridis]
MIGELNSIADLISNFFLAAFAITNFACFDASAAKSPGFRPGFRFYNKWLSLFGSALCV

SEQ ID NO: 134919 - protein, 280 aa, Heterodera glycines
  Coding regions on vcDNA: vcDNA=SeqID_61342; Strand=-; Position=1 -128,179-230,283-429,773-880,936-1046,1260-1442
  Homolog annotation: Hit_ID=XP_413814.1; Match level="QueryCoverage =90%, HitCoverage=13%, E-value=4e-48, Identity=42%"; Hit description =PREDICTED: similar to bumetanide-sensitive Na-K-Cl cotransport protein splice isoform A [Gallus gallus]
CRPEYCSNVNYSNTNTVKCLNCLTLISFLEFSGDLKDPSKSIPRGTFWAIAITTLTYLWPRGTFWAIAITTLTYLWCMVITCMVITALTTVRDATGFSEPELHPTHPATPSRRAANDTCRFGLANDYDVMTLQGAWAPLITVGIFSTTLSSASGCLIGAPRILQALCADKMFPYMHPFAKGYALCADKMFPYMHPFAKGYRKTNDPFRAYFLTLLIAISAIMIGELNSIADLISNFFLAAFAITNFACFDASAAKSPGFRPGFRFYNKWLSLFGSALCVL

SEQ ID NO: 134920 - protein, 88 aa, Heterodera glycines; identical to SEQ ID NO: 124691
  Coding regions on vcDNA: vcDNA=SeqID_61343; Strand=-; Position=1 -96,135-305

SEQ ID NO: 134921 - protein, 147 aa, Heterodera glycines
  Coding regions on vcDNA: vcDNA=SeqID_61344; Strand=+; Position=1-444
MLEQQMEEAKKVKTLVNMLNVRRKPIKTVKKLEGIPNEMKAKSTNLEVIMKTNEQQKMRGQGQSKDEKKEKPKKNKEKKEKGKEKKKKKKSDKKEQGEAEVRRAKRKSDDPWGEEGGNSVLEEPLTLPDNERDGTTTGRCNSERIRK

SEQ ID NO: 134922 - protein, 115 aa, Heterodera glycines
  Coding regions on vcDNA: vcDNA=SeqID_61345; Strand=-; Position=1 -192,273-428
MVEEAVQEQERRRSIVVMGLAESAEPKPSDRVAPDSTAVSSILDELGIECSISNYRMAPPPPSGSLKTNAIMMVMKNVNYLPAYLQIHLTFLMLTQAIIAWETIMQSMLYIEELD

SEQ ID NO: 134923 - protein, 370 aa, Heterodera glycines
  Coding regions on vcDNA: vcDNA=SeqID_61346; Strand=-; Position=1 -273,725-1563
  Homolog annotation: Hit_ID=CAE65897.1; Match level="QueryCoverage =98%, HitCoverage=28%, E-value=8e-97, Identity=43%"; Hit description =Hypothetical protein CBG11064 [Caenorhabditis briggsae]
SATRAREIAVSKDTQDERALEVEQCECPPGYVGTSCEECAEGYERSGQGPYLGHCVAARQPPERPLCDSAGALSAHPQHDRRCDCKPNVVGVTCDRCAPEAFNLSPQNPQGCLRCFCSGVTRVCESSHWRRNRVELDYARVDRDQLEATTSDAHSPYNRRRNRRFAEQSESKSQNERIVHTVPSPQVYDGSISFHGFYEARGQTLYWSLPQKFLGDKVTAYGGKLRYTFRFSGAGPLNPDADAIIRGNNIQLEYVSRQQVHADRPNLVEVKSAQREGAANIGKCPPPPQVPITELGWRHSNGVSASREQLMMVLADLDALLIKMSYMRECSQASLVSASLDTADAYGTGEGALDVEQCQCPAGYIGSSCE

SEQ ID NO: 134924 - protein, 173 aa, Heterodera glycines
  Coding regions on vcDNA: vcDNA=SeqID_61347; Strand=+; Position=1 -316,369-573
MCGSMCPPALAKLLGWHRAKGGQRGQRPESFLTAYEMEQLPVMLNELEKANRHFWQMVCWRWSQNEQKAAAERSAKKARHQQQMQQQQQQQETTSGEPSPKDKRKGCPDDSYVNGCALRELVRLMAKTMCEKGTFDARTETMLTEFRARILGQRNASMRETMGKESKAERRRK

SEQ ID NO: 134925 - protein, 94 aa, Heterodera glycines
  misc_feature (81)..(81): Xaa can be any naturally occurring amino acid
  misc_feature (90)..(90): Xaa can be any naturally occurring amino acid
  Coding regions on vcDNA: vcDNA=SeqID_61348; Strand=-; Position=1 -49,1000-1063,1177-1345
  Homolog annotation: Hit_ID=NP_608830.3; Match level="QueryCoverage =70%, HitCoverage=46%, E-value=6e-30, Identity=89%"; Hit description =CG3058-PA [Drosophila melanogaster] gb|AAF51017.2| CG3058-PA [Drosophila melanogaster] gb|EAL34050.1| GA1
FMNIINFKFAKSPIITEVPDFNKMYELYDPVTAMFFFRNKHIMIDLGTGNNNKINWPMHDGQELIDIIETVYRGARKGRGXAVGQLKDRXKNPR

SEQ ID NO: 134926 - protein, 84 aa, Heterodera glycines
  Coding regions on vcDNA: vcDNA=SeqID_61349; Strand=-; Position=1 -124,166-293
MTVIGDLSTQKQLKNAVGNGAAEFTQRRKKGKYSPNSTECEESPLVPNGRLFHVGQRILRALLLLRHACHSDHLFGGGPQTVGQ

SEQ ID NO: 134927 - protein, 123 aa, Heterodera glycines
  Coding regions on vcDNA: vcDNA=SeqID_61350; Strand=+; Position=1 -81,130-417
MVHMHRLVGNQPHSGGSAFFTSENVELVNQSMGTNGHCSVGVAPHNFGSFGQPTNVMAFSSGQAMASGMDNPIVLMGQNFSADQMEVGPGRTAETNEETTGAFRMLFKCPECGLVKNSNGELE

SEQ ID NO: 134928 - protein, 64 aa, Heterodera glycines
  Coding regions on vcDNA: vcDNA=SeqID_61351; Strand=+; Position=1-192
MANFTIRSSIEIERTRKSTPMVAAMSGSNLSSTNRAIRLDFPTPLSPKEKYKKTWTMELFHEPM

SEQ ID NO: 134929 - protein, 132 aa, Heterodera glycines
  Coding regions on vcDNA: vcDNA=SeqID_61352; Strand=-; Position=1 -133,175-311,353-478
  Homolog annotation: Hit_ID=AAH74233.1; Match level="QueryCoverage =100%, HitCoverage=64%, E-value=5e-53, Identity=75%"; Hit description= RAB18 protein [Xenopus laevis]
MAATIGVDFRVRSISIDDRIVKLAIWDTAGQERFRTLTPSYYRGGQGVILVYDVSNRPSFENLDHWLLEVDTYCTKSDTVKMLVGNKIDAERRMVSREEGLQFAKKHRMLFIEASAKTREGVQCAFEELVEK

SEQ ID NO: 134930 - protein, 171 aa, Heterodera glycines
  Coding regions on vcDNA: vcDNA=SeqID_61353; Strand=-; Position=1 -165,440-613,889-1062
MQYNACKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMEISDG

SEQ ID NO: 134931 - protein, 79 aa, Heterodera glycines
  Coding regions on vcDNA: vcDNA=SeqID_61354; Strand=+; Position=1 -230,372-442
IVKNIRKLFSVLIMLYNAFKPRREAGQFQNFVPHFTVESPSTLLDNYVSMSTVAFGQLWNGKMGISDGVRSFLKIPLFV

SEQ ID NO: 134932 - protein, 402 aa, Heterodera glycines
  Coding regions on vcDNA: vcDNA=SeqID_61355; Strand=+; Position=1 -59,105-660,703-1203,1250-1339
  Homolog annotation: Hit_ID=NP_001004509.1; Match level="QueryCoverage= 99%, HitCoverage=27%, E-value=6e-53, Identity=32%"; Hit description =si:busm1-180o5.3 [Danio rerio] emb|CAD60788.1| novel protein similar to DNA polymerases [Danio rerio]
MEDYSPGSMNKEKFIKFEKWYNENKETPFYLDEELKNYCRNDTEILLLSIIEFRRILINDITKGFDPLPRSCTNAGVAMNIFKALFLLTEQLSIVPEKGYERCDRASVMAIKYLEWRSKRDGIEIRHAGNGREVKVGNYKLDGFIANEGGRDKCIEVMGCYIHGCLNCYDPAAELIGGRTAQELNDETQERLMELRKTLDVEEVWGCQIEKELKKDEEMRDFFDDRGNEKGPIDPRMAYAGGRTGPMKLFAKSDEKKKISVYDIVSLYPSVNYGTAYPIGLPEIIIPKSDEIDVNWTRPEDLKYKGLYKVRVNPPRGLRVPVLQLKCDDRLLFPLCWRCASKFKKETTRCNYNCPHDETQRRYVATYTSVELAKALECGYSVDRFYRAWHYEEEADDLFKGY

SEQ ID NO: 134933 - protein, 71 aa, Heterodera glycines
  Coding regions on vcDNA: vcDNA=SeqID_61356; Strand=+; Position=1 -120,176-271
MDYETVPKWGDGDDGSMGRRKFGRFEHCRLYVFPCQGMRWAFVSTSKMVSNYVKVIYAFEKRSIILDYNDE

SEQ ID NO: 134934 - protein, 59 aa, Heterodera glycines
  Coding regions on vcDNA: vcDNA=SeqID_61357; Strand=+; Position=1-322
KVRSPLFHSNFRVLNRFKNRFKCFSEPNFKLFYRSQHLRKPIKVFLCDFEPIPYSAILP

SEQ ID NO: 134935 - protein, 375 aa, Heterodera glycines
  Coding regions on vcDNA: vcDNA=SeqID_61358; Strand=+; Position=1-8,59- 331,377-797,864-1135,1827-1980
  Homolog annotation: Hit_ID=AAL78214.1; Match level="QueryCoverage =36%, HitCoverage=71%, E-value=5e-10, Identity=31%"; Hit description =putative esophageal gland cell protein Hgg-20 [Heterodera glycines]
MNPWICNDVLMDILPFFERVELGLKMALLSPRFDGLVDKHFDGKSELTIWRPILIHKYNVAVLSVSIDNTNSMPFPLPNHSLHNKIRFNNLLIKYIDHSVIAFLRANKQIWNKGTNLWLSVPFARDDQPIWGVFVREIWPIFAPYIRHLNIYNDGLLLDNLRRFISPTILTDLNINSISSAFLPDATDDFDEPNAIPTAGQMLSKWLHIPRKDGQPKRLCCMLASAGDVNNFKEEFLNATTSVSYKIKFIVNPPSPQIVPFELANERTMEKLTLIKKSGHPQEDRWIMKRCQNGATATTDQWEDGDLDDLNTVSFVFFPVKGCIGRKELHINNNEQRTATKLCIRPICPFNNIQIRRSFLNYFSLPNISTVERMA

SEQ ID NO: 134936 - protein, 127 aa, Heterodera glycines
  Coding regions on vcDNA: vcDNA=SeqID_61359; Strand=+; Position=1 -96,452-534,762-882,935-1018
  Homolog annotation: Hit_ID=CAE74530.1; Match level="QueryCoverage =95%, HitCoverage=24%, E-value=7e-22, Identity=41%"; Hit description =Hypothetical protein CBG22284 [Caenorhabditis briggsae]
GSTGPPKAVGLTHYQLINGCRIAAQAIDIKRETVLCCALPLFRIPVFALAIFTPFLIESRCSTLLTNATALRLLLKTSPLTQGQKFSLPSIDTVILLGDRVSTDLLTAIESVMPNAKGIAVILIEIT

SEQ ID NO: 134937 - protein, 41 aa, Heterodera glycines
  Coding regions on vcDNA: vcDNA=SeqID_61360; Strand=-; Position=1-193
TKLRFFQLYNMDQQQKIKTKRNKVKLEHDGALYVFDQLSAD

SEQ ID NO: 134938 - protein, 31 aa, Heterodera glycines
  Coding regions on vcDNA: vcDNA=SeqID_61361; Strand=+; Position=1 -49,190-235
FISGQDVFAWPFSRGRFRVVAYKREFITHIY

SEQ ID NO: 134939 - protein, 99 aa, Heterodera glycines
  Coding regions on vcDNA: vcDNA=SeqID_61362; Strand=+; Position=1 -143,205-361
MRKYQILCKFTDVIWPQGMSDEAKKQMAKDYGEKNSETAKNPCSKPRRMGRMFEMRVYGRVGNPHTAKPRREHTWRYSPYKAHYDYADYYSDGSVDFYY

SEQ ID NO: 134940 - protein, 62 aa, Heterodera glycines
  Coding regions on vcDNA: vcDNA=SeqID_61363; Strand=+; Position=1-185
RFSLEARAHQLLAIARLHCYEFSNFYANCVPNLLSEFGRENGLGEQSRTKLEKALAHSLFKV

SEQ ID NO: 134941 - protein, 53 aa, Heterodera glycines
  Coding regions on vcDNA: vcDNA=SeqID_61364; Strand=+; Position=1 -48,398-511
MSENDLARDGDDGVGLFRHLSPNDYEISVPSRRLAYFSEFSSQKVKFCLKKCK

SEQ ID NO: 134942 - protein, 58 aa, Heterodera glycines
  Coding regions on vcDNA: vcDNA=SeqID_61365; Strand=+; Position=1 -63,573-686
MGCKMCVLTLFLGNRKSYAFATRTVLKILVSVRIVLIILKHTRTVLKILENVRIVLKI

SEQ ID NO: 134943 - protein, 990 aa, Heterodera glycines
  Coding regions on vcDNA: vcDNA=SeqID_61366; Strand=-; Position=1 -446,489-1500,1545-3059
  Homolog annotation: Hit_ID=NP_001004509.1; Match level="QueryCoverage= 50%, HitCoverage=34%, E-value=4e-75, Identity=34%"; Hit description =si:busm1-180o5.3 [Danio rerio] emb|CAD60788.1| novel protein similar to DNA polymerases [Danio rerio]
MAMRDERTKNFRICVQYSRKHSMLIWRDSCLIMPIALAELKKTFNLDCEDKPFFPYAFNRRENDAIRLENLPDESEYEPGTMKADKYEKFKKWYNDNKETPFFLPDELRAYCLNDTEILLKALVKFRQILMDEITDGFDVLPISCTIASACMNIFKVQFMQEDQIAMVSELGYERNDRASVIAIKYLDWRAKSEGIEIQHAGNGREKRWKQFKLDGWIERQQRCIEVLGCYWHGCEKCFKPNEELVDGKTCRELNETTHDRLRQLREPDDNGICLQVEEVWECEINDQLKKNDEMKEFFDDLGNERGPLDPRLAYCGRRTGPLRLFAETAEDEKISVFDIVSLYPWVNYDTDYPVGVPTVVHPSAEEMIVNWTKPEHLSYRGLYRVRVIPPRGLQIPVLPMKIDERLLFSCCHRCAALFRKSVTRCSHKCNHTDQQRAFTGNFTHIELEKALEMGYIVDRFWRAWHYAEWSDQIFKGYVRQFIRLKVESSGFPEGIETLEQKQEYIDEYRRIYGVDLDFGHIKKNPGLRFIAECNESCKPCDYHFVESMDGEHTGSTDWAGGTWISKSKEQALTFSKEAKMETACNGKPIRLSDQSFGILEDEYLKIVNDRGLGKRAIQEEQLAVQLTAGQLATSRSIAQLFSKECRRSSRGGNPTIQARRLLRRKDVMARWLNEDTMQIFSCAEFSMQNVDYQAVNNCYRYIPVQIRIDKKTLNAFLDPELHILTASSPFADCGNFRYHYLQLSQSNWIKIDTRTATIQKIDSSSISEIHEASGDKSLLEITPLVFHRWTIDNETGEGLFAHLDEWLRLDQWKSKEKEHKTARALTLGALPNGVIGLTEEWFMEKLRLLVSYWTTACCIYVTFIFGRDVLIPLVWVYLMGPVIVTIRNLVTGNQWTQRNRATRGTRRAPAISRIEAIELVPPPMPQEMRANETASSQQEDPEPSPLVMDLKRQMVAFRSKRRFQSRGNVATERQPRMSVERTNGEDGEE

SEQ ID NO: 134944 - protein, 55 aa, Heterodera glycines
  Coding regions on vcDNA: vcDNA=SeqID_61367; Strand=+; Position=1-167
PTPPFTPFFPSSFPVCPNFLIISSINHSSFATSFIPPRPPHLSARRTFAADVQSR

SEQ ID NO: 134945 - protein, 18 aa, Heterodera glycines
  Coding regions on vcDNA: vcDNA=SeqID_61368; Strand=+; Position=1-56
YREATPEGFGLPINLGAS

SEQ ID NO: 134946 - protein, 115 aa, Heterodera glycines
  Coding regions on vcDNA: vcDNA=SeqID_61369; Strand=-; Position=1-933
GKLEQAGQPKLTVYTLHLATPEELRFSAGLFPVHSPLLRESSLVSFPPLTDMLKFSGCSRLSSGRKIKAGMPVIQALRHSMQSIGALELRSVKRELEPQVRASTPKPHSRAEQVT

SEQ ID NO: 134947 - protein, 158 aa, Heterodera glycines
  Coding regions on vcDNA: vcDNA=SeqID_61370; Strand=+; Position=1 -125,192-308,662-768,825-951
  Homolog annotation: Hit_ID=NP_871861.1; Match level="QueryCoverage =98%, HitCoverage=35%, E-value=4e-27, Identity=43%"; Hit description =carboxylesterase, type B family member (49.3 kD) (1A647) [Caenorhabditis elegans] gb|AAO38636.1| Hypothet
PIFFTQENIAFFGGDPENVTLFGQSAGAACIDLLSLSPLAKGLFKRIILMGGNACTDWSMTTPERTQQAAIRMARKGGWKGADTDLDSLLTFMRSVPAYKISAPLIGKSAFNRHKKGLDFCPVIDGELITKSPEQMRRELDWPLEVIVGGTESEALLF

SEQ ID NO: 134948 - protein, 15 aa, Heterodera glycines
  Coding regions on vcDNA: vcDNA=SeqID_61371; Strand=+; Position=1 -36,398-409
MKKIIKKNNAGVKML

SEQ ID NO: 134949 - protein, 87 aa, Heterodera glycines
  Coding regions on vcDNA: vcDNA=SeqID_61372; Strand=-; Position=1-629
IIFIQKKFFFGFRGSTLNRCAQIYGETESFGNSFPIACTLILRWIFAPHNCLSTPNGHLKKSIYFCFRGSPPEPMRPDLWGDRILRE

SEQ ID NO: 134950 - protein, 68 aa, Heterodera glycines
  Coding regions on vcDNA: vcDNA=SeqID_61373; Strand=+; Position=1-206
FLPGGTQFFTLTTPALFFFNYFFHFITQRSRLIRSSPNFAGKLLRTLQMLINFLRIFCLEEHSSSHLP

SEQ ID NO: 134951 - protein, 42 aa, Heterodera glycines
  Coding regions on vcDNA: vcDNA=SeqID_61374; Strand=+; Position=1 -43,656-741
MIAYNLSSKTKRQSEEQDCVNIRHIQLRRSISCIFRIIPQEF

SEQ ID NO: 134952 - protein, 71 aa, Heterodera glycines
  Coding regions on vcDNA: vcDNA=SeqID_61375; Strand=-; Position=1 -51,298-462
MLLFEFGFVEFETCRNCALRWADEKCRQNGIECSSGNRRSVLGPALFKIRFPNIHEEDFAKCVGKNFEIGN

SEQ ID NO: 134953 - protein, 90 aa, Heterodera glycines
  Coding regions on vcDNA: vcDNA=SeqID_61376; Strand=+; Position=1 -72,266-466
MLKQEFLSVALSGSTSESGYDPIQGFDKICIILLKNNKISYSSEDSPGFSLLDCKKMPVIRARRHRDQVGIFLRSGPNHVFFKRIRMPTK

SEQ ID NO: 134954 - protein, 253 aa, Heterodera glycines
  Coding regions on vcDNA: vcDNA=SeqID_61377; Strand=-; Position=1 -88,138-406,447-670,725-902
  Homolog annotation: Hit_ID=NP_507525.1; Match level="QueryCoverage =95%, HitCoverage=25%, E-value=2e-85, Identity=63%"; Hit description =pre-mRNA splicing factor (109.2 kD) (5S521) [Caenorhabditis elegans] emb|CAC14407.3| Hypothetical protein
MEGLEKIEKSEDLWLEAIRLHPPNVGKNIVANAVRALPHSVKIWLKAADLEADLKGRKIVLLKALENNPSSVRLWKAAVDLQGPEDARSLLTRAVECCPLSTELWLALAKLETYENAQKVLNKARENIPTERMIWIAAARLEETRGQAKRVPLLIDRALISLRSAQVEINKKQWLEDAVECERADCPLTSKAIIQNVLAVGVEDEDRKHTWMEDGEWFITQGALQCARAVFSFYAEHISRKRKESGRKQRSLN

SEQ ID NO: 134955 - protein, 272 aa, Heterodera glycines
  Coding regions on vcDNA: vcDNA=SeqID_61378; Strand=+; Position=1 -124,296-434,535-724,831-1016,1122-1300
  Homolog annotation: Hit_ID=CAE71390.1; Match level="QueryCoverage =82%, HitCoverage=22%, E-value=2e-25, Identity=33%"; Hit description =Hypothetical protein CBG18297 [Caenorhabditis briggsae]
MDEDKLALKNGQKDDTGGRESENSDKQGEQFAEDNFDTNPLVEKGVMQKSLIDNAFDVFECASQNLNCLLANAEMSAIKFDQFIKVVEFRTFGRQYFGNPCQLIRHTLMDQSRKYIERYHAEKMEEVKMFLESETFTLCPVPVQFTLFDLPEFFFLKELQQKQQNDEQTEEETEQNSVETFVHGKSIRFSVFRHSSEMDTEIFPYSPEQFDESPRRIGDRRRMICKNGEVSQCSSSDDGTRNSIEDESLAPSPHNAMPNLCNSALNLLRVIG

SEQ ID NO: 134956 - protein, 92 aa, Heterodera glycines
  Coding regions on vcDNA: vcDNA=SeqID_61379; Strand=+; Position=1 -159,278-393
SLAAVFDLGDASFGCVAAKIILFQSILKQISATDWTTGEIHSQHSPYVDTIVQECSQFKQKFVRLFPYVHISDELYAAIWSMLLLCIFRILV

SEQ ID NO: 134957 - protein, 113 aa, Heterodera glycines
  Coding regions on vcDNA: vcDNA=SeqID_61380; Strand=+; Position=1 -82,131-221,273-608
  Homolog annotation: Hit_ID=CAE71390.1; Match level="QueryCoverage =63%, HitCoverage=7%, E-value=6e-14, Identity=47%"; Hit description =Hypothetical protein CBG18297 [Caenorhabditis briggsae]
CSIEGRALQLLDVEQLCGELEEITGLRPLPHRPFVENFVKAFYLPFGELQNWMVNHTEYSLSQTSAILNAAAGAAAISSSSVATNSRKATMSRIMANLLDAGGIGEGGNSLFQ

SEQ ID NO: 134958 - protein, 165 aa, Heterodera glycines
  Coding regions on vcDNA: vcDNA=SeqID_61381; Strand=+; Position=1 -96,166-288,419-508,559-675
  Homolog annotation: Hit_ID=P21250; Match level="QueryCoverage=100%, HitCoverage=60%, E-value=4e-27, Identity=42%"; Hit description =Immunodominant antigen Ov33-3 precursor
NKLFVNGHFTKDLSEDEQEELKQYQEQLDQFKSEVKTYLEERQKQFRNQSEVKTYLEERQKQFRNQVARQGGAEAKEGGTQLKKPEPPKKPSFCSDKATTQYVFDGCSVQGDNVYIGDTFVRKLSPVRKLSPDEQKELAQFDQKFTAYQKAVTAGFRKVENCFGK

SEQ ID NO: 134959 - protein, 297 aa, Heterodera glycines
  Coding regions on vcDNA: vcDNA=SeqID_61382; Strand=-; Position=1 -277,977-1080,1589-2101
MPPKRKNIYLESYEKEFRHIKKSRKGEEFALCVVCNDDINLLSIGKSAISLHQKTGKHQKAAKAANRSIPLQEFMPNTSAPSTEDRKVLAAEGRAMDIEAVIFKMAGHFKNSTKRIEELKGFCEELESFYTSVLAYLDKWHRIDRFPEKLQWVALAYRKIPHDDALALARQIAPELTNDLFDDVSEANQILNSFPNDEFQKLTPEQKWKKLFEADLPNLLKLVSVVLSVPVSNAFVERVFSLCGSQWTDKRNLLQVETVKALVQTKVNYDLSCPQMYQMLISNHKLSEKIGGWEKYF

SEQ ID NO: 134960 - protein, 393 aa, Heterodera glycines
  Coding regions on vcDNA: vcDNA=SeqID_61383; Strand=+; Position=1 -381,801-944,1675-2015,2781-2910,2949-3134
MTISAWKFSNISITRKFQKILLCIILFVNVSRLGTDREVRSSSSGRIFQVRGSGATSLVQSPTARVGGGACTMLTRLQQQQQQMRRCVGGATSAASPTTVATAAVRQDSADEASMGSVSTVASGGAVQQQRFKMRRPKSTGQIIIQQQQQMVEAQNHHQRKKMSENHQQHAVVMQDRGSVGTAGTGQSGGSGSLSLAPVIAGAGAVRGGAHAQHNHQCNSNNNNNNSNSVSAYNTVNTAYDPSYTSATVYSDSITCLHAPGVLQSGGGVIGAGGGASSCADGITDQRRGRLIEPVKSFRMISRLFDSVNNFKSYIDSKLAQTELARSVERPSLINRYFLAGKTGIKPGLFPGQNQDLGTQLYAFFNTRCRSRTTLILTNSKILKTNYKLNMGL

SEQ ID NO: 134961 - protein, 121 aa, Heterodera glycines
  Coding regions on vcDNA: vcDNA=SeqID_61384; Strand=-; Position=1-366
MIDDDISEMELVNEEELNYELKEEKSEENGEKLMIKTKKQKIKHFNDPLEITKLRIEFEEKMEKLCQKIKENAKKEKAKLEKALKNAANNEDEKRHLNNEYDDKFGTFNSSPFSQKISGTF

SEQ ID NO: 134962 - protein, 230 aa, Heterodera glycines
  Coding regions on vcDNA: vcDNA=SeqID_61385; Strand=-; Position=1 -231,767-886,936-1053,1124-1347
MFMALPDDLLSRFPVPAAFRKLSPAQQRRVHQIYYSKRIGFDEKMRELGRLINQLSTDQQRRLMPIRPVEEEQKPKKSRARLVGVFLKQSYQLDPDNFPLPLNGDSHEIEDDIRNLGVRLMFGQSPFDRTDIFKVKLDKLKHAFSKRTQKEDKQTKATNEAALDCVEEAENAWIDRLEMFPEAKLFEFRHNDNSALTAQKSGSLFGNLEKLFAAINGTVHMDWNSNDFSS

SEQ ID NO: 134963 - protein, 160 aa, Heterodera glycines
  Coding regions on vcDNA: vcDNA=SeqID_61386; Strand=+; Position=1 -13,439-704,760-963
MFCPLNRKSRLFKYSANLAKWTIFYRLSLISTETEGGRAQWVGKGCGEAAIIGPKADNSYHLYHMGRKQTLLRYSPYSNAVNAKRTQRLLATKFKAFHRQGAPEDERRSVFRAVERVSAHGLGSAAQHRLGRIFGTHFSHRSPIFCQIYIGFNILSKKGF

SEQ ID NO: 134964 - protein, 105 aa, Heterodera glycines
  Coding regions on vcDNA: vcDNA=SeqID_61387; Strand=+; Position=1 -146,217-329,1090-1148
MSQLNIWCSMAAVFYRQINWITSFLLTDRSVKGKSAYKYELKINLKNGGYGLECLASFGVIVSHLKPLNLSELELSALNGIQLWNCTAFDGTAELMSSHEVFWPK

SEQ ID NO: 134965 - protein, 75 aa, Heterodera glycines
  Coding regions on vcDNA: vcDNA=SeqID_61388; Strand=-; Position=1 -196,801-832
MTIMISIGQWMMHIIWHQIDRLRHIANFLINYWIEFRLTDYPLALSHYQCCVHDYVPLGDSLKNSEIFIRIKFLY

SEQ ID NO: 134966 - protein, 165 aa, Heterodera glycines
  Coding regions on vcDNA: vcDNA=SeqID_61389; Strand=-; Position=1 -106,154-379,426-500,559-648
  Homolog annotation: Hit_ID=NP_501266.1; Match level="QueryCoverage =96%, HitCoverage=33%, E-value=2e-32, Identity=53%"; Hit description =Succinyl-CoA synthetase (4I495) [Caenorhabditis elegans] gb|AAA83304.1| Hypothetical protein C50F7.4 [Cae
YAEYVVKAQILAGGRGKGHFIGCPKNGGGIRITKSVEKAKSYTEGMLGKRLVTKQTGDEGVVVKKAFIRFPRFVFVSLLIFFAQVMVAESITIRRETYLSVLMDPTSAGPVVVACPLGGVDIEEVAATQPVLILKERISVFDGITEGQCQKIAQFLGFSGKTAAK

SEQ ID NO: 134967 - protein, 24 aa, Heterodera glycines
  Coding regions on vcDNA: vcDNA=SeqID_61390; Strand=+; Position=1-73
PQFGKTQVNGQKSGKINEYNRRKR

SEQ ID NO: 134968 - protein, 64 aa, Heterodera glycines
  Coding regions on vcDNA: vcDNA=SeqID_61391; Strand=-; Position=1 -60,759-893
MPKTETITKPCATAKMNKSAIFIQVIIISLFNSIACVIYVSMQFVRISKIYIIVGTYAWVFTSG

SEQ ID NO: 134969 - protein, 59 aa, Heterodera glycines
  Coding regions on vcDNA: vcDNA=SeqID_61392; Strand=-; Position=1 -51,414-542
MCQQKQKHCRLMGLLAMNYDDGQQQQQLLEQKSENNFDLHRQWHQQQQQQYQQQQQVVN

SEQ ID NO: 134970 - protein, 133 aa, Heterodera glycines
  Coding regions on vcDNA: vcDNA=SeqID_61393; Strand=-; Position=1-402
MSFDSKFESCAIACSAFDPHLAWTKTCHPAPVGQPACLIEFRNGKLIVDGACPSLYAGLQTSLNTPNDVSSLNGSVSCLLCHGIMSVVELLRNESVAIIKEEIGHYCDYLLALRSVCKGIISDFILDNLVQSH

SEQ ID NO: 134971 - protein, 163 aa, Heterodera glycines
  Coding regions on vcDNA: vcDNA=SeqID_61394; Strand=-; Position=1 -217,275-454,505-597
  Homolog annotation: Hit_ID=CAE72860.1; Match level="QueryCoverage =85%, HitCoverage=11%, E-value=3e-51, Identity=65%"; Hit description =Hypothetical protein CBG20159 [Caenorhabditis briggsae]
MVSGNGKLSLDSFLTKNCTGCCRYLNYGDPAWKEATRKCLASLNTFSDEVRRNFEHTIEWLHEYACSRSFGLGTKLPWDPQYLIESLSDSTIYNAYYTVSHLLQNDIYGAETGELGILPPQLTDAVWDYIFMGIPYDSTKMPIEEAKLKRMRHEFEYWYPVDM

SEQ ID NO: 134972 - protein, 182 aa, Heterodera glycines
  Coding regions on vcDNA: vcDNA=SeqID_61395; Strand=-; Position=1 -39,81-236,409-507,610-677,728-804
  Homolog annotation: Hit_ID=NP_491993.1; Match level="QueryCoverage =87%, HitCoverage=37%, E-value=1e-48, Identity=56%"; Hit description =sec14 -like 2 (43.8 kD) (1H585) [Caenorhabditis elegans] emb|CAB07482.1| Hypothetical protein H06O01.3 [C
WGGRMMDPNGLPRCPSKIRYGLGPVPDSFCPSKIRYGLGPVPDSFFVDPSQAMPDYDQLTTVYAGDKHLIELKVKANTRIGWQYLTEEEDIGFAVYFDPSGNANNLTEMDCVFPYIRLECSQVPISGSLLCEQSGRYIIEFDNYYSWFSAKQLRYNIIIEFDNYYSWFSAKQLRYNIEIDDR

SEQ ID NO: 134973 - protein, 60 aa, Heterodera glycines
  Coding regions on vcDNA: vcDNA=SeqID_61396; Strand=-; Position=1 -9,128-301
MISVDEKGCEAGAATIVSMPTGFAYNPPPPPVFRADHPFAFFLIRSKKEVLFNGAFVGGK

SEQ ID NO: 134974 - protein, 80 aa, Heterodera glycines
  Coding regions on vcDNA: vcDNA=SeqID_61397; Strand=-; Position=1 -156,204-290
  Homolog annotation: Hit_ID=NP_503318.1; Match level="QueryCoverage =75%, HitCoverage=16%, E-value=2e-09, Identity=43%"; Hit description =patterned Expression Site PES-21, Serpin (srp-2) [Caenorhabditis elegans] gb|AAB71270.1| Serpin protein 2
MELEKTFNLSIANKIFLNESFTILEEFNQTLSKYYQGNFEQIDFGKREEAANEINAFVENATNGKIPKMINPEFLDGRPV

SEQ ID NO: 134975 - protein, 237 aa, Heterodera glycines
  Coding regions on vcDNA: vcDNA=SeqID_61398; Strand=-; Position=1 -97,143-399,1978-2167,2243-2410
MIINQQLKHLLVLTVFKTIILLLSIKFIDASPEFNAADVCRAIDRSAQFHSLCLRSSVVQQKGFIPKHLRPPWLDSSLFEDNKLKAEEKMSANGCYACYSGTKASNGTNQDEDYCACVGRVHEMRGLQLNMAGQAVQWRDPRGAHLYTEQHQLTWQPTELKSISANGKVNIAFQYPQTTGPQFSMNLLNAIYRNCCADASSTQNTVLSPISAAIALAMAYAGARGQTAAEFVNLLAD

SEQ ID NO: 134976 - protein, 123 aa, Heterodera glycines
  Coding regions on vcDNA: vcDNA=SeqID_61399; Strand=-; Position=1 -163,460-540,803-930
MDANAIHSLTLPRDATARKPFEDGHPKQHVVHVAYFDHFTANLRGHHATSATWHIALVAARGADSKRRDWFWPAQKNGHLLDASQMFVPLPSELVPFVSLFSFDDQIEANFGLNFEFDLSNLC

SEQ ID NO: 134977 - protein, 46 aa, Heterodera glycines
  Coding regions on vcDNA: vcDNA=SeqID_61400; Strand=-; Position=1 -19,633-754
MRKTEKSLLHHFTLFTRIHNERIIYYKINQTDWDDSSPFFISNIPL

SEQ ID NO: 134978 - protein, 55 aa, Heterodera glycines
  Coding regions on vcDNA: vcDNA=SeqID_61401; Strand=+; Position=1 -63,273-377
MTNKIILCTIIALAFLTKIDQVLSLCVVSAVRGATLLEGIASFANLFSFRLHVVS

SEQ ID NO: 134979 - protein, 191 aa, Heterodera glycines
  Coding regions on vcDNA: vcDNA=SeqID_61402; Strand=+; Position=1 -306,357-627
WICSDVWMDILPSFDHAQLGLKLALLSYRFDALVDTHFDGKSELTIWRLIRIRKDTSGPKPKICVTLDENNNDIDDDDNFVDFPFSDRQLPNKNCFKSLWIEYIDHSIITFLHSKKRIFDRSGTNLYLSVATDFQPIWNAFVRQIWPIFAGSIRHLSFDAGDPLDNLRRRISPTFLTDLNRFWCSVTRRYC

SEQ ID NO: 134980 - protein, 31 aa, Heterodera glycines
  Coding regions on vcDNA: vcDNA=SeqID_61403; Strand=-; Position=1-99
KLRTSKVFSSRLPPIHLHILKHGFGSYFIFN

SEQ ID NO: 134981 - protein, 41 aa, Heterodera glycines; identical to SEQ ID NO: 130306
  Coding regions on vcDNA: vcDNA=SeqID_61404; Strand=+; Position=1 -301,462-871

SEQ ID NO: 134982 - protein, 108 aa, Heterodera glycines
  Coding regions on vcDNA: vcDNA=SeqID_61405; Strand=-; Position=1-327
MNCTGTAKTIGMRAGVEVQLGKPHNHAPSPTRCEAAKINRSVRNTALSSRGNMPRTVVNECLAGASNEVIASLPLIPSMEKAVSRVRHAAGGQFQIPKTLADIEIPAV

SEQ ID NO: 134983 - protein, 78 aa, Heterodera glycines
  Coding regions on vcDNA: vcDNA=SeqID_61406; Strand=+; Position=1 -93,416-556
MGRKLPAELLFEMVLCVRREHAHASICLSSLAFFKLKENYQDAIAAGQDWNFVRQTARDDIACNNVMVALDRLMDVPQ

SEQ ID NO: 134984 - protein, 17 aa, Heterodera glycines
  Coding regions on vcDNA: vcDNA=SeqID_61407; Strand=+; Position=1 -39,295-309
MEKACKIWRDYIDNYWS

SEQ ID NO: 134985 - protein, 74 aa, Heterodera glycines
  Coding regions on vcDNA: vcDNA=SeqID_61408; Strand=+; Position=1-512
FISIFSESALKHTKLYLQVSLGTLMLFLSKREMNKIFNSFLNRPKSLGLTFFSETDQKRTKLCRDTERKSNNLF

SEQ ID NO: 134986 - protein, 67 aa, Heterodera glycines
  Coding regions on vcDNA: vcDNA=SeqID_61409; Strand=-; Position=1 -24,161-340
MASMSDCLAQNQFPGIFKGADCKFELGFAQFRTPEPNSNKSCEIFSKRYVETGQILAQIAHFVQLII

SEQ ID NO: 134987 - protein, 31 aa, Heterodera glycines
  Coding regions on vcDNA: vcDNA=SeqID_61410; Strand=+; Position=1-94
MPFVLCPNYALGERQNFLGRQSAKFNGTGSE

SEQ ID NO: 134988 - protein, 294 aa, Heterodera glycines
  Coding regions on vcDNA: vcDNA=SeqID_61411; Strand=+; Position=1 -130,752-890,994-1162,1674-1891,2177-2405
  Homolog annotation: Hit_ID=XP_314273.1; Match level="QueryCoverage =74%, HitCoverage=42%, E-value=5e-21, Identity=29%"; Hit description =ENSANGP00000018635 [Anopheles gambiae]
MANEIGQLANRRRAFITRGGDYEELMEMNSEREKLRRKLRSLAEHHIYDNKLGFFNGISLSLLVAKVMLLYPMASLPFLIEKFFFTFSTWPWPTPVKLSNLPDGSALRWNPSEEKQKRSEIGYGIAAELAMPIVTPGHIEQNATFNFSHFIRINCKAFALADFYDFCGYVETRIRLQLLIDVERFDRIRLAHAKQIVEKEQILGENLDGSTANKKNHKKNVFFKIWLVGLELDEQIASENESESTNNWNNWKEALNSMLSEQFNAVILKAYRTKNGFSGPLVHIQLTAQYEQKH

SEQ ID NO: 134989 - protein, 212 aa, Heterodera glycines
  Coding regions on vcDNA: vcDNA=SeqID_61412; Strand=-; Position=1 -92,163-709
MASQISKILPTLLFIAAAFLLNFGCCQQNESQTTETLRARNASSSPQFPLNTTTFTTTKKETTVATPSTTEAGTEAATTDDTNDEQSLLFWILIGSVSFCSTLFTAIHFSPTIFSVIVAIVLFLVLLVCIVCCMRGGSQKDARETVNGESGGAVTKLTMNGDNADSSSASQSASEPDEGWFVPDSLPNNTMTDLAKVNARLAQGKKQQAPKQ

SEQ ID NO: 134990 - protein, 85 aa, Heterodera glycines
  Coding regions on vcDNA: vcDNA=SeqID_61413; Strand=-; Position=1 -59,137-202,500-634
  Homolog annotation: Hit_ID=CAE71615.1; Match level="QueryCoverage =96%, HitCoverage=47%, E-value=3e-33, Identity=81%"; Hit description =Hypothetical protein CBG18577 [Caenorhabditis briggsae]
GEKFPDENFKEKHTVPGLLSMANAGPNTNGSQFFINTVKTEWLDGKHVVFGRVVEGMDVVKQVEAQGNQSGKTANDCPSFRCSFR

SEQ ID NO: 134991 - protein, 156 aa, Heterodera glycines
  Coding regions on vcDNA: vcDNA=SeqID_61414; Strand=-; Position=1 -192,332-418,550-678,740-802
  Homolog annotation: Hit_ID=NP_611208.1; Match level="QueryCoverage =89%, HitCoverage=60%, E-value=8e-21, Identity=36%"; Hit description =CG4802-PA [Drosophila melanogaster] gb|AAF57869.1| CG4802-PA [Drosophila melanogaster] gb|AAO49165.1| GM0
MTHFPPLAPHRTTKREQTFYDGLPGHPPGICHMPMHPALNERLRRALLATATRLGAAHSDRGVLAVLAKELGIPYASVAVVTDYDCWRDTAEGVSIALVGETMRKNAQLMQKFFVEAISEIAGHKEQFVAEAQKAKQLAAASVMEGEHKLNFDHLC

SEQ ID NO: 134992 - protein, 101 aa, Heterodera glycines
  Coding regions on vcDNA: vcDNA=SeqID_61415; Strand=-; Position=1 -42,514-777
MKAILIFQSLTILTRGICRFIICLFKFILWDPIGAEKMHFFPAIANLYFVGVYSRNVVPHILIVERILATVFVRSYEHWRGYLFTIIWAPIAVRNFCIFKY

SEQ ID NO: 134993 - protein, 16 aa, Heterodera glycines
  Coding regions on vcDNA: vcDNA=SeqID_61416; Strand=-; Position=1-50
MITFFCSASSNDSIRP

SEQ ID NO: 134994 - protein, 45 aa, Heterodera glycines
  Coding regions on vcDNA: vcDNA=SeqID_61417; Strand=-; Position=1 -76,172-230
MEELQLNMPYRVQPHFGDTQELLGRGMHPVPKSVDTAEPLRAEND

SEQ ID NO: 134995 - protein, 58 aa, Heterodera glycines
  Coding regions on vcDNA: vcDNA=SeqID_61418; Strand=-; Position=1 -134,249-291
MTEYDLPTPRPIRAVERELPGSRQSTATVGIRAESPQRAQHAFYSTHTDQVASYNPIE

SEQ ID NO: 134996 - protein, 57 aa, Heterodera glycines
  Coding regions on vcDNA: vcDNA=SeqID_61419; Strand=+; Position=1 -64,109-218
MDQSESAHYTDFSESDESALKLDIWNSNPKYPCCSSIIPSALSGEPAPPLAPKLKLN

SEQ ID NO: 134997 - protein, 42 aa, Heterodera glycines
  Coding regions on vcDNA: vcDNA=SeqID_61420; Strand=-; Position=1 -73,565-620
MSLDARTSLKMSIWKSGKNNQRKFESTARAIIDNKHSFNFYH

SEQ ID NO: 134998 - protein, 34 aa, Heterodera glycines
  Coding regions on vcDNA: vcDNA=SeqID_61421; Strand=-; Position=1 -58,350-396
MAKKESKNGGTNEQQQKKHATSGMGSVLEWQGRP

SEQ ID NO: 134999 - protein, 128 aa, Heterodera glycines
  Coding regions on vcDNA: vcDNA=SeqID_61422; Strand=+; Position=1 -37,89-249,460-648
MAKATHARWAKKAAPQPDTDAEKPQPSEEGPSTSEATAQDNDGQPSSTPTPVTPLEMDVPSVEMMVVGRYSHLGTQEKIVEKLVKHTTMLNALHDRGVENNKENDKYPDFDQIFTSLLFIFTLIFRKI

SEQ ID NO: 135000 - protein, 17 aa, Heterodera glycines
  Coding regions on vcDNA: vcDNA=SeqID_61423; Strand=+; Position=1-53
MKKVMAYQNKQSKMHGS

SEQ ID NO: 135001 - protein, 92 aa, Heterodera glycines
  Coding regions on vcDNA: vcDNA=SeqID_61424; Strand=-; Position=1 -141,1564-1701
MEQYNARENSEIKSEARFGFSGLDLATKTAFNKFPTDQSKVLTRTIKAKSENKMRKRKPIPAAHPKMLDSCLCEFLWREDCKRRGADTFDDI

SEQ ID NO: 135002 - protein, 164 aa, Heterodera glycines
  Coding regions on vcDNA: vcDNA=SeqID_61425; Strand=+; Position=1-492
MSSIPAAVSANLIVRSPICADMSIMQFSFSKDDSSSTIGGRETPAASKSISGTASASAPSKKAPSSLSVSNGGGAKAASVVASGTVPKSKSVVGKNAKSSPAADPLDLVRASGQRTNTRLLERDALEAFVKTVDPNELLEDEVADAIGLVVEEFVDELIRHSVD

SEQ ID NO: 135003 - protein, 51 aa, Heterodera glycines
  Coding regions on vcDNA: vcDNA=SeqID_61426; Strand=-; Position=1 -82,473-546
MKRIQQNFSDQIGVSSISTLKKDNRFAILYTRVSRYCDWIEKNTDGEVKCL

SEQ ID NO: 135004 - protein, 270 aa, Heterodera glycines
  Coding regions on vcDNA: vcDNA=SeqID_61427; Strand=-; Position=1 -83,591-732,899-1044,1088-1529
MGTKGCRNRETSLLAILHLTISNTMHGRRGKWIIPVCHFLLTSKSQASYIRMFELLHQAWPTFAPTSFTIDFELARYCTDSVFAENARMITSVAFVPLCDIRMAVAALDTEFGNLAVFQPLIDWLLINYVGQPRPNGTWSQPTFRPEQWNVYTRTLNADSRTNNHSEAEHHRLQGAFNCRHPSIFHFIDVLSREQKTTDVKYASFIAGEEPPPKKRKFLATDERILNLVRLYVPMNAGNINHDHNYHNRNQFHIILEFLRGISRNYRMNP

SEQ ID NO: 135005 - protein, 28 aa, Heterodera glycines
  Coding regions on vcDNA: vcDNA=SeqID_61428; Strand=+; Position=1-86
VKINRNSRVHSIVARNSPEKLQNNVKLI

SEQ ID NO: 135006 - protein, 81 aa, Heterodera glycines
  Coding regions on vcDNA: vcDNA=SeqID_61429; Strand=-; Position=1 -22,324-361,426-514,790-816,895-954
  Homolog annotation: Hit_ID=NP_499087.1; Match level="QueryCoverage =96%, HitCoverage=16%, E-value=4e-27, Identity=77%"; Hit description =putative membrane protein of ancient origin (51.8 kD) (3K560) [Caenorhabditis elegans] pir||S28281 hypoth
IKLTNMIIHLDEETLLSINSNGILNFCEDGRHQFGQGVITYAQGEIVNWITTLSDSFRVADDVADDMGKLRFQFKVHKPLF

SEQ ID NO: 135007 - protein, 278 aa, Heterodera glycines
  Coding regions on vcDNA: vcDNA=SeqID_61430; Strand=+; Position=1-837
  Homolog annotation: Hit_ID=NP_011103.1; Match level="QueryCoverage =85%, HitCoverage=20%, E-value=4e-09, Identity=22%"; Hit description =DNA dependent ATPase/DNA helicase belonging to the Dna2p- and Nam7p -like family of helicases that is invo
MQAPPGTGKTDVATRIMLSILKENDEARVLFIAPMNVAVVRAVQQMAENMEEVRWRERMLALFAGTGKAKYRDEIAHIGSHLLASAVSAPQLLDTLDEEKKKVVARYVKACQDTPKMANEGKVTEILMGKEKRRLVFCTLSLAEQLGGLFSDFDYVFLDEAGQASTVQVLSMLSKFPGLKKLLITGDEHQLGVNLQEVPEAVRDKCGLDTVLENLRVAESVDKTVLSVNFRSHPVITKCVEAAAYAPHGIQLISGRSADQMNMLSGLTGSGSHPQGFP

SEQ ID NO: 135008 - protein, 171 aa, Heterodera glycines
  Coding regions on vcDNA: vcDNA=SeqID_61431; Strand=-; Position=1 -84,820-993,1038-1157,1206-1343
MPWVWHSAGQGRRRQQQQQQQQQQHYGSSCPLRVRGIPCRRKLPTNLTCDSCGQTVEKPVKNIYLKIVLQDLDDSTCTQRATIFSAVAEAFLGLKAIDVHEMEEQKLYEHFEAKLGTTINAKVTIKEDSQNFFGLDWVVTRIYKSSEKKIGDTEKKAVENEGTSSKIARLD

SEQ ID NO: 135009 - protein, 96 aa, Heterodera glycines
  Coding regions on vcDNA: vcDNA=SeqID_61432; Strand=-; Position=1-291
MEEAPDKAGERNFHRICRRSQRRGRKATAEHWEPWAEEGMPWDVPWVGVGMPWDVPWVGVGMPWDALKDTIPRLGFVRGDTVPLDFEHFVVPFLSN

SEQ ID NO: 135010 - protein, 49 aa, Heterodera glycines
  Coding regions on vcDNA: vcDNA=SeqID_61433; Strand=+; Position=1-151
GSCMVDHEKRTEGNDTTDKREQRKQRGKVIGNGFTVPIENSDKHRTGQC

SEQ ID NO: 135011 - protein, 170 aa, Heterodera glycines
  Coding regions on vcDNA: vcDNA=SeqID_61434; Strand=+; Position=1 -23,237-627,1081-1179
MKAINLESFATIGFATKEVPLDGSIGQILNSYGYRNDGSFGCNGINRPCKMPFGQMPMSLFGIPSSFSPVAMPSADVTMAYKSSEFSTGDVVGCGLFLDTQLIFLTKNGRRMGGPIKFKKHFKMTHRFSFLLPPILFSFCKKMSQLWTTGNGICVMIMNSKMLMTEVFLF

SEQ ID NO: 135012 - protein, 176 aa, Heterodera glycines
  Coding regions on vcDNA: vcDNA=SeqID_61435; Strand=-; Position=1 -201,277-468,526-663
MARKKRKPRFAKYGKVDGRWRFGLYKRKYNILLGPALEGVQNLLVTAYHEAAHAIKYGQNNIDILDKVTIQAQGGNLGETSWHDVEGLYTDEERFAQIVQFMGGRAVELLMFHNAQGDEQDVEDARAVAIQVLELREMEPTDELIANLIQQATNTATQVLTNNERRLKRVRTTFKN

SEQ ID NO: 135013 - protein, 151 aa, Heterodera glycines
  Coding regions on vcDNA: vcDNA=SeqID_61436; Strand=-; Position=1 -53,184-586
  Homolog annotation: Hit_ID=NP_001005317.1; Match level="QueryCoverage= 72%, HitCoverage=36%, E-value=7e-14, Identity=40%"; Hit description =si:busm1-173m20.16 [Danio rerio] emb|CAD59047.1| SI:dZ173M20.16 (novel transposase) [Danio rerio]
MTQMIYQSIRLDELCTKNHDAFVLLRQSSVWEAFEGGQIQGIILVDSAYPTRRWLMTPFANPTTAAQQQYNYAHAKTRVIVENAFARWKRRFHILHSEVRIKLQNVPTLITAAAVLLHNIAIDRKLPDFLVALRNLFYFSFLFMSKIDKSF

SEQ ID NO: 135014 - protein, 128 aa, Heterodera glycines
  Coding regions on vcDNA: vcDNA=SeqID_61437; Strand=-; Position=1 -215,274-443
MEDLYEKCLKNSRPIHRKMEENLYDIRVLDVKAKLAENELRQKMTQMANTWKKTGKDERKRKYEEIEEQFAKANDLCNEKIQLAESTYEMVDSFIQKLDKETSSFNAFVKRSKRTAQSTPGTSKENIA

SEQ ID NO: 135015 - protein, 224 aa, Heterodera glycines
  Coding regions on vcDNA: vcDNA=SeqID_61438; Strand=+; Position=1-674
  Homolog annotation: Hit_ID=CAE69179.1; Match level="QueryCoverage =82%, HitCoverage=12%, E-value=2e-10, Identity=27%"; Hit description =Hypothetical protein CBG15212 [Caenorhabditis briggsae]
TSSAWRHDIDTAGDGDSQSAALKRSKLHLLCGGGDGLTTERESGGNSEFDEEEGEGSDDYDSYGLASDDDMSPSSNNLSDDDEDDELSAESDDGGDNSDEEELERLLGGGAAAIDGDAVPLANDGDNASFEQPEEEVEVNPFCMDLAVEDPWASVQKKQSVESGGGKSQQQSLDKQRAATVAAEAEKQRRLQRRKRKREAAAKRKRQQRQMQEALIKATVSNIT

SEQ ID NO: 135016 - protein, 42 aa, Heterodera glycines
  Coding regions on vcDNA: vcDNA=SeqID_61439; Strand=+; Position=1 -10,218-307,388-416
MKICKLCHPIFAICIVSVPISPYFVPTSCGRTPEYSYTILQG

SEQ ID NO: 135017 - protein, 132 aa, Heterodera glycines
  Coding regions on vcDNA: vcDNA=SeqID_61440; Strand=+; Position=1 -135,583-846
MQLCWDLVIFLHFLLAANRLLIFMKASFKPSILNKEPKSEQILFNYRKKSSDGKTAKKFVLNKQEWRILGQSVAMFVLMAFIVAIWDLVDLLSWVLPDGLILLSDFFFLLFCGISPILYLCTLPYVLGATFN

SEQ ID NO: 135018 - protein, 38 aa, Heterodera glycines
  Coding regions on vcDNA: vcDNA=SeqID_61441; Strand=-; Position=1 -48,98-166
MIGCNNFLAASFRVKMKCLPLQRDCTHVEGQFFGNEDQ

SEQ ID NO: 135019 - protein, 117 aa, Heterodera glycines
  Coding regions on vcDNA: vcDNA=SeqID_61442; Strand=+; Position=1-466
PKNGYLFFLIFLPQTWYQQLPSLVWPYQTILRYLKRKQKKFLTKNGYLFFLIFLPQTWYQQLPSCLALSNNLTIFETQTKKILDQKMAISFFSFFYRKLGTNSCLLLSGPIKQSYDI

SEQ ID NO: 135020 - protein, 81 aa, Heterodera glycines
  Coding regions on vcDNA: vcDNA=SeqID_61443; Strand=+; Position=1-246
MRTTVIKRGTTVIRRGTTVIKRGTTVIRRGTTVIKRGTTVIRRGATMIRRSATVIKRGTTVIRRGTTVIKRGTTVIEEVQL

SEQ ID NO: 135021 - protein, 39 aa, Heterodera glycines
  Coding regions on vcDNA: vcDNA=SeqID_61444; Strand=-; Position=1 -33,146-232
MAFPQRSSLTEKTAPSASRLLLRMNSPLFQLEQPEEEIN

SEQ ID NO: 135022 - protein, 333 aa, Heterodera glycines
  Coding regions on vcDNA: vcDNA=SeqID_61445; Strand=+; Position=1 -93,429-482,536-595,639-716,762-877,997-1251,1567-1718,1882-1929,2045- 2188
  Homolog annotation: Hit_ID=CAE66009.1; Match level="QueryCoverage =85%, HitCoverage=23%, E-value=2e-51, Identity=37%"; Hit description =Hypothetical protein CBG11201 [Caenorhabditis briggsae]
MNSTSSRSHAIFTIILTQREHDTITDLDTEKEGANINKSLTTLGMVIKKLAEQSTKKGRHSRTAVIPYRDSVLTWLLRENLGGNSKTAMIAALSPADVNFDETLSTLRQETHSYGNYVMVNCSVKDMRTVPNKLGSVQTAEHVAKLWSGGWQNKDENGTVPSHSPEICQVDENGDISSSTRVFSGREEETLEQIKTSEKLIAELNESWEDKLKKTEAMKVGRSEADQRPDILLSGEHIRNAHCQFINADAVVNIVPIEGECFLNGQPIEDPQEVRTSRHNLAAIAKAGHRPEAGDAQKSVGDGATVSQGNGTDGKGTPKTEQCKSKGITRNDC

SEQ ID NO: 135023 - protein, 108 aa, Heterodera glycines
  Coding regions on vcDNA: vcDNA=SeqID_61446; Strand=+; Position=1 -69,174-296,648-782
  Homolog annotation: Hit_ID=AAM09703.1; Match level="QueryCoverage =58%, HitCoverage=32%, E-value=3e-12, Identity=52%"; Hit description =glp-1 [Caenorhabditis briggsae]
MDKENCKKAGCEAKYGNHRCDSECNLFACQFDGGDCSTKQAQPFGKCPQASYCSHVFADGKCDETSVPVDKFNRTDSDHFAPVVWLLFGAFTSSRKSKWSVSQILINF

SEQ ID NO: 135024 - protein, 78 aa, Heterodera glycines
  Coding regions on vcDNA: vcDNA=SeqID_61447; Strand=-; Position=1 -117,232-348
DGLGLVSLDQSRTGLALTSLDQKLLRTGWAWSALINQGQAGWDAKKNRRMVGLIMRKAIEKLEDKNNDGLMASISEDE

SEQ ID NO: 135025 - protein, 16 aa, Heterodera glycines
  Coding regions on vcDNA: vcDNA=SeqID_61448; Strand=-; Position=1-49
EAIPEGFGLPINLGAS

SEQ ID NO: 135026 - protein, 122 aa, Heterodera glycines
  Coding regions on vcDNA: vcDNA=SeqID_61449; Strand=+; Position=1 -63,226-360,907-1077
  Homolog annotation: Hit_ID=CAE66288.1; Match level="QueryCoverage =54%, HitCoverage=33%, E-value=1e-14, Identity=59%"; Hit description =Hypothetical protein CBG11535 [Caenorhabditis briggsae]
MSVDETIRELSGTLTQLKILVGKINEQISGVSARINITLQNFDDSVAGIATDANQMTKQVDTTIDQERRRRFNRWSNPSQSSRFTRNKFQPFITGTFQQKATSRLRVGVLNGSTDAVHATKQ

SEQ ID NO: 135027 - protein, 129 aa, Heterodera glycines
  Coding regions on vcDNA: vcDNA=SeqID_61450; Strand=-; Position=1-731
  Homolog annotation: Hit_ID=XP_453844.1; Match level="QueryCoverage =48%, HitCoverage=35%, E-value=9e-09, Identity=50%"; Hit description =unnamed protein product [Kluyveromyces lactis] ref|XP_453838.1| unnamed protein product [Kluyveromyces la
VNADQIRQLCPFPLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 135028 - protein, 42 aa, Heterodera glycines
  Coding regions on vcDNA: vcDNA=SeqID_61451; Strand=+; Position=1 -53,207-282
MGEEEEEEDEADEQRMTILCAFECYQKDSVCSNMNKVIVFIV

SEQ ID NO: 135029 - protein, 54 aa, Heterodera glycines
  Coding regions on vcDNA: vcDNA=SeqID_61452; Strand=-; Position=1-163
MRGLRTTTSSSAWRRRRAPPCCCCTAANPAQIFMPGHIWAECLSTDWQCRIGLA

SEQ ID NO: 135030 - protein, 339 aa, Heterodera glycines
  Coding regions on vcDNA: vcDNA=SeqID_61453; Strand=+; Position=1 -213,565-771,1116-1715
MDEAEQTMMNNEDEQNCSDQPIVQRTTQDEYVVSEDWPNANNVGTKKARKSETTTTRRTSVKLTAGQKALEAFSFQRLRSAAGPSSTTIETSAVDHLHTEPQQRQQQRTFADQQIQNEHNFGLADQIILPKNEPPNSQNSQQYYYDSAADDCCCPSTAAEDEAVAAVGFEFVGTSAAAADDEEWGCTSPPISSQQPISQCFSVVTNTSAATTSCSQMTQQFIYDEEHDEFGDEIDDNDDEAATALSSSSSFRPQQIVHVDMDVLRTNFAHRCEQQRRQRREHNNLLRQSCGGNDDGGTRLHVVTTSAGIMSSGSQEEEREEDNASVEQRLSMMLKLVNH

SEQ ID NO: 135031 - protein, 108 aa, Heterodera glycines
  Coding regions on vcDNA: vcDNA=SeqID_61454; Strand=+; Position=1 -118,574-662,733-852
PLPQAVPPKRRSVGCSSSTICCCWPVIGALSFAAPPVPESPQRCVELCCASQAEKDALFDIVWKVIHHETNSKNSAETLAKNTNNNSSNTEQQQQNKSCAHCDTDFGW

SEQ ID NO: 135032 - protein, 66 aa, Heterodera glycines
  Coding regions on vcDNA: vcDNA=SeqID_61455; Strand=+; Position=1 -7,726-840,917-995
MKNNLRGAAVINSPRPKPSFCASNPFSGLIVRRSASMGDARIRQMTAHNRTTENGQNEKDEMAEKN

SEQ ID NO: 135033 - protein, 50 aa, Heterodera glycines
  Coding regions on vcDNA: vcDNA=SeqID_61456; Strand=-; Position=1 -108,326-370
MMPRVDLIWVDMEKVLNEENSVTPEFKPYGTCAAMKDLFSEIKILHLALI

SEQ ID NO: 135034 - protein, 86 aa, Heterodera glycines
  Coding regions on vcDNA: vcDNA=SeqID_61457; Strand=+; Position=1 -92,340-465,641-683
  Homolog annotation: Hit_ID=CAE66990.1; Match level="QueryCoverage =98%, HitCoverage=40%, E-value=6e-18, Identity=48%"; Hit description =Hypothetical protein CBG12388 [Caenorhabditis briggsae]
MKDLMAVGKKMFGCTRKCMSSKAGNCEKSLRCGLNLPPDNVLVQQVKRCAINSGLNTANAKAMCKCASAAGVKNLTPAVCAKIRVT

SEQ ID NO: 135035 - protein, 92 aa, Heterodera glycines; identical to SEQ ID NO: 127421
  Coding regions on vcDNA: vcDNA=SeqID_61458; Strand=-; Position=1-304

SEQ ID NO: 135036 - protein, 92 aa, Heterodera glycines; identical to SEQ ID NO: 125147
  Coding regions on vcDNA: vcDNA=SeqID_61459; Strand=-; Position=1-304

SEQ ID NO: 135037 - protein, 36 aa, Heterodera glycines
  Coding regions on vcDNA: vcDNA=SeqID_61460; Strand=-; Position=1-108
MIGRAVRNRPFIFEGIFKFILYPRKMAISFFDKFYT

SEQ ID NO: 135038 - protein, 121 aa, Heterodera glycines
  Coding regions on vcDNA: vcDNA=SeqID_61461; Strand=-; Position=1-368
  Homolog annotation: Hit_ID=NP_702721.1; Match level="QueryCoverage =100%, HitCoverage=13%, E-value=8e-21, Identity=41%"; Hit description= hypothetical protein [Plasmodium falciparum 3D7] emb|CAB62842.1| hypothetical protein [Plasmodium falcip
DDRDSKADDGEPKADDRDSKADDGEPKADDRDSKADDGEPKADDRDSKAYDRDSKADDRDSKADDRDSKADDGEPKADDRDSKADDGEPKADDRDSKADDGEPKADDRDSKADDRESSVKN

SEQ ID NO: 135039 - protein, 105 aa, Heterodera glycines
  Coding regions on vcDNA: vcDNA=SeqID_61462; Strand=-; Position=1 -48,240-387,761-882
MPTNALHSNRANSIYLPLVYVLQRVNSAEFQPLINTAPIENNLYGGIASIEGNINSDLSLIVLDTASSLTYIALAYAIRRNFQIDTNFAYELMAAGNARNTTLGR

SEQ ID NO: 135040 - protein, 66 aa, Heterodera glycines
  Coding regions on vcDNA: vcDNA=SeqID_61463; Strand=+; Position=1-198
  Homolog annotation: Hit_ID=NP_494571.1; Match level="QueryCoverage =100%, HitCoverage=6%, E-value=3e-16, Identity=59%"; Hit description =AdaPTin or adaptin-related protein (apt-5) [Caenorhabditis elegans] gb|AAK73904.1| Adaptin or adaptin-rel
MLRIKLSVVPGPLLSVFVQNIAKLYTFQLCKLEADDDWDGIESLDNLLTSKLPEYQYTDHLEAQER

SEQ ID NO: 135041 - protein, 244 aa, Heterodera glycines
  Coding regions on vcDNA: vcDNA=SeqID_61464; Strand=+; Position=1-735
MVQAEAISEREGGVALAAATKNALSERGSEVEQQHQQVVVMARGGTISNGDGARAKAEATGGAKSVVETRITEHHGEERLAAATAVIHREERREERRRKIRVRNRDRQQGGEERQRGEGHRQSRPNERHNDNFHSSLQLNLPPNRMDRKEQEEHMHHSRDGLMGQSNNQQGEERQQGGGGHRQYRPTESHNDNFHSSLQLNLPPSRLEGREQEERIHHSRDGLMGQSNNQQMRKRIQRECFCTC

SEQ ID NO: 135042 - protein, 124 aa, Heterodera glycines
  Coding regions on vcDNA: vcDNA=SeqID_61465; Strand=-; Position=1 -44,101-431
MKDIVLEHYDHDGQIDDALYFADYDDTFVFSGSSRSIRVAFPQIGRNTSADLYTYQAHKDYRPHYVKGRIRPGMETLPFGFRNAQQQTRHRTEQDDEEETNDDDDDNDDLDQDRLSNLPGCSHW

SEQ ID NO: 135043 - protein, 962 aa, Heterodera glycines
  Coding regions on vcDNA: vcDNA=SeqID_61466; Strand=-; Position=1 -406,450-2707,3653-3877
  Homolog annotation: Hit_ID=NP_507780.1; Match level="QueryCoverage =41%, HitCoverage=26%, E-value=8e-24, Identity=25%"; Hit description =predicted CDS, DNA polymerase type B, organellar and viral family member (5T899) [Caenorhabditis elegans]
MANRNPFSIESVHEMRNRPRNTRGEVAQVRFVPLEQVQRPDRVLEMLVEQLFARVLGDRPPPSLIGLQLHPPTFENPFTIALRPPEQKNPAAIADYIQRLNDQSAAGIDLTAGTTLTKVLAVWPMHDDRTGNGREGACSWDHEHSVVHTVNSLVRIRNPNDRLCLARAVLIGLKDHRSRQYQNTRAGQQMFKNYVGQQRFHGPDARHLLRRAGIKTNKNMYTLDDVRQLQQWVDERYEEAQIRLTVFEKVRQYRIVFKGASGRAACFNLCLLLENAHFHYVGRIEQLFRCTSYCVDCERRVTRWYHPQECKVVCRLCLRYGANYPCQQQQFANGRNSKHFCTQCQFVFPDLDCYNYHLSNRAPATLDGRSGRAFRSICEWRRVCRACGGIVYTNFQHVCPPSVRQQQQQQEQQQQQQQQQFASLCHQCGGPHAEDGPCFIQPMDGRRVFGQTRRQQKQQQQQQQSSVENCLNGNDDAADKEDDTDDDNDAEGESQHGAGGGGHRRQASQKTIRYCFFDAETSQDRPLQLRTQIPQKHVPLLIIAQVICERCIADRITIYGGIGQKANGCVCGMPSGPRGRLWCSPPFRNAPNDDTEMPTNITYNPRRLFFHCFEDATKNPVDQFLDFLISTGPRKSHTICLSHNGGKYDMHLVLEALHHRNLPPKRICTTGLKIYSMSLKGNLQRQITFKDTLNFFFCELDALPRTFNLPNEIATAKPFFPYLFIRHQNLNVRLQGLPNAVFYQPDHMKTAKREQFLSWYAYEGAVAKFQLREQLIIYCANDVAILRESVLKFRQLIMENTMGLDPFVIASTGAALALATFRRCFLSRNKLINTPEGGYLRGRRASAESARYIRMYELMNPGVHVQSAQWTVGEAHVEDSGYRLDGLHVWHYDEWDAEMFRGYMNTFVGMKVQASGWPTGCESEERRDDYIDEFERAEGIRLDRGKIANNPGLRMVAVTCLE

SEQ ID NO: 135044 - protein, 119 aa, Heterodera glycines
  Coding regions on vcDNA: vcDNA=SeqID_61467; Strand=-; Position=1 -245,465-579
MPPSENFSNISLDFNDLEARPLPEPQQPEQQQAELLIQILDVEEALLFNVHEGEERGEEEEEDEEEEEDFVQFEELMRLHADYSERLKKFANDQVEKAMSEIEEEKKQKKKPKKQHNKK

SEQ ID NO: 135045 - protein, 42 aa, Heterodera glycines
  Coding regions on vcDNA: vcDNA=SeqID_61468; Strand=+; Position=1 -78,110-160
MGEQNILIRLRIYRYKNSQSLNKFDIALSPYAKIFSLNLMPF

SEQ ID NO: 135046 - protein, 19 aa, Heterodera glycines
  Coding regions on vcDNA: vcDNA=SeqID_61469; Strand=-; Position=1-59
TFAFSSLALPNTHTIFEML

SEQ ID NO: 135047 - protein, 19 aa, Heterodera glycines
  Coding regions on vcDNA: vcDNA=SeqID_61470; Strand=-; Position=1-59
TFSFSSLALPNTHTIFEML

SEQ ID NO: 135048 - protein, 19 aa, Heterodera glycines
  Coding regions on vcDNA: vcDNA=SeqID_61471; Strand=-; Position=1-59
TFSFSSLALPNTHTIFEML

SEQ ID NO: 135049 - protein, 19 aa, Heterodera glycines
  Coding regions on vcDNA: vcDNA=SeqID_61472; Strand=-; Position=1-59
TFAFSSLALPNTHTIFEML

SEQ ID NO: 135050 - protein, 19 aa, Heterodera glycines
  Coding regions on vcDNA: vcDNA=SeqID_61473; Strand=-; Position=1-59
TFAFSSLALPNTHTIFEML

SEQ ID NO: 135051 - protein, 19 aa, Heterodera glycines
  Coding regions on vcDNA: vcDNA=SeqID_61474; Strand=-; Position=1-59
TFSFSSLALPNTHTIFEML

SEQ ID NO: 135052 - protein, 19 aa, Heterodera glycines
  Coding regions on vcDNA: vcDNA=SeqID_61475; Strand=-; Position=1-59
TFAFSSLALTNTHTIFEML

SEQ ID NO: 135053 - protein, 24 aa, Heterodera glycines
  Coding regions on vcDNA: vcDNA=SeqID_61476; Strand=-; Position=1-72
MVTHAYSELANKILHRNGMNLECT

SEQ ID NO: 135054 - protein, 160 aa, Heterodera glycines
  misc_feature (4)..(4): Xaa can be any naturally occurring amino acid
  Coding regions on vcDNA: vcDNA=SeqID_61477; Strand=+; Position=1 -251,625-721,788-830,1059-1109
  Homolog annotation: Hit_ID=NP_499087.1; Match level="QueryCoverage =61%, HitCoverage=21%, E-value=2e-36, Identity=73%"; Hit description =putative membrane protein of ancient origin (51.8 kD) (3K560) [Caenorhabditis elegans] pir||S28281 hypoth
GIIXLNIKIKLKTRYFSPKFSHFVGQNFSFFSPFTFWDFLQQRRRWLQGIYLTVHSKFIPLRCKILLASSLYAWVTMPLTTLQIFLSPFFPLPRSFLFDFLVVFVGAVNLYMYIFGVIKSFSHKYRCGILVIKSFSHKYRCGILRPKMFLAPPPLKILPF

SEQ ID NO: 135055 - protein, 182 aa, Heterodera glycines
  Coding regions on vcDNA: vcDNA=SeqID_61478; Strand=-; Position=1 -110,168-606
MARCVTSLAFLPIGDLTPGIIALDMALPDELTPVLDWFIMNYTGRLKHDGSRTRPRFDPNIWSVYTRTLQSDDRTNNHSEAANRRLQCAFACSHPSIWRFIDLLRKDQKLSDDDFAKCSTGQEPPQKAKKYRKADRRILTMVQNYLPLNNGDPNTFPLHQPFNHQFIIAFLSGISRNYEMIP

SEQ ID NO: 135056 - protein, 309 aa, Heterodera glycines
  Coding regions on vcDNA: vcDNA=SeqID_61479; Strand=+; Position=1 -658,718-988
  Homolog annotation: Hit_ID=EAL30669.1; Match level="QueryCoverage =71%, HitCoverage=18%, E-value=2e-14, Identity=28%"; Hit description =GA20021-PA [Drosophila pseudoobscura]
RQSNRTAPTQKKPKDEPTEKEENQQKASTPDKKKQRPTNGEPPARRERAREPPHAPAKADGSDPKPRQQKSADDTAESSNEIRSLVAEPRKDTTDNNTTNAAFTDSEEEGEDSSCGVGFMSCASLATPSSAECASAPKRRRVILSSDDEEEKMMGNGQRKDQKGDETENEPQRQATKRKRRDAAKEAKERTPPSVARVPRDEIQTTPSAKCAHSFINSFSIDSPNASSVQLPFSSLQIQPKNLKNRNKNDQIAESANDGDEEAERFPHLDFDFLRTEKIKDAKGRKPNHPEFDERTLFVPEHFLKSQTP

SEQ ID NO: 135057 - protein, 122 aa, Heterodera glycines
  Coding regions on vcDNA: vcDNA=SeqID_61480; Strand=-; Position=1 -150,204-419
MAPLFHRFSSLFVLLMPFLSVVLLPSTVCTGSDSAAAPFDRKNYPKIDLRLFEWPIASHSGSSAEVSFIAVDCYTQLDRSFISTDAVLRLNNSLALRHRACLLRIPTGTRLTVTEMQTTNRK

SEQ ID NO: 135058 - protein, 150 aa, Heterodera glycines
  Coding regions on vcDNA: vcDNA=SeqID_61481; Strand=-; Position=1 -30,225-394,871-1102,1411-1433
  Homolog annotation: Hit_ID=CAE73354.1; Match level="QueryCoverage =95%, HitCoverage=24%, E-value=2e-37, Identity=55%"; Hit description =Hypothetical protein CBG20786 [Caenorhabditis briggsae]
HAKMLLKFSKCVAATVCDVSSKEHRKEKPEALHTVELLRVASTALGLSPAQTMAVAEHLYTRGYISYPRTETTAYPDSFDFVGALRELAKGQRFVDTAIQLLREGIARPRGGTNKGDHPPITPMKAADGWLSGGARRATEFCERQIVLTR

SEQ ID NO: 135059 - protein, 121 aa, Heterodera glycines
  Coding regions on vcDNA: vcDNA=SeqID_61482; Strand=-; Position=1 -4,1069-1164,1563-1672,1987-2141
  Homolog annotation: Hit_ID=NP_496822.2; Match level="QueryCoverage =86%, HitCoverage=12%, E-value=2e-39, Identity=68%"; Hit description =TOPRIM and DNA topoisomerase I (2N691) [Caenorhabditis elegans] emb|CAB60424.2| Hypothetical protein Y48C
MRWNGACSVSEYKASFRGKQANFRVTSTCGHVMCVDFPARYNSWDRTDPAELFLCNIEQKEANPKLKMPEFLASEAKHCDMLVLWLDCDKEGENICFEVVDAVRPAMRGAGGANFMDAAVF

SEQ ID NO: 135060 - protein, 51 aa, Heterodera glycines
  Coding regions on vcDNA: vcDNA=SeqID_61483; Strand=+; Position=1 -109,600-646
MTFLCDYFLHVMAYLKIAFPYFFNAERWELLETEVFVHCFILFGYTVLELC

SEQ ID NO: 135061 - protein, 74 aa, Heterodera glycines
  Coding regions on vcDNA: vcDNA=SeqID_61484; Strand=+; Position=1 -37,91-182,347-442
MVKVNFVDQLFAGIVGIANSIERFGGPFPSLDVFGLNRHDPNYANRVMKEAAAIVDDCCDSQLSTAADINMLSV

SEQ ID NO: 135062 - protein, 206 aa, Heterodera glycines
  Coding regions on vcDNA: vcDNA=SeqID_61485; Strand=+; Position=1 -396,440-664
  Homolog annotation: Hit_ID=NP_507780.1; Match level="QueryCoverage =84%, HitCoverage=12%, E-value=1e-09, Identity=26%"; Hit description =predicted CDS, DNA polymerase type B, organellar and viral family member (5T899) [Caenorhabditis elegans]
MQHEPADPHFPKRKKHQVNFVTAKVACPDCISTGKWKESLLGKFCKICGYHRTITFSQMPFRETTVDRQTIDRHPLVAFVKWLLYKLPKQYETIAYSHFGGRFDMVLVFRELFMEGLNPSMIRKGNRLFEMRVKSRKNLNPNVTFRDSWNLIPGPLASMVPMFGLDVQDKPFFPHMANKPDNYGCQIFPSKADYLADGMNQRNGTI

SEQ ID NO: 135063 - protein, 281 aa, Heterodera glycines
  Coding regions on vcDNA: vcDNA=SeqID_61486; Strand=+; Position=1-5,56- 503,555-826,887-1007
MCYIDHSVIAFLRSNHQIFDKRGTYLYLWIPSPHNTDGQLIWDIFGREIWPIFSENIRHLGFNDGVDLDNLLRRTSPTILTDLNQLTSIDSCDLSPEAIGGDFDGPNATISAGQALSKWLHSPRKDGQPKRLRCDDYNEQTDLDWINNFKEHFLRANAISSVSYQIHFAVHALSIQIVPFELVNEWTKEKLTLAKAKGWDNRWIMKRCKIIGETAAVNWEDGNWDNNCNSVFVWLFRTDCIGPLSPPPAEEAGQNITKGPSSELTMSDGQTNKNSDQPQKE

SEQ ID NO: 135064 - protein, 69 aa, Heterodera glycines
  Coding regions on vcDNA: vcDNA=SeqID_61487; Strand=+; Position=1 -35,364-538
MDNLLTDFWLINGLTIPAPNLFITFEFAILSGLSVSGTYIMEISFKDVLPLAFKDKAEPFFIIFIFVYF

SEQ ID NO: 135065 - protein, 52 aa, Heterodera glycines
  Coding regions on vcDNA: vcDNA=SeqID_61488; Strand=-; Position=1 -37,251-372
MYRRGNNRQNNPEIYAPVSDFCGFIASVAGSRVKCIDPYNAITMAKRKKVTP

SEQ ID NO: 135066 - protein, 64 aa, Heterodera glycines
  misc_feature (5)..(5): Xaa can be any naturally occurring amino acid
  Coding regions on vcDNA: vcDNA=SeqID_61489; Strand=-; Position=1-911
PFRVXMRHQLHSFLVLPNCLKCIPKNALKMIKPVFSRISCQYFPIRNDTVNSFASLIHSCFASD

SEQ ID NO: 135067 - protein, 271 aa, Heterodera glycines
  Coding regions on vcDNA: vcDNA=SeqID_61490; Strand=-; Position=1 -264,563-635,677-768,889-1217,1574-1631
MVKGNKPKLILKLRQNGGELNKQKEEKEKEETENDQKKEEQEKVADDEQREGKREENWENANKFHWRIIGDEDDEFTLEKEGIEQKQKHVSCPAKSLSIEQIRKKDEKEIPEELLLALLKRLLIEYLKSDLNESGQMSILFTLYYCSIWYLNGIAHKTLKVMERMAPKGSDFEKEVAKLKEHHREMNDNFEFDQRGMTDQQQRAEFVNKSMLIRVFRFLEHIANNKTLIENSADWNAYREEYMEKWVKNRGGKEIKKRKMDFIWLKSTNPN

SEQ ID NO: 135068 - protein, 60 aa, Heterodera glycines
  Coding regions on vcDNA: vcDNA=SeqID_61491; Strand=-; Position=1-180
PGLKCPAQAKKFFYFREKIEIFPKKLPIDRARKTMFWKWSPFFWENSLKIPKIQKPENRF

SEQ ID NO: 135069 - protein, 473 aa, Heterodera glycines
  Coding regions on vcDNA: vcDNA=SeqID_61492; Strand=+; Position=1-1420
MTKKQEAKRKNDQERYRRRTEQSVSPGRSPVPDGSADGNGEASASLRGTTTPSLSALQISTPASSIGSKKRGRPLKAGAKPILATQETVSSIDTPRTAVTQSDQGSPCKKRGKVTECDKPTFANEAIASTPVSTQSRGGRPAKKIGGPGRGKLSDSMSKSSEMDINLENAPIPATSHTVSEKIDFSTVQINFATSRNFACKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPAHWTLIVHDVQFGTHFADSLPTTYGRLDPQLTDKIKNIISDILPSAVLEGIVDVENLTVQHDGNSCGYFVCLYAESWLMNNRTFVLPDLSINYEKKRILWHINELYGSDNVPYHPREGVPTPCPIVYRHADEAQSTSMTVAPMEVDGNDDIMIIEPQTSGQALNVIPTQTQVA

SEQ ID NO: 135070 - protein, 31 aa, Heterodera glycines
  Coding regions on vcDNA: vcDNA=SeqID_61493; Strand=+; Position=1-92
FVAFQNFAQHFLVNLQKSLRFDQSVGIFVNV

SEQ ID NO: 135071 - protein, 19 aa, Heterodera glycines
  Coding regions on vcDNA: vcDNA=SeqID_61494; Strand=+; Position=1-57
RARERAESDASTAVAVRLT

SEQ ID NO: 135072 - protein, 30 aa, Heterodera glycines
  Coding regions on vcDNA: vcDNA=SeqID_61495; Strand=+; Position=1 -47,269-314
MADLKKMKRDTEAEKTSNFMHGVGAVQAQG

SEQ ID NO: 135073 - protein, 28 aa, Heterodera glycines
  Coding regions on vcDNA: vcDNA=SeqID_61496; Strand=+; Position=1-84
MHLPVPLHLRPIVRFLLPLRLPPLLRCP

SEQ ID NO: 135074 - protein, 264 aa, Heterodera glycines
  Coding regions on vcDNA: vcDNA=SeqID_61497; Strand=+; Position=1 -353,898-1111,1305-1532
MWHQWFYRHSIYTKSDSQLEPHEDDKKPPNFNVMPTEQMLIDIFEALINERNWGQLKRQKLAIIYKIGNVLERALHDDPIKTLKCMHNCEGYGPKMMEMVKDFCEKDYNRKWTGEHQNVWRLICDVFIWENWLFNYPMLTEKDLKMFHDKILKLVGRLEKKVEKNTSWIEMNVVDKSVLNIIGQILVARVLIDHSSKTFISFVNYNQSTICNFCANRTSQFSGWEHICVYNMWLFVVGALRNGQARLIIISLFSKIDRQNLIIL

SEQ ID NO: 135075 - protein, 105 aa, Heterodera glycines
  Coding regions on vcDNA: vcDNA=SeqID_61498; Strand=+; Position=1-315
MQSTKAPLLSTTQITPKVREVITTEAPPITTTQTVKIELTTKPRKIEPKVKVETPKSFSKGIQFKRVINEQQIYKIMGIRKGTILTTTIPFISTTQAPKITKPTT

SEQ ID NO: 135076 - protein, 199 aa, Heterodera glycines
  Coding regions on vcDNA: vcDNA=SeqID_61499; Strand=+; Position=1 -163,330-766
MKNIKKGMEKCLDRKDLTMCQELAEEAKQSIEIAKNYRQEIGHIYRTAYSQPDLEKANTILVEAAKKETERAWRDVAALAEEVGDFAKSSRETLNQAIKSREKAPYANGVRELYLKMSDSIWEIFKIEDQINLESVKAESAWREFERCKTFDQATKFEEQAQNSLMEARRLHFESRRVQSQMLNYENRLKTIVWEHVGI

SEQ ID NO: 135077 - protein, 121 aa, Heterodera glycines
  Coding regions on vcDNA: vcDNA=SeqID_61500; Strand=-; Position=1 -58,542-712,768-904
LAVQIDEGNPDSRIAPDEHGWPGYEEWTISEDCENLEQTNEFTELVTVEAIFDLMLNRPIARHLAKIVETSPKYVQVRQKYGLKNTKIMKLDISFVSNTEDRIKRKAVNGLQKFIDNVFKS

SEQ ID NO: 135078 - protein, 158 aa, Heterodera glycines
  Coding regions on vcDNA: vcDNA=SeqID_61501; Strand=+; Position=1 -80,120-220,288-583
MSFEPIGQLPELPTVRYFECKLIGTGCAFGIGFASRKYATHEFVGWAFDSIGFDSMGDVLGLEEFGGPSVLKWWTMGADDVVGAGFSGSSPFFTLNGEILRNISFFFNDFFCLKGIDDVRLDVSHFAFPTVSMIGADTSVLVNTGPIFLFDINQIFMP

SEQ ID NO: 135079 - protein, 263 aa, Heterodera glycines
  Coding regions on vcDNA: vcDNA=SeqID_61502; Strand=-; Position=1 -108,335-442,671-799,1415-1666,2274-2295,2469-2639
  Homolog annotation: Hit_ID=CAF98839.1; Match level="QueryCoverage =23%, HitCoverage=26%, E-value=7e-11, Identity=61%"; Hit description =unnamed protein product [Tetraodon nigroviridis]
QYLLKFFLKFPTVFNMFGCINGGKRRGKGGAKGFCKTGRHNIQGITKPVIRRLARCGGAKRIPGMNYDEIHTADYDNIQGITNMTIKNFARLDGANDIFNMIDEQIWPNDSNFGTDNDWDSIAANLQIDETEEQIELGHDVNSAFLDIGATVEIVGAESDIDDENRSSTFATTSTTSKRAKNTAKQQRKRANKRNKPKPGEIGFTLGWPGYEEWTISEDCENLEQTNEFTELVTVEAIFDLMLNRPIARHLAKIVEACPKYDH

SEQ ID NO: 135080 - protein, 68 aa, Heterodera glycines
  Coding regions on vcDNA: vcDNA=SeqID_61503; Strand=+; Position=1 -25,1728-1909
MAKIVGVLGSSQRGPVNWTPENWTPENWTPENWTPSGKMDTAGILDTKGKLDTGKLDTKISFLKKIKN

SEQ ID NO: 135081 - protein, 19 aa, Heterodera glycines
  Coding regions on vcDNA: vcDNA=SeqID_61504; Strand=-; Position=1 -4,111-166
MKNEFWNPTRVRIHEMRAT

SEQ ID NO: 135082 - protein, 102 aa, Heterodera glycines
  Coding regions on vcDNA: vcDNA=SeqID_61505; Strand=-; Position=1 -257,1347-1398
MPTTVFIDYIMFSVHLTLIRWQFILHGKSNFRFQTNRKRRMEEEKKVLRICNNVSDGKRRKKAIFYEKKGCLEGKNVLANLGFRLWLIEDTLELSNEINNVG

SEQ ID NO: 135083 - protein, 18 aa, Heterodera glycines
  Coding regions on vcDNA: vcDNA=SeqID_61506; Strand=+; Position=1-56
PYRDRDLSFSKYGTGNRD

SEQ ID NO: 135084 - protein, 31 aa, Heterodera glycines
  Coding regions on vcDNA: vcDNA=SeqID_61507; Strand=-; Position=1 -25,640-710
MQQMHFSIVYFYKIMYRYTAVEVKLMPLGHK

SEQ ID NO: 135085 - protein, 16 aa, Heterodera glycines
  Coding regions on vcDNA: vcDNA=SeqID_61508; Strand=+; Position=1-83
KLFVFIYTNLFYIIFS

SEQ ID NO: 135086 - protein, 58 aa, Heterodera glycines
  Coding regions on vcDNA: vcDNA=SeqID_61509; Strand=+; Position=1 -44,363-495
MYLVFSGIHFGLVFRKYNLAKNDFISKNLIEIDMNLFIRPMSTPNTNVEVGTSSNSSG

SEQ ID NO: 135087 - protein, 97 aa, Heterodera glycines
  Coding regions on vcDNA: vcDNA=SeqID_61510; Strand=+; Position=1 -115,406-584
MSWNESLEQNNCELINLDEILKNAGPSGEKPVSLMQVYENTRTIIVQKQLIDFKTRKHILTHPMTDILLQAVAGSKRTLKATPFTRGVKPKMRAQIF

SEQ ID NO: 135088 - protein, 71 aa, Heterodera glycines
  misc_feature (3)..(3): Xaa can be any naturally occurring amino acid
  misc_feature (69)..(69): Xaa can be any naturally occurring amino acid
  Coding regions on vcDNA: vcDNA=SeqID_61511; Strand=-; Position=1 -63,641-738,1094-1151
RHXLDKEFIQKVIEEIRPLYVEAIRDHLNILVKLNFLENDKGFKKDAKNMENLNALENQLIANKACLIXGR

SEQ ID NO: 135089 - protein, 68 aa, Heterodera glycines
  Coding regions on vcDNA: vcDNA=SeqID_61512; Strand=-; Position=1-205
MANDNPWKGNGNDGTNRQNSTGGLISTAFTEEKNEKRKNIEEAEKDEAYPREATTWTEMAKQWPKSTI

SEQ ID NO: 135090 - protein, 97 aa, Heterodera glycines
  Coding regions on vcDNA: vcDNA=SeqID_61513; Strand=+; Position=1 -11,58-340
MNRRWICNDVWMDIFPSFDRPQLGLKLALLSPRFDALVDKHFDGKSELTIWRTIEIRRKGIGPETKLYVEIDYEFVPFPLPDRPLPSKIRFKWLRIE

SEQ ID NO: 135091 - protein, 186 aa, Heterodera glycines
  Coding regions on vcDNA: vcDNA=SeqID_61514; Strand=-; Position=1 -11,73-308,478-788
MNRRWICNDVWMDIFPSFDRPQLGLKLALLSPRFNSLVDKHFNGKSELTIWRKIKIHRKDKGPEPKLSVRIDDKFVPFPLPDLVWPIFSANIRHLRFYDGDHLDHLLRQISPTILIDLNQLTSIHSFDLFPAAIDDGFDGPNSTISAGQALSKWLHSPRKDGQPKRLRCGNYNEQTDFDWINNFKE

SEQ ID NO: 135092 - protein, 67 aa, Heterodera glycines
  Coding regions on vcDNA: vcDNA=SeqID_61515; Strand=-; Position=1 -86,738-857
DLIKEWFTEFVQAHERGSDISGRDGIDMVVKNLPVPVPGSRKNTGLDPGTGRSLNEIILRCMKGPVL

SEQ ID NO: 135093 - protein, 96 aa, Heterodera glycines
  Coding regions on vcDNA: vcDNA=SeqID_61516; Strand=+; Position=1 -157,364-421,602-677
MPNDLPGVDAATDQRSVLFARKSNRASGLEAGEYFALRTWRSQNHRLRLRETGHLASFALLCGPTQCRSAEAVSSMCQVCRGFPKMSLNVLGVLLM

SEQ ID NO: 135094 - protein, 60 aa, Heterodera glycines
  Coding regions on vcDNA: vcDNA=SeqID_61517; Strand=-; Position=1-380
KVRSPLFHSNFRVLNRFKNQFKCFSAPNFKLFYRSQYLRKPIKVFLCDFEPIPYSAIFPR

SEQ ID NO: 135095 - protein, 31 aa, Heterodera glycines
  Coding regions on vcDNA: vcDNA=SeqID_61518; Strand=+; Position=1 -12,171-254
MSLLNRTKGFIWLRIIVGNRHRFGPYAKNSR

SEQ ID NO: 135096 - protein, 1008 aa, Heterodera glycines
  misc_feature (120)..(120): Xaa can be any naturally occurring amino acid
  Coding regions on vcDNA: vcDNA=SeqID_61519; Strand=+; Position=1 -99,454-737,1058-1176,1234-1353,1449-1620,1846-1931,1971-2040,2273 -2399,3126-3329,3384-3509,3607-3744,3808-3961,4048-4223,4401 -4527,4571-4653,4704-4873,4941-5205,5447-5562
  Homolog annotation: Hit_ID=AAF39972.5; Match level="QueryCoverage =99%, HitCoverage=59%, E-value=1e-172, Identity=36%"; Hit description= Drosophila sos homolog protein 1 [Caenorhabditis elegans]
SFRDEETRFMRDLNLLVNVFKRRLSSGIGTDANKDIISNLFGNVHEILELTIKIHRTIDDAIDMSDPPMLGMGLWELAEGCEFDAYVQFMVGGGGTNGEKPKNLNFIFGIISGSLSRTPXQKVGQTADRMYSGTPGGHTFRMTVKYVLPALLHSVVAHFKCYSEFVKLIMEASDHEADRKDLYLIMEASDHEADRKDLYNTDMYLNMVTKRMNDLRGLMSAQVRIARGRIARGMRRDNSRSFQLSAIQRIQRSIDGWEGKEIGYMCNTFIREGKLFQLRGSTTIADNILRNRSGGTERHVFLFDHLLVICKPNKGNFKFKEKLYIGNFKFKEKLYIRRCDIIDLDDDHVKICTSAKAGGNDEYMSMLTLFCQSPEEKEQWMAGMVEMQTAGTLQRMLDAHQKEEEKRIPLIIPTVSEYRYAEPDTDENIIFEDYTHNSGIPVVRAGTVLKLVERLTYPQYTDNEFVKTFMTTFRSFCSYTDNEFVKTFMTTFRSFCSPAELLALLIERFVIPTPHIFMAFNDSASNDSASLSNGSLQHSQLHSFAHNLSQSQLEQAFHKFRQEYQKPIQLKVLSIINHWVSNHFYDFEVLSIINHWVSNHFYDFESDALLLVRLIDFLSGNDRSIKLITSHKKWCTKIQEVIKRKHRHQQQQQQQQNQLDSAGHSADGEVADSSNRFQQHQHSHVVVVGTARLRQRHPVWHYAKEGEVDAYDLLTLHPLEIGRQVTLLQFFLYRAIKPFELVDAAWTKRDKYQRSPQLLKAIKPFELVDAAWTKRDKYQRSPQLLKLIDHSNNLTYWVARSIVETESLELTYWVARSIVETESLEERVEMFSRVLEIMTVFEELNNFNGIVAFFAALNCQPVYRLEYLFQRLDKEKKGWYDHYYLFQRLDKEKKGWYDHYVQLCDGHLTELLQKLRSINPPCVPFAGEEKGECQQINSLIVCRYIFNANCASFGESKANGGTDEPTNDERAARKMISFMKCRKIAAIIREIQMYQNQPYSLRVEPTIR

SEQ ID NO: 135097 - protein, 119 aa, Heterodera glycines
  Coding regions on vcDNA: vcDNA=SeqID_61520; Strand=+; Position=1 -304,533-588
MQCSVDSLEMMKNEQHQQQQRVMMETSVDSLEFGTKMTTAQQKDEAEIEALLLVERDSLSSAQSQQQDDNELEQYSSSRTGTTITTTTTTMTENERKAEEHPTSSSFPLPLPTAAGGNG

SEQ ID NO: 135098 - protein, 60 aa, Heterodera glycines
  Coding regions on vcDNA: vcDNA=SeqID_61521; Strand=-; Position=1-182
MKQFRIQTLGFRMIAGLFVGPGPGNALKRISSTFDRDLFQKRRKRKRELNGKEASDSVVK

SEQ ID NO: 135099 - protein, 46 aa, Heterodera glycines
  Coding regions on vcDNA: vcDNA=SeqID_61522; Strand=+; Position=1 -20,71-191
MSTMIECSGVVNGEIDDMNDQQDDDDAPTSTVYLNLGKDERTAENY

SEQ ID NO: 135100 - protein, 189 aa, Heterodera glycines; identical to SEQ ID NO: 132977
  Coding regions on vcDNA: vcDNA=SeqID_61523; Strand=-; Position=1 -36,88-621

SEQ ID NO: 135101 - protein, 141 aa, Heterodera glycines
  Coding regions on vcDNA: vcDNA=SeqID_61524; Strand=+; Position=1 -65,115-475
  Homolog annotation: Hit_ID=CAE60250.1; Match level="QueryCoverage =97%, HitCoverage=24%, E-value=3e-32, Identity=47%"; Hit description =Hypothetical protein CBG03824 [Caenorhabditis briggsae]
MTIYPNLLKHAKQEEAEMDIKQYEMLVKVQCSADFKFFLCTLFTPVCTILNEPIPPCRHLCLSAKNGCETLMRKFGYQWPEIFDCDKMPESRDGMCVGESKTEETDGGASADGKGAEEPTERGGKWAMECPHTMKVLSKRR

SEQ ID NO: 135102 - protein, 147 aa, Heterodera glycines
  Coding regions on vcDNA: vcDNA=SeqID_61525; Strand=-; Position=1-444
MSAAFFCPFPPENGVRQLAAPRKAFPKRRKRTHYYCPGGDSVQNGSDRLGFARLGLAKASMANLEWSHGGRPLRQPKDAPAHSPEIHPKGTNEKKNTEKQSNRAETIRSRSAEKGKGMTKSKGTFGGFTQKSPTNRHFASVREIGNQ

SEQ ID NO: 135103 - protein, 45 aa, Heterodera glycines
  Coding regions on vcDNA: vcDNA=SeqID_61526; Strand=+; Position=1-138
KGMRTRPIRQVKQRLLTSQKVRCRDETNQHCLPRGTRHGPPKEWI

SEQ ID NO: 135104 - protein, 297 aa, Heterodera glycines
  Coding regions on vcDNA: vcDNA=SeqID_61527; Strand=-; Position=1-894
  Homolog annotation: Hit_ID=NP_920291.1; Match level="QueryCoverage =94%, HitCoverage=18%, E-value=1e-21, Identity=30%"; Hit description =putative helicase [Oryza sativa (japonica cultivar-group)] gb|AAP52578.1| putative helicase [Oryza sativa
MYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKL

SEQ ID NO: 135105 - protein, 89 aa, Heterodera glycines
  Coding regions on vcDNA: vcDNA=SeqID_61528; Strand=-; Position=1 -237,327-355
  Homolog annotation: Hit_ID=CAE71479.1; Match level="QueryCoverage =95%, HitCoverage=21%, E-value=2e-25, Identity=62%"; Hit description =Hypothetical protein CBG18398 [Caenorhabditis briggsae]
LANEIARRVRIFCWILTGKQNHQKRAIHVKATWAKRCNKFVFMSSEDDPTLPAVNLNISEGRWRIKKYFKKFVYAYQNLLLNFFETIVF

SEQ ID NO: 135106 - protein, 111 aa, Heterodera glycines
  Coding regions on vcDNA: vcDNA=SeqID_61529; Strand=+; Position=1-336
MHLLFSVWEAVLHEAEDLMEDNERELEEWVGIRERLPGGGGGGGGAGGLGPRRGRLPGGGGGGGGAGGRGGVSTPLNLHLRRLSLAVHLFLSSAQLWLAYLQVPSSFSSIA

SEQ ID NO: 135107 - protein, 125 aa, Heterodera glycines
  Coding regions on vcDNA: vcDNA=SeqID_61530; Strand=-; Position=1-378
MERHKQQQVKIGELIKQNRDWLCALAKTKSGKKCRKLIRKANTEQLLSLVEICLNLVASRFHLTTRQKKRLMPYVDTVRRISRARSERGAKRVLVQKGAGFGGLFAALLTPVLMEVAKSFVNKNA

SEQ ID NO: 135108 - protein, 95 aa, Heterodera glycines; identical to SEQ ID NO: 124528
  Coding regions on vcDNA: vcDNA=SeqID_61531; Strand=-; Position=1-820

SEQ ID NO: 135109 - protein, 161 aa, Heterodera glycines
  Coding regions on vcDNA: vcDNA=SeqID_61532; Strand=-; Position=1 -202,324-607
MTFFLILLLIHPVHFFQNNLARTVETIKICLQSILAAQQLNSWDINHCNEGIYVYDFLLVEHLSKNNYAIVNLKCFQISLIILRDVGVGLAPEHMRMHELVGHFEASIALWSDGSIHSKLPYVPDVLDGFAQFGPGDVVGCGMDANNRGIFFTLNGHKICK

SEQ ID NO: 135110 - protein, 105 aa, Heterodera glycines
  Coding regions on vcDNA: vcDNA=SeqID_61533; Strand=-; Position=1-318
MNEDLAFSIKFSNYCHRNGDGNGTKKNNGQNVIAKKRNGIALWHRTGDNAQQNGHGKKRTKAKGHLRRKCRVWRELGMGKGSDQRIRENGSDRRGGKEEKWNKSN

SEQ ID NO: 135111 - protein, 211 aa, Heterodera glycines
  Coding regions on vcDNA: vcDNA=SeqID_61534; Strand=+; Position=1 -44,97-162,213-263,355-492,630-790,1070-1190
  Homolog annotation: Hit_ID=NP_500341.1; Match level="QueryCoverage =97%, HitCoverage=40%, E-value=2e-56, Identity=58%"; Hit description =nicotinic receptor family member (53.3 kD) (4E181) [Caenorhabditis elegans] gb|AAB92023.2| Hypothetical p
VALASPLLTINPFEVNTTQPPSVNTTQPPSDSYFAGNSEWNLINVSVRNMHYLVSVRNMHYLEEGEYRAEVHVHFVFNLRRRPIFYITVIVVPIFLISALSILGIFTPGSNEGPRSEKVSLGLGSLLAMTVLLGIVAGAMPKSNSIPLLGYYILSVILLCAIAVAVSMAIIRMAQQKGQIQRPSRYHIKFWGSASQRLTKASGENGKGKGI

SEQ ID NO: 135112 - protein, 110 aa, Heterodera glycines
  Coding regions on vcDNA: vcDNA=SeqID_61535; Strand=-; Position=1-333
  Homolog annotation: Hit_ID=NP_490772.1; Match level="QueryCoverage =66%, HitCoverage=8%, E-value=9e-09, Identity=38%"; Hit description =tuberin-like protein 1 (1B174) [Caenorhabditis elegans] gb|AAK21507.1| Hypothetical protein Y18H1A.3 [Caen
MGQARNNSNRLSLQELIKELGAAVELTTAKSDAFGQATAGGLARTLLSVYIFVSVIREVRLVDEQRMWDDALAVFRACIWGQMVEQWAHVVDSMTRALVLNLWVFVSMHL

SEQ ID NO: 135113 - protein, 241 aa, Heterodera glycines
  Coding regions on vcDNA: vcDNA=SeqID_61536; Strand=-; Position=1 -432,636-929
  Homolog annotation: Hit_ID=XP_313895.1; Match level="QueryCoverage =53%, HitCoverage=17%, E-value=1e-09, Identity=33%"; Hit description =ENSANGP00000021699 [Anopheles gambiae]
SYCEGASIFVDDVPSSSSSTASSANARHLHAGSSSASSSVPICSAGGSGADVRPARALPIVQPELVEPSTAAAGNANNGANNQQQLLLQHHHHSHHHHHHHQQPSSQLSYHQHHSSSSASSVSSSPTNSSSAKLRFRERAQNLQIYLDKFLEYTTRETTKIDWADPARRADTVSFMLDRVIVAYIFEVFPDAEANGVDVFGGWEGTSADEAEEEGGGTGTDADGAIVQPMLDTVDPIIIAR

SEQ ID NO: 135114 - protein, 102 aa, Heterodera glycines
  Coding regions on vcDNA: vcDNA=SeqID_61537; Strand=-; Position=1 -123,350-535
MLRKKPHQDLQNSLNRFAEWGRDPVSRAKHFRNAYECLSVQERRQLFEGFSFEIFHLIDALFLAHYDAAIVDPQTIADVESALWILEQAMCCAPELVGKGEQ

SEQ ID NO: 135115 - protein, 349 aa, Heterodera glycines
  Coding regions on vcDNA: vcDNA=SeqID_61538; Strand=+; Position=1 -191,240-579,629-1149
SIQDKNMKHTLENCGEKFEEYLKEMFKKSEEKAKKDKQWKANEINNGKHLIIKHSKFDDQGTWTADALFSEFVKGLATKSEKFFKMAEEYSNYLSRSKEKVLFDEQAPIIVGLCEFVEMKKHLARKYEAHLGLVYLMRANWQCSYFFNFIHCWGQCQKFRKYLDILYEYLFRLYVEGKSNELTYKLPAVKPIFMNHYKNSMQLISVVRALNEIAILFWSNDKNKFEDNDYWKMVLVNDVELNYEIKEEKNLFNEFKQNILKKFNAPKNMQKNGKKILNLSNEIENNLRQEFDQKMEKIYENTKENAKEEKAKLEKAIENATNSEEKKVLRVEYIDKFGTFNSSPFIYAI

SEQ ID NO: 135116 - protein, 190 aa, Heterodera glycines
  Coding regions on vcDNA: vcDNA=SeqID_61539; Strand=-; Position=1 -173,231-440,493-682
MSTEEILMDLVTATLKGSEEHLTFRVHFDERMRQLHLMQIDRKAASDWSKLDQENRKLLSTRIQRLSSLLDGLKEQNEGEYLLIYDDETLRLVRERNTGKAKKMEYSDNEGEEMGLCIQEDEEESGERNAPSVGPVYDLEWIKHFIKMKPILSHAPVEDYWNGIDPHYPLQWHIVRGQIPGALYPKNQRN

SEQ ID NO: 135117 - protein, 26 aa, Heterodera glycines
  Coding regions on vcDNA: vcDNA=SeqID_61540; Strand=+; Position=1 -27,151-204
MQTYGWAERLAPIKKNANKAIRDALL

SEQ ID NO: 135118 - protein, 131 aa, Heterodera glycines
  Coding regions on vcDNA: vcDNA=SeqID_61541; Strand=+; Position=1 -135,186-281,766-930
  Homolog annotation: Hit_ID=NP_497892.1; Match level="QueryCoverage =71%, HitCoverage=57%, E-value=4e-30, Identity=51%"; Hit description =peroxiredoxin, thioredoxin-dependent peroxide reductase, mitochondrial (24.9 kD) (3F499) [Caenorhabditis
MTMARCQPLNALAMLGGARLCHHTPPNCTDAIRPLGPKSNVPSFKGQAIVNAEMKTISYDDYKGKWLIFFFYPLDFTAWVNTPRNDGGLGKMEIPVLSDFSKKIAADFGVLDKETGLSYRFVFLGQILIGN

SEQ ID NO: 135119 - protein, 50 aa, Heterodera glycines
  Coding regions on vcDNA: vcDNA=SeqID_61542; Strand=-; Position=1 -76,197-273
MPKKPGTNHSSCRRIRPFLSEPCAICELFVKNANISADLSNNAKLMKVNN

SEQ ID NO: 135120 - protein, 131 aa, Heterodera glycines
  Coding regions on vcDNA: vcDNA=SeqID_61543; Strand=-; Position=1 -221,442-528,588-676
RLHTDLHNNPVRQLGEHTCSSSAARVERLRIVSNIRKRALVTGEDPATIRANELMNVPDAVLSVMPSKSATKKLIQRARHEINEAPPIPNQLCNLEIPKAYQVYKHSEDSEEQFLLADSGVYKEEGLPGDQ

SEQ ID NO: 135121 - protein, 291 aa, Heterodera glycines
  Coding regions on vcDNA: vcDNA=SeqID_61544; Strand=-; Position=1 -96,358-451,510-694,750-827,1176-1403,1500-1691
  Homolog annotation: Hit_ID=NP_503052.1; Match level="QueryCoverage =79%, HitCoverage=28%, E-value=4e-51, Identity=48%"; Hit description =cyclin M2 (89.5 kD) (4S142) [Caenorhabditis elegans] gb|AAK77203.1| Hypothetical protein C52D10.12 [Caeno
MKNAAQAEELKIAIGAFEMNDKIVKDVMTGIKVKTVCEYYQHPVRHVPENTPLRTMLEEFKKGDYHMALVDRVVAPSTEDKESKYELVGLVTLEDIVEEILQAEIVDETDVVTDNVTKIKRRRQQHRDLELFIDDGEACQISMQMQLVTIQFLEGTFRRAFHTDRIAQAILEKVIRAHVHRVEVSHLADFNCPKTALPRKARLYVKKQPSDKFILILEGRAMVTIGQTEMKFEVGPWHFFGKELLQQLNQIIEGDPGNPPAASGAAVSGTASVVPAATNGGANSHSDKCCR

SEQ ID NO: 135122 - protein, 36 aa, Heterodera glycines
  Coding regions on vcDNA: vcDNA=SeqID_61545; Strand=-; Position=1 -98,1160-1172
MRAFCSMRSLYIRILNFSSAYFQGHFEFNDIFKKKE

SEQ ID NO: 135123 - protein, 45 aa, Heterodera glycines
  Coding regions on vcDNA: vcDNA=SeqID_61546; Strand=+; Position=1 -63,114-188
MMKQERYGSQQVTQSYFGTNGINGMSDRNAWPQQNSTRQTRGKIA

SEQ ID NO: 135124 - protein, 151 aa, Heterodera glycines
  Coding regions on vcDNA: vcDNA=SeqID_61547; Strand=-; Position=1 -43,96-191,235-551
MAPRACKKTGSTPKRLKQTEAVPTADGEGTSTQAAENGPSTSTPDLRPRSSPRPLSATPIRRHVGFRPKTTDNATNMDLTMMDKATDVDLAYEDAATQTEQLDKQLKEQEQTISFLRLQVRNRDAMIADLSRQLEQQAQNDQLTTAKASQK

SEQ ID NO: 135125 - protein, 94 aa, Heterodera glycines
  Coding regions on vcDNA: vcDNA=SeqID_61548; Strand=+; Position=1-285
LTRGTVDEPLLQSIEFERIILAPFHVFQGIGNALIKELEVTENAEIANEFFRSIRGQEGKCSGKKDMTGNSIRKVLIHADQLERLYSAEWPQII

SEQ ID NO: 135126 - protein, 68 aa, Heterodera glycines
  Coding regions on vcDNA: vcDNA=SeqID_61549; Strand=-; Position=1-207
MKEEDRHWNLIVQDYNNNPQNGMRGRGMARKNIYVQQDQAIRAIFLDRHNRPFLAYLRAIAYRMPEPN

SEQ ID NO: 135127 - protein, 18 aa, Heterodera glycines
  Coding regions on vcDNA: vcDNA=SeqID_61550; Strand=+; Position=1-64
IIGENKRILTFKESYKPK

SEQ ID NO: 135128 - protein, 143 aa, Heterodera glycines
  Coding regions on vcDNA: vcDNA=SeqID_61551; Strand=+; Position=1 -117,177-212,304-343,406-443,511-574,669-715
  Homolog annotation: Hit_ID=NP_497941.1; Match level="QueryCoverage =95%, HitCoverage=35%, E-value=9e-36, Identity=55%"; Hit description =lipase, class 2 family member (3F705) [Caenorhabditis elegans] emb|CAA84650.1| Hypothetical protein F10F2
LTDHFLNWLVSNGYEGDAFDRPDIGPSGSFGGKLTTAQQITKEPITKEPVIFIHGTGDAGDAALHTQAPQATGWSRSIQYFWSRSIQYFLEQNYTNAELYATTWGDTYTNAELYATTWGDTWGTGNILDGYATMHTCFLFGQF

SEQ ID NO: 135129 - protein, 107 aa, Heterodera glycines
  Coding regions on vcDNA: vcDNA=SeqID_61552; Strand=+; Position=1 -136,272-303,415-570
MCHLGDPAHQPETAYYTDINALISYCAEFVCYALIWLIIWRRTAQITEHVKKLTISNLFIVKGIIPLLSLDPFAIEFCVFPISLFFQTLAYGSSAPVLYFCKCKTRK

SEQ ID NO: 135130 - protein, 81 aa, Heterodera glycines
  Coding regions on vcDNA: vcDNA=SeqID_61553; Strand=+; Position=1-244
FIHKKQRKYTKFRVGHSFFADQFKCVGHPSWYHVEGQLVNVLKVAVRVLRVHPLVLRVHFAVLACDHHRSVTNRFSQVLVP

SEQ ID NO: 135131 - protein, 132 aa, Heterodera glycines
  Coding regions on vcDNA: vcDNA=SeqID_61554; Strand=+; Position=1 -93,388-522,577-747
MGTISLGTYTLLKAAFPLGSLVASALNIATKPESEEYKAFQQLHKKMDENFDNIRTTIGVARKVISMEARLLDYKNKVQVPINPLRDLLDLFWNPAVPKKASDVDEFRLLCYRSHDKTPLTILHVNIFFNIK

SEQ ID NO: 135132 - protein, 107 aa, Heterodera glycines
  Coding regions on vcDNA: vcDNA=SeqID_61555; Strand=+; Position=1 -175,496-644
MSGLEIIRRFCIMFPLDKMIMIWPTVRKCRVSRKVADWVLLTHDPNIPIKDQQIIPYQDSEAVLLSNTYVDLLKDNELFESGTDVSQIYRIIQQSDKFLLAAIWLVN

SEQ ID NO: 135133 - protein, 44 aa, Heterodera glycines
  Coding regions on vcDNA: vcDNA=SeqID_61556; Strand=-; Position=1-150
IFLYLSTSIERKNKSNWIPITKDSEKLTHTSVSFKILGTALSKH

SEQ ID NO: 135134 - protein, 43 aa, Heterodera glycines
  Coding regions on vcDNA: vcDNA=SeqID_61557; Strand=-; Position=1-505
CFAVPRTGRQWMAFNLQEIRLTISGCKKLLGKELFFEVSQTPY

SEQ ID NO: 135135 - protein, 1401 aa, Heterodera glycines
  Coding regions on vcDNA: vcDNA=SeqID_61558; Strand=+; Position=1-4206
  Homolog annotation: Hit_ID=XP_318550.1; Match level="QueryCoverage =71%, HitCoverage=99%, E-value=0.0, Identity=41%"; Hit description =ENSANGP00000020240 [Anopheles gambiae]
MDAQQLQQLLNALQQMVTNAAPANLSNASLASSIDARLSAFHYNPEVGTTFESWFKRFGKLIEDDGSTLPEASKVRLLLGKLGEEEYSKYRDTISPTQPDQVNWNDTISHLKQLFAETRSLFVRRYECFKIRQQPGQDVSSLIAQINASCENADLSLTKEQLKCIILVIALNDEHHDLRQKALKMLEDAQKNGTNISLKKIEEELRAIQLVKESALSLVNPPIATNAIRTRPRQWTDPAQRQSGGSNQRQTPNANSSGKPTRGQPTLPCGSCGKSDHWRSDCTFKDATCFKCNKKGHISTICRSKKAKAPPNSHRSFHTVKIDANCLHVGTTQGRWWKLCILINGRQTSMNGDTGAQATIISLQTWRELGEPELTPSDIDAKNCNDQPFALLGKFICTVQFSDKPPQTLIAYVSGEVGHNLLGLPWIEALEIIPRQILFPSSKSADQATKMIDNFSAVKPPNKSINDVSTLKAALQNDFPEVFEEGLGHCSKAKAHLILRSDAKPVFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDDKSKQLCAINTHRGLFQCQRLPFGVKSAPAIFQHLMDQICAGIPGVFAYLDDGLIATKTLDQHITALYTLFGRIKEYGLRIQLDKCKFLQPELLFLAHIVSANGIRPDPSRSDAIRKMPAPIDKSTLRSFLGALNYYGRFVKCMREMRAPLDKLLQKDVVWNWTSEQQNAFEKAKETMTSDLLLTHYDPARPIVVSADASKDGIGATLSHTFPDKKEKVVEHAACTLTAAQQNYSQIEKEALAIVFAVQKFHRMVYGRKFILQTDHKPLLAIFGSKKGIPIYAASRLQRWSMILANYDFEIRYVNTTSFGQADVLSRLIANYSRPEEDILIANICADTDCYINSVFENRMDQLPVTTVEITAEMANDQPLQTVLQFLRNGWPAKVADSEISPYFPKRDKIFEVDNCLLYEDRVIVPTSLRSRILKALHIAHPGIVRMKALARRHVYWPGMDSAIEKVVSTCEECQLGQKNPTKAPLSPWPTTDKVFQRVHIDFAGPCSDGHQYLILIDSFSKWPEVYRMNTISAYATVFVLRSIIYRLGIPEEIVSDNGTQFRSAEFATFCKEFGIKHIFTPPFHPQSNGQVERFVDTFKRSMKKMSKGGKDWIEKMLFSYRTTPHVALNGFSPDQLFFGRKLRTKLSLVHPNGEKAENFDQNSFKKGQSKYTDKMAQNFDRKHGSKLINFFPNDHVLLINYRNNKTEWLQGKVVERLHKSPTYRVYVPVLRRLVHRHANQLRRRHLLEEEAEKEAPQIEEPPPVVKPPLPPQQNLPQPANSPLVVRRSTRVKKPRQFYSPSK

SEQ ID NO: 135136 - protein, 19 aa, Heterodera glycines
  Coding regions on vcDNA: vcDNA=SeqID_61559; Strand=+; Position=1 -45,121-135
MPKWGRSKRSTTAHTAIFY

SEQ ID NO: 135137 - protein, 147 aa, Heterodera glycines
  Coding regions on vcDNA: vcDNA=SeqID_61560; Strand=+; Position=1-445
VLKLGNAFAIFEPGPANVLERRFARFRIRLALFDAVSLSQNEAAQFVGTKFVDDDNYGTFGRLKIGHFATNYAKDSAVVDDDTTNSKTITDFGPIAYAIQTSGSTGAKFLFFVPTDFCVKVPKFRFFRIFRHSEGRLGSVLCHFAKC

SEQ ID NO: 135138 - protein, 171 aa, Heterodera glycines
  Coding regions on vcDNA: vcDNA=SeqID_61561; Strand=-; Position=1-516
AEHNSKCEAETMEVIKAEQVDRKQRKKIFKCNSDVKTIWRQGLEKVREEDAQKDVDSLEQNSLTNLYPSWIEIRKSYNRRRQQAHGSEAAEPFDVPPRLQLTKFGAIKLTMGKKIAGSEWLIYKNQEIGVMIFASQTQLDAAKNCRIMVADATFELAPKGFNSNMATSKGI

SEQ ID NO: 135139 - protein, 79 aa, Heterodera glycines
  Coding regions on vcDNA: vcDNA=SeqID_61562; Strand=-; Position=1 -33,171-281,341-436
  Homolog annotation: Hit_ID=CAG05588.1; Match level="QueryCoverage =75%, HitCoverage=18%, E-value=7e-09, Identity=45%"; Hit description =unnamed protein product [Tetraodon nigroviridis]
MSTLAKRQEYTSDQWQELESEFEKIKYPDAYMREELAKEMGLTAEQVNKWFQSRRTRERKWDKLAEHTAQIKKKVCGND

SEQ ID NO: 135140 - protein, 162 aa, Heterodera glycines
  Coding regions on vcDNA: vcDNA=SeqID_61563; Strand=-; Position=1 -62,382-808
MRFLMEKLYFVHNELDIYVLDEQNERSLIKTIEYLEAIELMKIEKESADFKTHSPKQTVSIPQNDKKANGLITTQFGSFKSTEFNQMLDILHTHIFSVLVAKNVQKITASNESDETKCAPNWQRYYSHIINMERLNSLFKSVENLVKSVENIEKMEKQQKIG

SEQ ID NO: 135141 - protein, 174 aa, Heterodera glycines
  Coding regions on vcDNA: vcDNA=SeqID_61564; Strand=-; Position=1 -97,274-410,713-860,949-1088
MLSLCANWRAETISSVRHQLDNLKDYVTPPVDRVEKVSRPHNNEFVDSIKSCMAEIQRSMQEKLQNIVEKRLVAALGKHYFHAIAISDLLPNSFSLDYLKTKMSEHMNTSDNPQFNQINADLMLRYTELERHLKQIQLAELEEQEQKKRTLLAKGKGECQFNLEKKEILNRLYR

SEQ ID NO: 135142 - protein, 18 aa, Heterodera glycines
  Coding regions on vcDNA: vcDNA=SeqID_61565; Strand=-; Position=1 -38,197-215
MCWCCSNWPTSSRIIFCI

SEQ ID NO: 135143 - protein, 69 aa, Heterodera glycines
  Coding regions on vcDNA: vcDNA=SeqID_61566; Strand=+; Position=1-386
THKKGRIFSFFFLSFFYSSKFSVIFSRLIEPVKSFRMISRLFDSVNNFKSYIDSKLAQTELARRSWPVP

SEQ ID NO: 135144 - protein, 47 aa, Heterodera glycines
  Coding regions on vcDNA: vcDNA=SeqID_61567; Strand=-; Position=1 -121,736-758
MREKQHRLITLNELGLDMEQFKDFMEAISLVALQCPILPNRDPPWVK

SEQ ID NO: 135145 - protein, 101 aa, Heterodera glycines
  Coding regions on vcDNA: vcDNA=SeqID_61568; Strand=+; Position=1 -21,94-378
MLISTLQERQAHLNALQAVCDADIKSVKEEEEKEKEAAQILLQAEKQREEAAQILLQAEKHREEAAQLLKEATERRKKAEEKKEKSVPRASMSLVTNPLSI

SEQ ID NO: 135146 - protein, 24 aa, Heterodera glycines
  Coding regions on vcDNA: vcDNA=SeqID_61569; Strand=-; Position=1-75
TSDFMVDPSFADGSFYPFVTLFDS

SEQ ID NO: 135147 - protein, 67 aa, Heterodera glycines
  Coding regions on vcDNA: vcDNA=SeqID_61570; Strand=+; Position=1-205
HSQSILCVDSPSWDDQMVASGSKDNSIFFWRIGGVKTDSASDGHQNLTDAFMADKIAVATGHTHSVA

SEQ ID NO: 135148 - protein, 115 aa, Heterodera glycines
  Coding regions on vcDNA: vcDNA=SeqID_61571; Strand=+; Position=1 -115,403-558,719-797
KLSFPIRKCVHVIVDGGPERVVDKTGTFHEPTQRRAAAVMREKERRKEMRRKFTQENQAQQKRQKDIEKRHNEWTKQMEEEREAVKERIRMNKQKLEERKKSGMNGEGDDDDEEN

SEQ ID NO: 135149 - protein, 47 aa, Heterodera glycines
  Coding regions on vcDNA: vcDNA=SeqID_61572; Strand=-; Position=1 -33,72-182
MAKTGFPDFKSIFLGNKTVIQYLREAEFLLYVVVDELIFVLPCNKPP

SEQ ID NO: 135150 - protein, 268 aa, Heterodera glycines
  Coding regions on vcDNA: vcDNA=SeqID_61573; Strand=+; Position=1 -135,177-302,368-490,1739-1841,1892-1937,2284-2482,2623-2695
  Homolog annotation: Hit_ID=NP_501866.1; Match level="QueryCoverage =99%, HitCoverage=68%, E-value=4e-38, Identity=50%"; Hit description =NAD synthetase 1 (78.9 kD) (4K980) [Caenorhabditis elegans] emb|CAA18773.1| Hypothetical protein C24F3.4
MEMCEEMWAPFGPSQRLALQGVDIICNSSGSHHVLGKSRMRINQLNYTNNQCPLENWFQLGGTYLYANHRGMDGERVFFDGMSSIAQDGKLYAQIDQFDIEETAVCSCTLNLDNSVAYRAKIASLCQQSSDLREGMALQNVQARARMVLAYLHAQLTLTKERRKGSLLVLGASNVDESVIHSVPTAELRPLKDGQIVQTDEAEIGLTYRELSTFGKLRRPGCSGPYRMFQELVHIWHPARSYDEIADKVRIFFRRYAMNRHKATVATP

SEQ ID NO: 135151 - protein, 137 aa, Heterodera glycines
  Coding regions on vcDNA: vcDNA=SeqID_61574; Strand=+; Position=1 -108,199-504
EQPVDYDGTEIQVVDDGAEEGPTMADGQQNVQYILQYADSGEMENSMVQLEDGRIIHATQIGQPIPLSSATEANLPIGQPLIMSIPGPNSHQQQMQQHFQVVGNSVAVPSSSAASLPPIASAPSPQFQHSPAEGEEQ

SEQ ID NO: 135152 - protein, 106 aa, Heterodera glycines
  Coding regions on vcDNA: vcDNA=SeqID_61575; Strand=+; Position=1 -109,316-402,781-852,914-963
PKKPEKSSKTQQSMASKSTTAKAEWANALPSDVFSSGPAPPVVKKPPPSKTKPPEKGKKVPPQPPSSHPDYGTLHLVDKDLFTKEQQAKDAKRTPPKAGPLSVPSD

SEQ ID NO: 135153 - protein, 77 aa, Heterodera glycines
  Coding regions on vcDNA: vcDNA=SeqID_61576; Strand=+; Position=1-234
MQLMEPCLFQVRLVLVLNLCKLNSAVRLLNVLLGVVADGLQIASNHIRHFHMTTFVHFDQLIAGPVEHNLLNRKLIM

SEQ ID NO: 135154 - protein, 84 aa, Heterodera glycines
  Coding regions on vcDNA: vcDNA=SeqID_61577; Strand=+; Position=1 -92,142-209,329-420
VSVIRYEAPILFHNAKHFKYSVLEAARQIKGQLLGIGIGTRTGSMKSMKSTNAGNVGSGAGPSAPTNKDSIQMKSTLLISGDIV

SEQ ID NO: 135155 - protein, 127 aa, Heterodera glycines
  Coding regions on vcDNA: vcDNA=SeqID_61578; Strand=-; Position=1 -368,569-584
MTRYRRTGSIYPRSAQLIHRRPHHHQSAIPPPISFINDMEMADQDKLIENNMFDEHAILPSAFRPPPFSACVSAADHRLSPICASSDQSGLSGADQRPIVCHADGAVGQQLETELKHPYLVKRLLDC

SEQ ID NO: 135156 - protein, 149 aa, Heterodera glycines
  Coding regions on vcDNA: vcDNA=SeqID_61579; Strand=-; Position=1 -335,629-672,722-790
TSSGHIIRQVNELLQQQLAHLNNGQVLLQQHNLIANCAAATASASAAMDNNNNDNIRNNDCMSSTVPVLAQADTVQRKETVVDNNDHTMHGTNMDKRMTVLSAAADQLESFSRNKLGRSYNPGRPLGMLDRQKILNLYQRGLKISHIAK

SEQ ID NO: 135157 - protein, 213 aa, Heterodera glycines
  Coding regions on vcDNA: vcDNA=SeqID_61580; Strand=-; Position=1-642
MSLAASETAATSNNNYNHHYEQLSDQFNLAQLLANQQQQEQQNESPLISRMLLEHQQHYQNQQHHLLLRAANSLSISGNNDNLPLLAPPNNGFHPLPMLLRLITMTSPQPATTTICCDVGRSNMNMSMDQLQMMMKTMIKVEDVNQLKLQVEEPVATNWQKSAFVAAQQPQFQQQQQLLQRQMIMEQMLWELLARVISINYMDYLIMLRMLLD

SEQ ID NO: 135158 - protein, 84 aa, Heterodera glycines
  Coding regions on vcDNA: vcDNA=SeqID_61581; Strand=-; Position=1 -94,185-241,646-749
MHAFCARAIYHRAYQSKAKQQRWCFERIKGIESVNRLLEKYVCNLSTILRISCLHLNGMMLITAFNRQLTMETLCNFPSKANGN

SEQ ID NO: 135159 - protein, 104 aa, Heterodera glycines
  Coding regions on vcDNA: vcDNA=SeqID_61582; Strand=+; Position=1-348
SNQCTFSWLMSHSKKTGSRATSQERDEEINITIIDRNFWNGKTSVKVPDLERAHIEVLRLEESVNRSFRIVNRRAYANTRALNKMAEEVNTNMGVLNANGVWAC

SEQ ID NO: 135160 - protein, 82 aa, Heterodera glycines
  Coding regions on vcDNA: vcDNA=SeqID_61583; Strand=-; Position=1 -117,342-455,746-763
MQLFVSQMKLLENSVGNPFISERRKADESMATRRKGNSYVRKGTQIPFVKMRFSSTAIFLLVLAIASHLNFFQSTECFYLRN

SEQ ID NO: 135161 - protein, 71 aa, Heterodera glycines
  Coding regions on vcDNA: vcDNA=SeqID_61584; Strand=-; Position=1-215
SSVVPCPAELALCRQAVLVNSDQQQQQQLHDYEQRPVIVGYDFNAGIQWEALLDSFLTTGFQASHMGIAIQ

SEQ ID NO: 135162 - protein, 95 aa, Heterodera glycines
  Coding regions on vcDNA: vcDNA=SeqID_61585; Strand=-; Position=1 -143,189-333
MTRPIFTCASPAACAPMLYDDSVVGDDVGDGDDDGEHVHDVAAEFEALAIGIALGYRTIVGIRFIGQGQNVKFEPHISGGTQSTFSVVQSHQCAV

SEQ ID NO: 135163 - protein, 145 aa, Heterodera glycines
  Coding regions on vcDNA: vcDNA=SeqID_61586; Strand=+; Position=1 -102,859-1105,1269-1354
  Homolog annotation: Hit_ID=NP_502274.2; Match level="QueryCoverage =100%, HitCoverage=2%, E-value=2e-51, Identity=59%"; Hit description =UNCoordinated locomotion UNC-22, immunoglobulin-like and fibronectin, type III and protein kinase family
MPGAPRFTQKPSIQQTAQGDLLMECLLEADPPPEEPSASDGGAYKCTAANKFGESNANINLNFAGGEEQKSTSSGSAKGPTFVGKPRILPRDGGALILMECKVKSGTRPTVKWSKDGAPLSMGSLYQDVFADLGDGTYLCQLEIR

SEQ ID NO: 135164 - protein, 102 aa, Heterodera glycines
  Coding regions on vcDNA: vcDNA=SeqID_61587; Strand=+; Position=1 -158,766-917
SIQNESSNYPPFLYVIHTSEMSSSPHGDEDEGEEAAAAWGQDSYETGDENEMTYYSSASSTFTLIRKHCGCCCFCCVDHLLDQQNHLLQMIPNTIAGQKNAN

SEQ ID NO: 135165 - protein, 86 aa, Heterodera glycines
  Coding regions on vcDNA: vcDNA=SeqID_61588; Strand=+; Position=1 -117,210-353
MEVDTNGTAAQKKRRVPSSKKEEEKEEDQLVPEKRVQIHSPSPSESGATTPTKKGGKKYSGSRHSTQEDVGYCNSLNKFTVQFFKH

SEQ ID NO: 135166 - protein, 296 aa, Heterodera glycines
  Coding regions on vcDNA: vcDNA=SeqID_61589; Strand=+; Position=1 -573,1303-1575,1701-1745
MSWKNADSRESFSSASDSPLSHPLDIIHEEAAGPSSPSSTTGGGVESHAESLSSVSPAFRSPTPSHDHDVIAHGGHAKTTISNNWTTLRNHTKTTTAPSSTTAATRNGTNNNTLVKPAAAAPSFRSATRAKQLREEAEEEAQRNRAVAQRRISAVHEFVLNRLPRRSVASNAILDNIIDFHAAQPALPTVEISQVSDDIPASGLKIPPERRRELLALSGGGGESEDERTSSISEQPPAKKATTTMKKPSVTIQKEEEKQPAQAKSKSPSPRPAKSPSPNPKECVLISHLSIHDTVS

SEQ ID NO: 135167 - protein, 122 aa, Heterodera glycines
  Coding regions on vcDNA: vcDNA=SeqID_61590; Strand=+; Position=1 -273,613-708
MATSISTTSGINGDESGPSKPAKTARYSPVGSVANRFESRGAKSSVLTEINQTSLRVTSPQRKNAFPLQAAAAADQQAETSPTPEYVPMEEANGRTPTMIQVGRKKTGQALISEPTDEYRES

SEQ ID NO: 135168 - protein, 145 aa, Heterodera glycines
  Coding regions on vcDNA: vcDNA=SeqID_61591; Strand=-; Position=1 -329,917-1025
MVASSQTVPSCWPACTAPAGWPRAPPRSLAATRRASAPAPLPDAVTDCAAAQTSGASSLPLPAPPFGPPSWFWPFSSAAPGGTRAPPASCPLGRLAGVALSCASTVCHPGGETFKIEQTKGEQGEKQQINTKLEEVLLHQEGRNE

SEQ ID NO: 135169 - protein, 67 aa, Heterodera glycines
  Coding regions on vcDNA: vcDNA=SeqID_61592; Strand=+; Position=1 -120,187-268
VSLIISKCRPQDEDEYTLMVKNAHGKDEVGAKLLVTPAAESNLDFRAKLKKRDTSISISEQEKQRQR

SEQ ID NO: 135170 - protein, 57 aa, Heterodera glycines
  Coding regions on vcDNA: vcDNA=SeqID_61593; Strand=-; Position=1-172
MECTLFLGLLFCATPTENGAEVTHKGTVGGEQYGPIRHHFGVPCTPQTVQSVTKKSD

SEQ ID NO: 135171 - protein, 101 aa, Heterodera glycines
  Coding regions on vcDNA: vcDNA=SeqID_61594; Strand=+; Position=1 -153,653-802,1070-1072
MLEPRSASAAAAVHSLTNFENCHELEEMQQLIDTLAGSLRKQLDALVSVNRQKVQHCSVRWKNVKNSFLFADAIPGKERRKLESQTDECRLRSSLLTDKIT

SEQ ID NO: 135172 - protein, 35 aa, Heterodera glycines
  Coding regions on vcDNA: vcDNA=SeqID_61595; Strand=-; Position=1 -48,102-280
WRPHKVSKPRNVQKSRKPTKCPKFFKIYNNKMSLI

SEQ ID NO: 135173 - protein, 70 aa, Heterodera glycines
  Coding regions on vcDNA: vcDNA=SeqID_61596; Strand=+; Position=1-214
LMEKRMFDYFCQRAAAEWLTNLPSRNLTAKSSKTPTASQHGKTRLRQGTREVGGTSLNGNGMQRARNCPI

SEQ ID NO: 135174 - protein, 111 aa, Heterodera glycines
  Coding regions on vcDNA: vcDNA=SeqID_61597; Strand=+; Position=1 -55,309-589
MAKLILLALAFLSMFGIVSPFAVTSAAKSFWNAKARANWSIGQAMWNVQSTAISCWKTARAISVVSHAHVPEINTEKRVIEKNEFDGKSDGWKIVIKSMKELNKIYINFIY

SEQ ID NO: 135175 - protein, 75 aa, Heterodera glycines
  Coding regions on vcDNA: vcDNA=SeqID_61598; Strand=+; Position=1 -99,161-289
MCHWNETNATNRTMANANTSPGPFGTRSCDSPLSLVNFMVKEAQKQLESPDYVIWTGDNAAHDEYDEKSEKEKQK

SEQ ID NO: 135176 - protein, 134 aa, Heterodera glycines
  Coding regions on vcDNA: vcDNA=SeqID_61599; Strand=+; Position=1 -193,242-489
FFPSLAFVYPFTHYFLPFIIYVPDWHYYGTVFCAILPQFFGIVLPPYFPIYFLPIFGIVLPKFLTLYFANFAHFCAKFPYLFLANFWHYFATIFNPIFCQFLHIFVPNFPIYFLPNFCTFLCQISLFISCQFLA

SEQ ID NO: 135177 - protein, 29 aa, Heterodera glycines
  Coding regions on vcDNA: vcDNA=SeqID_61600; Strand=-; Position=1-87
FGSGPLSLSIMIVLQIVNSLLPSKCLSTN

SEQ ID NO: 135178 - protein, 83 aa, Heterodera glycines
  Coding regions on vcDNA: vcDNA=SeqID_61601; Strand=-; Position=1 -209,398-437
MEATPRQIDLQKLYNDLIGLPGVIGVHSLRVWSLKSDTFAATAHLELAFNGGSIKDKYFADSVVAMAQQKMISRHHIRFVTVQ

SEQ ID NO: 135179 - protein, 52 aa, Heterodera glycines
  Coding regions on vcDNA: vcDNA=SeqID_61602; Strand=+; Position=1 -91,174-241
MTTITMPMSMLIPITSTICSLVFLEIMKCAQKNQNITHVTQKQLARLKRPPD

SEQ ID NO: 135180 - protein, 95 aa, Heterodera glycines
  Coding regions on vcDNA: vcDNA=SeqID_61603; Strand=-; Position=1-288
MASSSHLSSQLQNCGFSGQDTAFAIEYETGAADELYCTTPKRRKSDLIAGIDISNPNNRREWSESRTFNRFYDCVLDNGGNLTSLVACKLCNQSN

SEQ ID NO: 135181 - protein, 31 aa, Heterodera glycines
  Coding regions on vcDNA: vcDNA=SeqID_61604; Strand=+; Position=1-96
VIGIAINRILGHNRNRRFNRNRILSGSAHPW

SEQ ID NO: 135182 - protein, 169 aa, Heterodera glycines
  Coding regions on vcDNA: vcDNA=SeqID_61605; Strand=+; Position=1 -32,1542-1947,2071-2142
MTKISNVFLRRCIDRSVIAFLRANKQIFDRNGTNLQLSVSYAFKHDVIRPIRLVFVRQIWPIFATNIRCLYIQRIGDFVNLRRLISKTILTDLDIHMVDSNFISPDATFSTGQALVKWLHTPTKDGQPKRLCFKNFDEQLINKFKKCCTLNTPSQFWASSSINKLAFVR

SEQ ID NO: 135183 - protein, 161 aa, Heterodera glycines
  Coding regions on vcDNA: vcDNA=SeqID_61606; Strand=-; Position=1 -232,1310-1438,1835-1959
  Homolog annotation: Hit_ID=NP_508294.1; Match level="QueryCoverage =47%, HitCoverage=6%, E-value=5e-12, Identity=41%"; Hit description =predicted CDS, endonuclease/exonuclease/phosphatase family and RNA -directed DNA polymerase (XC178) [Caenor
MHKALHNLSEWANKWQIRISIKKTFVLHLGNKNPKEIYKIGGNIINVVDTIRDLGINIDNKLQFSNHVTQIIKNAYLPIFPNLSTSEEMSVLIARIAELNRAKTMEPSVASSEVFGQDGYGMNDDQFSLEEEEGKEQQEDRKTPTKDGNIQILEDIFRIIW

SEQ ID NO: 135184 - protein, 149 aa, Heterodera glycines
  Coding regions on vcDNA: vcDNA=SeqID_61607; Strand=-; Position=1 -57,642-830,884-959,1275-1400
MPGGSKTNYKIHVQTISWKVEPLFDPIYEKDTKRMKALIGTLSEEKRRGFLRTRYAPEGTNKTLTALMLASVLGTGEMVEILLESGADPNQMCLRKLIDARGSPTMTIVTPLWVGAMDGHFEVCQALVKHGADVDLGAPQFAMSPLMAA

SEQ ID NO: 135185 - protein, 93 aa, Heterodera glycines
  Coding regions on vcDNA: vcDNA=SeqID_61608; Strand=+; Position=1-282
MADVEQSYMTEADRRALERFRRAERRLFSTEIELDKVLFTFQQYDMLRRRWAMEQARQMPHGRRKRQQAAAAAVAATTAQSPNVNSASHLAKS

SEQ ID NO: 135186 - protein, 49 aa, Heterodera glycines
  Coding regions on vcDNA: vcDNA=SeqID_61609; Strand=+; Position=1-147
MATTDWGQFDANGTDYDAIYDDTDDEAGTTDNGQGSGQGGSVLNHLLTQ

SEQ ID NO: 135187 - protein, 32 aa, Heterodera glycines
  Coding regions on vcDNA: vcDNA=SeqID_61610; Strand=+; Position=1 -88,493-503
MRDCGLGSRKIPRGIPSRAGLYLAPCGGNDFQ

SEQ ID NO: 135188 - protein, 38 aa, Heterodera glycines; identical to SEQ ID NO: 130624
  Coding regions on vcDNA: vcDNA=SeqID_61611; Strand=-; Position=1-150

SEQ ID NO: 135189 - protein, 284 aa, Heterodera glycines
  Coding regions on vcDNA: vcDNA=SeqID_61612; Strand=-; Position=1 -488,582-709,931-1167
  Homolog annotation: Hit_ID=NP_502797.1; Match level="QueryCoverage =24%, HitCoverage=20%, E-value=4e-11, Identity=44%"; Hit description =HASI (4P602) [Caenorhabditis elegans] emb|CAB16520.1| Hypothetical protein Y57G11C.19 [Caenorhabditis ele
MKFAKKMLMIPEAEYLALRSAMNSGDYLQNEKASLDAKISQNLQDPGISEDLKAKRHDWLYKERRTVKGILENRPQKVVIENHVPGPNVAPYLGLNTQSKPQETDEPRKIIIPRKRLEEQTPDPESDNDTINELTPEPQTTSTLKPIPIKTIIHPTLLNGLFRDVLLYLAGKKDETPRGAKFLKDRLLKDPTVKDMVDKSKVMWGQKQRTYTIHKPIRKRFPRLKTIPSGFHTDWQCDLCIFDQLKKHNDGYKYLLVCIDVLSRMIFSAPAKSKKSEDMIEAFD

SEQ ID NO: 135190 - protein, 220 aa, Heterodera glycines
  Coding regions on vcDNA: vcDNA=SeqID_61613; Strand=-; Position=1 -394,947-1212
MLVLFNIISFLFFIAIFLTYPKQICGGPKSSKSSDSLMAPLLNSKRISGAKSSKSSVSPKVPLLLKSSLKSSTPKSTPNQSKSTKNSNSAINCEKINHSLESFKHSIIKSPNEYRFKPRNHYKLRILSGPIGKPQKQFHFVTDEKGKIKWNFTTDVRENKFTPKGFKNCKSKLPVTILVETTKESRLLAKYKNYAQMKKKMLARKGKLCKENIIKFNELE

SEQ ID NO: 135191 - protein, 454 aa, Heterodera glycines
  Coding regions on vcDNA: vcDNA=SeqID_61614; Strand=+; Position=1 -176,515-767,845-941,1078-1140,1186-1286,1511-1720,1774-2079,2167-2325
  Homolog annotation: Hit_ID=CAE60358.1; Match level="QueryCoverage =32%, HitCoverage=85%, E-value=2e-31, Identity=45%"; Hit description =Hypothetical protein CBG03955 [Caenorhabditis briggsae]
MSTIDTKSNHADEMKPNMQKGTKRAATDRSDEPKRPRFLSEKCRHPRLIAFEEREAACHFQLIIIASNQIELLEMPSQLTPEMIFDKICNDGSTKMDKNTLQSLLSNGTDRSFNQDTCRLLIDLFDSNRDGMIDRNEFWPLWKYVDEWKISFKNIAAEGELTIGVDRLETALREYGYRFSVNFYCTLLRKYDRTMSDRLHFDDFIYLCLVLQQLTTPFRDRDFDQKGRIRQIISVFSPHRCVKMNNNNNNNLKRFQIKPKGPEEQPTLRTKTLSEVQEFDAAGSFFLRAKIASVLFSIYKACPMRSNGIPCRKKLDEEDFCVSCAHRAKKPSRNLYLRVVLRDCDDEECEQQTTAFSHVAIKFLGIASVDAFYNLSENAPDKLESILQSKIDQTVFVKLNIKEKNETATLDWIISSISEEKPVAVVVDVESSDDEAEDGSSSSNGSPKKRTKKN

SEQ ID NO: 135192 - protein, 171 aa, Heterodera glycines
  Coding regions on vcDNA: vcDNA=SeqID_61615; Strand=+; Position=1 -215,259-375,434-508,571-679
MKKGEDDTATAAAAVPRGKRPNSNSVSAAHFSTESEEMKSCKKEEPMATGCRKGAKRQYPYSLMSARAQDVWSLKLDQLEEKYSRMEEELSEDSDDAIDFYEDGIDDIVEKINRFEAKVKKWSVNHGNTPVVKKPRYNTNADENSNDADDDAPTSTVYLNLHNDKMIEKTN

SEQ ID NO: 135193 - protein, 334 aa, Heterodera glycines
  Coding regions on vcDNA: vcDNA=SeqID_61616; Strand=+; Position=1-1005
MPSDSDRKRRTTSEKSSKQSQTQPKQPRWDFRSMSYFEKYPTEPQMEEEMRQLRLATANDQIGTGDTHTSADSEQQQQQQKQQPLYKEITNHVHKLERFSVQRHVTEFMLNAQHDEPDEALRQAFDELIARAVQNAEKKSGRAVSKLGIMVSGKVLNDPVVIPMRPPIQNNVDVVMAELDKLGQSEGDDGGADKKTLLLSDPVEIIVTCLTPPVGSAPRLHPYQNWGYDESQRIVIRNKDSYCLFHALVAGRAYHDRDIFCLTHNPIDEQQPQFMANIMNRHDFCKDYEAFNRLVSNIGRMQTAVEELMNASGIQKDQTSYGIEHIQQVQQYWV

SEQ ID NO: 135194 - protein, 55 aa, Heterodera glycines
  Coding regions on vcDNA: vcDNA=SeqID_61617; Strand=-; Position=1 -76,440-531
MRKKFFAFTIFLFIVLQLTDAEMSNEYKEACNDTCAALPKQNCGRGRQKVTVTHR

SEQ ID NO: 135195 - protein, 23 aa, Heterodera glycines
  Coding regions on vcDNA: vcDNA=SeqID_61618; Strand=+; Position=1-71
VEYAVPSEYQFVDYLGGGNYGNV

SEQ ID NO: 135196 - protein, 137 aa, Heterodera glycines
  Coding regions on vcDNA: vcDNA=SeqID_61619; Strand=+; Position=1-819
FFVFGAVPPNRCAQIYGETESFRNSFPIACTLILRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGVASL

SEQ ID NO: 135197 - protein, 119 aa, Heterodera glycines
  Coding regions on vcDNA: vcDNA=SeqID_61620; Strand=+; Position=1-357
LEKVEKEMNERTEELEEMREMLTHFQHVKEVDLKQLEQQIEQRQKRGEERMDKKEEKQREEKEKQREEKETKGDREEKQAQKRGDSSRRTVLMVDNSSEWAEQLQKVRERAKLCVDTYK

SEQ ID NO: 135198 - protein, 167 aa, Heterodera glycines
  Coding regions on vcDNA: vcDNA=SeqID_61621; Strand=+; Position=1 -51,112-168,465-860
IVPPSMLSKPQKIGSFKPQPSPMGLPHPKNGVRTGIAVPTSIWAPNDDDMYKPKQYDQQEQPKQAERPAAAHGKLADDDIYNPKQYTEQKAGGGGRPTYEAALADDDLYNPKQYSQKPQQQKGADDDDLYKPPQQYNQQQQQRKMGRPKSYEDELDEDDLYKPKQYN

SEQ ID NO: 135199 - protein, 244 aa, Heterodera glycines
  Coding regions on vcDNA: vcDNA=SeqID_61622; Strand=+; Position=1 -238,280-401,545-689,746-892
  Homolog annotation: Hit_ID=CAE67933.1; Match level="QueryCoverage =98%, HitCoverage=36%, E-value=2e-51, Identity=46%"; Hit description =Hypothetical protein CBG13533 [Caenorhabditis briggsae]
FIFSAGAELLPTKIPCLINLLSILRSGLINFCACALALADLGFRAIGCRIDSGGLAFLSKEIRRRFRQIATEYSKIEWFANLKIVGSNDINEETIITEYSKIEWFANLKIVGSNDINEETIIALRTQGHELNAFGVGTHLVTCQQQPALGGVYKLVDLDGKAKIKLSESKHKLLIPGRKKAFRLYSKTGIPLVDLMIPLVDLMMLDNEPDPTPHKEILCLHPFEPGKRAKVFPDRVERLHHIVS

SEQ ID NO: 135200 - protein, 231 aa, Heterodera glycines
  Coding regions on vcDNA: vcDNA=SeqID_61623; Strand=-; Position=1 -161,218-322,463-605,667-731,850-1028
  Homolog annotation: Hit_ID=NP_508515.1; Match level="QueryCoverage =81%, HitCoverage=57%, E-value=5e-41, Identity=47%"; Hit description =MIP family (XD645) [Caenorhabditis elegans] pir||T16635 hypothetical protein M02F4.8 - Caenorhabditis ele
CAKSKGGHDPAVSLAFLSLGKLPFAHFLLYSLVQTVGAFFGSALCFHVYRESFESFEKFDAGIRTVGGPSGTGAIFCSFPDEHIGHYTAFVDEIVGTALLLFFVNALIDPRNQVPKWVHPIGFGLAIFLITSSFGMNVGSPINPARDFGPNVGSPINPARDFGPRLFLLFAGGSESASDSSYSFLPVVSLSAGQGCSGSRKIIGSGFGSRKRPGFGSIDKFLICLKIKWHC

SEQ ID NO: 135201 - protein, 68 aa, Heterodera glycines
  Coding regions on vcDNA: vcDNA=SeqID_61624; Strand=-; Position=1-209
  Homolog annotation: Hit_ID=NP_921817.1; Match level="QueryCoverage =98%, HitCoverage=4%, E-value=5e-09, Identity=49%"; Hit description =hypothetical protein [Oryza sativa (japonica cultivar-group)] gb|AAP54104.1| hypothetical protein [Oryza s
RLAFAATFIKGQGATYQKIGIDWTRQSFSHGQTYVALSRVGSWQQIKIKLSNENIDGKVDNIVWKEIL

SEQ ID NO: 135202 - protein, 125 aa, Heterodera glycines
  Coding regions on vcDNA: vcDNA=SeqID_61625; Strand=+; Position=1 -114,326-390,559-662,715-809
MGCMVPAESASFVPMTRIFSRVGHNDDLVQNLSGFAVEALPPKKALEFVMRFARNCFPLGYHFASVSTIDQATRLEILTPSPQLHEGPYEGPLYGLELAELATLPQKITQEARQLAEKIRKAKEN

SEQ ID NO: 135203 - protein, 57 aa, Heterodera glycines
  Coding regions on vcDNA: vcDNA=SeqID_61626; Strand=+; Position=1 -59,257-371
MTPQPFRDIMGETTILLEPRYLIVSNYNFFYLRFLKKNTNKHSLMKNYGLEIIKYQI

SEQ ID NO: 135204 - protein, 78 aa, Heterodera glycines
  Coding regions on vcDNA: vcDNA=SeqID_61627; Strand=+; Position=1 -90,633-779
MRVWMFVQQQLPVCARLVRDNDFKERLLLPAVIRPVPEEDPRGLQPRPVPGRHSSKSDEMLGPNCGSRLPSTAIIHNP

SEQ ID NO: 135205 - protein, 149 aa, Heterodera glycines
  Coding regions on vcDNA: vcDNA=SeqID_61628; Strand=-; Position=1-448
MNKIVLFVLFGLVFGQTNPNCCCLSNEEKQQLNAARKTIEKAFRDTLRLNTEARDFAAVSNRAISEAEKIKVRHPEAPGMKTWFGRLLEWVRKVQGFSEKLNEEKQKIGFIRKEMDKCLDRKDVLMCRELADEAKGIFEIVKQYRQDVG

SEQ ID NO: 135206 - protein, 58 aa, Heterodera glycines
  Coding regions on vcDNA: vcDNA=SeqID_61629; Strand=+; Position=1 -39,396-533
MCCYELDSHSRELRKIWAVKKESLRLLFKEFQKTNALTKLITETLNRGATLWYRLDNN

SEQ ID NO: 135207 - protein, 147 aa, Heterodera glycines
  Coding regions on vcDNA: vcDNA=SeqID_61630; Strand=-; Position=1 -83,432-792
MANSGDGTVNGTELVAQIEQSAKNDTERVVDTFLHIIHEARRQNGENGGGQNVDKFIRTVKIYRQIYATLDQFMEKNSANEVIAKNDTFKSVWTKLRNFMAKSVAQLDHLAKQRVEFKPSDGPSEQQTDEVIRQRFRSDFIKKYCKI

SEQ ID NO: 135208 - protein, 25 aa, Heterodera glycines
  Coding regions on vcDNA: vcDNA=SeqID_61631; Strand=+; Position=1-78
LPIPSTIAFIHPIMSAKIIRVPKIA

SEQ ID NO: 135209 - protein, 87 aa, Heterodera glycines
  Coding regions on vcDNA: vcDNA=SeqID_61632; Strand=+; Position=1-323
FLPGGTQFFTLTTPALFFFNYFFHFITQRSRLIRSSPNFAGKLLRTLQMLINFLRIFCLEEHSSSHLPHQHYFFLIIFFILSPNVLD

SEQ ID NO: 135210 - protein, 66 aa, Heterodera glycines
  Coding regions on vcDNA: vcDNA=SeqID_61633; Strand=-; Position=1 -90,172-282
MNTYIKVSPFILVSKPETLLVNVKIKYYPVLFFLLIKKLKFLQKFFLNIIYIILSLYLMIYLVTLL

SEQ ID NO: 135211 - protein, 496 aa, Heterodera glycines
  Coding regions on vcDNA: vcDNA=SeqID_61634; Strand=+; Position=1 -183,226-390,436-584,627-836,879-1059,1100-1336,1384-1654,1925-2019
  Homolog annotation: Hit_ID=EAL42187.1; Match level="QueryCoverage =72%, HitCoverage=73%, E-value=3e-31, Identity=30%"; Hit description =ENSANGP00000020626 [Anopheles gambiae str. PEST]
MSEIWSFYKKSQTSETALCNLCRNSFSCKKSSTKGLWDHLKTMHNDEFEQWQKNKGNTNKEGQENKITKFFQQSDDQKQKADELVLKLMLRTNSSFLITESPELRELYSKAFPGFELHSREYFRKIVLPKMANAIKEKICSQVSNDYFTITTDGWSQPTSTPSLLSITIHHIDNEFNRNDFVLEAVPIESHSGDNIADSIYDALDENGLKIEKLISIVRDDAKNMQRMARVLGKSSHQCVAHFLHLVAHDVLKLGQIKELTDKVHEWVKFCRTRKGFEILRRHQEKQNTEKIKLVQSVITRWNSVYKMLDVFRRQKKALLSMEAERTEFHLLGSQAKRSRLDFVSDHLPPLIQSDFVFLRQLCPLLELFNRETERFSREKSTCSCILPTLKRLFDFLTKEEHPQQIMIIAQSLAESIGSRMHNYRENELLRISMLLDPRFAYDLNLFMSGFWKSIAEDLIDFAKEMVWLNVDLFPRLFFIGLLLPNLRTLALAKTM

SEQ ID NO: 135212 - protein, 68 aa, Heterodera glycines; identical to SEQ ID NO: 134199
  Coding regions on vcDNA: vcDNA=SeqID_61635; Strand=+; Position=1-324

SEQ ID NO: 135213 - protein, 100 aa, Heterodera glycines
  Coding regions on vcDNA: vcDNA=SeqID_61636; Strand=-; Position=1 -54,650-789,841-888,1176-1236
  Homolog annotation: Hit_ID=CAE68058.1; Match level="QueryCoverage =77%, HitCoverage=15%, E-value=2e-20, Identity=53%"; Hit description =Hypothetical protein CBG13678 [Caenorhabditis briggsae]
MRTRPIWQVKQRLLTSQKVGAKLEATDQCEPNLVCPATICAIRGRLLQVHFDGWESEMDQLFDYRSRELFPIGWCEMYGYKLEAPKGYDLSKKKMRTIGE

SEQ ID NO: 135214 - protein, 259 aa, Heterodera glycines
  Coding regions on vcDNA: vcDNA=SeqID_61637; Strand=-; Position=1 -286,338-466,864-937,1042-1126,1199-1404
VGPKDALTLETELLRTAETKEIEIKTETIQNENNGKPKNYGKIKIKKEENDEENIFIKNEAQPNEFDKIKSEQNDEHFGNDEQNLDEESSDENKSDEESWTASSDYEQTDEESDEKSSKKGKLATKSVKNSFKRTIAKRSELSDNEKIRIVKQYIKRKGSLNQKNKKREQIASELGVTIHQIKNWTRKFGLGNQKWLTDRQRKMLIKKFDKIKEKRTQNGLPAGEIRELEEKIAEEIGINIRTIYKWRKKFGISGSWQK

SEQ ID NO: 135215 - protein, 111 aa, Heterodera glycines
  Coding regions on vcDNA: vcDNA=SeqID_61638; Strand=-; Position=1 -91,200-439
  Homolog annotation: Hit_ID=CAE67004.1; Match level="QueryCoverage =100%, HitCoverage=65%, E-value=2e-41, Identity=69%"; Hit description= Hypothetical protein CBG12403 [Caenorhabditis briggsae]
LRQETAEEAKRRFEIECEFVQALANPHYLNYLAQRGYFKEDYFVNYLKYLLYFKRPEYARTLKFPQCLFFLEALQSADFREAIASVDNARYIEDQQLLQWHFYIRVRQRLC

SEQ ID NO: 135216 - protein, 17 aa, Heterodera glycines
  Coding regions on vcDNA: vcDNA=SeqID_61639; Strand=-; Position=1-53
MPTSYHSSYNIPKIYYF

SEQ ID NO: 135217 - protein, 111 aa, Heterodera glycines
  Coding regions on vcDNA: vcDNA=SeqID_61640; Strand=+; Position=1 -109,164-257,666-797
  Homolog annotation: Hit_ID=NP_501970.1; Match level="QueryCoverage =100%, HitCoverage=3%, E-value=3e-24, Identity=45%"; Hit description =EGF motif related, Lin-12 and Glp-1 X-hybridizing, abnormal EPIthelia EPI-1 (407.8 kD) (epi-1) [Caenorhab
LLFFMGKDRDQLMVELVGGRISLSFDLGSGLGKLLSNGQRYNDGKWHLVQMDRQERSAKLKIDDTDKVEGESPGSMFEMSVSDVFFIGGLPSNIDARFIVHPFHGCMRNLK

SEQ ID NO: 135218 - protein, 54 aa, Heterodera glycines
  Coding regions on vcDNA: vcDNA=SeqID_61641; Strand=+; Position=1-162
MCNKLIIVTQTPPSSGRKGTDVRKMEDKINKEMEHTLRRYEQELWSSKAQQQAL

SEQ ID NO: 135219 - protein, 187 aa, Heterodera glycines
  Coding regions on vcDNA: vcDNA=SeqID_61642; Strand=+; Position=1 -226,276-418,470-662
MPFPTNGRISDRKKGTLLMDIEKVSEFAREEVESSRYSEKMYINGLPWKIYAENDKDESTDNKLYIFLLCDVPEEDKHWNCKCSGNVRIVSQKNGVLGFKKVFVDLVFDNENSCQCVKSISFAELMDLNNGFYNREDDKVTLAIDVTVKDEKTENFLSDPNKSNGTISMEIEKVSEFVREVIGSECE

SEQ ID NO: 135220 - protein, 125 aa, Heterodera glycines
  Coding regions on vcDNA: vcDNA=SeqID_61643; Strand=+; Position=1-378
MELSIDNDQLIWDVFAREIWPIFATNIRNLGFTSANGLDNFCRRTSPTILTDLNHLNSINSNFLLPDAIADDGPNASAGQVLSKWLHTPSKNGQPKRLHCIDYYDRSNLEWVNNLKEVAGHILTD

SEQ ID NO: 135221 - protein, 34 aa, Heterodera glycines
  Coding regions on vcDNA: vcDNA=SeqID_61644; Strand=+; Position=1 -84,776-796
MTKNDFAIVGENIFTAFLEEHDKLDPEAKFHSFG

SEQ ID NO: 135222 - protein, 49 aa, Heterodera glycines
  Coding regions on vcDNA: vcDNA=SeqID_61645; Strand=-; Position=1 -92,231-288
MSSGNSGSSANTFFNSPIISSHSNEYLHNEKNTNAEKMQNKRAIFASIE

SEQ ID NO: 135223 - protein, 80 aa, Heterodera glycines
  Coding regions on vcDNA: vcDNA=SeqID_61646; Strand=+; Position=1 -15,224-451
MSLFYESHHRLASELVTGMVSGSKLWQYAKVKKVQERLEQRLTDTFLGLTEEVEKNWGTALATIVRHHFVSLIISNYFIV

SEQ ID NO: 135224 - protein, 59 aa, Heterodera glycines
  Coding regions on vcDNA: vcDNA=SeqID_61647; Strand=+; Position=1 -26,163-316
MINEIWDKCCLATISSSDFKKALVEANGGEANTDDDSQLKHVTVEEVISRINAMVTFVD

SEQ ID NO: 135225 - protein, 79 aa, Heterodera glycines
  Coding regions on vcDNA: vcDNA=SeqID_61648; Strand=+; Position=1 -128,694-803
PSFLLQLFPSLILRPPRRCSESSSTTAGRLNQQQTDGATVTNANEPGATTATNTEAPAATTPATTTNADGATVTNANEP

SEQ ID NO: 135226 - protein, 159 aa, Heterodera glycines
  Coding regions on vcDNA: vcDNA=SeqID_61649; Strand=+; Position=1 -120,788-902,977-1024,1078-1274
MEGKGITDLEEVISSMRDEEAVDELELCCDSATEREGKKCDGQSNNGQDKGISSASTEHQNQSSKCQEGACRNWTSRTYTQCDRTREVHDVSGQSGGGANSDQFRTHGSPNSNKSKSRVFLAKMPEVLLLLITEFEIRSDQFLTHDRRVRTSLKVVFCP

SEQ ID NO: 135227 - protein, 326 aa, Heterodera glycines
  Coding regions on vcDNA: vcDNA=SeqID_61650; Strand=-; Position=1-981
  Homolog annotation: Hit_ID=AAK58439.1; Match level="QueryCoverage =59%, HitCoverage=97%, E-value=1e-26, Identity=43%"; Hit description =glycoprotein gp2 [Equine herpesvirus 4]
LAPASVPLFCCNYFRLSFYALPAVVQRARRRQQGASTNNRRTAPVRGRSSARARVSAAVRRASRRQGNNNDGDGTSTRKKRGSAMRRPLKLKPLRGRPRGSRKSRAAPRTAGQKRGRGRPRTVKKGRARRGKNAAQQQTTTTADAATNTDATGAATVTTDAATTATTPPTTTTADGATVTNANEPGATTATNTEAPAATTPATTTNADGATVTNANEPGATTPPTTTTADGATVTNANEPGATTATNTEAPAATTPATTTNADGATVTNANEPGATTTTTTAIADGAVATNTDATGAATTPTTNAATNTEAPAATTPATTADVALD

SEQ ID NO: 135228 - protein, 86 aa, Heterodera glycines
  Coding regions on vcDNA: vcDNA=SeqID_61651; Strand=+; Position=1-259
ADLYADYEGDGDDDNEEDEQYYMHLIAHKDSLEFGSIMVVPPTEPLTTADGNWVPNEGNVSRLSSQMSFSADGLMTPLGTLDTQET

SEQ ID NO: 135229 - protein, 109 aa, Heterodera glycines
  Coding regions on vcDNA: vcDNA=SeqID_61652; Strand=-; Position=1 -139,326-516
MIRRGTIVIKRGTTEIKKGKTVIRRDTTVIRRGTTVIRRGTTEIRRVIRRDTTVIRRGTTEIKKGKTVIRRDTTVIRRGTTVIRRGTTEIRRGTTVIRRGTKLLEEVQK

SEQ ID NO: 135230 - protein, 271 aa, Heterodera glycines
  Coding regions on vcDNA: vcDNA=SeqID_61653; Strand=+; Position=1-820
  Homolog annotation: Hit_ID=EAA06779.3; Match level="QueryCoverage =99%, HitCoverage=100%, E-value=1e-30, Identity=35%"; Hit description= ENSANGP00000001657 [Anopheles gambiae str. PEST]
FCTSSDHSCTSSDLCCTSSNHCCTSSNHCCISSNHCFTFLNLCCTSSNHCCISSNHCFTFLSSCTSSNHCCTSSDHSSNHCCTSSNHCCTSSDLCCTSSNHYCTSSNHSYTSSSNCTSSDLCCTSSNHCCTSSNHCCISSNHCFTFLNLCCTSFYHYSTSSNHCCTTSNHCCTSSNHSCTYSDLWCTSSNHCCTSSDLCCTSSNHYCTSSNHSYTSSITVTSSNHSCTYSDLWCTSSNHCCTSSDLCCTSSNHYCTSSNHSYTSSITCTSS

SEQ ID NO: 135231 - protein, 170 aa, Heterodera glycines
  Coding regions on vcDNA: vcDNA=SeqID_61654; Strand=-; Position=1 -20,560-631,683-824,867-905,976-1112
  Homolog annotation: Hit_ID=CAE64901.1; Match level="QueryCoverage =100%, HitCoverage=17%, E-value=7e-33, Identity=48%"; Hit description= Hypothetical protein CBG09716 [Caenorhabditis briggsae]
YESIAKIGTGFKDEDLKSQFKEFQELRIDKPRSYFAFDPSLAPRSYFAFDPSLAPDHWFEPSVVWEVKAADMSISPRHLAARGLVDAEKGISLRFPRFIRISLRFPRFIRNRADKKPENATSSEQIDKKPENATSSEQIAEMYRNQDHIKNQKDGKVDDEEEEGEEKKEE

SEQ ID NO: 135232 - protein, 58 aa, Heterodera glycines
  Coding regions on vcDNA: vcDNA=SeqID_61655; Strand=-; Position=1 -37,175-314
MQGEAEEGKLVEDDGGKTADTAERRRWNKYSNANEDDKQFSGRKRRREREQQDKDLYI

SEQ ID NO: 135233 - protein, 103 aa, Heterodera glycines
  Coding regions on vcDNA: vcDNA=SeqID_61656; Strand=-; Position=1 -91,164-384
MGFHLFVRVRNQSLFRQPFGPFAYSALALVGSSNSKLSFSNKFTDGTKNMLNSQPFVVAGWGITKPWCSSGIHSATDQLMYGTMRMISMEECVGDKSESGRVY

SEQ ID NO: 135234 - protein, 103 aa, Heterodera glycines
  Coding regions on vcDNA: vcDNA=SeqID_61657; Strand=+; Position=1-312
MFNRFSPIAARKRNSNGTNILQGRPGNKQKIVMERSRIRWGKRGKKGKSIGGKIGGGKGGIEKGGKGGKGGKGVEETDTEERIGQRNGRQIGGQLDDEKQTKA

SEQ ID NO: 135235 - protein, 99 aa, Heterodera glycines
  Coding regions on vcDNA: vcDNA=SeqID_61658; Strand=-; Position=1-300
MSVMPFVALLLLAADLPPDPFLLTLGRAIGAFIGGPDNPSVVHPSVVNPSVDNPSVKDNPSVDNPSVKDNPSVMDNPSVDNSSANFFLSNDQKSCENDC

SEQ ID NO: 135236 - protein, 97 aa, Heterodera glycines
  Coding regions on vcDNA: vcDNA=SeqID_61659; Strand=+; Position=1 -169,458-579,1273-1275
MNLPKNLAQLGPVRVARVAQGSSSVEQPRQSASRHLTTAHKVPSAVSTLALALAELRISFWKFFNFLRALFFVYCIFVKDLFENPLNRHIKHKNPEK

SEQ ID NO: 135237 - protein, 95 aa, Heterodera glycines
  Coding regions on vcDNA: vcDNA=SeqID_61660; Strand=-; Position=1-660
LFEYPKRTLEKINFFVFGAVPPSRCAQIYGETESFRNSFPIACTLILRWIFAPHNCLSTPNGHLKKSIFLFSGQSPRADAPRFMGRPNPSGIASL

SEQ ID NO: 135238 - protein, 446 aa, Heterodera glycines
  Coding regions on vcDNA: vcDNA=SeqID_61661; Strand=-; Position=1-1340
  Homolog annotation: Hit_ID=NP_494149.1; Match level="QueryCoverage =98%, HitCoverage=28%, E-value=2e-91, Identity=42%"; Hit description =predicted CDS, putative protein of ancient origin (2C297) [Caenorhabditis elegans] gb|AAF39854.1| Hypothe
MRAMRDANIGIDPQLLRTAYEVIKNVNPFAEAYMMMKEEEDEEVERARNENREPAEIKLLFETGRQLDRRLEYNVPRANEVAAVYVPGADGEVPNAKIVVRERGKELKILKGTDSMVTPMTYPLFYPRGTLGWHPEMKHRNSNRRVTRLQYVCYTLAIREREFNPILFGGKLFQQYCVDEYVKIEGDRMNWIKNNQKKILADAYKNVDNMLMKRAQERGLPLGRKVILPPSVTNSPRYVEKYFQDAMAVVRRFGKPDMFLTMTCNPQWAEISENLFHEQTSIDRPDLVVRVFNLKVKAIMNEIAKKKIFGEVIAWMYPVENQGRGLPHIHLLLTLTEQDKMINGEDVEKKGISARIPDKELVPDLFELVKRFMIHGPCGDLNPNCPCMEEFVDKNGMRGRKCSKGYPKAFQEETIVLENGLALYARPNDGRTVEVFANGRRHALDN

SEQ ID NO: 135239 - protein, 88 aa, Heterodera glycines
  Coding regions on vcDNA: vcDNA=SeqID_61662; Strand=+; Position=1 -89,196-373
MGNIRRRNGKNLMQKLNKCLVLIIGQLKDGAEALYICEKTEKIKQYYQLKNQNPKLNDRQIAEILNITKRSLERYKSEFKRKSEGVTD

SEQ ID NO: 135240 - protein, 67 aa, Heterodera glycines
  Coding regions on vcDNA: vcDNA=SeqID_61663; Strand=-; Position=1 -156,255-302
MDEEIKGRKISKELENYHELLLRLFKIKFKQLINQNDKFVEEMLTKEWVIELLCRQFKKRSIKKNDC

SEQ ID NO: 135241 - protein, 26 aa, Heterodera glycines
  Coding regions on vcDNA: vcDNA=SeqID_61664; Strand=+; Position=1 -34,374-420
MNGAISKCHSTISIKQFFKLDFMAKC

SEQ ID NO: 135242 - protein, 80 aa, Heterodera glycines
  Coding regions on vcDNA: vcDNA=SeqID_61665; Strand=-; Position=1 -124,176-294
MPKRKLLSKINARNSTQKREQKREERREKTERARQARWAKKTAPQPNTDAETPQPSEEEPSHQRHRRGTTTDDHHQLQHR

SEQ ID NO: 135243 - protein, 147 aa, Heterodera glycines
  Coding regions on vcDNA: vcDNA=SeqID_61666; Strand=-; Position=1 -249,966-1160
  Homolog annotation: Hit_ID=YP_050229.1; Match level="QueryCoverage =91%, HitCoverage=35%, E-value=4e-26, Identity=47%"; Hit description =ABC transporter, substrate binding protein [Erwinia carotovora subsp. atroseptica SCRI1043] emb|CAG75036.
MFEQRFPNMTLDIPVDYSVNHAPRVNLQMVTPGGVVPDIVSLQTLQEFARWKRLGKLLAYKPRGWDKVYRAFRDPDGYFTGLYVMTLGISINKNLVSNSTNPPTYGDLLQSAEFANGTVGTADPNHDDAVLFIYKQVGGASVVKFAY

SEQ ID NO: 135244 - protein, 124 aa, Heterodera glycines
  Coding regions on vcDNA: vcDNA=SeqID_61667; Strand=-; Position=1-375
MKSFSIVCFLLITTLLCGQFAAAHLGFFDDFFDSDENFDFDELFKSKLHYAIGQRDKKQQQKKPHKHGNVDVENRSLDQLYAAALAEGGKLVVYAGGEAPRQQVIQWRELFPRLMLKLSPRLVT

SEQ ID NO: 135245 - protein, 92 aa, Heterodera glycines; identical to SEQ ID NO: 125147
  Coding regions on vcDNA: vcDNA=SeqID_61668; Strand=+; Position=1-304

SEQ ID NO: 135246 - protein, 74 aa, Heterodera glycines
  misc_feature (13)..(13): Xaa can be any naturally occurring amino acid
  Coding regions on vcDNA: vcDNA=SeqID_61669; Strand=+; Position=1-303
IILYPRKMSISFXEKFYTSQKRLRMRRRAVHNRHFISQRIFIFRLYPRKMSISFFDKFYTHTNALEHDREGGAQ

SEQ ID NO: 135247 - protein, 49 aa, Heterodera glycines
  Coding regions on vcDNA: vcDNA=SeqID_61670; Strand=-; Position=1-150
LLAKLDEERREKAMEMVGEQQHTDAEFEQKFVEFAKGFKRDEQKVDKKK

SEQ ID NO: 135248 - protein, 19 aa, Heterodera glycines
  Coding regions on vcDNA: vcDNA=SeqID_61671; Strand=-; Position=1-59
TFSFSSLALTNTHTIFEML

SEQ ID NO: 135249 - protein, 19 aa, Heterodera glycines
  Coding regions on vcDNA: vcDNA=SeqID_61672; Strand=-; Position=1-59
TFAFSSLALPNTHTIFEML

SEQ ID NO: 135250 - protein, 19 aa, Heterodera glycines
  Coding regions on vcDNA: vcDNA=SeqID_61673; Strand=-; Position=1-59
TFSFSSLALPNTHTIFEML

SEQ ID NO: 135251 - protein, 19 aa, Heterodera glycines
  Coding regions on vcDNA: vcDNA=SeqID_61674; Strand=-; Position=1-59
TFAFSSLALPNTHTIFEML

SEQ ID NO: 135252 - protein, 19 aa, Heterodera glycines
  Coding regions on vcDNA: vcDNA=SeqID_61675; Strand=-; Position=1-59
TFAFSSLALPNTHTIFEML

SEQ ID NO: 135253 - protein, 18 aa, Heterodera glycines
  Coding regions on vcDNA: vcDNA=SeqID_61676; Strand=-; Position=1-58
TFSFSSLALPNTHTIFEC

SEQ ID NO: 135254 - protein, 57 aa, Heterodera glycines
  Coding regions on vcDNA: vcDNA=SeqID_61677; Strand=+; Position=1-172
MGKGRTTGNSGGGKGGSGGGGDEKSGGSGAGKGTVAAGSGGVRGKGAGQSGPAAAAA

SEQ ID NO: 135255 - protein, 203 aa, Heterodera glycines
  Coding regions on vcDNA: vcDNA=SeqID_61678; Strand=-; Position=1 -517,1124-1216
LLAKRLTELKMDLKTVAAIASVDEHKKHLQKLSSNLKREKNGLKRFHRELADEIEAEIALRTNYAQTAEHLAKLDAEVRSAAAEGRVPQTEAMLRRIELQMEMLKKQCRATRKFVEMSVDGAASTSPTRRRRIIFKLSSTVTTIIQAGRNRNYQALGEMKHLLSCCCFSKCQEEQEDQSDFLVQAEQMVEKSEMVRLKKEELI

SEQ ID NO: 135256 - protein, 307 aa, Heterodera glycines
  Coding regions on vcDNA: vcDNA=SeqID_61679; Strand=+; Position=1-929
  Homolog annotation: Hit_ID=AAM11674.1; Match level="QueryCoverage =100%, HitCoverage=36%, E-value=4e-64, Identity=42%"; Hit description= pol protein [Drosophila melanogaster]
LRPCVDFRPLNNITIPDPYPIPRMDKTILRVAGQTFYSTLDLASGFWQIPLDSESSYKCGIVTPWGLYQMVKLPFGLRNAPSIFQRTMDKALEGIRNVTVYIDDILVHTNTEEEHLETLEKVFCRLNEFGLKLKREKCEFLKNECTYLGHILNGKGYRPSLNNQEVIEGFPEPENAREVKRFLGMMSFFRKFIQNFAEIANPLQQLTKKSLNLYGKSRKEAFGKLKNFTECQCLRAPNYELPFYLFTNASAIAYAGALMQSQNGNDLYSVGYWSRTLSTTESKLQPTHGELAAIVHAVENFRHYLVG

SEQ ID NO: 135257 - protein, 273 aa, Heterodera glycines
  Coding regions on vcDNA: vcDNA=SeqID_61680; Strand=-; Position=1 -474,619-798,843-1008
EIKIGDSLALSGKNLIFGKEIARVASRNRDCVQLALCFRQHSSMPPLERLRLLQAQQQMPHELVLDRFPPQLVQSVHQLADTVERRYDRSANSRGFSPFPVFGPFITDSISGGSGATMAPQPRQKSVPPQATYDGTKPWAMAPPKEEMSVSMTTSQHRMPIFDKLPKQQQEQSTHFLPPPMTSSSGDEWQSAYECLPQWTKQMPKMPPETAPKPQQDLSSSFPSFCAAPFAESVQCSVNLCKFHAYSRQLAAKSIWPMSDSQAEMFQSVVSVE

SEQ ID NO: 135258 - protein, 84 aa, Heterodera glycines
  Coding regions on vcDNA: vcDNA=SeqID_61681; Strand=+; Position=1 -123,746-877
MYYIQVTTISDASKCMLTFALGAFAPMSKIGFKFEFFSIREFYDSFKDADFPASFIAICAARALISFFGVILNGILLFVTLRSK

SEQ ID NO: 135259 - protein, 81 aa, Heterodera glycines
  Coding regions on vcDNA: vcDNA=SeqID_61682; Strand=+; Position=1 -91,282-436
MFLKQYNLDQIDYTKRIFKALLVNVLFVSTVRIIELRSTNIFLDDKHSFYTRDSDAICGGNVMAKRQIDQRNGRVGNVRLA

SEQ ID NO: 135260 - protein, 88 aa, Heterodera glycines
  Coding regions on vcDNA: vcDNA=SeqID_61683; Strand=+; Position=1 -94,145-317
MSRKISKKIAEKIGTNMHSIWDWKKKFQLNNRKTKTYTDAEKLEYVKKCEEMMKRNPMMSETKIAEELEIPRQNLRRWKKKFGTNEIN

SEQ ID NO: 135261 - protein, 177 aa, Heterodera glycines
  Coding regions on vcDNA: vcDNA=SeqID_61684; Strand=+; Position=1 -104,144-374,484-679
  Homolog annotation: Hit_ID=CAE68555.1; Match level="QueryCoverage =96%, HitCoverage=37%, E-value=6e-47, Identity=58%"; Hit description =Hypothetical protein CBG14388 [Caenorhabditis briggsae]
MPSGSRDFDLPAESHEWAPPSINCEDLQKEIEHLRRLIVKSRSLVTFCHNDLQEGNILLPKAHSGNIRIGSESDEILSGIDGNMTNNSLTAFNPMDPRLVLIDFEYASYNYRGFDFANHFVEYSINYDNDEPPFYEMLPEKFPSEGQMLEFMYNYEKELRPNASEEHLWEIARSMVE

SEQ ID NO: 135262 - protein, 34 aa, Heterodera glycines; identical to SEQ ID NO: 125570
  Coding regions on vcDNA: vcDNA=SeqID_61685; Strand=+; Position=1-102

SEQ ID NO: 135263 - protein, 24 aa, Heterodera glycines
  Coding regions on vcDNA: vcDNA=SeqID_61686; Strand=+; Position=1-73
MHCLCVASWDHVLVRVLTLLAQLG

SEQ ID NO: 135264 - protein, 21 aa, Heterodera glycines
  Coding regions on vcDNA: vcDNA=SeqID_61687; Strand=-; Position=1 -54,581-592
MRTRPIWQVKQRLLTSQKKGF

SEQ ID NO: 135265 - protein, 44 aa, Heterodera glycines
  Coding regions on vcDNA: vcDNA=SeqID_61688; Strand=-; Position=1 -87,148-194
MSASLARQLVELQTNPTDGFAVRGLVDDNIFKWQVIIFGPSESP

SEQ ID NO: 135266 - protein, 132 aa, Heterodera glycines
  misc_feature (131)..(131): Xaa can be any naturally occurring amino acid
  Coding regions on vcDNA: vcDNA=SeqID_61689; Strand=+; Position=1 -200,251-409
  Homolog annotation: Hit_ID=CAE63231.1; Match level="QueryCoverage =92%, HitCoverage=23%, E-value=2e-23, Identity=44%"; Hit description =Hypothetical protein CBG07592 [Caenorhabditis briggsae]
LPSPFRYLCIRYPLNSRQICSIRNVRIATVCITCISIICGLPKCVDYHFAVYEGLLYVEGEWVPLRSCLSGFTFFVQLVGSCLSGFTFFVQLVGQNAFFNAYFWTRVVAFILLPSLLLICLNALLIQLVNXI

SEQ ID NO: 135267 - protein, 671 aa, Heterodera glycines
  Coding regions on vcDNA: vcDNA=SeqID_61690; Strand=-; Position=1 -182,230-483,540-823,871-1082,1127-1562,1607-1864,1917-2306
  Homolog annotation: Hit_ID=NP_920291.1; Match level="QueryCoverage =89%, HitCoverage=38%, E-value=6e-70, Identity=32%"; Hit description =putative helicase [Oryza sativa (japonica cultivar-group)] gb|AAP52578.1| putative helicase [Oryza sativa
MLLAHAHPSNPQALFDEFLDEMNPPVAANHPGAVPKPAEVRAAEVMLNLEYYLNCMGTNTKDVGLQGLPVGYDFQHQAQLLEEDNILDSFYGEDARQRCKPPQQVAIEQIGRLNPDQRAAFDEISTSILGGCDQKLFFLEGAGGCGKTYFYNTLIKWCIAGKPSLDGNANAQWVRNQELQRNSVVAAASTGIAALLLIGGGTAHRHFYVPNDVSQETPPMLNFESAKAEQLRHAQLIIIDEISMLSNTVLDYIDRLLRDVCANATPFGNKVVVLSGDWRQLTPVVEHGTREDQVGTSIKMGALFRLFKKISLTINMRTAPGEQSLRDWLQEIGNGMHRVGTDSQGFTNQLRIPPELLVDDLDHTIHFCFPEALFDDPLANADAIAHNAILCPTNNDVQHINEVALGRMSGCGREFLSIDEPLEPNEEMHNFRTDFNMEAVHNEMPSGMPPHKLTIKVGTPVMLIRNLDVTQGLCNGTRLQVMRTSENNLFCRILTGPRAGAQNIIAIPQIQFEYGRARHHRGLRFRRLQFPVRLCFAMTINKAQGQTLQRMALVLNGRQCFSHGQVYVAMSRVTQMDGIRVYAPFCQSGYGTHIENVVYHELLDLETQQSRIPNRGLMDVDNDPDAAIPDVGPRVPDVANDPDVERDNGHAAGANHQEPNDLDSSFDDFFD

SEQ ID NO: 135268 - protein, 421 aa, Heterodera glycines
  Coding regions on vcDNA: vcDNA=SeqID_61691; Strand=-; Position=1 -106,176-244,374-484,824-954,1098-1443,1489-1697,1799-1946,1989-2134
  Homolog annotation: Hit_ID=NP_494302.1; Match level="QueryCoverage =63%, HitCoverage=19%, E-value=4e-14, Identity=27%"; Hit description =predicted CDS, putative protein of ancient origin (2C878) [Caenorhabditis elegans] gb|AAB95006.1| Hypothe
MPSKDRRRKEADRLRWRAAIQTPDVANALGGPNTSEPSTSTGIRAQIRQQRNDGQAIVGSASKRTRHNGNVGTPNNAALSSEQHRSDTSDVESVAAANYTRCGYACDCPSYAQCQQNASSFLSSQKYLKQYEHGIKPAPVDYYDCGQFGDAFCGHCGARLLLGEFNNIKRARRQTPCCGNGATHTEQMITELDELKLPPPAYVHGLVDAVDERVREAFLNNIMAFNNLFAFASTHGEKAPPEQMGGRLDTCKYNGQFSFLFSDLIAPGVRLPSFAQVYTLPPEDALNVRQEALDTAVAPLIKQTIMERLEALMRQNPFGQTFQTIALLTDRDLKGGPLHGRTDVTVIERADAPTAKQVAVIWVQEDGLPPQISAFWLSDKAGKMRELKSGMPQIDPCCFPLIHPRGTLGWRWFMKKRGFEV

SEQ ID NO: 135269 - protein, 250 aa, Heterodera glycines
  Coding regions on vcDNA: vcDNA=SeqID_61692; Strand=+; Position=1 -46,246-949
MPTSSSPTNLHPLLYVSQLTTNSNKAAEVIFSMKLHSVCVDFDKVAVSLQQRFKDGKGELPKFCDPLGLRWAEIVEEPISENLECGKDSNSSDAQNKILSILPANETVPPATEEFSMVDNKNQKEEKEEGRDKETPADEVFEGELGFSRQVGGVEVVLSRAELEKLRRLEKPGIVVIGFKPLHLLKDSHRMGATVFVYPIKSVISGSWPLVNADQVETAKQFVKKLTNTKFLPDDFANSMLQQHYKAVEM

SEQ ID NO: 135270 - protein, 48 aa, Heterodera glycines
  Coding regions on vcDNA: vcDNA=SeqID_61693; Strand=+; Position=1 -82,125-189
MGLTRYSFVKWIINLEKYETYAFAHFSGRYDSHFVLRDLRIWDISSRN

SEQ ID NO: 135271 - protein, 61 aa, Heterodera glycines
  Coding regions on vcDNA: vcDNA=SeqID_61694; Strand=+; Position=1 -40,82-227
MYFPNQFNKEENYGIILTTLPPFEDYFPDELSEEEYDKFKKWYYANYNSGFNVVKLKNFLY

SEQ ID NO: 135272 - protein, 84 aa, Heterodera glycines
  Coding regions on vcDNA: vcDNA=SeqID_61695; Strand=+; Position=1 -113,424-565
  Homolog annotation: Hit_ID=CAE72291.1; Match level="QueryCoverage =95%, HitCoverage=5%, E-value=1e-18, Identity=59%"; Hit description =Hypothetical protein CBG19421 [Caenorhabditis briggsae]
MPLAVISNTVVRSVGVEQHEDSESVEKFVRYVAKCKYSLEIDYQQCSDLDNELATSAAETEEPAEPSRHLAAFDPKDVQQRHEG

SEQ ID NO: 135273 - protein, 75 aa, Heterodera glycines
  Coding regions on vcDNA: vcDNA=SeqID_61696; Strand=-; Position=1-225
PGLKCPAQAKNFFYFREKIEIFPKKIPVDRARKTMFWKWSQFLWEKSLKNPKIQKPENRFLGLARKIFKIFEILK

SEQ ID NO: 135274 - protein, 19 aa, Heterodera glycines
  Coding regions on vcDNA: vcDNA=SeqID_61697; Strand=-; Position=1-61
FGREILFFETKLKTYITYI

SEQ ID NO: 135275 - protein, 86 aa, Heterodera glycines
  Coding regions on vcDNA: vcDNA=SeqID_61698; Strand=-; Position=1-318
KNRFIFGFGAVPPNRCAQIYGETDSFGNSFPIACALILRWIFAPHNCLSTPNGHLKKSIFLFSGQSPRTDAPRFMGRPNPSGIADL

SEQ ID NO: 135276 - protein, 123 aa, Heterodera glycines
  Coding regions on vcDNA: vcDNA=SeqID_61699; Strand=-; Position=1 -180,331-506,661-678
SERELTPFFSINHIFFIHFLSRSHELYYFLNLYRVNLIKDLNNINFLRFYTASETFKSVNSERELTPFFSINHIFFIHFLSRSHELYYFLNLYRVNLIKDLNNINFLRFYTASETFKSILHAN

SEQ ID NO: 135277 - protein, 234 aa, Heterodera glycines
  Coding regions on vcDNA: vcDNA=SeqID_61700; Strand=+; Position=1 -240,283-669,717-794
MKRGQGNEHILQWFNDYETQQKQSQRKGENAKDDDGTTEENPFKFIKIHINEMANSLTIDAHVTEEKGAVVEICLCDEKYGICDGPFEATENFGGKINPKATECVKFDYKTINILNQIVKKENKLSVLAQFRMNYKKGGKNKAKNAIFGGLFKKVNTQNEKEMAQKMIDVRNWHIGNLLAANDERNSRRLDREFFLRISFANESKSNPKVILGEWAVQKSVKFEMIPSPNWSKL

SEQ ID NO: 135278 - protein, 135 aa, Heterodera glycines
  Coding regions on vcDNA: vcDNA=SeqID_61701; Strand=+; Position=1 -95,1119-1345,1451-1536
  Homolog annotation: Hit_ID=NP_872134.1; Match level="QueryCoverage =75%, HitCoverage=28%, E-value=1e-25, Identity=55%"; Hit description =mitochondrial substrate carrier (39.7 kD) (5P134) [Caenorhabditis elegans] emb|CAD56651.1| Hypothetical p
MPKAIQPITTSNNSLNNAFRNDRRFFCWMPRSGLLITQLRDCPAMGVYFASYAFLRRSMDSENEQSQGMSNLQLLFAGGAAGMCSWLSNYPTDVVKTRFQSDDAYENYREVVKKAYSEHGWRTFFAGLGSTLIRC

SEQ ID NO: 135279 - protein, 59 aa, Heterodera glycines
  Coding regions on vcDNA: vcDNA=SeqID_61702; Strand=+; Position=1-182
FFSADRCKMSQQNEEALGKDQKELRAVQHDMERLFKARDAKGLSELYTVDAIFASNLNF

SEQ ID NO: 135280 - protein, 87 aa, Heterodera glycines
  Coding regions on vcDNA: vcDNA=SeqID_61703; Strand=-; Position=1 -169,1274-1368
MEYLSVLELHLTGSILLAFVFGPKLYVLLFYEPVVVQFDTDGCAHGDKALDLFEAAEPKNIIPNDNIVIIEYLSHFIFMIHPLAIVP

SEQ ID NO: 135281 - protein, 293 aa, Heterodera glycines
  Coding regions on vcDNA: vcDNA=SeqID_61704; Strand=-; Position=1 -116,171-310,357-591,633-774,824-1069
  Homolog annotation: Hit_ID=NP_501400.1; Match level="QueryCoverage =96%, HitCoverage=17%, E-value=4e-26, Identity=30%"; Hit description =calcium-sensing receptor, similar to human metabotropic glutamate receptor type 3 (157.9 kD) (4J72) [Caen
MCTGEERLNVKGMGRLSKAGNLAKGVDRLLKAIDKAHKKLCIREKLCDEFIENGRKLTREYLRKSAKEESAEMFEVFEFVPIDHHGNFDYSLMANLSLPRTSIDSSAGGAFSPNNNPSISNIAINFLADYRPFAYGVPITRDSPSATVISRCKSPFCKCPLMMSDDFHFGADVSAWLGHNSVFRREPSRQRMAEISEDDEFLLRENMADEPEIRELSADAVDREVAWAIRAILLSLSALLSAIAVGTLLCILFKIWRRTIRGSQSLGILLLLGIITMHLSAFLFTTEGANEPF

SEQ ID NO: 135282 - protein, 22 aa, Heterodera glycines
  Coding regions on vcDNA: vcDNA=SeqID_61705; Strand=+; Position=1 -54,120-134
MCHTRSKMMLTSAGKKSRVITN

SEQ ID NO: 135283 - protein, 92 aa, Heterodera glycines
  Coding regions on vcDNA: vcDNA=SeqID_61706; Strand=-; Position=1-3,49- 303,775-795
MDGCVDVVEYEKRKAEVVKERLRASNRQLVAFTESPELMIQKILEEEANRKEGEAEEAQPKRGLEEEEEEEAESGEEEDEESFCMEYANNRY

SEQ ID NO: 135284 - protein, 63 aa, Heterodera glycines
  Coding regions on vcDNA: vcDNA=SeqID_61707; Strand=-; Position=1-191
MSAPPPYNPNMQQYPQQPQPNYGQPGYGGGGGGYGYPSQPYPQQPNSYGGGGYPQQQQPQPQV

SEQ ID NO: 135285 - protein, 53 aa, Heterodera glycines
  Coding regions on vcDNA: vcDNA=SeqID_61708; Strand=-; Position=1 -150,354-365
MFGWTLSLFDRHQLGLKLALLSPHFELLVDKHVDDESELTIWRAIEIRRKYWA

SEQ ID NO: 135286 - protein, 99 aa, Heterodera glycines
  Coding regions on vcDNA: vcDNA=SeqID_61709; Strand=-; Position=1 -171,222-349
KLWETYPTAFDTNNAAGFIPKLHWSLAHGPDFAKRWGWFAWISEQGIEHLHHVLNKQSERFFRYKGDELLLKIGEHQTLLNSIFDRHMDSFDTSKAKKH

SEQ ID NO: 135287 - protein, 30 aa, Heterodera glycines
  Coding regions on vcDNA: vcDNA=SeqID_61710; Strand=+; Position=1 -87,390-395
MHPEKESSVYRVHVRKKKRNGHGTHGFVEG

SEQ ID NO: 135288 - protein, 91 aa, Heterodera glycines
  Coding regions on vcDNA: vcDNA=SeqID_61711; Strand=+; Position=1 -147,526-654
MTRWAVMNFPANEMCLWPQALLYGTNDDNNNNKYNYRKLIRRREVLSDRVVYSLFNQHSAHKFVVNIYYSSESDLFKQMHCFTIRRHRPSR

SEQ ID NO: 135289 - protein, 103 aa, Heterodera glycines
  Coding regions on vcDNA: vcDNA=SeqID_61712; Strand=+; Position=1 -21,64-222,265-394
VGEQKAQMTSLMVKNGRLCEKLGEHQKGLKAVQNRIELLEQCHLREFVAGLPPVHEDGSLVLSQFENGNYFAEMKILFQSGSRFCSGFAIKSSAHFRNYPSNL

SEQ ID NO: 135290 - protein, 134 aa, Heterodera glycines
  Coding regions on vcDNA: vcDNA=SeqID_61713; Strand=+; Position=1 -219,608-793
MSNLFVASSAVVFLLLQLHFVVTFASSFEGAPPKANEEAMPTTGEQNGGAEFGGSKQKMARKMMRYNGNNFDKVSVLFIRREMALRKLQLQINVLEQQLANALSSAFAAGCPPSGVSSVSDGISHRRHLPMPRE

SEQ ID NO: 135291 - protein, 160 aa, Heterodera glycines
  Coding regions on vcDNA: vcDNA=SeqID_61714; Strand=-; Position=1 -225,763-832,928-1115
LFDWPLAELLPQQSAEDGTPISPISCYTQLDESFVDESRLYRLNNTEQLRERACLLRIPTGTRFTVERMHTKNQGTFVGVMAGSSQAYLPMWTGRIFEGHSDMYGPWHVQCQNAYLVFNSVAFPHLEWFDFRLTRETEEDRSTSNAEDCIAEELVDRGRF

SEQ ID NO: 135292 - protein, 190 aa, Heterodera glycines
  Coding regions on vcDNA: vcDNA=SeqID_61715; Strand=+; Position=1 -522,755-805
MNSTIIRVPKIACDLSLAKNGVSKNRNYAQKASQTILAHPIPSTIAFIHPIMNAKIIRVPKIACDLRLEKNGVSKNRNYAQKASQPILAHPIPSTIAFIHPIMNAKIIRVPKIACDLRLAKNGVSKNRNYAQKASQPILAHPIPSTIAFIHPIMNSKIIRVPKIACDLSLAKNGRITYIFVNIIFARRYY

SEQ ID NO: 135293 - protein, 139 aa, Heterodera glycines
  Coding regions on vcDNA: vcDNA=SeqID_61716; Strand=-; Position=1 -108,543-727,989-1112
  Homolog annotation: Hit_ID=NP_741181.1; Match level="QueryCoverage =98%, HitCoverage=25%, E-value=2e-47, Identity=52%"; Hit description =membrane bound C2 domain containing protein (3H314) [Caenorhabditis elegans] gb|AAC24452.2| Hypothetical
MIMREREMVMAQYSRVDDLPAWVQFPDIERIEWVNKGGLKVYTQNVGRDRVIMDMDVVYAGDAEFAVQACGFRGGLNQMVFSGKLRCTLQPLLSQPPMVGGVSSSFMELPKFDFNLTGMGEFVQLPGLIDAIRSVVNTQ

SEQ ID NO: 135294 - protein, 44 aa, Heterodera glycines
  Coding regions on vcDNA: vcDNA=SeqID_61717; Strand=-; Position=1 -39,313-408
MTIHIKKRYFKLRVLHEKQGLIEQHFRIYCFRLTNVLFQLSEKD

SEQ ID NO: 135295 - protein, 88 aa, Heterodera glycines
  Coding regions on vcDNA: vcDNA=SeqID_61718; Strand=-; Position=1-376
PLKTCFWKIFVEKIFSLKNHVHPPLVPNLKITFIFIKILKKVIKMPNKIYIIEQKTADFCSILFFQNIFSEPSYEFFSENSNFSRNSG

SEQ ID NO: 135296 - protein, 385 aa, Heterodera glycines
  Coding regions on vcDNA: vcDNA=SeqID_61719; Strand=-; Position=1 -95,145-296,377-413,458-669,728-822,868-1036,1135-1290
  Homolog annotation: Hit_ID=CAE69240.1; Match level="QueryCoverage =98%, HitCoverage=31%, E-value=5e-76, Identity=43%"; Hit description =Hypothetical protein CBG15283 [Caenorhabditis briggsae]
ACVAVKTESRNVLDNLARCLNAFCKVDDLIGQIVSEGGVKLLLHLFKKCSAEGKGQIVSEGGVKLLLHLFKKCSAEGKLRAAHGLAKIGIRSDPNIAFSGQRMYEVVKPCIVVKPCIELLHPEVDGKANYDALLTLTNLASVGDGKANYDALLTLTNLASVGDSVRKRILKEKCLPKVEEFWFEVNNEHLRAAAAELLLNLLYCEEYFNTVIKAGTDRAKVWAGTDRAKVWLLYCAEDDRLRLASSAGFALLSENPTFCERILQELNSWEELFTALLSENPTFCERILQELNSWEELFTELAMSENPEVQRRCLIGIANLAVGGERVASQLFASQVFHVLVAITKLDEKGREGSKKEARRALEVAESRGLIRATERQIKEQIDSK

SEQ ID NO: 135297 - protein, 683 aa, Heterodera glycines
  Coding regions on vcDNA: vcDNA=SeqID_61720; Strand=-; Position=1 -75,130-306,823-922,992-1461,1876-2140,2495-2965,3269-3762
MDYFIPIFLLFNLCLFFAFTIGNPSMEDDAMVELAKGPEYFNKFCADKGLIINEKNQFVSDKYEAHLGVLYVMRMKWNHVTETRYNINVFNELDNFRQFAFILYEYFFWQYVAEYVKAVDPTLAEQISITKNPIKPKLESNGREIKFCDAILDWAFVWRNHWLGGNYSKTTRLINKETLIEKYGINLNNWYEQESLFDMPKMKLKLNANSKFDNSFPRLRKMFDFKMEKLKTMALEKVSRYDFFGAALIECSSITNEALISHINHKPFYGIDKAIEDNIFLIVLKEMRVEKFGAKLETAPLSANAKSLIHSQKLEIKLYLKIIYLMRLKWQCAEIENYRKECTKFRKYFNFLYEYLFRTYNEADNSEVPQQFAAVRPNFTFGSGNIIKSLIYVASELCGIAAFFFDPTYAKEFDYKLDKYFKKYAEPKLLNESEVSGEKTIGQKVFESVAKIGKSPKRVEEKAAAISPSEQLTFDLSRSNFDNLLRENFEKLQRENDYETANVIYKWLYLPTNKKAGRKTDNSEVPQQFAAVRPNFTFGSGNIIKSLIYVASELCGIAAFFFDPTYAKEFDYKLDKYFKKYAEPKLLNESEVSGEKTIGQKVFESVAKIGKSPKRVEEKAAAISPSEQLTFDLSRSNFDNLLRENFEKLQRENDYETANVIYKWLYLPTNKKAGRKSLQIEQI

SEQ ID NO: 135298 - protein, 190 aa, Heterodera glycines
  Coding regions on vcDNA: vcDNA=SeqID_61721; Strand=-; Position=64-636
MGSAHFLGPILLVAFAALILGQRSSPNHSSGSPSQRDKSHGLSQQGKGHGAKEAPGQQIKNKDNSMPTIKKGTSTKSQKKGKGRHAKNNDGIGTLGKSKRQKRFLTEIFGNSLDKSKNNAEESERKREGFGIVPEKVKGKAEKTNERATEKAGEKNGNGGRQKRFDERILGNNSFELPVLNLGPNWTPPQ

SEQ ID NO: 135299 - protein, 158 aa, Heterodera glycines
  Coding regions on vcDNA: vcDNA=SeqID_61722; Strand=+; Position=1 -103,218-283,396-500,542-744
QKAFQEELEKKVTERLVTVQTEVDKMEIAHQQQKVIIDELDGQQKHQKQQWEKETNALVSQIRQFKDEQKKYLEKVNELEKQQKQRQKERDGRIDKMEIKQQQMSDSHKTLLEKIEAKHKEKQKMFKMVNKYLGKLGNLYDMHLIRSPNEQISIPKHY

SEQ ID NO: 135300 - protein, 83 aa, Heterodera glycines
  Coding regions on vcDNA: vcDNA=SeqID_61723; Strand=-; Position=1-526
KNRFIFVFGAVPPNRCAQIYGETESFGNSFPIACTLILRWIFAPHNCLSTPNGHLKKSIYFCFRGSPPEPMRPDLWGDRILRE

SEQ ID NO: 135301 - protein, 84 aa, Heterodera glycines
  Coding regions on vcDNA: vcDNA=SeqID_61724; Strand=+; Position=1 -45,350-626
KRKQSKQQKNVLSFNLAHFRFVVFLLLVFASSLFAFCFLRPPPSLPHHFFLQLLLRLFAKVGAHQLAQSHRGVGAGRQIETDFQ

SEQ ID NO: 135302 - protein, 59 aa, Heterodera glycines
  Coding regions on vcDNA: vcDNA=SeqID_61725; Strand=+; Position=1 -16,436-599
MSTHPGIYEYLPLYTNFEPNRTYELIGTYEPISQTDPPQFEMNFVILHKSEQTRQMMKW

SEQ ID NO: 135303 - protein, 153 aa, Heterodera glycines
  Coding regions on vcDNA: vcDNA=SeqID_61726; Strand=+; Position=1 -100,550-911
  Homolog annotation: Hit_ID=CAB62924.1; Match level="QueryCoverage =73%, HitCoverage=8%, E-value=5e-09, Identity=29%"; Hit description =OTTHUMP00000028562 [Homo sapiens]
MHYIICNNISFNSITILLFMLLCNRKLNVKNIIEGLCADNDIEKLFVKCRKIVGHFKKSNKALGKLNEIQELLAIPEHSLLQVYILIILNDCTFKEVSTRWNSALMMIERLYEQKKAINEYAYQNCDFGLTLTSEEWSILDELIAGIVLKKNW

SEQ ID NO: 135304 - protein, 63 aa, Heterodera glycines
  Coding regions on vcDNA: vcDNA=SeqID_61727; Strand=-; Position=1-363
MFEYSKRTLEKIDFFVFGAVPPNRCAQIYGETESFGNSFLIACTLILRWIFAPHNCLSTPNGH

SEQ ID NO: 135305 - protein, 184 aa, Heterodera glycines
  Coding regions on vcDNA: vcDNA=SeqID_61728; Strand=-; Position=1 -88,128-349,395-600,930-968
MMRSVIKFVFNPINEDQRQELCETWFYRFSDAPIEYPVPFDFVSSEYGLGEVISILGDGNCGWRAVSLAMTGTESNHTEIRRDVIEYLQETINQNSYTENSWWSLFGSNIYIREHLEKAITPATGAHETEKWMNNLDLAAVIKMFRINIFVCEWLVEEIYRWQVYSPNLEQRLIVAVITMIYAI

SEQ ID NO: 135306 - protein, 83 aa, Heterodera glycines
  Coding regions on vcDNA: vcDNA=SeqID_61729; Strand=-; Position=1 -221,1425-1455
MPIADLPMPRNDGTRTVAAAVTSKHLIKALQRHFAQCSFVTLAEWPKHVVAANQREAVETCCSKKITETIHKHMKKHVNKYVK

SEQ ID NO: 135307 - protein, 174 aa, Heterodera glycines
  Coding regions on vcDNA: vcDNA=SeqID_61730; Strand=+; Position=1-525
VTVRLSKDGTEHTALGPTLTTAKQKAATLALAHLRPELEQLKLLLKEAEGTEEEKQIVPKLVTKIDGTDQQQQQRQHLLGCDAASKFHHLSSSSPTDEMDQQQQYDGLNDDDDEEAVAAELVEPVPLEEAESCREERRQSANKNGKCCQILIKFWYHSVQNNKLLKKANFNSNN

SEQ ID NO: 135308 - protein, 39 aa, Heterodera glycines
  Coding regions on vcDNA: vcDNA=SeqID_61731; Strand=+; Position=1 -96,222-245
MYLHVILPTNIHKQIINSEQRWIIIIRKWTSYQMIVNYR

SEQ ID NO: 135309 - protein, 26 aa, Heterodera glycines
  Coding regions on vcDNA: vcDNA=SeqID_61732; Strand=+; Position=1-78
MQRPFLSIFKALFSGALFSNNFGQQR

SEQ ID NO: 135310 - protein, 139 aa, Heterodera glycines
  Coding regions on vcDNA: vcDNA=SeqID_61733; Strand=+; Position=1 -73,122-303,552-716
MILIGLIIIAFVTFCLLLSFIGFRARSHSASVYERFRRVSQTGTRAHVIDFDEPNTSAGANPVRGGGGGRFPIDDATWLSMFRRLNNLTRTVEAIKICLQSVLTNQQLNNWDLNNCNEGIYLYDYLLLAEHLSKNNCNN

SEQ ID NO: 135311 - protein, 115 aa, Heterodera glycines
  Coding regions on vcDNA: vcDNA=SeqID_61734; Strand=-; Position=1 -144,331-534
MSSAISNCSILLLFTTMVFISTAKSLPLVTYNFNQPIQLLRLLKMDPRRQMALIRLSDSAFKHRYVPAERQTYSEQQPYEERTSANGDETISTEKKWDTKAMNWPKMLLDEEGKR

SEQ ID NO: 135312 - protein, 43 aa, Heterodera glycines
  Coding regions on vcDNA: vcDNA=SeqID_61735; Strand=-; Position=1-315
MFSSFLLYFFFYFIKFCNYFSFFEFISFFFFFFFPFFSKYFAK

SEQ ID NO: 135313 - protein, 68 aa, Heterodera glycines
  Coding regions on vcDNA: vcDNA=SeqID_61736; Strand=-; Position=1 -195,1551-1562
MKNNSGKLESLFENITATISVKNKEPKQFWNLETMGVWDNPEEKDDEIALKMFKETVQRKNGRYMSCF

SEQ ID NO: 135314 - protein, 153 aa, Heterodera glycines
  Coding regions on vcDNA: vcDNA=SeqID_61737; Strand=+; Position=1-460
MKLFPLLFCLILIFIALINQIKSAKKKLQQKSFGEIFGEKWEEKEEEKRNELKKREIIGKFYKIKEKIKQKGRKYSTKEWGKINSKIAKKLGTKRQYIQKWIKELGLNQNKCYKSTTDEEKLEIVQKFIEMTNEFKQKGKYSLKEWNKNYAEI

SEQ ID NO: 135315 - protein, 110 aa, Heterodera glycines
  Coding regions on vcDNA: vcDNA=SeqID_61738; Strand=+; Position=1 -83,176-425
MIFALNCGLMAMFCAAFDRLFAVISPFNHNAIFTKYKSLYLLGHLFICTIYSSFIQYCVIVYAYENAGKYGTIKILLIIEFQPVIKAWVFPGPGFSYIFVQDRSRPRSNN

SEQ ID NO: 135316 - protein, 373 aa, Heterodera glycines
  Coding regions on vcDNA: vcDNA=SeqID_61739; Strand=+; Position=1-1120
MACKIRRWADVGLYERDGETGLGPRSGPRFIETCWNDLTQFLNDAFVAEYLAYLASISQRKVVVVDPMVWQEGMHRVTSYKNMTFGYDPNVQAEVILLPVHFPAHWTLIVHDVQCGTHFADSLPVPNGRLDWQRTDKIKNIISDILPSSVFTGIFNAEVTCQNDGNSCGYFVCLYAESWLINNRTFVLPDLSINYEKRRILWHINELYGSDNVPYHPREGVPTPCPILYRHADEAQSTSKAVGPMEVDDSDEITIIEPLTNGMNAILSQVQVEGENQADMFGLVSDSCVPQEPIAQVDDAIFVRPKTPPRRSLRIGRRQSASISRSPSPAPKRRTSANAVDQIRAFTRRCYLVHKGWCCAAAAAKHYPEYSDS

SEQ ID NO: 135317 - protein, 115 aa, Heterodera glycines
  Coding regions on vcDNA: vcDNA=SeqID_61740; Strand=+; Position=1 -62,383-445,767-829,1151-1311
LFFCSIFSHIRKFHNLIGSPCYFSAAFFSHITKFHNLIGSPCYFSAAFFSHITKFHNLIGSPCYFSAAFFSHITKFHNLIGSPCKGNLNIERPFCDKQTNETEPMISYEELFLTR

SEQ ID NO: 135318 - protein, 258 aa, Heterodera glycines
  Coding regions on vcDNA: vcDNA=SeqID_61741; Strand=+; Position=1 -198,274-852
NKMYGRQSNNHYFPQQNVMGIEESATTSSRNSAGGGEHRVIRSEVWSRFRLEGLNAVCLVCNEKLKVQPMAPSEAAQPRGGGPKPTHSLGLSPNPSAEPTVHPATAAANDAQQKQQRFCGIERWRLHNSTATKGRCPFACLAGTFSAPIPPPAAAENGGTSGSTRDGTASQQQFPTPKPPHSTATAAEFSPSAAPVLRLLLHVTVHPATIGFSSPILRRRNSAHASAAGDRGLQAGAEPGIGPTAGHLSRGGGGTAGI

SEQ ID NO: 135319 - protein, 168 aa, Heterodera glycines
  Coding regions on vcDNA: vcDNA=SeqID_61742; Strand=-; Position=1 -185,240-383,774-885
  Homolog annotation: Hit_ID=AAV41030.1; Match level="QueryCoverage =86%, HitCoverage=14%, E-value=5e-45, Identity=60%"; Hit description =furin [Dirofilaria immitis]
TRTLSFVRTIPNGNRLHLQVYTDGCADRREQQVKYLEHVQAIVTLSAPRRGDIQIYLTSPRGTRSTLLAKRQRDTSRTGFKEWGTRSTLLAKRQRDTSRTGFKEWAFMTTHNWGESAYGTWSLEIDNDGNDDAELLKWELVLHGTDVYVGPTGFEPTAAVAERSVQQQ

SEQ ID NO: 135320 - protein, 123 aa, Heterodera glycines
  Coding regions on vcDNA: vcDNA=SeqID_61743; Strand=-; Position=1 -170,363-564
MLKAMRHVFPSCERSGCNFHMAQALFRKARSMGIFHLFAENNAEALGQRKSVHKTFSVQCVPGVHNDRQWTNTIRTAFAITSTPTIPLSEESSLHGLVMQGFAEGFHVRGNSESGEETEADQN

SEQ ID NO: 135321 - protein, 22 aa, Heterodera glycines
  Coding regions on vcDNA: vcDNA=SeqID_61744; Strand=+; Position=1-67
VGLKSIFYNGGRAISRPFLGYT

SEQ ID NO: 135322 - protein, 342 aa, Heterodera glycines
  misc_feature (290)..(290): Xaa can be any naturally occurring amino acid
  Coding regions on vcDNA: vcDNA=SeqID_61745; Strand=-; Position=1 -27,375-443,562-669,932-1101,1269-1319,1423-1489,1692-1927,2263 -2377,2718-2906
  Homolog annotation: Hit_ID=CAE59800.1; Match level="QueryCoverage =99%, HitCoverage=45%, E-value=1e-113, Identity=61%"; Hit description= Hypothetical protein CBG03262 [Caenorhabditis briggsae]
RQAATSLLPLFDRCGPEDYTMDLCDYNRNLTTAFLQLIMALFAKLLFTIFTFGVKVPSGLFVPSLAMGAIAGRLLGIKVEGLTYALQQSYPNSELWTCQIGRDCAMPGLYAMVGAAAVLGGVTRMTVSLVVIMFELTGSLEFIVPTMAAVMFAKWVGDAIYRMGIYDAHIELNGYPFLDNKGEYPYSTVAGQVMRPSAEMRLIEQHKMTVGELETLLRDTNCNGFPVVNDQREMLVVGFCTRMDLSLVLRNARKMQPNVTTNSTVHFSTEAGLASQSLPPKIRSKSLLIXAPMTVADQTPMETVIDMFRKLSLRTTMVTSNGRLLGIITKKDILTFMRECDH

SEQ ID NO: 135323 - protein, 136 aa, Heterodera glycines
  Coding regions on vcDNA: vcDNA=SeqID_61746; Strand=+; Position=1-413
  Homolog annotation: Hit_ID=NP_702063.1; Match level="QueryCoverage =84%, HitCoverage=2%, E-value=8e-10, Identity=26%"; Hit description =hypothetical protein PF14_0175 [Plasmodium falciparum 3D7] gb|AAN36787.1| hypothetical protein [Plasmodium
FQSLGLNSPAFQPPTLNPPAFQSTGLNPPAFQSTGLNPPEFQSLGLNPPTFQSTGLNPPAFQSLGLNPPTFQSTGLNPPHSSHWDSILPNSNHWTQSHQSFINTITGTQFSDISITGTQPQQRNTELFKRNPEIEI

SEQ ID NO: 135324 - protein, 28 aa, Heterodera glycines
  Coding regions on vcDNA: vcDNA=SeqID_61747; Strand=-; Position=1-151
IFYRFLNIWIFFWLTKTSSNLALYILIQ

SEQ ID NO: 135325 - protein, 61 aa, Heterodera glycines
  Coding regions on vcDNA: vcDNA=SeqID_61748; Strand=-; Position=1 -73,452-561
MLSFIYADDLSEFDGDNAMAVLYAAKKYCIDGLVNECLQIPIPQLSNVFLAFTQARLFDFE

SEQ ID NO: 135326 - protein, 109 aa, Heterodera glycines
  Coding regions on vcDNA: vcDNA=SeqID_61749; Strand=+; Position=1 -138,472-663
MLFLSLPPMISTTTVVMAEIDAVVTVPLSLTLTLNSTKMAARLAEVLFELLVAGIKTANQLDLINTIFAIWAASRFPAKVFEFPITFVAIITCADHKNIIPVAWMIKAW

SEQ ID NO: 135327 - protein, 72 aa, Heterodera glycines
  Coding regions on vcDNA: vcDNA=SeqID_61750; Strand=+; Position=1-216
MLLSPPLLFVLSLCSLCVFGHKTPNASDGPAMPELPKALQKLSDAERNCLFTIYTMSKLFENKKVQKTLAKQ

SEQ ID NO: 135328 - protein, 321 aa, Heterodera glycines
  Coding regions on vcDNA: vcDNA=SeqID_61751; Strand=+; Position=1 -89,194-348,1385-1483,1543-1659,1708-1879,1940-2033,2085-2125,2168 -2363
  Homolog annotation: Hit_ID=XP_415012.1; Match level="QueryCoverage =74%, HitCoverage=41%, E-value=1e-43, Identity=42%"; Hit description =PREDICTED: similar to brain-selective and closely mapped on the counter allele of CMAP in cystatin cluste
MPMLPFLSCDSKDTSEPDISQESGEEQRMVEYGPVIMHAHGSIASINGARLFVKSTSGGIWIAIYQPECLKEKDESKKSEEDVLYTCTTDGKCVKIVDGKIQKTVPMTGHKNCDGKRQTLPYCGRPLGIRRYNANLFVVADAILGIFVVDFEKGSAELLVSSSKLVDGKRLLFPDDLDFVDNDTILFSDASTRFGISDFLLAFMEHAEDGRLIEYKISTGQLRVVADGLSFANGVQIHPDRQSVLFCESANSRIQRFYYAGPKKGRQEIFVDNLPGFPDNIRLSAARRSFYVALFGHRSKDLPDALDWLGPRPWARKFLGE

SEQ ID NO: 135329 - protein, 260 aa, Heterodera glycines
  Coding regions on vcDNA: vcDNA=SeqID_61752; Strand=+; Position=1 -142,188-380,430-633,693-807
  Homolog annotation: Hit_ID=NP_388707.1; Match level="QueryCoverage =92%, HitCoverage=40%, E-value=5e-32, Identity=37%"; Hit description =hypothetical protein BSU08260 [Bacillus subtilis subsp. subtilis str. 168] emb|CAB12655.1| yfiG [Bacillus
SSSARPSLVPSLSADVPNFFLRSVSWICSIGGFLFGYSASVINGSVFFMFMERELGLNSFTKGVVMFMERELGLNSFTKGVVTSSIIVGAAIGAPIGGHLADHFGRKRVMISLDLLFIAGVFATTFAPNFKCLIPFRAILGFAAGGFKCLIPFRAILGFAAGGHCSVGPVFLAEISTPENRSQNVTLNSLFIVLGELVAFAVCASLGNIFLQYVLIWRWMNLVLIWRWMNLVVVLPAVILLFCRCLLVRESPRWLVGANR

SEQ ID NO: 135330 - protein, 83 aa, Heterodera glycines
  Coding regions on vcDNA: vcDNA=SeqID_61753; Strand=+; Position=1-252
MALDQLGYPGTFLLLALLGLFALAFVWRFMPETRRKSLEELEKEFQHGDWQALKKPGEKRRNLRRKVERTLSKIEEEERGERY

SEQ ID NO: 135331 - protein, 35 aa, Heterodera glycines
  Coding regions on vcDNA: vcDNA=SeqID_61754; Strand=-; Position=1 -21,457-541
MGVESDWASDRPQQHEQINHNDLLTLFMDQFLGPI

SEQ ID NO: 135332 - protein, 150 aa, Heterodera glycines
  Coding regions on vcDNA: vcDNA=SeqID_61755; Strand=+; Position=1-453
MEPVLSDQSRCIAALTDAIDELSLKGTEQSVNPSTDGGPAELAKEAPMNPQGGGPASELAKGRTSPARSTGRAWHGKQHRQPARKAGRLNYLMRQLEREVGGSQMVRSPHPYWENRRGNGYGGPRGGGRGGYNAYRGDRSERVGPSNNGR

SEQ ID NO: 135333 - protein, 80 aa, Heterodera glycines
  Coding regions on vcDNA: vcDNA=SeqID_61756; Strand=+; Position=1 -129,177-219,276-346
MEYEREEQHPFKKAMCGKGIREWAFWFIVTFLACLTIKDVVNLIREYGENPKKSDMNEINGISESVATRVPRDRDLVADN

SEQ ID NO: 135334 - protein, 43 aa, Heterodera glycines
  Coding regions on vcDNA: vcDNA=SeqID_61757; Strand=-; Position=1-129
VGAEQRVFCGTNCSPQWRVKKAATSAFDRLVSERTEAKFWAKL

SEQ ID NO: 135335 - protein, 123 aa, Heterodera glycines
  Coding regions on vcDNA: vcDNA=SeqID_61758; Strand=-; Position=1 -85,202-423,589-653
MEKNGKQSKDSVLCENGQDVCRAFFCVANHSLLFIQWDCATFSKKDKCPQKDGPNTANSVRVDHGLPQSDDWHCVCEFGQVGEEMGNEHIYKMDPTEPTPMAGVILPLSTALYRQLLSLTWAD

SEQ ID NO: 135336 - protein, 211 aa, Heterodera glycines
  Coding regions on vcDNA: vcDNA=SeqID_61759; Strand=-; Position=1 -162,348-468,511-863
MDEKRFLKVPKEKRQLRNKKNYFSKTNNIPDGSYYTEISNTIKENRKFGIKENINNEDVVMESFYHIQQSFSEIDLLNEQISIIITTYAIPSGSRNQLNSTNYFKIKENGRILVANDDNYCLFYGIILSRFYQIIGANESFGISYDQFRRIYRNKKRQKIHVLQLIQETKIDSNRTNYGIDDLLTVQEFYDKEFPGKFLIVAFSKVKKEKS

SEQ ID NO: 135337 - protein, 178 aa, Heterodera glycines
  misc_feature (29)..(29): Xaa can be any naturally occurring amino acid
  Coding regions on vcDNA: vcDNA=SeqID_61760; Strand=-; Position=1 -189,240-406,621-746
  Homolog annotation: Hit_ID=NP_504476.1; Match level="QueryCoverage =83%, HitCoverage=45%, E-value=6e-37, Identity=55%"; Hit description =type V secretory pathway protein (31.7 kD) (5G75) [Caenorhabditis elegans] gb|AAP57298.1| cell death-rela
LHRALGKALAIIKPDSNTFESKINFFSFXGIVKLLITGASESITDEAAKLASKEPGFLYYTAGVHPHDAKDFDDGRTLDFLVHPHDAKDFDDGRTLDFLRSHLTVNSQCVAVGECGLDFNRNFSPRDQQLRVFETQVQLACDLGKPLFVHESEAHQEMVAILSLERKSLPPTVIHCFT

SEQ ID NO: 135338 - protein, 113 aa, Heterodera glycines
  Coding regions on vcDNA: vcDNA=SeqID_61761; Strand=+; Position=1 -240,705-806
MFTHGFIKYFDRRVWVVEMDPFAYRNALSRANQYADRRVRHAWHSNFVSALDFWRNVGQRMPMFAAVIGTELLAQLQDEQQMLENGAQFATVEVLGTNQTQSIDDKKLKATLV

SEQ ID NO: 135339 - protein, 110 aa, Heterodera glycines
  Coding regions on vcDNA: vcDNA=SeqID_61762; Strand=-; Position=1 -190,732-874
MTHCYIIVILITFVFCFCFRDDQKVLAGGCMSCSKADDGSGINNPSNGRRLVSIIDLPTPTMHEYINAGKEEARKSSFSTPSHELQQFRAAAAAAGDGQRRGKKTDRKNK

SEQ ID NO: 135340 - protein, 43 aa, Heterodera glycines
  Coding regions on vcDNA: vcDNA=SeqID_61763; Strand=-; Position=1 -118,238-251
MRTDNLCQWLQIRRIGRRSIANVFDFQYEIIAYRKFTKIYDNL

SEQ ID NO: 135341 - protein, 76 aa, Heterodera glycines
  Coding regions on vcDNA: vcDNA=SeqID_61764; Strand=-; Position=1 -112,295-413
  Homolog annotation: Hit_ID=NP_504033.2; Match level="QueryCoverage =97%, HitCoverage=30%, E-value=6e-14, Identity=47%"; Hit description =putative protein, with a transmembrane domain (26.3 kD) (5E192) [Caenorhabditis elegans] gb|AAC17698.2| H
MGLYVCRLLTVIGLLMLLGGAMAIIVGYCWPRQQNIEGELMKIAIDQDEEGNFYVLPERLTEILADPMHSWKITGN

SEQ ID NO: 135342 - protein, 129 aa, Heterodera glycines
  Coding regions on vcDNA: vcDNA=SeqID_61765; Strand=-; Position=1 -53,98-242,289-480
MLTTLEELKATPCGTQLASFCGQIVSILPSEKKLTALLACASGENVVLTEFKSVSSKFSKICSLGIVVKFYMLKAQRFQERFDGKTIYVTPLDYEFVVMTFTRMEVIQCAIATADSFEKLTSGCIYCEF

SEQ ID NO: 135343 - protein, 91 aa, Heterodera glycines
  Coding regions on vcDNA: vcDNA=SeqID_61766; Strand=-; Position=1 -92,446-631
  Homolog annotation: Hit_ID=CAA11148.1; Match level="QueryCoverage =100%, HitCoverage=19%, E-value=1e-31, Identity=77%"; Hit description= Hgm1 protein [Heterodera glycines]
FCLFSLMIMLKNSGKELHLKYMPGFVAYNKNVSDSLRDFDISKTADADAIRAKHIDNEYALFQKNQSSTMALRGSLVGEDGQAVYFSIWSK

SEQ ID NO: 135344 - protein, 175 aa, Heterodera glycines
  Coding regions on vcDNA: vcDNA=SeqID_61767; Strand=+; Position=1 -169,387-530,657-734,1155-1288
  Homolog annotation: Hit_ID=AAB99830.2; Match level="QueryCoverage =97%, HitCoverage=10%, E-value=9e-61, Identity=65%"; Hit description =thrombospondin [Haemonchus contortus]
NLCVQFRSVTCRSAKEGEEGKMLPAEACTGQMPPEERDCNLGPCKGLRFHTTEWELCQKCNDTEETREVSCVDKNGREYPLEKCLDGKKVTKIPEDTRPCASQAPCVYEWHTSQWSKCSTECGHGHKQRKVFCAINELGQTKRVDEALCGQSLEEKPVAREECVNEEKCTVNMYN

SEQ ID NO: 135345 - protein, 195 aa, Heterodera glycines
  Coding regions on vcDNA: vcDNA=SeqID_61768; Strand=+; Position=1 -146,327-765
  Homolog annotation: Hit_ID=AAL78214.1; Match level="QueryCoverage =46%, HitCoverage=47%, E-value=3e-33, Identity=78%"; Hit description =putative esophageal gland cell protein Hgg-20 [Heterodera glycines]
MRRRLVGHIGMDQSCRSRHEVRAGQCSVKRFGGQTFQAEEVVLRRVSYLYINEEVVNFLRTIRRLLTEDIALEFSTFFTEYRSWKVMAQHIWPLLKDGISTLCLKKCDLAMLRKHVSPTVLFDCAGLHRIHTQMLPECPSADGAVDEENVVVDTTCRELYTWVHSPREEGHGPVSLKLNKWKEGKWDNFVNNLNK

SEQ ID NO: 135346 - protein, 113 aa, Heterodera glycines
  Coding regions on vcDNA: vcDNA=SeqID_61769; Strand=+; Position=1 -225,421-535
PIAEFGPVAIRQPPEVIEGMTDWCKETFSKNGLIERIKASDKGERETEKMVTDRGGEGTLKQNQCIDRLRSWTFCLAKRWYEHTEGWKKLPPKKEIHLALDDIRESINILKYC

SEQ ID NO: 135347 - protein, 34 aa, Heterodera glycines
  Coding regions on vcDNA: vcDNA=SeqID_61770; Strand=-; Position=1-104
MRGSQQLRMSLAKEEKDAFYWAVKVDWRKTGPFV

SEQ ID NO: 135348 - protein, 109 aa, Heterodera glycines
  Coding regions on vcDNA: vcDNA=SeqID_61771; Strand=+; Position=1 -63,115-381
MKTLRSQAGRQSMPMVVNFGRTGDGQMFGQVGGRQSSMSPPVVPVNFGRRAAVPGTTKTNTFASIASISYSHFFFEKGLQTQQREVIYDVPTDGGGHEHAEDDEDDDSF

SEQ ID NO: 135349 - protein, 71 aa, Heterodera glycines
  Coding regions on vcDNA: vcDNA=SeqID_61772; Strand=+; Position=1 -72,124-267
MSDSPTPETEISIAWDILENDKDVWYNWFTPTTAKQACVEALAFAREGGLKHENILKIMKTLEEREKRDKK

SEQ ID NO: 135350 - protein, 240 aa, Heterodera glycines
  Coding regions on vcDNA: vcDNA=SeqID_61773; Strand=+; Position=1-723
MAINISDTKSLFNQILAQSDITITTSGITVSGPRLSTPRFLPFDDCGRCRVCKATEAEVDTMVTKEGVTLWCTRINKPQFVPFDVVYDLPGHCFFRVKNKARVFNVPYGDLPSGTCAKSKPTDHQQQQQQQQDLKRKAKVALDLVEAGLMADAMQDGARWKKAKTAINVLGNLLLAESLDNTSAPPLKNDAVDIKKEEEEANVAEEHKEDDQQKEDLGDIDKTLDDFFKSLNASTSNVPI

SEQ ID NO: 135351 - protein, 535 aa, Heterodera glycines
  misc_feature (476)..(476): Xaa can be any naturally occurring amino acid
  misc_feature (492)..(492): Xaa can be any naturally occurring amino acid
  Coding regions on vcDNA: vcDNA=SeqID_61774; Strand=+; Position=1 -428,2415-2473,2588-3512,4550-4620,5921-6054
  Homolog annotation: Hit_ID=CAD22154.1; Match level="QueryCoverage =98%, HitCoverage=56%, E-value=4e-63, Identity=31%"; Hit description =pherophorin-dz1 protein [Volvox carteri f. nagariensis]
PPRLPSPPRAKPKPPPRHPTTKREQHKPKKLELPPKIEPKFEPDSRPSTSKVAPRSKKEPEFPLDPRPSTSRQAGYIPPPAPKIVPKHEPTKRPVPYRIPKREPKIVEETPQRQQQPLPAAVVEEMPPVPPPEGDQTPPPPPPPLKRNKRDASPIPPPPPSPPHYEETPKETVKTTPKVSTPPPVSSPAKPTTVKPSAPPPSVTTPAPPTIAKPPVTTPPTTTKPTTPIPPPAVQTTTPVPPPVVQPTNIPKPAKPQATVTALTVKPTTPVPPPVVQSTTTPQPTKTPVTVPPPVTTPVPPPPKTTTTPTISKVPSPSVTIPAPPAQLKSSALSPKAPISTVKPPPPVSLSAKSKSPPSPPEESPPHYDEEKDITVKPTSPVKPTITAPPAQLKSPAATQVIKPPQQPTKPLAPPPGAPPRFPAAAVSPPPPTSAAQIDPSRLIHTLDPPKIYFKTPPANVDPLTYVPPAFPRPMXASLRPKCLSCCLATLXPPPENTYSAYLKNLTLSRQQQHPEYSYTEYLRSFKVSDYYDNN

SEQ ID NO: 135352 - protein, 107 aa, Heterodera glycines
  Coding regions on vcDNA: vcDNA=SeqID_61775; Strand=+; Position=1 -206,282-399
MLICVNYASSFSHSLDSADSELQPHGKKRAKHYDDLPEQSYGPGSADYSQTPAELLEIAEMDPDDLSFKPKQTGQPQKSAKGKAIGFRKPGTSHATKSFRKANKTEF

SEQ ID NO: 135353 - protein, 611 aa, Heterodera glycines
  Coding regions on vcDNA: vcDNA=SeqID_61776; Strand=-; Position=1-1833
  Homolog annotation: Hit_ID=XP_320889.1; Match level="QueryCoverage =99%, HitCoverage=73%, E-value=1e-113, Identity=37%"; Hit description= ENSANGP00000012033 [Anopheles gambiae] ref|XP_313651.1| ENSANGP00000013044 [Anopheles gambiae] ref|XP_31
MILIIALRDEFTDLRQKCLQRLEESRTSGRSTSLQELGEECRKYQILKESALSLGSNPCSTSAIRAKPQQIRDKQKPKTKPQQSHKGQNFLPKNSTAPKGKVDQRDQPCYSCGGKSHWQKDCWFKNSTCEKCGRNGHIAKACKSGTEIRRVRAVVTDSVKDTHIHTVSIKPKCMAIEGSSNKWWEVIIQINGMDHPMNVDTAAQITVIKTDSWQKLGKPKLGKTAITVRNCNEKAFPIEGKFKCQVSYKGRTASLIAYVSDEIHQDLLGMPWIEELEIIPKELMFPNSSQIVNSMPTKPISSQISDEKSLISALQTNYANTFGPELGHCTKFRAHLILKKEAKPVYCKARPVPHGALDEVNAEIDRLSKIGAIKPIEFSQWAAPILAVKKKSGKTRVCIDFSTGLNDAIELHRHPLPRPENIYNAVAGAKFFSRLDLRDAYLQLELSESSKNLCVLNTHRGLFQCQRLPFGVKSAPAIFQGLMDKIIAGIPGAFVYLDDFVIANKSLIDHTSTIFAVFDKISEYGLRIQLEKCSFLQKETLFLGHIISENGIRPDPSRAEAIEKMPAPTDKSTLRSLLGALTYYGKFIKPMRELRGPLDELLKKEAKWEWK

SEQ ID NO: 135354 - protein, 133 aa, Heterodera glycines
  Coding regions on vcDNA: vcDNA=SeqID_61777; Strand=+; Position=1 -210,585-776
  Homolog annotation: Hit_ID=CAE66803.1; Match level="QueryCoverage =97%, HitCoverage=28%, E-value=1e-27, Identity=43%"; Hit description =Hypothetical protein CBG12165 [Caenorhabditis briggsae]
AILSNKVIWVVWLNAFADIVTAVFLITYLPTYVSKVLGYGVRETGIWSAVPALLHIPVKIGAGWMADTLTCMNELNRMRAFNSVALVGSGVLFALTGFVPKEMPFLAVILMTLNFAVVSTNCGGFYKCATLIS

SEQ ID NO: 135355 - protein, 28 aa, Heterodera glycines
  Coding regions on vcDNA: vcDNA=SeqID_61778; Strand=-; Position=1 -26,89-149
MGKTTSETRLIEDTKCYRMIPTMLGKSM

SEQ ID NO: 135356 - protein, 136 aa, Heterodera glycines
  Coding regions on vcDNA: vcDNA=SeqID_61779; Strand=-; Position=1 -50,199-559
  Homolog annotation: Hit_ID=NP_495933.1; Match level="QueryCoverage =80%, HitCoverage=26%, E-value=2e-20, Identity=42%"; Hit description =putative protein, with a coiled coil-4 domain, of eukaryotic origin (47.3 kD) (2J345) [Caenorhabditis ele
MQRLDLDIKNAEKREQSLKEEARVALGRKDKKGALNIMRKVARVRKDIQDKDVQYQRLLAMLEQLAASKQTKEIIDVYKQGSNAFRETMARQGLTPDKVRHLIELLGNKMKFLPFFKWFQNSNGWCILLRFFDCSL

SEQ ID NO: 135357 - protein, 108 aa, Heterodera glycines
  Coding regions on vcDNA: vcDNA=SeqID_61780; Strand=+; Position=1 -36,638-838,1042-1131
  Homolog annotation: Hit_ID=NP_498041.1; Match level="QueryCoverage =91%, HitCoverage=13%, E-value=3e-39, Identity=78%"; Hit description =SET (trithorax/polycomb) domain containing (83.9 kD) (set-2) [Caenorhabditis elegans] gb|AAA21163.1| Set
SPDGEKKIGQYTYRSKMIKFARSRIHGWGLFALEPIAQDEMIVEYVGDKIRPEVANVRELAYERQGIGSSYLFRIDDHNVIDATKKGNFARFINHSCQPNCYAKVGIN

SEQ ID NO: 135358 - protein, 156 aa, Heterodera glycines
  Coding regions on vcDNA: vcDNA=SeqID_61781; Strand=-; Position=1 -291,580-756
MMLRNRDLNVQPAAGAGAPLPKRQSAHLVKVVGGASGRASSQSSAGSDRDSKYEPRPKRACSQKDKENSHYNNNNHNKSSHNKSKKNTSGGTVVPVTAFSRSLLIDSAKKDVTVVSTAVDAGGGGVLAAPIVGRKRSSALLSTRDSNVGEHMSSTQ

SEQ ID NO: 135359 - protein, 70 aa, Heterodera glycines
  Coding regions on vcDNA: vcDNA=SeqID_61782; Strand=-; Position=1 -141,454-525
MKNRITATLHCCTQLALTPQWWVWSSRPSTKKIVPLVDPESQTRELPSVSVYLNHLGEKLRYRLFVRIRV

SEQ ID NO: 135360 - protein, 216 aa, Heterodera glycines
  Coding regions on vcDNA: vcDNA=SeqID_61783; Strand=+; Position=1 -24,70-211,414-463,505-642,833-920,1002-1149
  Homolog annotation: Hit_ID=NP_494777.1; Match level="QueryCoverage =88%, HitCoverage=24%, E-value=1e-50, Identity=50%"; Hit description =myeloperoxidase family member (80.8 kD) (2E693) [Caenorhabditis elegans] gb|AAA83575.1| Hypothetical prot
SIIGSVSTATPFQLSADSAHCATPFQLSADSAHCSQALCYHLAYRSIDGVCNNLARPTLGASFRAYMRYLPAEYSDGFSEPAGNSSGRRPTARSGRRPTAREASRLVLAKGAPSIHDQINSMFMQLGQFMAQEMAKTAYQPVDPCLSCAPLVGKCMPVPISEQDNNPIFRQFRQKGCLKVSRSASVCGTEPREQLNENTAFVDGSTIYGSNAKDLY

SEQ ID NO: 135361 - protein, 48 aa, Heterodera glycines
  Coding regions on vcDNA: vcDNA=SeqID_61784; Strand=-; Position=1-146
MGKGRAFGQRLVQKGPHNGKGKGGHSSRRGQGGHSHRQRAAKAGCSER

SEQ ID NO: 135362 - protein, 71 aa, Heterodera glycines; identical to SEQ ID NO: 124984
  Coding regions on vcDNA: vcDNA=SeqID_61785; Strand=+; Position=1-217

SEQ ID NO: 135363 - protein, 27 aa, Heterodera glycines
  Coding regions on vcDNA: vcDNA=SeqID_61786; Strand=-; Position=1-82
MEEHELEQYDRIINGRHTEWELFHYFS

SEQ ID NO: 135364 - protein, 96 aa, Heterodera glycines
  Coding regions on vcDNA: vcDNA=SeqID_61787; Strand=-; Position=1 -95,127-322
MTEPTGWSIFVLYTDHFSCSARNRWTFFCSSGFVIVGTFSLDQGLLEWHFNAKTMYEYLENGKQIETNSFLLTTHLSLRMITIQLLTVGEHFGYKF

SEQ ID NO: 135365 - protein, 43 aa, Heterodera glycines
  Coding regions on vcDNA: vcDNA=SeqID_61788; Strand=-; Position=1-505
VKHPISALLCREPAGNGWLSICKKLDWQYVVVKNFWVMNYFLK

SEQ ID NO: 135366 - protein, 95 aa, Heterodera glycines
  Coding regions on vcDNA: vcDNA=SeqID_61789; Strand=-; Position=1 -359,468-566
  Homolog annotation: Hit_ID=AAV53354.1; Match level="QueryCoverage =88%, HitCoverage=24%, E-value=4e-09, Identity=35%"; Hit description =TATA-box binding protein [Volvox carteri f. nagariensis]
MQKPIIVNIIALANLGTGIKLNSLMITECEFKYNPRKFNAAVIKCTTPIKATALLWESGKMICLGTKSLIDCENAIKIFIEIIRARGVRGLLTPD

SEQ ID NO: 135367 - protein, 107 aa, Heterodera glycines
  Coding regions on vcDNA: vcDNA=SeqID_61790; Strand=-; Position=1-333
  Homolog annotation: Hit_ID=AAF36090.1; Match level="QueryCoverage =100%, HitCoverage=97%, E-value=3e-36, Identity=58%"; Hit description= flagelliform silk protein [Nephila clavipes]
VPASPGPGFSGPGSPGPGFSGPGSPGPGFSGPGSPGPGFSGPGKSGPGFSGPGKSGPGFSGPGKSGPGFSGPGSPGPGFSGPGKSGPGFSGPGKSGPGFSGPGKSGP

SEQ ID NO: 135368 - protein, 81 aa, Heterodera glycines
  Coding regions on vcDNA: vcDNA=SeqID_61791; Strand=-; Position=1 -95,183-333
MQFVSLSASSFALAMQLCIGLDRLAGVAFPIWYKIDGKYTVFKILIGICVIKVIVDKCIQFYGSSKHWETFVNWNISFSIV

SEQ ID NO: 135369 - protein, 77 aa, Heterodera glycines
  Coding regions on vcDNA: vcDNA=SeqID_61792; Strand=-; Position=1 -126,677-784
MVSSNTVDGTVHFGERCAEMDNVHGPAFPPQSNFCIHYRSDQFFTVFATVSVRTMAFCAIIRIQIAPVLALVLMVFA

SEQ ID NO: 135370 - protein, 211 aa, Heterodera glycines
  Coding regions on vcDNA: vcDNA=SeqID_61793; Strand=+; Position=1 -120,910-1118,1313-1378,1433-1675
SCKDHEDKCQNGGYLNPNDCTKCHCPDGYGGEYCKELEESNVKLINSSKCVKIENLYAEKRRKGTPSTGTLRCYNPTKNQYYNCSCNGDKKCLAEEKWAHDAFLCQIIRVNGIQIQIDYRYNWTRLDVDCYKAEGGTVSFWGYSKPETKEIIRVDEVHCLTFEAAGVTPPSQKRFKSLQVEEQLSMKLNPSTLLDNASSLIHVFVPFVGHP

SEQ ID NO: 135371 - protein, 108 aa, Heterodera glycines
  Coding regions on vcDNA: vcDNA=SeqID_61794; Strand=+; Position=1 -107,728-947
MGEPLKVAPVAQLVRARHGLLESWVRVPPADELPFIAIQTIGPFGLLGDQGPIPKIKTFQSWDNPSPPIPLWHGSSRLTVSTGWFDFRVEGKTIQRGDEIRLAQAAEA

SEQ ID NO: 135372 - protein, 76 aa, Heterodera glycines
  Coding regions on vcDNA: vcDNA=SeqID_61795; Strand=-; Position=1-231
MSSLADFVNEQRSKANSSSGRQAYFNVATLGSKVSNSFTDFFKPRNSNGIDDVQRLTEDADAAQNGQLPSNKNRHL

SEQ ID NO: 135373 - protein, 95 aa, Heterodera glycines; identical to SEQ ID NO: 125597
  Coding regions on vcDNA: vcDNA=SeqID_61796; Strand=-; Position=1-660

SEQ ID NO: 135374 - protein, 22 aa, Heterodera glycines
  Coding regions on vcDNA: vcDNA=SeqID_61797; Strand=-; Position=1-90
KSIKNLKMRIHARFSGNKLNWA

SEQ ID NO: 135375 - protein, 41 aa, Heterodera glycines
  Coding regions on vcDNA: vcDNA=SeqID_61798; Strand=-; Position=1-439
IFYRFLNVWIFFWLTKTSSNLVLSILFQIAPNFFYSLTRPY

SEQ ID NO: 135376 - protein, 90 aa, Heterodera glycines
  Coding regions on vcDNA: vcDNA=SeqID_61799; Strand=-; Position=1-667
IIFIQKIFFWVFGAVPLNRCAQIYGETESFGNSFPIVCTLILRWSFAPHNCLSTPNGHLKKSIFLFSGQSPRTDAPRFMGRPNPSGIASL

SEQ ID NO: 135377 - protein, 32 aa, Heterodera glycines
  Coding regions on vcDNA: vcDNA=SeqID_61800; Strand=-; Position=1 -27,82-152
MSSSFVWKRGMVALRRGSTKISACGFHGRNFW

SEQ ID NO: 135378 - protein, 92 aa, Heterodera glycines; identical to SEQ ID NO: 125147
  Coding regions on vcDNA: vcDNA=SeqID_61801; Strand=+; Position=1-304

SEQ ID NO: 135379 - protein, 41 aa, Heterodera glycines
  Coding regions on vcDNA: vcDNA=SeqID_61802; Strand=+; Position=1-137
IYTLSQKKWLSLFLRNFIHIQMLSSMIGRAVRNRPFIFEGI

SEQ ID NO: 135380 - protein, 173 aa, Heterodera glycines
  Coding regions on vcDNA: vcDNA=SeqID_61803; Strand=+; Position=1 -76,494-590,830-1044,1095-1228
  Homolog annotation: Hit_ID=AAV34698.1; Match level="QueryCoverage =61%, HitCoverage=42%, E-value=3e-16, Identity=45%"; Hit description =IC5 [Globodera pallida]
MRSENGEQNEGVAPLSAADQQQLKAPAKLLGWHRLPQRIGNHWCQTFDGPIQRKSLKRCAMIGLATKEMPLYGRVGTYPNSYGHRSDGLFWVNGSCQIGSQSAKFGIGDVIGCGIILATRQIFFTKNGHHSADFVALFPSEDVPLFTCVTLHDSEDKIEANFGPEFNFNLNTL

SEQ ID NO: 135381 - protein, 129 aa, Heterodera glycines
  Coding regions on vcDNA: vcDNA=SeqID_61804; Strand=-; Position=1 -47,246-466,512-633
  Homolog annotation: Hit_ID=AAV34698.1; Match level="QueryCoverage =86%, HitCoverage=44%, E-value=2e-12, Identity=39%"; Hit description =IC5 [Globodera pallida]
MNLKLLPKSITVENACDGGVLIGLAAKQKPFLSVLSRIGTYAYPNNGTFYINGSSLYGSSNQFYREDIVGCGVNLANRQIIFTKNGRLLDVSNSLVASFAVPLFSFVSLCGFGDKIVANFGPKFLLPDI

SEQ ID NO: 135382 - protein, 80 aa, Heterodera glycines
  Coding regions on vcDNA: vcDNA=SeqID_61805; Strand=-; Position=1 -36,142-348
MEMQMKKEQQKMLFLKLQQNYWDVKFCQNELEITGDDGLTVVNKQKHSTGKWKENKNPWYALMSLAPPQDKPIKLKFKNA

SEQ ID NO: 135383 - protein, 105 aa, Heterodera glycines
  Coding regions on vcDNA: vcDNA=SeqID_61806; Strand=-; Position=1 -70,377-504,723-842
MSISNDSTNDGFIPAEAADQQFQVIGDAFSLDDFGYKDENAEQVGDEQLRKEAKSKQQDDDEDGILKSLQTELKQQRLMAENIELKDKIDRLEKEKEKLQMEKYS

SEQ ID NO: 135384 - protein, 179 aa, Heterodera glycines
  Coding regions on vcDNA: vcDNA=SeqID_61807; Strand=+; Position=1 -193,464-807
  Homolog annotation: Hit_ID=XP_393207.1; Match level="QueryCoverage =62%, HitCoverage=18%, E-value=5e-18, Identity=43%"; Hit description =similar to Glucosylceramidase precursor (Beta-glucocerebrosidase) (Acid beta-glucosidase) (D-glucosyl-N-a
MDDGGKGGGWHGQRKNDQKLGGNKTAVVFVSDPDKFRLHRQFVPILNEAKERKKRKRNGSKWEKGHWLTVRVNASARFQSLLGFGGAFTDSATFNMDALSGPTRSTLLKAYFDRNIGHFIMMIEHSFVITPIFEGIRYSVGRVPMGATDFSVRQYSYCDTPGDLNLTTFALAKEDLEWK

SEQ ID NO: 135385 - protein, 223 aa, Heterodera glycines
  Coding regions on vcDNA: vcDNA=SeqID_61808; Strand=-; Position=1-672
  Homolog annotation: Hit_ID=S02771; Match level="QueryCoverage=41%, HitCoverage=4%, E-value=2e-22, Identity=53%"; Hit description=myosin heavy chain A [similarity] - Caenorhabditis elegans
MQKIKVKVEKDKQQIQRELEDATQTADSELRARQEAEKVIKNIELQLSELQSKTDEQSRLLNDFAALKSRLHNENADLEHQVEDLENQVRRMDEQGLGQCYHHGHLITGEFAASPEESVGQPIGGGETNRRRGKPRAANPRGTAEERAARERLIARTARRRAGGQSGMPASNQQTERGDPTVEGAVRVGRIGQDGGDRGGQAQLAEESAGANGRQRSGQHKGD

SEQ ID NO: 135386 - protein, 30 aa, Heterodera glycines
  Coding regions on vcDNA: vcDNA=SeqID_61809; Strand=-; Position=1-91
MFIRNIIFIDHLMSRLLKIITIDGNFTSYR

SEQ ID NO: 135387 - protein, 96 aa, Heterodera glycines
  Coding regions on vcDNA: vcDNA=SeqID_61810; Strand=-; Position=1-290
MKRSNTTKDTPPQPKRSMAFAPDSGPNTAALAEQERQRTLVLIGLPESNAVRPSQRVKEDREAVTKILDHLDVEAEPTAVFRLGRFNPQRTHLARS

SEQ ID NO: 135388 - protein, 24 aa, Heterodera glycines
  Coding regions on vcDNA: vcDNA=SeqID_61811; Strand=+; Position=1-76
ITGVSIIAVLFLVFLMPSQNLVRF

SEQ ID NO: 135389 - protein, 42 aa, Heterodera glycines
  Coding regions on vcDNA: vcDNA=SeqID_61812; Strand=+; Position=1 -51,893-970
MWGAAQAATAAAGGGTPSSIANSSPFVTMSGNAAAADRVTKC

SEQ ID NO: 135390 - protein, 310 aa, Heterodera glycines
  Coding regions on vcDNA: vcDNA=SeqID_61813; Strand=-; Position=1 -697,736-930
  Homolog annotation: Hit_ID=NP_502797.1; Match level="QueryCoverage =100%, HitCoverage=86%, E-value=1e-54, Identity=36%"; Hit description= HASI (4P602) [Caenorhabditis elegans] emb|CAB16520.1| Hypothetical protein Y57G11C.19 [Caenorhabditis el
VEKILSKIYFNLKSPASFAGIQKILNEAKKIDPKITTDDVNKFLERQKTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQARKIKNILRKNFIKNVMYSPDLHAGVVERANRTIKERLYRYFTKKDTLRWVDVIDKIITNINNSVNRTLGAKPSSINLKMPVRSGKKKFKIGDIVRITKEKKFKIGDIVRITKEKGKFSKGYLPNFTEELFKIVVANSTTPDSYRIEDLEGNLIKGIFYNQELVK

SEQ ID NO: 135391 - protein, 51 aa, Heterodera glycines
  Coding regions on vcDNA: vcDNA=SeqID_61814; Strand=+; Position=1 -147,832-840
MKRCATKPQLANVLQTLIYAMQSNAMTVNLPNNNLFHSEFGQNPFFCLKLE

SEQ ID NO: 135392 - protein, 18 aa, Heterodera glycines
  Coding regions on vcDNA: vcDNA=SeqID_61815; Strand=+; Position=1-56
YREATPEGFGLPINLGTS

SEQ ID NO: 135393 - protein, 96 aa, Heterodera glycines
  Coding regions on vcDNA: vcDNA=SeqID_61816; Strand=-; Position=1 -138,426-578
MLNKIKIAPYKNICSEQIRNGENEEVENFMDTISDLVVGENITIDSANTNGEYQEGETDNVWRPNQDVVPYDEFQNALALNMDGGNNNLEEENSER

SEQ ID NO: 135394 - protein, 91 aa, Heterodera glycines
  Coding regions on vcDNA: vcDNA=SeqID_61817; Strand=+; Position=1 -108,632-799
MAQSNANMGLKSVGSTNFMLLYFIETNTFSEGVRFYAFRWRKHPKNAMSNCIQSRTFTTKLREQMELYPLNQLFLKLEKYIYSFHGIIRES

SEQ ID NO: 135395 - protein, 334 aa, Heterodera glycines
  Coding regions on vcDNA: vcDNA=SeqID_61818; Strand=-; Position=1-1009
  Homolog annotation: Hit_ID=NP_510671.1; Match level="QueryCoverage =96%, HitCoverage=33%, E-value=2e-64, Identity=42%"; Hit description =predicted CDS, endonuclease/exonuclease/phosphatase family and RNA -directed DNA polymerase (XR69) [Caenor
GNTFVNQCFISDIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLITVVEDWYEAIINGKVDCIYIDFKAFDSVPHELLLYKLEKIGIKGKLLMWIKGFLSNRTFRVKIGDSLSSSKKVTSGVPQGSVLGPLLFLIYINDLPDALPSGVKIKLYADDVKLYICYKARTDTEIMHKALHNLFEWANKWQIKVSMQKTFVLYLGSKNPKETYEFDGNTINAVDTIRDLGVNIDNKLQFSDHI

SEQ ID NO: 135396 - protein, 91 aa, Heterodera glycines
  Coding regions on vcDNA: vcDNA=SeqID_61819; Strand=-; Position=1 -230,624-669
MTEEIFNDEVNFVKAIQSVVSADDNFICEKPSFCIAPLLNSALFEILFALAIRLGLLIGQNGFVEKYLPTFLIPLYEFPLHCVFRKSNSIN

SEQ ID NO: 135397 - protein, 72 aa, Heterodera glycines
  Coding regions on vcDNA: vcDNA=SeqID_61820; Strand=-; Position=1-218
QTHNLRTTEQHKTVQMFIRFIGIEKSLARHISALVLISQKIKPLFLRTHGCSMHPPNFIPKLHGHLQTFLCE

SEQ ID NO: 135398 - protein, 214 aa, Heterodera glycines
  misc_feature (207)..(207): Xaa can be any naturally occurring amino acid
  Coding regions on vcDNA: vcDNA=SeqID_61821; Strand=+; Position=1 -372,436-654,1320-1342
  Homolog annotation: Hit_ID=NP_501429.1; Match level="QueryCoverage =100%, HitCoverage=30%, E-value=1e-39, Identity=40%"; Hit description= tc5 transposase and CENP-B protein and Tc5 transposase, C-terminal family member (mut-x) [Caenorhabditis
ITKFISKTHFINLEKIKMESQQFVELTRQFVETISIRDVLNADQSGFELELHQKRSLAPIGTKLVECVVQSVASTTHSYTIMPIITANGLLLSPLFIVIAERNGKFPQKGIFQVKNIFLENNTSHIMTKNLMVEWVNSHIMTKNLMVEWVNTVLCPVLRPGETVLLVDSWNGWKNFGSHKMSLQVKQIPKHGTGFSQPLDVYVFRYXKNLIKKI

SEQ ID NO: 135399 - protein, 104 aa, Heterodera glycines
  Coding regions on vcDNA: vcDNA=SeqID_61822; Strand=+; Position=1-315
MMITVEKVVGAGGSGTIVGAASVDGSPARRVDKQELNRAYKMMLHQRRDAVSGQSGNEAMLRSTSPATKGGTNSSMGLTLASEDEQKQHKEVGELMTGPNGEPN

SEQ ID NO: 135400 - protein, 81 aa, Heterodera glycines
  Coding regions on vcDNA: vcDNA=SeqID_61823; Strand=-; Position=1 -217,1406-1434
  Homolog annotation: Hit_ID=NP_492548.1; Match level="QueryCoverage =87%, HitCoverage=15%, E-value=4e-23, Identity=64%"; Hit description =lectin mannose-binding 1 like (55.0 kD) (1K186) [Caenorhabditis elegans] emb|CAB03169.1| Hypothetical pro
MPLLFVPACQRDFRNKQYPVHIKVEYFRNTLTVHVSDGMSATPRFEMCIRAEHIFLPKAGFFGVSAATGGLAVSFGVFRSP

SEQ ID NO: 135401 - protein, 38 aa, Heterodera glycines
  Coding regions on vcDNA: vcDNA=SeqID_61824; Strand=-; Position=1-122
GSTPSGQLRLSNVQKAITFFFVGQTSQSWYHSKDSRGP

SEQ ID NO: 135402 - protein, 59 aa, Heterodera glycines
  Coding regions on vcDNA: vcDNA=SeqID_61825; Strand=-; Position=1-280
GMGRGFAFRISPFALFAFFGVSHFAFRFLARKATFTPLRIGLNSHKIFQNFTYKLANFQ

SEQ ID NO: 135403 - protein, 33 aa, Heterodera glycines
  Coding regions on vcDNA: vcDNA=SeqID_61826; Strand=+; Position=1 -68,325-356
MEAQFHFSKISGSDFEAQKRNLEDSRLSALVQK

SEQ ID NO: 135404 - protein, 162 aa, Heterodera glycines
  Coding regions on vcDNA: vcDNA=SeqID_61827; Strand=+; Position=1 -105,140-328,489-581,688-789
MPKIDDIAKCLHLRHKRAAFQSAVLLLTEKASFLNPSTFLPDQRADETQQQQQLTQHQLQQLMNDIADWLGLYEQLPQETEKTKTEMFNTLVNRNGQQVDQSEQTTSSLIHSSVLRELANAKRCEENERLVRVVIDEDESADDQPPTTCSVGTQTKMSFANK

SEQ ID NO: 135405 - protein, 91 aa, Heterodera glycines
  Coding regions on vcDNA: vcDNA=SeqID_61828; Strand=-; Position=1 -102,620-793
MHIKIGEAQAVTHKFKAVNFNQIQRGNFIDVEFELLALHSPFFRTLFFSESELNKISAVDHQHEISIEAPVTFEHLKLLIDLLHDKKASNH

SEQ ID NO: 135406 - protein, 19 aa, Heterodera glycines
  Coding regions on vcDNA: vcDNA=SeqID_61829; Strand=+; Position=1-58
GLLRSWVRVPPGELPFMFY

SEQ ID NO: 135407 - protein, 84 aa, Heterodera glycines
  Coding regions on vcDNA: vcDNA=SeqID_61830; Strand=-; Position=1-255
ANKQRTAPNGEKFYYLALLGGSPPHCRDHWTKESPSPSVKGQGEPEGPVFRGRRNVMPEGTECGRKWDKGPERTSKRGARSSVG

SEQ ID NO: 135408 - protein, 125 aa, Heterodera glycines
  Coding regions on vcDNA: vcDNA=SeqID_61831; Strand=+; Position=1 -196,646-827
MCCESEHDPSKQHLKRPDKAQKEFEEPKIPFQPIPFSKKETPNQQRTFMEMYSICELDGNQRILNEDFEISQQKGVCEMFGGKSRNSQKTKFFLSSDSSQSKYFQQKHMSIPKTGTLTCFHQFKA

SEQ ID NO: 135409 - protein, 213 aa, Heterodera glycines
  Coding regions on vcDNA: vcDNA=SeqID_61832; Strand=+; Position=1-642
MDVGSVSAGFGWTSECSGGGSGHELCEKITLGSIDPVLDMSNLGSAVVKTPLQALLSIFLLRSGVASSLTAAQTLVQTIVGAEPKLELCMYTGKRGDQISTGKYPTEEDQRQALEKWVGSCFVARQALTESGYKPLSMQMPEGVNSLPDSEKNGTRSSKTVHGHSNVCGPRLCIKRAAFWHMTVFCSETRRQKCFPNTSTAPTALAERVRWQI

SEQ ID NO: 135410 - protein, 179 aa, Heterodera glycines
  Coding regions on vcDNA: vcDNA=SeqID_61833; Strand=+; Position=1 -217,327-427,777-957,1349-1389
  Homolog annotation: Hit_ID=NP_498182.1; Match level="QueryCoverage =98%, HitCoverage=20%, E-value=2e-64, Identity=55%"; Hit description =EGF-like domain containing protein (3G623) [Caenorhabditis elegans] gb|AAL02474.1| Hypothetical protein D
MAKRMHLNHPITFFGHSHSTVWVLSNGGIGFDNGIKQYKPNALPSMGQKLIAPFWNRNDLRNGGKVLFREVNGGRVLERGQSEIRYQYDREVKVVSAVVVTYEKMQAGFNAGDGTNHFALPTSGTGNIMYLEEYGNTGIPGEWMFILEEERVVRCKAGIKGDTCDEACSPGEWGEDCVK

SEQ ID NO: 135411 - protein, 94 aa, Heterodera glycines
  misc_feature (67)..(67): Xaa can be any naturally occurring amino acid
  Coding regions on vcDNA: vcDNA=SeqID_61834; Strand=-; Position=1-282
SRGNSKPKKSRNSTSRRRRVPCRHLRHKGNGRRPPRRRERHGHRQKWQQRRNRGKHQKGKLTKKRQXTQEHTSRSEPNIHSDHEQHEQAQFAVP

SEQ ID NO: 135412 - protein, 101 aa, Heterodera glycines
  Coding regions on vcDNA: vcDNA=SeqID_61835; Strand=+; Position=1 -108,168-365
  Homolog annotation: Hit_ID=CAE72832.1; Match level="QueryCoverage =97%, HitCoverage=21%, E-value=2e-16, Identity=43%"; Hit description =Hypothetical protein CBG20118 [Caenorhabditis briggsae]
MNNWLQNIKGQITELATEVLNDATEEGQVSVSSELQVEKKKCAEVERQFLSEKAKNEALEKRVKELEEQLFNTNEENDAIKEKFTGIVSDREQQIQRLNVN

SEQ ID NO: 135413 - protein, 191 aa, Heterodera glycines
  misc_feature (168)..(168): Xaa can be any naturally occurring amino acid
  misc_feature (170)..(170): Xaa can be any naturally occurring amino acid
  Coding regions on vcDNA: vcDNA=SeqID_61836; Strand=-; Position=1 -119,170-203,247-320,559-731,848-973
  Homolog annotation: Hit_ID=NP_508221.2; Match level="QueryCoverage =82%, HitCoverage=11%, E-value=2e-36, Identity=51%"; Hit description =putative protein family member, with at least 8 transmembrane domains, of bilaterial origin (XB793) [Caen
QKYLEQNESKVSKTHLYRRELVKRWRWFLRWLSNIGIYFVPWESRIKRIESVPWESRIKRIESQFGSVVSQFGSVVSSYFTFLRWVIFINFIITAIIIAFVVVPECAADATADAGRQNRTASRKRIPPEEQSHVDEWAVVWHFDVSWHNAKLFLTFYCFPSLPIKSNXFXNYYYLYLCKIFFITLFGIIDF

SEQ ID NO: 135414 - protein, 221 aa, Heterodera glycines
  Coding regions on vcDNA: vcDNA=SeqID_61837; Strand=+; Position=1-663
MAGPTCSIWSTGLNEAIARERFARDASLTVPRNNSGHAQLALEMAVPPGGILVPHHLWQQQRQRHQMQQQQQQQQQKQQIRQSVKSNIVTKINRRRKAAIIARCAGGGTEADLILMSALSTANANGGSTIGPPQPQAQPTIGAVPSGNCTNQFPKPTKQRTPTTAKKTITAVKEPSQNPRGATTDISESDDESDVEVFEVDEKEFGNDDLFEKLNRLEERK

SEQ ID NO: 135415 - protein, 15 aa, Heterodera glycines
  Coding regions on vcDNA: vcDNA=SeqID_61838; Strand=+; Position=1-48
QTINETHNLGCKLEG

SEQ ID NO: 135416 - protein, 50 aa, Heterodera glycines
  Coding regions on vcDNA: vcDNA=SeqID_61839; Strand=+; Position=1-151
FFAYQIFAINAHLFKKYSILLKCSVFCYILRIAVHLKASVIEQISQISRK

SEQ ID NO: 135417 - protein, 60 aa, Heterodera glycines
  Coding regions on vcDNA: vcDNA=SeqID_61840; Strand=+; Position=1-387
QAPKNKKIIIMILLFFSGHPFITRVSVDKRTQLKRWYNTFGDDQFIGQILSSFINGRHFF

SEQ ID NO: 135418 - protein, 265 aa, Heterodera glycines
  Coding regions on vcDNA: vcDNA=SeqID_61841; Strand=-; Position=1 -92,156-576,623-907
MKIVNSDGKELPIPQNPLPNKVIGFKSISIGFINQNVISFLGRFDRFFASCTTMLSITTGNVRVSEFVVRTIWPMFKDTIYQLSLDIIAFRRMRQLAPSMLNDCPSLRFFNLSNGISLEFPPDDSANATDGQAVAKWLFTPRHDNFPKELICYMNSTMEEQWSATVEQIKASFSSASSPVSFGISVLIPPSSSLSAVVPFELTNEFTGEKLALSKEDEEADLSGFSIIRCPIVPDDKRQQQMNKELGDRWNQINIFIGDDGFGDG

SEQ ID NO: 135419 - protein, 123 aa, Heterodera glycines
  Coding regions on vcDNA: vcDNA=SeqID_61842; Strand=-; Position=1 -54,161-253,303-524
MRREQEYSQFTRKEEEEKRYEKSKVESHLSGEFCSKMTNTQKSLKEFSEELSSVRLNVKELGKIVDCLQSSELAQSVDNYFRDKFSTLVELRQITSEENNKKMIAEVEQKFKTQTEYIANELE

SEQ ID NO: 135420 - protein, 240 aa, Heterodera glycines
  Coding regions on vcDNA: vcDNA=SeqID_61843; Strand=+; Position=1 -221,938-1126,1212-1274,1365-1408,1497-1611,1671-1731
  Homolog annotation: Hit_ID=NP_741414.1; Match level="QueryCoverage =97%, HitCoverage=11%, E-value=5e-93, Identity=72%"; Hit description =novel Channel type/putative Nematode CAlcium channel (nca-1) [Caenorhabditis elegans] gb|AAM81121.1| Nove
FQACDFVVLAMTIELALKVVAHLFFTPNAVVRDVAGVMTLFIYASFLFLIWMPNHVEQNSLAQLLMIFRAMRPLRIYTLVPHIRRVVVELCKGFREILLVTILLVLFMFMFASFGLQIVGGKLAACNDVTITNKKNCTGLFEQQLFVTRMEVYGKNDEQMHNDEQMHPKMLVPRVWTNTNPRNFNFDHIGNSMLALFETLSYKGWNVIRDILWARQGPWAGPWAVFFIHVYVFIGCMIGL

SEQ ID NO: 135421 - protein, 834 aa, Heterodera glycines
  Coding regions on vcDNA: vcDNA=SeqID_61844; Strand=-; Position=1 -597,682-1857,1904-2635
  Homolog annotation: Hit_ID=NP_507780.1; Match level="QueryCoverage =62%, HitCoverage=35%, E-value=1e-36, Identity=25%"; Hit description =predicted CDS, DNA polymerase type B, organellar and viral family member (5T899) [Caenorhabditis elegans]
MENRPKRPFPFTINDILTTPPPKKLRQGFLINQLLGLTVQEGEGATQTTSSKKIPSEFVEKLDCNVEHIAKFHYTKVKSRFVIRDVPADPEGLLSAIFKHCIDEAKSDSREKSSEPTHLGCLISSALLDGGDVFVPVRQITANTIDAILNLFTKVAQSKQQNGVTLWGEPFTITITTVDRSRLPTKRHLKGGARRRLAPIHNSDNFCLFYALQATMVSKTRGLSRSAFYEYIHGRYGQRGKFQEETRQLMRQIRAPFDLDTYDADTYVPLIIDHWNNEQQQHRLAVFIFGASGHYKPLYKYGNDDYDTPLILYFSNNHFDGVQFISGLFAGKKYCLACERPYSRPSLHDQSCKAHCMMCSRVGPAFPCSASPAGFFKKCDGCNKVFRNNDCHQHHLKSNFCNRSKKCKDCGVIWNVNDNKRKGREGHVCGEKFCTLCNNFHSTERGCFIQQLEPRMQPPYRIVAFDLETMQHLPADPLQPERRNHEPNFIAARVVCSGCIDNNKWRSATAGCSVCGPYRTAVFCQRPFNGTTVDKKVVTDNPMEAFVDWLVFKLPIKYDTYAYSHFGGRFDMVITFRELFRRGFNPEMIRQGNKMYEMNVQAQRKKNPKVVFRDSFNLMPCALGQLVPAYGLDVEEKPFFPHMANRPDNYGRQIYPTPDDYLAQGMMPEKRRQFDQWYEQHRHEPFLLDEALASYCKNDVDILTAALVAFRREFFEITKRQAVNETDDQESNAGIDVLRECMTIASACMKHFRSNHLPADHLAIVPERGYDNAQNQSLLALRFFKWYEEKHGVKLQTAHSAGGEKRVANYSLDAWIEAEKRAIEVNGIFDLKKL

SEQ ID NO: 135422 - protein, 39 aa, Heterodera glycines
  Coding regions on vcDNA: vcDNA=SeqID_61845; Strand=-; Position=1 -22,589-686
MSHQIEDAFVCAFFRPFRKTSNFQLIALIVDLDAKQHKI

SEQ ID NO: 135423 - protein, 463 aa, Heterodera glycines
  Coding regions on vcDNA: vcDNA=SeqID_61846; Strand=+; Position=1 -1342,1758-1807
  Homolog annotation: Hit_ID=NP_507780.1; Match level="QueryCoverage =62%, HitCoverage=19%, E-value=7e-27, Identity=30%"; Hit description =predicted CDS, DNA polymerase type B, organellar and viral family member (5T899) [Caenorhabditis elegans]
MRQPNHHNDNNNNDDDSGNDRGHDDDGNEVEEEEEEEEDDDDDDANSPKKAVRLCFFDAETSQDLPLQLRTKVVQKHVPLLIIAEIICEACINEGISVHSGVGQYANGCVCSPPVGPRGRRWCSPPFLNVPGDDSALPAYVNYNPRRLFFHSFDNANNDPVDDFINFLTGTGPHGVKTICLSHNGGKYDIHLILETLHRRNLPPKRICTTGLKIFSMTLKGNHQRHVVFKDSLNFFFCELDALPRTFGLNTEVATTKPFFPYLFIRRENLHQRLRGLPPKEFYQPDHMKAQKRDAFFHWWEAENRASRFQLREQLILYCMNDVAILRESVLQFRKIIAENTNGLDPFKVASTAAGLALATLRRCFLPMNKLVNAPEGGYLRGRRASAESARYIRYYEMTHPGVHVQSAQWSIGEANVEDTGYRLDGLVTRDPPERDLAIEYMGCFYHGKLVSICDEGILVSCW

SEQ ID NO: 135424 - protein, 44 aa, Heterodera glycines
  Coding regions on vcDNA: vcDNA=SeqID_61847; Strand=-; Position=1 -103,148-179
MFKNGKQNQFAKELGIGKDTLRKWKKEFGIEISKNGIRYSMKKK

SEQ ID NO: 135425 - protein, 21 aa, Heterodera glycines
  Coding regions on vcDNA: vcDNA=SeqID_61848; Strand=+; Position=1-65
MAISFFSWGFDRKLGTNICLL

SEQ ID NO: 135426 - protein, 19 aa, Heterodera glycines
  Coding regions on vcDNA: vcDNA=SeqID_61849; Strand=+; Position=1-59
TFAFSSLALPNTHTIFEML

SEQ ID NO: 135427 - protein, 19 aa, Heterodera glycines
  Coding regions on vcDNA: vcDNA=SeqID_61850; Strand=+; Position=1-59
TFAFSSLALPNTHTIFEML

SEQ ID NO: 135428 - protein, 19 aa, Heterodera glycines
  Coding regions on vcDNA: vcDNA=SeqID_61851; Strand=+; Position=1-59
TFAFSSLALPNTHTIFEML

SEQ ID NO: 135429 - protein, 19 aa, Heterodera glycines
  Coding regions on vcDNA: vcDNA=SeqID_61852; Strand=+; Position=1-59
TFSFSSLALPNTHTIFEML

SEQ ID NO: 135430 - protein, 19 aa, Heterodera glycines
  Coding regions on vcDNA: vcDNA=SeqID_61853; Strand=+; Position=1-59
TFAFSSLALPNTHTIFEML

SEQ ID NO: 135431 - protein, 19 aa, Heterodera glycines
  Coding regions on vcDNA: vcDNA=SeqID_61854; Strand=+; Position=1-59
TFSFSSLALPNTHTIFEML

SEQ ID NO: 135432 - protein, 216 aa, Heterodera glycines
  Coding regions on vcDNA: vcDNA=SeqID_61855; Strand=-; Position=1 -271,425-564,743-982
MAYPFLRYSILIVILCFVYGNDEENRQETIQKEAGIDHKNDDHIIGDVYLGDEFWDQFSPITDLPTIDGVEFVGNHLKYTDQTENDKTHETIDDNEWKGKKEDDKNNKLKRPNDQLKSLNAIHKSETSQIIKKKIRRPKKSEIWEHFMQNEHSNTCNYCGKEIKIQNKSSTFHLWEHLRSHQTQYEATKYAKMKNENENKKLEAQQKEKEEDTASN

SEQ ID NO: 135433 - protein, 41 aa, Heterodera glycines
  Coding regions on vcDNA: vcDNA=SeqID_61856; Strand=+; Position=1 -78,270-317
MAHIGIEKAIPCIIVMISEQIEEAVPANRGFLGLSNNAKNV

SEQ ID NO: 135434 - protein, 30 aa, Heterodera glycines
  Coding regions on vcDNA: vcDNA=SeqID_61857; Strand=+; Position=1 -21,604-645,866-895
MNERVKMLYDQEKDEDGFLYIVYASQHAFG

SEQ ID NO: 135435 - protein, 19 aa, Heterodera glycines
  Coding regions on vcDNA: vcDNA=SeqID_61858; Strand=-; Position=1-59
TFSFSSLALPNTHTIFEML

SEQ ID NO: 135436 - protein, 19 aa, Heterodera glycines
  Coding regions on vcDNA: vcDNA=SeqID_61859; Strand=-; Position=1-59
TFAFSSLALPNTHTIFEML

SEQ ID NO: 135437 - protein, 19 aa, Heterodera glycines
  Coding regions on vcDNA: vcDNA=SeqID_61860; Strand=-; Position=1-59
TFAFSSLALPNTHTIFEML

SEQ ID NO: 135438 - protein, 19 aa, Heterodera glycines
  Coding regions on vcDNA: vcDNA=SeqID_61861; Strand=-; Position=1-59
TFAFSSLALPNTHTIFEML

SEQ ID NO: 135439 - protein, 19 aa, Heterodera glycines
  Coding regions on vcDNA: vcDNA=SeqID_61862; Strand=-; Position=1-59
TFSFSSLALPNTHTIFEML

SEQ ID NO: 135440 - protein, 19 aa, Heterodera glycines
  Coding regions on vcDNA: vcDNA=SeqID_61863; Strand=-; Position=1-59
TFSFSSLALPNTHTIFEML

SEQ ID NO: 135441 - protein, 19 aa, Heterodera glycines
  Coding regions on vcDNA: vcDNA=SeqID_61864; Strand=-; Position=1-59
TFAFSSLALPNTHTIFEML

SEQ ID NO: 135442 - protein, 100 aa, Heterodera glycines
  Coding regions on vcDNA: vcDNA=SeqID_61865; Strand=-; Position=1 -135,181-345
MDRQNDLRQQQNVPEFICQERLDTNSPIAFKEPLPGAWNLHSEYLSTKTKEEKERNASRFRTELDPEDVKLVNGHHQPMEYFAFYFSELGHLSADKLMEY

SEQ ID NO: 135443 - protein, 339 aa, Heterodera glycines
  Coding regions on vcDNA: vcDNA=SeqID_61866; Strand=+; Position=1 -409,508-616,665-793,837-1124,1172-1258
  Homolog annotation: Hit_ID=NP_001003870.1; Match level="QueryCoverage= 72%, HitCoverage=24%, E-value=6e-11, Identity=26%"; Hit description =myosin-binding subunit of myosin phosphatase [Danio rerio] gb|AAT68110.1| myosin-binding subunit of my
DQSSKESAKYPQSPTINPSRLHHRRQQHQMQLHSQQKGERGHTVNSKAHTANNKDATMAMTFMLGKDNGIGIVGVSSANAGTSLPIANNAIATSASESASCSSVTPSPSPSPIVAFNATNDALNSSSPFVTLRKQPQCQQSTPPTQPISSRESEAERKAKSRLKRSTRRSTQGVTLEQLGEVNMRNHSPKHHGRAEIGKEQKQRMAIGHDGSCELQMPASPCSSTSSSSAYLTAASHRAVDQHNSKVERVKENYNSTKNEATPSPSSTASLIDDLEKYKELYELERSESERLRTERRMFERRISALEYELEKSRQLQTDNEKLKDENIALVRVLAKLSK

SEQ ID NO: 135444 - protein, 130 aa, Heterodera glycines
  Coding regions on vcDNA: vcDNA=SeqID_61867; Strand=-; Position=1 -132,713-874,1383-1478
  Homolog annotation: Hit_ID=NP_356204.1; Match level="QueryCoverage =90%, HitCoverage=24%, E-value=5e-23, Identity=46%"; Hit description =hypothetical protein AGR_L_830 [Agrobacterium tumefaciens str. C58] gb|AAK88989.1| AGR_L_830p [Agrobacter
MVNTLKTTVKLSALNLGAIAAANPKIVVPNFARDALSAGIVHFGALYLTELFNTGRDLDWAVVGVGMRASDERMRCYLSGQDFMTTVVSQDEHNTTVQIVASMIDFLPVANSAAVLAQLSQPNIRIVSMT

SEQ ID NO: 135445 - protein, 154 aa, Heterodera glycines
  Coding regions on vcDNA: vcDNA=SeqID_61868; Strand=+; Position=1 -349,502-617
MDVTLPVSNSVGEWIGEERGDGSVVLYAPWTDVWHVQQQQQQHQQHQQQQQQNEVQQQQQQLVRRTGTGWTRFPAWNEPLVANDWREKEENLIQRKRLQRENPVYWARILEEEKRAVCCWGREDSGWKFWRRALVNDVGMGLKVLRLTMIGDGI

SEQ ID NO: 135446 - protein, 91 aa, Heterodera glycines
  Coding regions on vcDNA: vcDNA=SeqID_61869; Strand=+; Position=1-662
LFEYPKRTLEKIDFFVFGAVPPNRCAQIYGETESFGNSFPIACTLILRWIFAPHNCLSTPNGHLKKSIFLFSGQSPRTDAPRFMGRPNPSE

SEQ ID NO: 135447 - protein, 66 aa, Heterodera glycines
  Coding regions on vcDNA: vcDNA=SeqID_61870; Strand=-; Position=1-200
QSLSVDNCDKQRDEPREHFVQTGRRTIRLVTVHAEVPHEHFVQNLREDEAGTAVFVSILSIDQLEE

SEQ ID NO: 135448 - protein, 463 aa, Heterodera glycines
  Coding regions on vcDNA: vcDNA=SeqID_61871; Strand=-; Position=1-1392
  Homolog annotation: Hit_ID=NP_920205.1; Match level="QueryCoverage =86%, HitCoverage=26%, E-value=2e-39, Identity=32%"; Hit description =putative DNA helicase homolog [Oryza sativa (japonica cultivar -group)] gb|AAP52492.1| putative DNA helica
MEFQGRGGPHAHIVAQTDLDAVPDVIQQYIWAHIPLLPEKGDDTPIAEMHRQVRELMHLQLHRCSESWCGTRDQYYGRCKKGFPAPYSKCTILRPDRPALYYRPAPQDGGANIEVNGLIYDNSQVVPYNPYVLLRYRVHHNVLFAYGNKANIKYALKYPFKGLGHCYVECKEESGNKIGIDEPAQYAKMNFRGATEAYAVVNSTPYVRLSHHVVKLMIHLPNQQSIVYRAFQLVSKAQQIQQGTLPETQCSAYWKQWQNEWRHDPKFKDMLFEKVPEQFRWDKDKWVLYKRKPIKRPPIGRIVPVPPKDPERFALYSLMRHFPGDPDHLKMVNGQPCTSFTDAAIRHGLLEDDKIWDKTLAEAALSRWPDQMRWLFMSILVYGQPSNAVELWNKYKDQMYFPQGITTSAQRQAAELEALADIDWRLHSCFNLSSVHFGLPDPANCIAKIQMRQLMSFSLAMMI

SEQ ID NO: 135449 - protein, 62 aa, Heterodera glycines
  Coding regions on vcDNA: vcDNA=SeqID_61872; Strand=+; Position=1-353
MNNANHLDQCWQITLIFERTKSAQFLLVSRSEKSSKGLSTPSKMRKRSATGKSGPSKWHLHL

SEQ ID NO: 135450 - protein, 139 aa, Heterodera glycines
  Coding regions on vcDNA: vcDNA=SeqID_61873; Strand=-; Position=1-419
LVKRCNNNSSSSNKTTEHVPSAGAIDHAFVTVVPRRSVGGGPKIEPTSCGNVSVPENEAIPQLLRIRTLLDDLTTTDEFTAPPAVVYAIEGGHWHNANLFHIDPNTGWISSTKPLDRETMAEHLLMVSATDLNTVPKKV

SEQ ID NO: 135451 - protein, 204 aa, Heterodera glycines
  Coding regions on vcDNA: vcDNA=SeqID_61874; Strand=-; Position=1 -70,600-1144
MGLVNKWPNGPQTTPPLSPAIFPVDKEPTKKPQTRGKRSSSIAAKSDEITTTEVKKSSTPPLKKPKALFAPAKRQLPAEQIAELKQYFKQEEEAAKRQLDRAIKEVKKTIKFNKNKDLIEYTRALYSIKPGAPEKVEDFLDSFDPTTNTEVLDELDRVQTKKQQLFDAALTHHEKRIAKEAENCRHPHKFHSDFCGKGSKSLQF

SEQ ID NO: 135452 - protein, 117 aa, Heterodera glycines
  Coding regions on vcDNA: vcDNA=SeqID_61875; Strand=-; Position=1 -179,261-435
MIGEDEQLRRLGDDPALLSFVLGDTDEVKARKKKKRQSVSPPPQQPQEAVAKQQFAASGMKVNNSPSPGPGHSADTSAAEAAMAQVVAEDAIIAAEMSIAAGSILASSSRRGGDRHC

SEQ ID NO: 135453 - protein, 240 aa, Heterodera glycines
  Coding regions on vcDNA: vcDNA=SeqID_61876; Strand=-; Position=1 -147,727-1074,1230-1457
MCESRFSVPDSGNFSGFSLPGLVVFWVANHEYGIHFDNCEARTRFRTKRDTIVAGADDLNAITGRKAKSEAERNVLCNRLVERSLRVAAQMRQLQDYVCIFFQQYFQHYNILKYAESSEAKRRLRWAVAQKDKQISQLNKDNKQLRKDVEHLEDCNNEVVLQVKQPGAPEEVEDFLDSFDPTTNTEVLDELDRVQTKKQQLFDAALTHHEKRIAKEAENCRHPHKFHSDFCGKGSKSLQF

SEQ ID NO: 135454 - protein, 44 aa, Heterodera glycines
  Coding regions on vcDNA: vcDNA=SeqID_61877; Strand=-; Position=1 -58,504-580
MVAHAEQKWTTKAITFPCLCHCRHQRKKKKEKKKRIKATKMSSD

SEQ ID NO: 135455 - protein, 95 aa, Heterodera glycines
  Coding regions on vcDNA: vcDNA=SeqID_61878; Strand=-; Position=1-829
LFEYPKRTLEKIDFFVFGAVPPNRCAQIYGETESFRNSFPIACTLILRWTFAPHNCLSTPNGHLKKSIFLFSGQSPRTDAPRFMGRPNPSGIASL

SEQ ID NO: 135456 - protein, 170 aa, Heterodera glycines
  Coding regions on vcDNA: vcDNA=SeqID_61879; Strand=+; Position=1 -161,431-483,525-702,748-816,861-912
MISQRPEFSELINDYTIEMAKPIRSNDNTLRVIYCKKDEYIKEHKCSNIMISICEMSKEYADSKILEVVCAGPKQYALKLQKENGEIWYKTKIRGMTQNKNNKIDYKEFKDMVLNYKEEKKIRFTHSNKFGPTRESYVISRNVTKDYKPIQKKGIILDDENLTVLPFGCW

SEQ ID NO: 135457 - protein, 36 aa, Heterodera glycines
  Coding regions on vcDNA: vcDNA=SeqID_61880; Strand=-; Position=1 -70,172-212
MRCTQTENGQFDEPIQKGNKVPKEEFKMIPSVAMSP

SEQ ID NO: 135458 - protein, 218 aa, Heterodera glycines
  Coding regions on vcDNA: vcDNA=SeqID_61881; Strand=+; Position=1 -50,95-242,322-418,657-873,921-1065
MLFTGIDRLIGIAFSEFHDKLKTRLYLAMITVISVSFGCLFAVLNCQQANEDDDLMVTGSYTDALKGMPRFGPIILSITSMGFIIYLFLGITIRVKASGLSSADSFNRRTFRALFCIITVNIGGYFITTIAYFLLAPSITSPVTEFFCALMAAIPMNIGAVSNGPILYFTSTEYRQAFQKEFPFVFKQTPNQNQVVPRQNGPPIRVISQSRIIDSCQP

SEQ ID NO: 135459 - protein, 267 aa, Heterodera glycines
  Coding regions on vcDNA: vcDNA=SeqID_61882; Strand=-; Position=1 -79,474-617,1257-1463,1628-1788,2140-2349
  Homolog annotation: Hit_ID=CAE66170.1; Match level="QueryCoverage =98%, HitCoverage=45%, E-value=2e-81, Identity=58%"; Hit description =Hypothetical protein CBG11408 [Caenorhabditis briggsae]
MADNEVKLSGHSLTGPVTSFQESTFPAPIVAQLSSVFSAPTAIQAISWPVALAGKDLISIAKTGSGKTLGFTLPAIVHVLNNQRPQQQRRPGEGPAVVVLLPTRELAQQVETVAREYGQLMRLNVVACYGGASKWPQMGALKRGVDICIATPGRLNDFISSNAVSMDRCSFLVLDEADRMLDMGFEPQIRQIISKIRTDRQTLMFSATWPKEVRKLAADFQRQPVHLTVGSLELSANHNIKQNVEVLTEHRKPQRLSELLQQILDKM

SEQ ID NO: 135460 - protein, 55 aa, Heterodera glycines
  Coding regions on vcDNA: vcDNA=SeqID_61883; Strand=-; Position=1-179
IKLGRRFNSVEMQLNTSNYHFFNGQPSPAGATQSNNKNFFSGQPNYSNNNSNWNS

SEQ ID NO: 135461 - protein, 122 aa, Heterodera glycines
  Coding regions on vcDNA: vcDNA=SeqID_61884; Strand=+; Position=1 -52,448-632,1576-1705
  Homolog annotation: Hit_ID=AAH78488.1; Match level="QueryCoverage =74%, HitCoverage=22%, E-value=6e-19, Identity=51%"; Hit description =LOC446918 protein [Xenopus laevis]
MGQLYRLGQWIRHRYDGGFLSPDYNVNELYVRSSDFNRTLMSAQALLAGLYPPRPDRAFEPGLKWQPIPVHTEARETDRKFNGEGKELPKWANESVIERIWQLNDLSSNYLYKTTKLVRFRA

SEQ ID NO: 135462 - protein, 56 aa, Heterodera glycines
  misc_feature (52)..(52): Xaa can be any naturally occurring amino acid
  Coding regions on vcDNA: vcDNA=SeqID_61885; Strand=+; Position=1-172
FFSKIITIKKILLNYLVHIWGFLYTYFGIFLTYLCTYFDHFFVHIFGSPNYXILIN

SEQ ID NO: 135463 - protein, 87 aa, Heterodera glycines; identical to SEQ ID NO: 129152
  Coding regions on vcDNA: vcDNA=SeqID_61886; Strand=-; Position=1-819

SEQ ID NO: 135464 - protein, 86 aa, Heterodera glycines
  Coding regions on vcDNA: vcDNA=SeqID_61887; Strand=-; Position=1-301
FEYPKRTLEKIDFFVFGAVPPNRCAQIYGETESFRNSFPIACNLILRWIFAPHNCLSTPNGHLKKSIFLFSGQSPRTDAPRFMGTQ

SEQ ID NO: 135465 - protein, 95 aa, Heterodera glycines; identical to SEQ ID NO: 124528
  Coding regions on vcDNA: vcDNA=SeqID_61888; Strand=-; Position=1-827

SEQ ID NO: 135466 - protein, 104 aa, Heterodera glycines
  Coding regions on vcDNA: vcDNA=SeqID_61889; Strand=+; Position=1-438
NGLSKNRNYAQKASQTILAHPIPSTIAFIHPIMSAKIIRVPKIACDLSLEKNGLSKNRNYAQKASQTILALPIPSTIAFIHPIMSAKIIRVPKIACDLSLEKMV

SEQ ID NO: 135467 - protein, 160 aa, Heterodera glycines
  Coding regions on vcDNA: vcDNA=SeqID_61890; Strand=-; Position=1 -415,802-869
MGLGFLDKNPGCRKWHGPGSGSRKNPGLDPGPGQALNILLLESVIIKNNKKNSMIINKKVSEENADHNAKKTNNNQLIIINLSAKKNSLKNELIKKEENEMETPKKEEIKLKKKEKLKEKCKNDLLKEWERISPVNICAFLDDSFLYGKYAEILSSPLDG

SEQ ID NO: 135468 - protein, 34 aa, Heterodera glycines
  Coding regions on vcDNA: vcDNA=SeqID_61891; Strand=-; Position=1 -20,156-240
MIEKQNSFINKPRTEKKYFAIFDIGPCQNFVQEA

SEQ ID NO: 135469 - protein, 340 aa, Heterodera glycines
  misc_feature (240)..(240): Xaa can be any naturally occurring amino acid
  misc_feature (243)..(243): Xaa can be any naturally occurring amino acid
  misc_feature (270)..(270): Xaa can be any naturally occurring amino acid
  Coding regions on vcDNA: vcDNA=SeqID_61892; Strand=+; Position=1 -77,123-342,396-599,673-896,1896-2120
  Homolog annotation: Hit_ID=CAE74379.1; Match level="QueryCoverage =98%, HitCoverage=74%, E-value=4e-86, Identity=51%"; Hit description =Hypothetical protein CBG22107 [Caenorhabditis briggsae]
SSNRPIRSQRTPLKEIITLDDPTELNQFMARGNQFMARGEEQCIHAMRAFITQFSLRQTTVATMTGVSQPYISKLLNGNHRELSLRCRKNIYCWYLNCRRHPEKLAMFVQDPCTRLETSAEGMFVQDPCTRLETSAEGELVPQRRERYVFRPVLLRVLETYFQKCPFPDIAKRVEIANACNAHLQVDKRGVQLVQLMPKEVVTPQVIANWFANKRKEMRRRMGGTEGTESVEQFGKDGHXALXALGPIQSAGRSNSPSSPNSAAHSPISXILTLTGRDDANPLSLSLPPLFLSLTLSPLPPFSLPSFSPPSLLPLSFFLSLALSPLPPFFLSFSLFPLSL

SEQ ID NO: 135470 - protein, 32 aa, Heterodera glycines
  Coding regions on vcDNA: vcDNA=SeqID_61893; Strand=-; Position=1-97
MLCSLPFRGPARAPSAPGPPCGQSAAVPPAIA

SEQ ID NO: 135471 - protein, 168 aa, Heterodera glycines
  Coding regions on vcDNA: vcDNA=SeqID_61894; Strand=-; Position=1-505
  Homolog annotation: Hit_ID=AAO12864.1; Match level="QueryCoverage =88%, HitCoverage=43%, E-value=3e-37, Identity=47%"; Hit description =Ccmar2 transposase [Ceratitis capitata]
MAEAKRIGRADPQASSTAPKVLLCVWWCSSGLVRYELVPAGQTINADIYQQQLQRVHDQIRRPPFSAKFRGGVLLHDNARLDVAFSTQQKIEQLRWAVLPHPPYSPDISPCDYYLFRSMEHFLRGKEFADQNEVENALDDFIGSKNDQFYKKGIEILPERWGRIIDQN

SEQ ID NO: 135472 - protein, 52 aa, Heterodera glycines
  Coding regions on vcDNA: vcDNA=SeqID_61895; Strand=+; Position=1 -3,213-368
MQDIVNEEFGKLREMKEENKDNEKVIGEEELMNQARPISHFTAILRFNDLIN

SEQ ID NO: 135473 - protein, 153 aa, Heterodera glycines
  Coding regions on vcDNA: vcDNA=SeqID_61896; Strand=+; Position=1 -198,240-364,412-547
  Homolog annotation: Hit_ID=NP_508993.2; Match level="QueryCoverage =91%, HitCoverage=19%, E-value=2e-25, Identity=40%"; Hit description =fatty ligase long (79.9 kD) (XG556) [Caenorhabditis elegans] gb|AAA80409.2| Hypothetical protein C46F4.2
MSDRKDSVTGGKRIEQELAEDGRPVYIVVLTIFLKGFFFLYDLLVFIPFKLFADPELKKERSREQKAVPIDGNPASPWRHVDTIGTALYTELFEDCPTLGKIWDKAAELHRGHNCMGTRDILEVIQERQSDGKTFQKLALGKYSWMDYEHVDE

SEQ ID NO: 135474 - protein, 319 aa, Heterodera glycines
  Coding regions on vcDNA: vcDNA=SeqID_61897; Strand=-; Position=1 -253,316-653,712-1080
MDFTTTDSATNTDLTTVDKATDVDLAYEDAATQTDQLDKQLKEQEQVISFLRQQVRNRDAMITALRRQLEEKMAPPMETPTTSKTTPTGRPKMNVDHLQRTSRRKLADQIADVISRDRSRSASRASLEGISREVRHKFAHYTPKKKKQQLPRQNDSVDPEDALLILGLVGTQKAYRRLKGTIRLINAKLDVFPPLKKVLDIKRRICGPLQYAPIETNVGVGFVCTDVGAALEARLLSAKDNLITFGGEIYMKLSGDHGQSCTKITISFSQAARSNSPSNNFVCAVFPAKDSRENLERYGGTLWEQIDGIGTLAEKRVKW

SEQ ID NO: 135475 - protein, 37 aa, Heterodera glycines
  Coding regions on vcDNA: vcDNA=SeqID_61898; Strand=-; Position=1-112
MIMKGGKKGKKKAPVQRVCRKFARVENAKECRGNGRG

SEQ ID NO: 135476 - protein, 71 aa, Heterodera glycines
  Coding regions on vcDNA: vcDNA=SeqID_61899; Strand=+; Position=1 -82,379-503,1020-1028
MSLRLFYCPQIYSRFKCTFIFLLLFLISIQKCCPKYEGTSTPIFCCVDEMFDKAPEFPQQMCKDDNVEMFF

SEQ ID NO: 135477 - protein, 127 aa, Heterodera glycines
  Coding regions on vcDNA: vcDNA=SeqID_61900; Strand=-; Position=1 -80,196-277,612-691,963-1103
  Homolog annotation: Hit_ID=CAE69775.1; Match level="QueryCoverage =97%, HitCoverage=38%, E-value=3e-35, Identity=58%"; Hit description =Hypothetical protein CBG16060 [Caenorhabditis briggsae]
FVGAALNSIVLLIGLLKVDTADKPRQIIVISMTLADLLTCLFYMLTRPYKFLFSASLCHPYYVCIVTPQLCSCLCLLWINVDKLIFIGRPLHYYQLVKRDRVLILIALSWLCLISLVITLYSFMEIK

SEQ ID NO: 135478 - protein, 120 aa, Heterodera glycines
  Coding regions on vcDNA: vcDNA=SeqID_61901; Strand=+; Position=1 -130,243-300,545-719
ECICDIQPIASVGMFLNGYTTPLFGVFVELHDWRDTRPIMCCSEKVSWPLAGTFFCPDRCSCGNKQIYLPIGWYVCFGLIDIIFIYLSMLKISLLFLQTSAPFSPIIFLKSSKWLQIRAI

SEQ ID NO: 135479 - protein, 141 aa, Heterodera glycines
  misc_feature (3)..(3): Xaa can be any naturally occurring amino acid
  Coding regions on vcDNA: vcDNA=SeqID_61902; Strand=-; Position=1 -203,267-385,492-591
  Homolog annotation: Hit_ID=AAF01687.1; Match level="QueryCoverage =95%, HitCoverage=70%, E-value=8e-45, Identity=63%"; Hit description =CPN-1 [Caenorhabditis briggsae] emb|CAE67087.1| Hypothetical protein CBG12498 [Caenorhabditis briggsae]
IDXKLMTERATKSGLAAEAQQKIHSKFDLELSKQIFGWISQVTGESFTVSGEVEEFLSTLKDGTVLCKLANALSPNSIKKINTSNFPFKQMENISFFLGFAEKYVNKSELFQTVDLFEGQDPNSVLICLAALARKSEKSFG

SEQ ID NO: 135480 - protein, 19 aa, Heterodera glycines
  Coding regions on vcDNA: vcDNA=SeqID_61903; Strand=-; Position=1-60
EPVNSCIGCKYRRCCTPNS

SEQ ID NO: 135481 - protein, 18 aa, Heterodera glycines
  Coding regions on vcDNA: vcDNA=SeqID_61904; Strand=+; Position=1-57
EPMNSCIGCKYRRCCTPN

SEQ ID NO: 135482 - protein, 92 aa, Heterodera glycines
  Coding regions on vcDNA: vcDNA=SeqID_61905; Strand=-; Position=1 -20,73-331
MSQCVAYLFVFIIVTVPFQISHDLNEDERQYALNYCQMQKQHYLAPEEDIPWDNWARNAHQPITYYYHAVFLFYTLSYCCNLISLTHLQQLP

SEQ ID NO: 135483 - protein, 242 aa, Heterodera glycines
  Coding regions on vcDNA: vcDNA=SeqID_61906; Strand=-; Position=1 -45,92-167,219-259,314-427,494-540,693-735,788-880,1068-1192
  Homolog annotation: Hit_ID=NP_491354.1; Match level="QueryCoverage =95%, HitCoverage=34%, E-value=3e-46, Identity=46%"; Hit description =acetylcholine receptor (acr-6) [Caenorhabditis elegans] gb|AAF40009.1| Acetylcholine receptor protein 6 [
KADVYANGSVFWEPPVVYNSMCVVYNSMCAIDIKWFPYDEQECYMKFGSWTYSWTYGGFELDMVHLDTDVVEHVSQENLDTDVVEHVSQENGTVWNVELGVDISEYQESVEFELLSVTGRRHEKRYPCVTGRRHEKRYPCCDYPVIDITYFLKIRRKKLFYTVNLMIPCVGILFYTVNLMIPCVGIAILTSFVFYLPSQSHNKNLCINILVSLTVFFLLVMFFSNFFAFPPFLILPPSFGLV

SEQ ID NO: 135484 - protein, 164 aa, Heterodera glycines
  Coding regions on vcDNA: vcDNA=SeqID_61907; Strand=-; Position=1 -122,174-546
MAKRTLLRKRETKMHAIRVRTSGRRDEPKCKGDKSPMSQQKRSTAEPQCRNAKAGRSRAVNICCTGRRSDGVAATNSRTSADARDGRGNFGIWLFAAVDICHTNRRFEQDDQRKMLIICSAPHAANWLSPQTCIGNGTSLMAKDNLPSSYAFRPNPKISQKYKF

SEQ ID NO: 135485 - protein, 61 aa, Heterodera glycines
  Coding regions on vcDNA: vcDNA=SeqID_61908; Strand=+; Position=1 -81,143-194,381-433
MTMEGALITNGILSSCFSQIESHTIQKLSFDLLMSIYRTFGYMSVCPLNLNPYYTYKSIFT

SEQ ID NO: 135486 - protein, 44 aa, Heterodera glycines
  Coding regions on vcDNA: vcDNA=SeqID_61909; Strand=+; Position=1 -44,390-480
MARAAKSEKCKEEGTENRFNLFCYTRIKRTVEPGLDPGSCPGQT

SEQ ID NO: 135487 - protein, 199 aa, Heterodera glycines
  Coding regions on vcDNA: vcDNA=SeqID_61910; Strand=+; Position=1 -222,686-1063
MFIVCATIKTRIVFSLLLLLLINYPQCFVMGRHRIIAAEDMETVLNRLRPSVDRFDANFQRTFNEYGRVDSVRELLEDSVVPRFTVEEHGRVDFVDAFQQLQLRIQQFFDTKIRALHRLVGAAEKAAQKVDMDKVMGPTLGSEGRCRDQMRALNASSVHNPSIWKKSNGKTNSGIHVGILGMKVLGDDKQLGHGIFKTF

SEQ ID NO: 135488 - protein, 106 aa, Heterodera glycines
  Coding regions on vcDNA: vcDNA=SeqID_61911; Strand=-; Position=1-321
MQPMRLCRAAMRHGTGGKRTGTVADQCAVEVAAECKLKQKSDDWVVKRNCYSMRKPRLEKLSRAQARKDVPKKDVRAVMKEASGAMRGNARAGAGRRTVRRTVAIA

SEQ ID NO: 135489 - protein, 205 aa, Heterodera glycines
  Coding regions on vcDNA: vcDNA=SeqID_61912; Strand=-; Position=1 -89,132-394,438-703
  Homolog annotation: Hit_ID=AAL93203.1; Match level="QueryCoverage =96%, HitCoverage=28%, E-value=9e-11, Identity=28%"; Hit description =transposase [Bactrocera dorsalis]
MKIVNRTVETIRTTLYYAVERRFFGLANLKEYALATFLDVRFKDKVLMENSATFRARVNVWIKNEVKECQVENDLDELQNEFVRPVISPQPENPPAKRRMSFFERLKHITGANTTEQGFQTSQDDDIEKENKEFLALEIANPEANPLDEWKKIAPRFSILAKFAEKYLSAPATSVPSEQTFKVARDVFDYRRSKLSPETAEQLIF

SEQ ID NO: 135490 - protein, 211 aa, Heterodera glycines
  Coding regions on vcDNA: vcDNA=SeqID_61913; Strand=-; Position=1 -268,325-473,647-865
MPFSTNGRISDRKKGTLLMDIEKVSEFAREEVGSSRYSEKVYINGLPWEIEAEITKDTDEKKYLGFYLWYDAKEGPILITILKIYSTEKDSNWRCFVHSATFRIISQKNGTENSIGTFCDHVFDKKSNNLGFPNFVSFAELMDLNNGFYDREEDKVKLTIDLTTVDEPKVDKFNLDQSNSKGTLFMEIEKVSEFAREIIGSQRKSETVHIK

SEQ ID NO: 135491 - protein, 149 aa, Heterodera glycines
  Coding regions on vcDNA: vcDNA=SeqID_61914; Strand=+; Position=1 -136,349-530,652-783
MEGTTHGKYGIRLSYLFRYFFAERSGKKLPRLRNEKWKLSERCEIDISSLNAAIDSLELLLAELEPNKFQSEFGRGKYDLIASIIARLRGVYSDLQKYVNEDFLKRVSTEDIARSVWHAKSIMGCRTGGAGTLSVLSDNSFISAYDEFV

SEQ ID NO: 135492 - protein, 103 aa, Heterodera glycines
  Coding regions on vcDNA: vcDNA=SeqID_61915; Strand=-; Position=1-648
LCLSFPSPCRPHTPRFFKIYCRKFKKILGFFIIKFQKFFITDFSKFNELLPLCPSLPSHTFAIVQHSQAHRVALLHALQRICHQFAPVSAVQIGDCPNGEPTG

SEQ ID NO: 135493 - protein, 270 aa, Heterodera glycines
  Coding regions on vcDNA: vcDNA=SeqID_61916; Strand=+; Position=1 -171,265-451,497-747,894-1097
MSDFEIGMLKAMRHVFPSCEHSGCSFHMAQALFRKARSMGIFNLLDEYDDEALVQIKQFTFGTPFQRFNAAPLGIQGWLAYFGRTYIGTIQFEIDRGAEAYEPQADVGHFLLRRIRSTTPFSVSQTSIMTGSGPIQFGLHSPQPSTPTIPLSEESSLQLLRRWEQEIVQPPRFPISFWNVHTRAQMEIERTNNGMEAAHGQFAKSRKRPQRYIIKEQSVVRILDEADFESEEGLANALHLLGLVMQGFVEGLHIRGNDESDEETADADGN

SEQ ID NO: 135494 - protein, 79 aa, Heterodera glycines
  Coding regions on vcDNA: vcDNA=SeqID_61917; Strand=-; Position=1 -127,584-696
MACRCVRHFDDEKMGGQNAGGHRPEEIGRTFDWGTEVLREQREVFPSPATPLAHLFWVHPKITPGQNHAAKNLKKIFQT

SEQ ID NO: 135495 - protein, 127 aa, Heterodera glycines
  Coding regions on vcDNA: vcDNA=SeqID_61918; Strand=+; Position=1-384
MSTIRQLNDSSTRRFVNSAKMRRFVNSAKCQRFVNSTIRQLDDSSTQPKCDDSSTQPNVNDSSTQRFVNSTIRQLSQNATIRQLSQMSTIRQLNDSSTRRFVNPAKNSFKKQFQELLMALSTIIAFF

SEQ ID NO: 135496 - protein, 68 aa, Heterodera glycines
  Coding regions on vcDNA: vcDNA=SeqID_61919; Strand=-; Position=1-205
YQTILRYLKLKQKKFLTKNGYLFFLIFLPQTWYQQLPSLVWPYQTILRYLKRKQKKFLTKKWLSLFSH

SEQ ID NO: 135497 - protein, 132 aa, Heterodera glycines
  Coding regions on vcDNA: vcDNA=SeqID_61920; Strand=+; Position=1 -162,579-815
  Homolog annotation: Hit_ID=YP_051286.1; Match level="QueryCoverage =82%, HitCoverage=35%, E-value=3e-12, Identity=40%"; Hit description =hydroxyethylthiazole kinase [Erwinia carotovora subsp. atroseptica SCRI1043] emb|CAG76095.1| hydroxyethyl
INQWHPTVIRANGSEVMALATMLKQHSGGKIGTNICGKGPDSNVESAAAIGHAKDLALCSGSVVAMTGKTDFLIDPSCPSLMTQLDNGHPLMTKVTGIGCALSASVAAFLALAKSDEHKRRIACLTALAVRT

SEQ ID NO: 135498 - protein, 61 aa, Heterodera glycines
  Coding regions on vcDNA: vcDNA=SeqID_61921; Strand=-; Position=1 -22,76-239
MNMSTHPGMYEFLPMYTNFEPNRTYELIGTYKPIIKTDPPQFETNFVIMHKSEQTRQVMKW

SEQ ID NO: 135499 - protein, 21 aa, Heterodera glycines
  Coding regions on vcDNA: vcDNA=SeqID_61922; Strand=-; Position=1-63
GLTLSVQLAPYSRARRHKAKP

SEQ ID NO: 135500 - protein, 24 aa, Heterodera glycines
  Coding regions on vcDNA: vcDNA=SeqID_61923; Strand=-; Position=1-80
RTLSTAVRQRSSKIYSMPQILWAG

SEQ ID NO: 135501 - protein, 24 aa, Heterodera glycines
  Coding regions on vcDNA: vcDNA=SeqID_61924; Strand=-; Position=1-80
RTLSTAVRQRSSKIYSMPQILWAG

SEQ ID NO: 135502 - protein, 165 aa, Heterodera glycines
  Coding regions on vcDNA: vcDNA=SeqID_61925; Strand=+; Position=1-498
  Homolog annotation: Hit_ID=CAE61818.1; Match level="QueryCoverage =69%, HitCoverage=41%, E-value=3e-12, Identity=43%"; Hit description =Hypothetical protein CBG05788 [Caenorhabditis briggsae]
MDNPSEEYMEENLGKEMARRMGERHWKKWENGEEEEEENGKEPGEEEGKTYRKKLEEEEQKWKKPGEAKEWKKPEKEEEKVKKLGEEEKSHRKKPGEEEEEKWKMGQEEGIRFLEESAASSSTERSAGREKNLNPFEDTKFDERFPIHNLCGPWNSGRQTSDFEW

SEQ ID NO: 135503 - protein, 178 aa, Heterodera glycines
  Coding regions on vcDNA: vcDNA=SeqID_61926; Strand=+; Position=1 -126,486-894
MKKQKEERITAEDEEKQMEEGEKEDHYYYHNQQNDGTKTMEMNNNAHAAIRKRGQPKGTAVLPKSAVSATLPPKTEAFSSAEFGTPSEGKRRLLCRMSNIREEIMTRMGRNHSEEGILMGLGIMEGEEGMAMPTRKGGGEGQGEEGTSARDRPNPGRGGRHCQQCQWEDERRGRAVDQ

SEQ ID NO: 135504 - protein, 146 aa, Heterodera glycines
  Coding regions on vcDNA: vcDNA=SeqID_61927; Strand=-; Position=1 -119,217-535
MPTVQKNLQKCAKIGGAPAHGAPQFCRQNVTGEAIDHFAERRFASRGECDEHGKREHCQLSTDTEPKCNKYLVLSHIRSGRLKQEEAEDEQPQEEEEEGGERAPQVKRPKMEEEGEEDEVAEQHHREDGVREVGEKTDIAGGVEEE

SEQ ID NO: 135505 - protein, 29 aa, Heterodera glycines
  Coding regions on vcDNA: vcDNA=SeqID_61928; Strand=+; Position=1 -72,257-274
MMTRVNRMMQDFMSRDEKAKQVPMNKRRV

SEQ ID NO: 135506 - protein, 47 aa, Heterodera glycines
  Coding regions on vcDNA: vcDNA=SeqID_61929; Strand=-; Position=1 -116,605-632
MSQILNEICDEKCADPQNVQATKCPSLEIEFFIIRMGLSRELNPSDK

SEQ ID NO: 135507 - protein, 46 aa, Heterodera glycines
  Coding regions on vcDNA: vcDNA=SeqID_61930; Strand=+; Position=1 -67,720-795
SFFDRPQLDIIAPSNTMTVKQCKVYYLFLFDINEIVQNLLCSRGQL

SEQ ID NO: 135508 - protein, 169 aa, Heterodera glycines
  Coding regions on vcDNA: vcDNA=SeqID_61931; Strand=-; Position=1 -198,466-696,761-841
MYKILYFSPSRSRRKGADLATGGRDLAPQRGESRANGVCPVPDTNGPSACTSSGQKKAVHIPSFSQSGSAQSARKVVQSVDNCVADSVDDQMLDKLCTLPKGLDRHEWLASHGQSILKIFYFLPKICYFPTRHTKKMQILGEGFWLCSNMSIVSVPLCLKCALRSAAQQ

SEQ ID NO: 135509 - protein, 17 aa, Heterodera glycines
  Coding regions on vcDNA: vcDNA=SeqID_61932; Strand=+; Position=1 -29,598-622
MTCGNGLPLKKIYKGEI

SEQ ID NO: 135510 - protein, 373 aa, Heterodera glycines
  Coding regions on vcDNA: vcDNA=SeqID_61933; Strand=-; Position=1 -43,400-673,1058-1412,1514-1639,1871-2194
MGLLDKIMQNETKKLKLLKNTNDYLGSTEQLDENVIRALRKAYAENEKVIKDAIINDKKLVAQKSKSDDKKMEERATEHYEKLKAFFDDPIKFYNKLDVKVFQKFREVMGVVNDKDSNEELAELDTEQYQQFLLFLENPNEYLANANFDDTLKDTVMEVLNKKSELLSSLTPEQIVQLKEFKDALKNETKFQGQLDSDIFAKYRKTLPASAKKGIKERTNEFFVGTKLRFLFDELKTERQFDQLMRFFKHPIRFYQPRNIEHNVWKPFRSILNKIVDQKQQDKMFDGLNYEQLMELAANPANRFAPSEMEGDRKLKKFKEAPGVDPEVLNLYTRHLKRNQSCANVKPLIELALYGMEDRQKASLDLRGRLGEN

SEQ ID NO: 135511 - protein, 334 aa, Heterodera glycines
  Coding regions on vcDNA: vcDNA=SeqID_61934; Strand=-; Position=1 -238,531-804,1063-1417,1515-1652
MREYFIFLCSQIHDFFDDPAIFYLRGDKLDKTMKKALRETLIEMGLLDKIMQNETKTFIEKYKNIVKDEQLTKDQAYKIVKLLKNTNDYLGSTEQLDENVIRVLRKAYAENEKVIKDAIINDKKLVAQKSKSDDKKMEERATEHYEKLKAFFDDPIKFYNKLDVKVFQKFREVMGVVNDKDSNEELAELDTEQYQQFLLFLENPNEYLANANFDDTLKDTVMEVLNKKSELFSSLTPEQIVQLKEFKDALENETEFQGQLDSDIFAKYRKTLPASAKKGIKERTNEFFVDTKLRFLFDELKTERQFDQLMRFFKHPIRFYQPRNIEDNVWKVVE

SEQ ID NO: 135512 - protein, 378 aa, Heterodera glycines
  Coding regions on vcDNA: vcDNA=SeqID_61935; Strand=-; Position=1 -919,967-1184
  Homolog annotation: Hit_ID=CAG12037.1; Match level="QueryCoverage =91%, HitCoverage=47%, E-value=2e-13, Identity=23%"; Hit description =unnamed protein product [Tetraodon nigroviridis]
MPKEVIKEKNATNGVVIDQRAGKKEINVQKKPEATDQSNGLDKPKEALTDQSNKNNINNEQPKALETDQTKQNKETNDQRTKTIDQTKPKEEINVQKKPEVTDQSNGLDKPKEALTDQSNKKEHDINKEQINAEKMLKDVIADHGKLKALETDQMKKNEEIDGQKTKMIGQTKPKEGINDQEKPKANSTDFMKPKEETNDQKEPKTIGTDQIKPKEDAANTSVKSKAVIIDLGDPKENNVNDRKKTTTDDKAPKVMPFAQTEKSLHKINDQIDQRIKPREENRDHIKQSRANTEHPLPGQRIKPTKFRKPFDPLSTVADTLERTMLGDDDRDQRQEKSRFETGVGNVNKNGIIPDQIAHLERIISAVQRVMGLGSETK

SEQ ID NO: 135513 - protein, 93 aa, Heterodera glycines
  Coding regions on vcDNA: vcDNA=SeqID_61936; Strand=-; Position=1 -66,174-291,511-608
MLLAIDYANTLKPIADLHLAERLSLLRSTAMPFMVFAVACQSSFVHRPDQILLPNGLFVDEPTVAGTAVADGGGICDTEGNRRVGRPHARPQQ

SEQ ID NO: 135514 - protein, 90 aa, Heterodera glycines
  Coding regions on vcDNA: vcDNA=SeqID_61937; Strand=+; Position=1-273
MASFSPVFIAILIIIYTSAVGAQFGQFGSLLNGFGGANGGANLMNGMAANSRNFANMGSSFGGMINQFKGMGRNFKRQFGGNPSHHHHGK

SEQ ID NO: 135515 - protein, 135 aa, Heterodera glycines
  Coding regions on vcDNA: vcDNA=SeqID_61938; Strand=-; Position=1 -70,375-562,980-1129
  Homolog annotation: Hit_ID=CAE68849.1; Match level="QueryCoverage =98%, HitCoverage=31%, E-value=1e-22, Identity=39%"; Hit description =Hypothetical protein CBG14811 [Caenorhabditis briggsae] emb|CAE68833.1| Hypothetical protein CBG14794 [Cae
MLFLQAMLFYLPNWLWNHLNQQSGIEFTKFIEEATKLKGMPLAPIEERQEQINQLREKLSEAVLNRDPYRRIVGCRFGQSMGAYVSLLYVGIKVLYLGNVAMQFFVLNSFIGRNYQLWGYEVLKALFNGQNWQVN

SEQ ID NO: 135516 - protein, 310 aa, Heterodera glycines
  Coding regions on vcDNA: vcDNA=SeqID_61939; Strand=+; Position=1 -89,471-614,993-1156,1300-1349,1524-1621,1678-1780,2058-2160,2256 -2378,2741-2763
  Homolog annotation: Hit_ID=CAE67869.1; Match level="QueryCoverage =99%, HitCoverage=47%, E-value=1e-69, Identity=46%"; Hit description =Hypothetical protein CBG13461 [Caenorhabditis briggsae]
ISPIARFAFSDLVITVLRLDFYRTGDPEAIKFCKHSLDILLKWGELPAKTQQSLRHRIEVMICANKYHLTIVSPFLIPVKLDPVCQPQGLLHLLGSLLLCVLVDGDYDARFRVLLRHISALLGIHWDLFEEFESTLCDRLIDEYNETVDNQKVRESKSRLKKLKRYAMIGAASGLGGILIGVTGGLAAPVILTSIVTGGLAAPVILTSISALTTTILLPAAASAAIFGSVFGAAGAGLTGYRMQKRVGDIEEFRIERLTEQDELHCVLCVSGWIEDREESAFRHHWRHLWMSKEQYTLRWESKYLEELGR

SEQ ID NO: 135517 - protein, 259 aa, Heterodera glycines
  Coding regions on vcDNA: vcDNA=SeqID_61940; Strand=+; Position=1 -86,142-207,1207-1306,1412-1450,1499-1572,1702-1857,2462-2604
  Homolog annotation: Hit_ID=CAE67869.1; Match level="QueryCoverage =100%, HitCoverage=35%, E-value=1e-78, Identity=58%"; Hit description= Hypothetical protein CBG13461 [Caenorhabditis briggsae]
SFVVSYAIQRSLMETMLASLVSAIAWPLVLLGSSCVIDNPWNIVLLGSSCVIDNPWNICTRRARQVGEHLAEVLLTRQHGRRPITLIGFSLGARVLYHCLLEMSKRTESLGIVQDVILLGAPVSASPRQWRQLLGIVQDVILLGAPVSASPRQWRQLCSVVAGRVINGYCKSDWLLRFLYRTMSVQFIIAGTGPVDNRTERKIVNFNLSHIVKGHLDYAKKMTQVLEAVGVRCTPLSRASCANLSEDAPMHAEAEEATE

SEQ ID NO: 135518 - protein, 222 aa, Heterodera glycines
  Coding regions on vcDNA: vcDNA=SeqID_61941; Strand=-; Position=1 -33,800-952,1356-1499,1728-1868,2196-2393
MKAATATRPIKCRLIGQVQHHNESLIESIRKKLPNGGPKELILSLLYESAIYDAASLYNAMMAYVELYHEELKKHIDGDTSGAYNLLLTKLIAANRNESATVNIDKAFQVDATILFAVHKHGVDEETFFTKLTIESQKQLNETFRSYDRFYDDTIEQSQNERDLIRLVITRAESGDMSTVGAEFERVNGVPLTVQIVSETELATKLMLANLASAYGGDGDWE

SEQ ID NO: 135519 - protein, 85 aa, Heterodera glycines
  Coding regions on vcDNA: vcDNA=SeqID_61942; Strand=-; Position=1 -33,733-957
MKLKCPHTLANLVNPLSLGAYIRPICLSSRTLDLSHRLGQMAGWGQILNEKNEASVPNKLQLLTVPIQETEECSRLSQLKNKFII

SEQ ID NO: 135520 - protein, 126 aa, Heterodera glycines
  Coding regions on vcDNA: vcDNA=SeqID_61943; Strand=-; Position=1 -135,207-452
MHLIILIWLVIPHFIHATFSAVQLNNCLSKCGVMHDPVPEIEETRSMGGSGSPAHYSPWTALLFFETKCPNNEHIVDRCTGFVVSSTLLLTAAHCAFLNYTDMLLRCNFAEEMHENFHSQWYKKGI

SEQ ID NO: 135521 - protein, 185 aa, Heterodera glycines
  Coding regions on vcDNA: vcDNA=SeqID_61944; Strand=+; Position=1 -102,877-1088,1854-2094
MAAWMLLGAKVVLFVAVVVVAVVVINYASEQKAKYEKQYQSEQWAEWESESDGGNNGKEGKKKGMFGKFKDNVKGKKDKAKKKMKEKAKEKKKKLENRVFEEAVVTSDVRESRPRLEKSLGFFWSRTALTAGKGRFGASQSFWGKKHFIVGSVEKCGDDGGGEEANIWDGDESDGDGEKGTEEEE

SEQ ID NO: 135522 - protein, 58 aa, Heterodera glycines
  Coding regions on vcDNA: vcDNA=SeqID_61945; Strand=+; Position=1 -82,173-267
MTDVPETKDQLIKLINVCEKARRGDEKVDQIGPQSWPGGPCFVVIGLQRCDVFTLAPN

SEQ ID NO: 135523 - protein, 90 aa, Heterodera glycines
  Coding regions on vcDNA: vcDNA=SeqID_61946; Strand=-; Position=1-442
  Homolog annotation: Hit_ID=AAL40719.1; Match level="QueryCoverage =93%, HitCoverage=32%, E-value=2e-14, Identity=47%"; Hit description =14-3-3 product [Meloidogyne incognita]
QEAMDIATSKIAAINPTRLGLALSFSVFNFEILKSVDEARKLAQKAIDLAQAEIATLTVPLADDASINLRMMRENMELWTPEGGSHTKTT

SEQ ID NO: 135524 - protein, 196 aa, Heterodera glycines
  misc_feature (178)..(178): Xaa can be any naturally occurring amino acid
  Coding regions on vcDNA: vcDNA=SeqID_61947; Strand=+; Position=1 -100,210-390,781-905,1074-1266
  Homolog annotation: Hit_ID=CAE68439.1; Match level="QueryCoverage =90%, HitCoverage=36%, E-value=5e-43, Identity=49%"; Hit description =Hypothetical protein CBG14224 [Caenorhabditis briggsae]
ILSWNLLLVLTLISVFIGIGIAFFVRQFQPSQRTIDMIGFPGELFMNLLKSLILPLIAASLVSGLSQLDTRQSGRIGAFAALYYAITMVRENQTGICLVLLIHPGDPSIKEHFASENDSQNVSALEKLMDLLRNMFPDNIVQATFQQMETEYVEIRPPTNVSSTTAIVHAVHNTSTEXTLWVGKETGGKDGIFIPL

SEQ ID NO: 135525 - protein, 216 aa, Heterodera glycines
  misc_feature (11)..(11): Xaa can be any naturally occurring amino acid
  Coding regions on vcDNA: vcDNA=SeqID_61948; Strand=-; Position=1 -99,159-331,763-861,944-1055,1325-1415,1841-1881
  Homolog annotation: Hit_ID=NP_500139.1; Match level="QueryCoverage =100%, HitCoverage=58%, E-value=5e-95, Identity=78%"; Hit description= CaM Kinase (39.1 kD) (cmk-1) [Caenorhabditis elegans] gb|AAF23187.1| Cam kinase protein 1 [Caenorhabditi
SEYKTNYMIHXVLEAVSFMHDNGVVHRDLKPENLLYYNHELLYYNHEDDSKIMISDFGLSKTEESGIMATACGTPGYVAPEVLQQRPYGKAVDVWSIGVIAYILLCGYPPFYDENDANLFAQIIKGEYEFDSPYWDSPYWDEISESAKDFIAHLMCCDPEQRYTCERALAHPWISGNTARTKDIHITVVTHLKKSLAKRKWRKAYNAAAAIHHLQM

SEQ ID NO: 135526 - protein, 141 aa, Heterodera glycines
  Coding regions on vcDNA: vcDNA=SeqID_61949; Strand=+; Position=1 -271,384-538
MSSKSKYLQYFNCDTIPSGNLWCCRSENCSYKFESKKLSGYPMASLRSHLKNHHQPKLKELEEKDKAAESLKNNEANPRQPTLKRIFATSTQWTPDGEMTKKIDKAINDLVCTAGLPFSFVEEPGLKNLLRILVPHYKTRY

SEQ ID NO: 135527 - protein, 58 aa, Heterodera glycines
  Coding regions on vcDNA: vcDNA=SeqID_61950; Strand=+; Position=1 -129,227-274
MAPRDDSINNNNNGQPVIQFDQQIRQDPGLNAVFDFVREQGARQMAQHRLNERRAGNN

SEQ ID NO: 135528 - protein, 29 aa, Heterodera glycines
  Coding regions on vcDNA: vcDNA=SeqID_61951; Strand=+; Position=1-88
MLIKKGSNTKLIRSLLHGDLISPFWLGTW

SEQ ID NO: 135529 - protein, 116 aa, Heterodera glycines; identical to SEQ ID NO: 127487
  Coding regions on vcDNA: vcDNA=SeqID_61952; Strand=+; Position=1-351

SEQ ID NO: 135530 - protein, 99 aa, Heterodera glycines
  Coding regions on vcDNA: vcDNA=SeqID_61953; Strand=-; Position=1-311
FPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 135531 - protein, 219 aa, Heterodera glycines
  Coding regions on vcDNA: vcDNA=SeqID_61954; Strand=+; Position=1 -58,941-1035,1192-1285,1332-1466,1547-1656,1745-1912
  Homolog annotation: Hit_ID=NP_502244.1; Match level="QueryCoverage =81%, HitCoverage=29%, E-value=5e-26, Identity=38%"; Hit description =BTB domain containing (67.7 kD) (4M616C) [Caenorhabditis elegans] emb|CAB01179.1| Hypothetical protein F3
MPTKTDSSDDESDEENSAAAESPGNKWMKLMLSTGKYADVHFLVGDGDAKMRVPAHKLILEEASDVFKAMFRFDAKKEKAENDSANCPADVEIPDVEAAAFKVMLSFIYAGDLSELNGDNAMAVLYTAKKYIIPGLVERSLQIPISELRNVFFAYAQARLFDFEDYCNDCLDYIDGNADALLKSDGFLQIDQKLLCEILGRQLQIREEFSIWEAVIFLI

SEQ ID NO: 135532 - protein, 29 aa, Heterodera glycines
  Coding regions on vcDNA: vcDNA=SeqID_61955; Strand=+; Position=1-89
MRTEPGERTGVFATGGRENPLKVWNLEEQ

SEQ ID NO: 135533 - protein, 152 aa, Heterodera glycines
  Coding regions on vcDNA: vcDNA=SeqID_61956; Strand=-; Position=1 -174,225-309,444-643
MPKRKMPTELNVEIVAALPFDIRWANVRISFAFDHFLYKKQAQWIRNELIRQKIVEENRRRLGQAKRRIKLMSFRLFENRLRNMRDLIASHFRLDNCFGLTENQFRGELTPEIFEIQFDAIFETIDRNNLQDISWAQKCKKKCPLMSDNVDN

SEQ ID NO: 135534 - protein, 91 aa, Heterodera glycines
  Coding regions on vcDNA: vcDNA=SeqID_61957; Strand=+; Position=1 -33,324-479,714-800
MDKGRWINVSKPIPFTGQAEYCHNFRPLSLVHNIEHTFRVITVFVDGQEEASETFTGRLTMNAVKKTFEVQNEAALAYLPSWFFTLICHFA

SEQ ID NO: 135535 - protein, 91 aa, Heterodera glycines
  Coding regions on vcDNA: vcDNA=SeqID_61958; Strand=+; Position=1 -63,105-317
MINSDDWPTILATNSMNFVEKYKTFVAINCLGQNGAFVRNFCQFVEGRIRLQMTYDIGHRGATTNWHIYPALFQETCQITHKLEQIPAKFR

SEQ ID NO: 135536 - protein, 169 aa, Heterodera glycines
  Coding regions on vcDNA: vcDNA=SeqID_61959; Strand=+; Position=1 -68,112-553
MRHVLMLKWSRPQSKVFQPLIDWLLINYVGQPRPNGTWYQPTFRPEQWNVYTRTLNADARTNNHSEAEHHRLQGAFNCRHPSIFHFIDVLRREQKTTDVKYASFIAGEEPPPKKRKFLATDERILNLVRLYVPMNAGNINHDHNYHNRNQFHIILEFLRGISRNYRMNP

SEQ ID NO: 135537 - protein, 89 aa, Heterodera glycines
  Coding regions on vcDNA: vcDNA=SeqID_61960; Strand=+; Position=1-396
ISSTCHFGDRWMIDDLPAALRGAGKKHPQQFGKSDLVRRQLQSGPIGFGFETPPPPPSWIFDGAATSKGCTPPIGTGSCGKHPQPTRNL

SEQ ID NO: 135538 - protein, 37 aa, Heterodera glycines
  Coding regions on vcDNA: vcDNA=SeqID_61961; Strand=-; Position=1 -96,528-545
MARNKKMTEAQWQQLLNEIISEIPEEVANSDYHKNVK

SEQ ID NO: 135539 - protein, 158 aa, Heterodera glycines
  Coding regions on vcDNA: vcDNA=SeqID_61962; Strand=+; Position=1 -71,434-641,684-879
MPSGEGPRNVHKFDFGFKEHQRIGITNADKLCLFYALVASKFYLELHVDSFRRFMKNIVRQRDAAIELLHNCGIDINEYSYGVEQLPNVQKYWDEIYPGKYRVVAFEKSADPRKSIRVLWKGQMGREKVVPIFLENGHWDGLKNFVCFFNRGRKFCID

SEQ ID NO: 135540 - protein, 56 aa, Heterodera glycines
  Coding regions on vcDNA: vcDNA=SeqID_61963; Strand=+; Position=1 -90,146-226
MSVQQVQQPIPVPTTPATTTIEHKVLKELKHFQCLNSGQKRLEKQILNSKFRFLRI

SEQ ID NO: 135541 - protein, 88 aa, Heterodera glycines
  Coding regions on vcDNA: vcDNA=SeqID_61964; Strand=+; Position=1-267
MPQAFGEAIYSMNEGTPVKDKHRNNDTVKKLEAVEWAQKNSIHAAAKKFKVENFLFKMDFWMIFSANFRDLNRFKNRFKRFAAQFLMV

SEQ ID NO: 135542 - protein, 454 aa, Heterodera glycines
  Coding regions on vcDNA: vcDNA=SeqID_61965; Strand=+; Position=1 -445,517-1435
  Homolog annotation: Hit_ID=XP_497988.1; Match level="QueryCoverage =46%, HitCoverage=51%, E-value=2e-20, Identity=34%"; Hit description =PREDICTED: similar to Hypothetical protein CBG24508 [Homo sapiens]
MRNRIPIQALQPSYVGEHALDLAFQPSNFGASTSDQSFQPNLGEHARDLAFQPSNLGASTSDQSFQPNLGEHARDLALQPSNLGESTANQAFQQLNMRNKIPIQALQPSNFGERTSDLALKLSNLGDMAFPQAFQTLNLEQPALMPFVTQKTNSTSKNALLKSGTTAISCQIRKNAKQFFGNIRRIAQILGPTKIAFGYAGTSSATVQIASVHCQTARISAASPTNRHFHAKLTKNAISTAKSSMQSEHQPTFTAQAMPFEYQTQAMAPEHQPTFTAQAMPFEYQTQAMAPEHQPTFTAQAMPFEYQTQAMAPEHQPTFTAQAMPFEHQPTFTAEAIPFKQLTQTMQSEHQPTFTAQAMPFEHQPTFTAEAIPFKQLTQTIQSEHQPTTFTAQAMPFEYQTQAMAPEHQPTFTAQAMPFEHQPTFTAEAIPFKQLTQTMQSEHQPTFTAQAMPF

SEQ ID NO: 135543 - protein, 37 aa, Heterodera glycines
  Coding regions on vcDNA: vcDNA=SeqID_61966; Strand=+; Position=1 -6,325-432
MNFYGFQNKKYQWRFSSATVSGINLVKFALVRMGIRA

SEQ ID NO: 135544 - protein, 485 aa, Heterodera glycines
  Coding regions on vcDNA: vcDNA=SeqID_61967; Strand=+; Position=1 -91,213-490,634-759,925-1172,1216-1369,1678-2057,2161-2255,2490-2575
MADNFGWKVGKVFKRRNLNKQLAERCVGTDEMIYPWKWAPNFLFKAPTFWTLTSQRVQFDNKLNLMIESLVLMSSSSAELAEFQNALPFGVFLNDFDGAALGIIAFEIHCAIGTNDVNSCKTMATEEKSRKLTTRGIRTSTTTRATPPKTKLKIVTPFKTETPRVPNLFTPRDSTVKHFGTNCVQIDFPAEIAQFSLNVSAALFGIACKQYLKKYEIGQLPKNYDEKMEIKDKMEACGKVPTETNCKKSYELIGCYESKSQQKIANEEIAEVCRKHLANAKFSDGFRIRNCASRKPGTKNETIGHILGSIAEQSIDGGWAKSIHFIPPSDRFLKAFFQIWNPTFSRRINNETSWMPYQNDPNNVRVGKENRKRLNITRRFRLVAICWAKIVMRHAKFYGKFGKFWSAAPPLMLLAHVFVNFRSPTCSNSQSDDPLDWWDDILYTKEDAQQRYDYFMEVGDPTPQQYVEAVEQGIKLIMWDHFINH

SEQ ID NO: 135545 - protein, 190 aa, Heterodera glycines
  Coding regions on vcDNA: vcDNA=SeqID_61968; Strand=+; Position=1 -100,146-265,308-378,540-663,708-864
  Homolog annotation: Hit_ID=CAE66571.1; Match level="QueryCoverage =81%, HitCoverage=23%, E-value=2e-17, Identity=35%"; Hit description =Hypothetical protein CBG11886 [Caenorhabditis briggsae]
MITLNRFYQRTMFHSTYELSFKDAAIINKIYCDENCKNVENKCQKGGYPNPNHCNQCLCPVGYGGETCEMVENDGNCQTDRANEIEADWQIRTLKPKPQDGKKVIIKLKWLHEKVLTCDDPCGTYRVEIKYRKDKRARGAFICCSKQIDKDETKNWIEADAPGEDILISAYPNQTNFETFTEIVRIDLRN

SEQ ID NO: 135546 - protein, 120 aa, Heterodera glycines
  Coding regions on vcDNA: vcDNA=SeqID_61969; Strand=+; Position=1 -188,658-834
GAKILPASDCPDGVNWKPERSPGKVNMCNHPDTGKLVECCTKGHKCPLRANSAFGCKLIVGMRREGEMKSFWGYWKDKSKDPIRIDEMQCMSYEQAGIINPPDKTVIDYPLRFKSANTNE

SEQ ID NO: 135547 - protein, 38 aa, Heterodera glycines
  Coding regions on vcDNA: vcDNA=SeqID_61970; Strand=-; Position=1-115
FEYIDQLDSENKHEEAYCLLAKQSLNTGLNQQEILWRL

SEQ ID NO: 135548 - protein, 48 aa, Heterodera glycines
  Coding regions on vcDNA: vcDNA=SeqID_61971; Strand=-; Position=1 -121,247-272
MAIKSAPTVIRRGTTVIRRGPSVIRRGPTMIRRGTTVTRRDEIYKFKK

SEQ ID NO: 135549 - protein, 195 aa, Heterodera glycines
  Coding regions on vcDNA: vcDNA=SeqID_61972; Strand=-; Position=1 -54,337-636,884-964,1052-1204
MFIQHTYSSPFNINQCKFLIFLLPFLFYVTFNATKSIYWQKIELNSMFLNSNDRKMSEPKNGNEIPSKIDRLPNLDDMNINLEWHKLLINSSKIFKLPEIRTAVGEQFKKIETISVNPSSIISADRIDKFDDPNAENVDYVIIIQVHDRVKYLKSLIKSLSNAYLIGRVLLVFSSDFQSEEISAVIRSIGFCRGI

SEQ ID NO: 135550 - protein, 45 aa, Heterodera glycines
  Coding regions on vcDNA: vcDNA=SeqID_61973; Strand=+; Position=1-199
HHFGHHQRLIRRIKEVLKCERNYLIEELININLENVTIINYLLIC

SEQ ID NO: 135551 - protein, 38 aa, Heterodera glycines; identical to SEQ ID NO: 130624
  Coding regions on vcDNA: vcDNA=SeqID_61974; Strand=-; Position=1-438

SEQ ID NO: 135552 - protein, 40 aa, Heterodera glycines
  Coding regions on vcDNA: vcDNA=SeqID_61975; Strand=-; Position=1-122
MGPRGDQARDCLPTLAGHTISGFILGTTELRSLEKANVKY

SEQ ID NO: 135553 - protein, 170 aa, Heterodera glycines
  Coding regions on vcDNA: vcDNA=SeqID_61976; Strand=-; Position=1 -193,1151-1468
MRRSSVSDFSDFYDEFLKDMRMSNNKFLAEGINQVVDDAKLMGTNNSGENHGHDELNDLVNDGEELKALLEMRTRLLFAAGPGRVFLRAISVLSKQMTANEIRKFTKYFEWFPACRVRENADTIEANGNGVKPPAAADDIKFDVEQAKMDDVADFEQFMHEVKKELLKDS

SEQ ID NO: 135554 - protein, 618 aa, Heterodera glycines
  Coding regions on vcDNA: vcDNA=SeqID_61977; Strand=+; Position=1 -1824,3551-3600
  Homolog annotation: Hit_ID=NP_510849.1; Match level="QueryCoverage =99%, HitCoverage=46%, E-value=1e-160, Identity=45%"; Hit description= predicted CDS, zn-finger, CCHC type and RNA-directed DNA polymerase and Integrase, catalytic domain cont
CAGIPGVFAYLDDGLIATKTLDQHITALYTLFGRIKEYGLRIQLDKCKFLQPELLFLGHIVSANGIRPDPSRSDAIRKMPAPIDKSTLRSFLGALNYYGRFVKCMRELRAPLDKLLQKDVVWNWTSEQQNAFEKAKETMTSDLLLTHYDPARPIVVSADASKDGIGATLSHTFPDKKEKVVEHAACTLTAAQQNYSQIEKEALAIVFAVQKFHRMVYGRKFILQTDHKPLLAIFGSKKGIPIYAASRLQRWSMILANYDFEIRYVNTTSFGQADVLSRLIANYPRPEEDILIANICADTENSVFENRMDQIPVTTTEITAAMANDQPLQMVLQFLETDGQPKSPIEISPYFPKRDKILEVDNCLLYEGRVIIPTSLRSRILKALHIAHPGIVRMKALARRHVYWPGMDSVIEKVVSTCEECQLGQKNPTKAPLSPWPTTDKVFQRVHIDFAGPCSDGHQYLILVDSFSKWPEVYRMNTISAYATVFVLRSIIFGWLGIPEEIFSDNGTQFRSAEFATFCKEFGIKHIFTPPFHPQSNGQVERFVDTFKRSMKKMSKSEDCIEKMLFSYRTTPHVALNGFSPDQLFFGRKLRTKLSLVHPKGELEEASLYFCKSPLSTQ

SEQ ID NO: 135555 - protein, 216 aa, Heterodera glycines
  Coding regions on vcDNA: vcDNA=SeqID_61978; Strand=-; Position=1 -594,1553-1609
MKRTNASNITPPRAKRAMPPALDLDQNTATLEEQERQRTLVFIGLPESNAIRPLERVQEDREAITKILDHLEVEAQPTAVFRLGRYDPQRTTPRPLKVVMPTPTHQHVALGGWKRERVRLRSQQNLNRLFVRPALSKEQLKEEYEARLRKRQQNPAPPAPPTQLPKTTNDQTPIVAPNQKEASEDMSKPPEVFDQTIIHVQPSILIDDSQTHHAQH

SEQ ID NO: 135556 - protein, 25 aa, Heterodera glycines
  Coding regions on vcDNA: vcDNA=SeqID_61979; Strand=+; Position=1-74
IAEPALVEAGNAVLTRKDFTRTIAA

SEQ ID NO: 135557 - protein, 339 aa, Heterodera glycines
  Coding regions on vcDNA: vcDNA=SeqID_61980; Strand=+; Position=1 -200,249-684,738-1078,1136-1178
MALLSDRFDILVDKHFDGKSELTIWRTIAIHPGIEMPKLFVEGKFVAFPMPDRPLPNKILFHNLEIRYIDHSVIEFLHANKQIWDRSGTNLEVFVCSNNKEDEQPIWNVWARKIWPIFATNVRHLCIPNGAHLDNLRRLISPTILTDLDQLNSIDAGLLFPDGIADDGPNATAGQALTKWLHTPSKNGQPNELYRDACLNPRNLEWVNNFKEKFRHATTSVSYTIQLYTIVEPTPTEQFELVNGRTNEKLTLKHSKESIGSVYNWLLQRCPIIGEMATTAAVKWKNRENSGANLNNIRFDLRTCNYLCANLNNIRFDLWDGIHCIGPLSSPAVEEEELD

SEQ ID NO: 135558 - protein, 116 aa, Heterodera glycines
  Coding regions on vcDNA: vcDNA=SeqID_61981; Strand=+; Position=1 -159,243-434
MSDSSMDAIRELQRALREQQRTIFFLRSQMVDHRAVILQNVARTEALEGYAANSRGGRFRPRYSPMVSLEMTHLGRRLEEREQRCRAQAETVDAPAATESAEEGTSSSSAPSNGPF

SEQ ID NO: 135559 - protein, 97 aa, Heterodera glycines
  Coding regions on vcDNA: vcDNA=SeqID_61982; Strand=+; Position=1-294
MTHVFFDPESVDWSSFITPQHGRGQKQYFVGSKYQRGFGFLGNVARFLTPIARNIASSAGHEGLAAGQRVLSDIVQGRDLRDAVREHSRQGLTNLTD

SEQ ID NO: 135560 - protein, 59 aa, Heterodera glycines
  Coding regions on vcDNA: vcDNA=SeqID_61983; Strand=+; Position=1-177
MVTICGIIREEMELIRWLSQRVTCMMEHANFVPDYPRSLFKGVINKQFVHDLIKDEKGI

SEQ ID NO: 135561 - protein, 81 aa, Heterodera glycines
  Coding regions on vcDNA: vcDNA=SeqID_61984; Strand=-; Position=1 -72,850-1023
MKFQNNNSTACLINYASCHYDFDGFDISVIIIRLKKPVMSFRIISILLDSVNNLKSYIDSKFAQTELARSALDGFKNAPKL

SEQ ID NO: 135562 - protein, 65 aa, Heterodera glycines
  Coding regions on vcDNA: vcDNA=SeqID_61985; Strand=-; Position=1 -139,319-377
MPKAAKSNAVLNRHWISKFPEGTYSTDGKINPGLYKLIDIAKILIGGFLAHKNPSPSNSTLCIRG

SEQ ID NO: 135563 - protein, 160 aa, Heterodera glycines
  Coding regions on vcDNA: vcDNA=SeqID_61986; Strand=-; Position=1 -62,104-137,184-338,386-498
  Homolog annotation: Hit_ID=NP_498777.1; Match level="QueryCoverage =99%, HitCoverage=10%, E-value=5e-30, Identity=44%"; Hit description =phosphorylase kinase (3J230) [Caenorhabditis elegans] sp|P34335|KPBA_ CAEEL Probable phosphorylase B kinas
SGVRLDQLMVLVQKTILFCQDPVTGLFVNNPDFCQDPVTGLFVNNPDFLAHAWVRDNVYAVQAFLAHAWVRDNVYAVQAVWAMHRAYQKRAEFDEDLVKAHELGLNCVKCMQSLLECMLRQADLECMLRQADKVELFKRQQKKSDCLHAKYSAKNKATVV

SEQ ID NO: 135564 - protein, 87 aa, Heterodera glycines
  Coding regions on vcDNA: vcDNA=SeqID_61987; Strand=-; Position=1 -152,320-428
KCPSSIWWTRPGIDGFKPDVLALFRVYDQRYFQGRLTQSCVIINRSNKLLRCVGVTYNSTETRLMTIRLCVPILKFRTRRNRIETLL

SEQ ID NO: 135565 - protein, 40 aa, Heterodera glycines
  Coding regions on vcDNA: vcDNA=SeqID_61988; Strand=-; Position=1 -16,375-481
MNIKYGVYLVNGDKMLFAHLEKQWGDEVKMDKLVDAVSKI

SEQ ID NO: 135566 - protein, 215 aa, Heterodera glycines
  Coding regions on vcDNA: vcDNA=SeqID_61989; Strand=-; Position=1 -161,1042-1479,1527-1577
  Homolog annotation: Hit_ID=CAH99049.1; Match level="QueryCoverage =88%, HitCoverage=32%, E-value=4e-13, Identity=24%"; Hit description =conserved hypothetical protein [Plasmodium berghei]
LLRFLPFPCPAFPAVAGFEFGCDDEDCRSLRLLVKFHSEKTEIAPNYSPTHPPTVQPRNSGPQKSVRKCRSAKVGPQKSVRKSRSANVGPQKSVRKCRSAKVGPQMSVRKSRSANVGPQKSVRKCRSAKVGPQMSVRKCRSANVGPQMSVRKCRSAKVGPQMSVRKCRSANVGPQMSVRKCRSANVGPQMSVRKCRSANGFDQYLDKSQEIKNGY

SEQ ID NO: 135567 - protein, 474 aa, Heterodera glycines
  misc_feature (473)..(473): Xaa can be any naturally occurring amino acid
  Coding regions on vcDNA: vcDNA=SeqID_61990; Strand=+; Position=1 -191,268-576,624-739,788-926,974-1473
  Homolog annotation: Hit_ID=CAE73450.1; Match level="QueryCoverage =93%, HitCoverage=48%, E-value=2e-69, Identity=35%"; Hit description =Hypothetical protein CBG20899 [Caenorhabditis briggsae]
LACRLAVKTFLARELSCGDSSYQLVLIFELFVANGKAKCRQMVMDTLGRHSDMKEHSRRRGVDGVSSESLSPAESSDGVSSESLSPAESSASLLPRYVRVNTVRMAFTQAVELLERDGWCLCRLKKRITPSKYRRLVSTLESPKIYVDPHIYDLLIFPRGVDLHNNKLVTDGILVLQDKASCLSAFVLQPEPASCLSAFVLQPEPGASAMDVCAAPGMKTTHLAALMHNRGTIWAFDRDQKRVAVLRQMTIWAFDRDQKRVAVLRQMVKRSGAGIVTAQCADFLRVNLLDGRYKKVRFVVVDPPCSGSGMAVRFVVVDPPCSGSGMAKRSEHLDEFEADEQRIKALANLQVKPTANWDLISTRFLRVRASPHTFLSFWVMLLRHAFRLPSLQRLVYSTCSVHWAENEGVISEILSSSPLSEHFSLVDPLPQWRHRGQLGQSGNAELRKCLRASPKRDLTNGFFVALFQRRNSXT

SEQ ID NO: 135568 - protein, 34 aa, Heterodera glycines
  Coding regions on vcDNA: vcDNA=SeqID_61991; Strand=+; Position=1-104
EFIKTPAEDTFWSAQLKQPKIDERRHFDNISPCH

SEQ ID NO: 135569 - protein, 181 aa, Heterodera glycines
  Coding regions on vcDNA: vcDNA=SeqID_61992; Strand=-; Position=1 -96,135-252,468-628,667-837
MPKQNEIVLKYSFLDLTWFLDIEALFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETAIRPLERAARALQERMERKNSYFWDFFRNQN

SEQ ID NO: 135570 - protein, 105 aa, Heterodera glycines
  Coding regions on vcDNA: vcDNA=SeqID_61993; Strand=-; Position=1 -233,380-465
PNSVDNRRLYVLKKSESPQWEDLGWAWGKRSLPNSEKSAQSSANWDDLGWAWGKRSSAGGGGEAMRRAKAHGTDPILSVVANRVVRSMSKQSPDWHDLGWALGRR

SEQ ID NO: 135571 - protein, 61 aa, Heterodera glycines
  Coding regions on vcDNA: vcDNA=SeqID_61994; Strand=+; Position=1-496
MECFSECQFVYYHPSVIPFSPIYRTHLSVHANISRFLLNLSNSPPPPPFLSIWLPELFINN

SEQ ID NO: 135572 - protein, 270 aa, Heterodera glycines
  Coding regions on vcDNA: vcDNA=SeqID_61995; Strand=+; Position=1-810
  Homolog annotation: Hit_ID=CAG83749.1; Match level="QueryCoverage =96%, HitCoverage=33%, E-value=8e-34, Identity=39%"; Hit description =unnamed protein product [Yarrowia lipolytica CLIB99] ref|XP _499823.1| hypothetical protein [Yarrowia lipol
MLYLNAHFLITVVPLLITFVPLLITVVPLLISVVPLLIAVVPLLITVEPLLITLLIAVVPLLITVVPLFITVVPLLITLLIAVVPLLFTVVPLLITVVPLLITVVPLLITLLITVVPLLITVVPLFITVVPLLIAVVPLLITVVPLLIAVEPLLITVVPLLIAVEPLLIAVVPLLITVEPLLITLLITVVPLLITVVPLLIAVVPLLITVVPLLIAVVPLLITVEPLLIAVEPLLIAVVPLLITVEPLLITLLITVVPLLITVVPLLIAV

SEQ ID NO: 135573 - protein, 146 aa, Heterodera glycines
  Coding regions on vcDNA: vcDNA=SeqID_61996; Strand=+; Position=1-438
MTANYLGTFCGGGGGTTETTTAQLKVLKKKWRKKKKNKSASGGAKKSGKNKNIGILSSSSSSVEQQPEENGTVTTPQQQRHMAAASFEMTVTATTAGNTADTVVGVPKTTPPVLATSESVPSSSAASATKASAPAGGDASFERADK

SEQ ID NO: 135574 - protein, 128 aa, Heterodera glycines
  Coding regions on vcDNA: vcDNA=SeqID_61997; Strand=-; Position=1 -211,252-427
MMNRKKIENLQKCRKRKFLDNNDSENETLSADHREQNENNNDRDDDFEEHAIVNFELGETKRGGVCIWFNGFRFTHKQNELWRCSVRDCPARVTITDKSDNGMAGYFGQKVHNHLPEPQKQRVSDNHC

SEQ ID NO: 135575 - protein, 270 aa, Heterodera glycines
  Coding regions on vcDNA: vcDNA=SeqID_61998; Strand=+; Position=1-810
MPKGRSSHWLMCWKNQPGNQSRPSGEPERKENNHAMLISGMDQPTHVTTSRDEPNSRDISETNAGEQRAFTAFGSRVPAQQMIRRVTAAAEEGEDECQTTLLFDPGSHLDCAETELIQHLGPQPIDKRPLTVQVFGGKKQRIRSATYRLRLKRTDGKWESIEVSEVPQICTLIRTELIESGATPDSDPRTITQTTQPQIMIGIRKFWDYVVGFRKIESGAHVIDTVFGQVLCGEGTQASSGATPAASILTTMQCGNIHQTRTNKQQQIGE

SEQ ID NO: 135576 - protein, 106 aa, Heterodera glycines
  Coding regions on vcDNA: vcDNA=SeqID_61999; Strand=+; Position=1 -103,341-558
MLKLFPRGHSVSSSLLIALLEDGDEQSDNSSAVDEVTSFPIATVSKVMGPPLLRLAMPPPPLLRLPIVVALPVVLNLSAGASLSSLILSADAVVWSDERRPPPPRG

SEQ ID NO: 135577 - protein, 29 aa, Heterodera glycines
  Coding regions on vcDNA: vcDNA=SeqID_62000; Strand=+; Position=1 -79,371-381
MKNSGCRKTVWTWTWMKKNLGQDLGQGRP

SEQ ID NO: 135578 - protein, 129 aa, Heterodera glycines
  Coding regions on vcDNA: vcDNA=SeqID_62001; Strand=-; Position=1 -108,341-472,549-592,675-777
MSELSGQQFPQNVGISVQPKARVEVEEQNSQQNDVVAQKQNFSADQLDKLERKFGITKYPSAASRVQLAMETGIMEKQVQEWFQERQLQRKRKTMDQQNPQLPHIYDKIMAVVQKTVDDEVIALQNDDD

SEQ ID NO: 135579 - protein, 100 aa, Heterodera glycines
  Coding regions on vcDNA: vcDNA=SeqID_62002; Strand=-; Position=1 -39,365-532,838-932
IYVAVEAMYYCTHFVYESGQNLCPPTDPPLTYYASVHLCCKEDSEFGTALIYRTFATEPPTTFPQGCRAALHEAAIGQYVCKSGEDAYSNWDATFADVIP

SEQ ID NO: 135580 - protein, 229 aa, Heterodera glycines
  Coding regions on vcDNA: vcDNA=SeqID_62003; Strand=+; Position=1 -178,224-369,423-788
MEIEKGSEFAGESVGRSRFSDAVYINGFPWEIEAEIRKKTEDTDEKKYLGFYLLCDAKEGGPWNCVFSATFRIVSEKTEAENSIGTLCDCVINQSRFCWGFGFFITFAELMGSNKSFYNKAEDKLALAIDVITVDEPKIEKFVSDPNKSNGTLSMEIEKVSEFAREIIGSERKSETVHIKGLPWKIWAGIITKNGSTDKNEKWLGIFFLCDAPKEGAKLLIINIYINNN

SEQ ID NO: 135581 - protein, 24 aa, Heterodera glycines
  Coding regions on vcDNA: vcDNA=SeqID_62004; Strand=-; Position=1 -52,295-317
MEKACKIWRDYIDFSALELLELAS

SEQ ID NO: 135582 - protein, 146 aa, Heterodera glycines
  Coding regions on vcDNA: vcDNA=SeqID_62005; Strand=+; Position=1 -94,166-512
MPIVTPGHIEQNAAFNVNRSTATIIRREMQNAIKIVRNWPNLSISLNEKWKSLIKAKQFNEKVIINNSYLNWLSNFKIFPQFSHFIRIICKAFALADFYDFCGYVETRIRLQLIINVVPFDRVRLAHAKKVAEKEQENFGERNNKK

SEQ ID NO: 135583 - protein, 82 aa, Heterodera glycines
  Coding regions on vcDNA: vcDNA=SeqID_62006; Strand=-; Position=1 -13,446-681
  Homolog annotation: Hit_ID=CAE72423.1; Match level="QueryCoverage =90%, HitCoverage=25%, E-value=1e-14, Identity=49%"; Hit description =Hypothetical protein CBG19588 [Caenorhabditis briggsae]
MLENTSHFFYLAFENSVCPQYVTEKFWNAFRALTVPVVLRRAVLRGMGVPDDAYIAADDFCSAQELAQHLLTLRHDTDRYMQ

SEQ ID NO: 135584 - protein, 184 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  Coding regions on vcDNA: vcDNA=SeqID_62007; Strand=+; Position=1-558
  Homolog annotation: Hit_ID=BAB33421.1; Match level="QueryCoverage =94%, HitCoverage=62%, E-value=4e-67, Identity=75%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNS

SEQ ID NO: 135585 - protein, 141 aa, Heterodera glycines
  Coding regions on vcDNA: vcDNA=SeqID_62008; Strand=-; Position=1-425
MINASPYSIAVHKDNNHPFSNIPKSGRFRKNLFSFLIRDGDYRLSWDFFKHASRRIHCPVTKFYRYINGLVQIVSTDKKKPRIFIYFYQEGEGKFRAPSSYQGWLMRCEIDFDEIITTYLVKGRLSSFAQIIIESFICLFE

SEQ ID NO: 135586 - protein, 94 aa, Heterodera glycines
  Coding regions on vcDNA: vcDNA=SeqID_62009; Strand=-; Position=1 -137,179-326
MFQFYLSPLYRVKLRSKTIVNLFSIREWLVSPVILIVYGFFSIVDREMQEAWKLLNIGLPSLKDICTKSISENEKALEEFRSFPFVFKKLFTRF

SEQ ID NO: 135587 - protein, 268 aa, Heterodera glycines
  Coding regions on vcDNA: vcDNA=SeqID_62010; Strand=+; Position=1-807
  Homolog annotation: Hit_ID=XP_345024.1; Match level="QueryCoverage =77%, HitCoverage=89%, E-value=1e-23, Identity=29%"; Hit description =similar to SPAC23A1.17 [Rattus norvegicus]
SPQPTNISITGHSTHQHSQSLGLNPPTFQSLGLNPPTFQSLVLNPRALQSLALNPPTFQSLVLNPPALQSLGLNPPTFQSLGLNPPTFQSLGLNPPTFQSLALNPPTFQSLGLNPPALQSLGLNPTAFQSLGLNPPTFQSLGLNPPTFQSLGLNPPTFQSLGLNPPALQSLGLNPPTFQSLGLNPPAFQSLELNPTSIPITGDSTHQHFNHWGLNPPTFQSLALNPPEFNHWDSNHQHFNHWNSTQNIFNHWDSTHQNSISATQPHSI

SEQ ID NO: 135588 - protein, 40 aa, Heterodera glycines
  Coding regions on vcDNA: vcDNA=SeqID_62011; Strand=+; Position=1 -34,342-430
MARQIFGGHGKVGRKHSKNEWPSAEEAFKWNNEKVQNLEK

SEQ ID NO: 135589 - protein, 49 aa, Heterodera glycines
  Coding regions on vcDNA: vcDNA=SeqID_62012; Strand=+; Position=1-149
VHIRYSVIANCYSKWPLFSVFWPAVTFLCRPFCAKRRNNLPMNTSTKFG

SEQ ID NO: 135590 - protein, 243 aa, Heterodera glycines
  Coding regions on vcDNA: vcDNA=SeqID_62013; Strand=-; Position=1-729
  Homolog annotation: Hit_ID=NP_508324.1; Match level="QueryCoverage =95%, HitCoverage=8%, E-value=2e-31, Identity=40%"; Hit description =predicted CDS, peptidase family A16 and RNA-directed DNA polymerase and Integrase, catalytic domain and Zn
MIMDWNGLEHVGMSDLNSDKQNVRQRMIDKISFNGDRYQTELLWDEELAAQLPTNYDMAFRQLMSNLGRLRKTPDLLRQIHEIKMEQVETGFIEECEPLPIEERYLVGNKVHYLPHHPVVKETSEHTKVRIVYNASARCRGGLTLSQVLEKGENDYNDLAGILIRIRIKPMLLTCDIAKAFHQILVHPKDRDAMRFLWVRDPYVEDSPLVEYRFTRVTFGVICSPAHLSLTIKLHLSKYKDKK

SEQ ID NO: 135591 - protein, 106 aa, Heterodera glycines
  Coding regions on vcDNA: vcDNA=SeqID_62014; Strand=+; Position=1 -11,68-377
  Homolog annotation: Hit_ID=AAL78214.1; Match level="QueryCoverage =86%, HitCoverage=47%, E-value=4e-21, Identity=50%"; Hit description =putative esophageal gland cell protein Hgg-20 [Heterodera glycines]
MDQIGGTFSDQIWLDTLAWIGRGEVGWHLALVNARFAALVNMQLQQRRWCLEEFHISERKPKRTGAEVLSLANNGSYFSLPLATSPLPDSVIGFNGTFNIWSPFNF

SEQ ID NO: 135592 - protein, 71 aa, Heterodera glycines
  Coding regions on vcDNA: vcDNA=SeqID_62015; Strand=+; Position=1 -167,447-495
MAFRGPKNFRKSEFRGPKIFRKSEIGIPCHPWYTLAGLGLVSAPSQKLEKSNEPEMLIDDNQVYRMIPTKC

SEQ ID NO: 135593 - protein, 87 aa, Heterodera glycines
  Coding regions on vcDNA: vcDNA=SeqID_62016; Strand=-; Position=1 -78,143-274,588-639
MVNFCVIYRAFLVFGSQSVIILLFIRGLLEGHFNAKTMDDYLENGKQIETNSYLLTTHLSLRKMTIQLLTANRASEGLSNDTNSVGF

SEQ ID NO: 135594 - protein, 176 aa, Heterodera glycines
  Coding regions on vcDNA: vcDNA=SeqID_62017; Strand=+; Position=1-533
FINWALIEHFYCIIPLFSDLSIKALIEHFYCIIPLFSDLSIKALIEYFYCIIPLFSDLSIKALIEHFYCIIPLFSDLSIKALIEYFYCIIPLFSDLSIKALIEHFYCIIPLFSDLSIKALIEHFYCIIPLFSDLSIKALIEHFYCIIPLFSDLSIKALIEHFYCIIPLFSDLSIGH

SEQ ID NO: 135595 - protein, 51 aa, Heterodera glycines
  Coding regions on vcDNA: vcDNA=SeqID_62018; Strand=-; Position=1-155
LQIYWLKLHMRYISKFFDSVRRFDKDGFRFAISRSTFGNWSRIFSAITRNH

SEQ ID NO: 135596 - protein, 78 aa, Heterodera glycines
  Coding regions on vcDNA: vcDNA=SeqID_62019; Strand=+; Position=1 -33,115-316
MDFQNYSMVNLAFNRFGVGTFLMELFLSNSCRWLITLPGLMFNSALLYTTIREKLNLNYPEPDTRARFFENQIPGTRP

SEQ ID NO: 135597 - protein, 153 aa, Heterodera glycines
  Coding regions on vcDNA: vcDNA=SeqID_62020; Strand=-; Position=1 -135,358-453,511-646,1080-1174
  Homolog annotation: Hit_ID=NP_872254.1; Match level="QueryCoverage =80%, HitCoverage=17%, E-value=3e-32, Identity=49%"; Hit description =carboxylesterase, type B (88.7 kD) (XO244) [Caenorhabditis elegans] emb|CAD57691.1| Hypothetical protein
MGSPITQPKNRLFHRAILLDGSAMSPWAMAHTAQTQFMRLAEELKEHSEQNVSTAARHVASASPTFLSAFAPIVDGQIVPNHPRVLFNPQYGTLFREIDLMVGTVLNPAHHLLAKDDLENGITPLIETLRAHSLADANLGGSEEKKSSANTFL

SEQ ID NO: 135598 - protein, 49 aa, Heterodera glycines
  Coding regions on vcDNA: vcDNA=SeqID_62021; Strand=+; Position=1 -54,190-285
MCTVMLLAGDEPYKRYLGAWTTYWKGKCIKIKLFINAQMLSIFSFKNLN

SEQ ID NO: 135599 - protein, 38 aa, Heterodera glycines; identical to SEQ ID NO: 130615
  Coding regions on vcDNA: vcDNA=SeqID_62022; Strand=+; Position=1 -52,124-188

SEQ ID NO: 135600 - protein, 116 aa, Heterodera glycines
  Coding regions on vcDNA: vcDNA=SeqID_62023; Strand=-; Position=1 -307,412-456
DCPQTSKEKKKPLRKTRGEGENQQTDRREKGRTKNKLQTKTTDATPAQRKTKRKAKERRHQPTRAGKAQDPPPKSDNEPRAQKPTQAHTKKPALSIEKDSLNIQLRNAPNVTYEVK

SEQ ID NO: 135601 - protein, 24 aa, Heterodera glycines
  Coding regions on vcDNA: vcDNA=SeqID_62024; Strand=+; Position=1 -52,295-317
MEKACKIWRDYIDFSALELLELAS

SEQ ID NO: 135602 - protein, 18 aa, Heterodera glycines
  Coding regions on vcDNA: vcDNA=SeqID_62025; Strand=+; Position=1-77
LLINIWCVSEHVLKNIYE

SEQ ID NO: 135603 - protein, 24 aa, Heterodera glycines
  Coding regions on vcDNA: vcDNA=SeqID_62026; Strand=-; Position=1-72
MTNQFALPPLNWLILFASFLSAKA

SEQ ID NO: 135604 - protein, 352 aa, Heterodera glycines
  Coding regions on vcDNA: vcDNA=SeqID_62027; Strand=-; Position=1 -161,1418-2315
MMMMMMIGWIMKIWVITLQIFNHPTDQSINQSSIVHWYEADHADPALAELIHQMDVAVQKNSLSLYRSHCFTQSFHPSSSDVIWGNCSTLGGSGQLSLRDVDDDDDALFKMPLNIPWATSMRDVDDDDDALFKMPLNIPWATSMRDVDDDDDALFKMPLNIPWATSMRDVDDDALFKMPLNIPWATSMRDVDDDDDALFKMPLNIPWATSMRDVDDDDDALFKMPLNIPWATSMRDVNDDDDALFKMPLNIPWATSMRDVDDDDDALFKMPLNIPWATSMRDVDDDDDALFKMPLNIPWATSTSTDSTTSSTISSRSRRRRCAENGDDDEAARQVIGKLAYILVLCLKKNGK

SEQ ID NO: 135605 - protein, 180 aa, Heterodera glycines
  misc_feature (27)..(27): Xaa can be any naturally occurring amino acid
  misc_feature (89)..(89): Xaa can be any naturally occurring amino acid
  misc_feature (96)..(96): Xaa can be any naturally occurring amino acid
  Coding regions on vcDNA: vcDNA=SeqID_62028; Strand=+; Position=1 -186,283-306,352-372,421-441,490-510,559-579,691-711,760-780,829-893
  Homolog annotation: Hit_ID=AAM09303.2; Match level="QueryCoverage =66%, HitCoverage=73%, E-value=2e-62, Identity=66%"; Hit description =similar to Plasmodium lophurae. Histidine-rich glycoprotein precursor [Dictyostelium discoideum] gb|AAM443
WINFLDFFFAKNGLNIFGPSISKTVFXSFHLPFFFKQRTKCMPIFRSLAVPLHHHHHFRHTHHHHHQHPHHHHHQHHHHHHQHHHHHHXHHHHHHXHHHHHHQHHHHHHQHHHHHHQHHHHHHQHHHHHHQHHHHHHQHHHHHHQHHHHHHQHPATKVVHHHHHQHPATKVVDPPSVEQL

SEQ ID NO: 135606 - protein, 51 aa, Heterodera glycines
  Coding regions on vcDNA: vcDNA=SeqID_62029; Strand=+; Position=1 -35,441-561
MFDRNIFLSESKPPSASLAEWSKALRSGRSPLRRAQVRILRLAVNFLTILN

SEQ ID NO: 135607 - protein, 150 aa, Heterodera glycines
  Coding regions on vcDNA: vcDNA=SeqID_62030; Strand=+; Position=1-453
MAFFLKGCHWHFGTTPRGALHTKHTSHIAAPCHLSVPAEVPCQSTLFSRKIRVPKMVPSSRAHKFCPGAIGDQILCPGVAGGGLAAFISFPAIIPAGGKRVKMPMPMMAHTENGLIGVVSVPMPSLSVVVSLMVCPEALFVVHLEDGMND

SEQ ID NO: 135608 - protein, 51 aa, Heterodera glycines
  Coding regions on vcDNA: vcDNA=SeqID_62031; Strand=+; Position=1-154
MPLLPDTSAPIIFLHFPSTLILLCSTCAVTGGHALLLNGEYPWTYDNDLFG

SEQ ID NO: 135609 - protein, 116 aa, Heterodera glycines
  Coding regions on vcDNA: vcDNA=SeqID_62032; Strand=+; Position=1 -165,1118-1184,1262-1380
  Homolog annotation: Hit_ID=NP_495567.3; Match level="QueryCoverage =52%, HitCoverage=18%, E-value=6e-14, Identity=54%"; Hit description =carbonic anhydrase (37.6 kD) (cah-2) [Caenorhabditis elegans] gb|AAB93341.3| Carbonic anhydrase protein 2
MGQFPLLTLATKNATTADTTGGGGGEKREEQKQQQPVLNIAGGPAHPYTYQMQQIIGDRTNAELHRLSQATKHIKHRNQMVRIKRFQPAALVPSTEHYVTYDGSMTYPGCFETVTW

SEQ ID NO: 135610 - protein, 936 aa, Heterodera glycines
  Coding regions on vcDNA: vcDNA=SeqID_62033; Strand=+; Position=1 -1886,1958-2882
  Homolog annotation: Hit_ID=NP_508324.1; Match level="QueryCoverage =56%, HitCoverage=22%, E-value=1e-53, Identity=29%"; Hit description =predicted CDS, peptidase family A16 and RNA-directed DNA polymerase and Integrase, catalytic domain and Z
QQQLVHQRHDVTLPPITLPKFSGEPREWPLFWKLFETSVESLQIEDFKKHIYLLGCLPEKSIARRAIDLYPPSDENYPRVVEILKKRSGDEKTMVESIQAELLHLPKPAESVQSLRQFSESIERICHQLLDYGENEQNKFMASTIKSKLPYHLLTQVVEREMRAGGAFNCTELRRAITSIVEVKEEVQRCTQVFRGEEKPRNFPPHPMGGRAHQGRGTPFRFSQPFRQERQWRPMERNEPVRRMSPQPNRSFSAINKPQTPISDRGSKRLCSLCETKGHAPSRCTKYTTPGARRKRLTDQDRCINCLMMGHNTKNCTSPRRCSHCGERHHFMVCFGEKSREGTSRVQPNNQMKREARKSSQSHLTMSEHAHKSVPSSECSPITTNVMTSVMAKKPHAFLMTRKILVRSKNNRRVWMEVPFLFDPGSQTSYASDPLIERLKPPKVTSEEMEVYGFGGERNGPMRFHSPVYSIQIRRTDGKWEEILLNRTERISTPFKMAEWNSEEFPLKGMDMADAMSFSREEPEILIGARHFWQFFQGKEEVSPGLFVIQTTLGPLVNGESDFGPELPNPGLSMMAIDESNQGQMPTVKEIEYFFNLESLGIKDDPNENDDQTAMSLFNKSIRREKDGRLMSTFGKLCNSPDLMEQYDATIRDQLQKGIIEEARKAPGTLEHYIPHQGVLAKGKKLRVVYDASAHTRGTNSLNACLYRGPVILPDLIGMLMRFRCPRFPLLSDIQAAFLQIALEPEDREVTKFLWVKDVSKPLTPANLITYRFCRVAFGVISSPFILAATLQHHLKGYHSPVANELAQSLYVDNTLLECESTEEALHKYAESKAILKEGHFNLREFVTNSPEVMKAIPEEDRLNKPKVKVLGLIWDTDKDEIVFEFPTHGLEKLATRRLVLSFLASLFDPLGLMGPCIQPLKLFFQNSLGRKERLG

SEQ ID NO: 135611 - protein, 22 aa, Heterodera glycines
  Coding regions on vcDNA: vcDNA=SeqID_62034; Strand=-; Position=1 -44,519-543
MLYIPTNMTWIEVDGLIHEEVA

SEQ ID NO: 135612 - protein, 220 aa, Heterodera glycines
  Coding regions on vcDNA: vcDNA=SeqID_62035; Strand=-; Position=1 -151,264-407,455-588,647-715,969-1008
  Homolog annotation: Hit_ID=NP_036369.2; Match level="QueryCoverage =95%, HitCoverage=43%, E-value=2e-30, Identity=37%"; Hit description =sirtuin 2 isoform 1 [Homo sapiens] gb|AAD40850.2| sirtuin type 2 [Homo sapiens] sp|Q8IXJ6|SIR2_HUMAN NAD-
SNEKGMPNKEEVPKGSEEKVQNEAEVPNVEGVPSEAGSASQPSLYSQFVTMATRPQQKLPSLDLEGVAAFIREERPEIVFMVGAGVSTSAGIPDFRTPGTGLYDNLKQYDIPNPQAIFDIRTPGTGLYDNLKQYDIPNPQAIFDINYFRRNPEPFFVLANALFHESIMPTSAHHFIRLVADKGLLPTSAHHFIRLVADKGLLRRCFTQNIDGLEFRAGVE

SEQ ID NO: 135613 - protein, 56 aa, Heterodera glycines
  Coding regions on vcDNA: vcDNA=SeqID_62036; Strand=-; Position=1-229
IFLCKRTKEKQQARRKDGSQRFIHYSLSERNIKKAVRETIVGGRRNHRTVPLEPIK

SEQ ID NO: 135614 - protein, 199 aa, Heterodera glycines
  Coding regions on vcDNA: vcDNA=SeqID_62037; Strand=-; Position=1 -210,259-300,453-685,769-880
  Homolog annotation: Hit_ID=XP_393336.1; Match level="QueryCoverage =92%, HitCoverage=32%, E-value=1e-29, Identity=37%"; Hit description =similar to GMP synthase [glutamine-hydrolyzing] (Glutamine amidotransferase) (GMP synthetase) [Apis melli
MSPFSLDLNVDNIFLVQGTLRPDLVNISLFIYPISSLCQIESASQLASGCADVIKTHHNDSALVRELRDLGRVVEPLQEFHKDEEEHFDETQQRVKEYVEAFDDKLCAIVLPIKSVGVQGDRRSYSYVAAVFTKDPSLEDIPWLKLEELARLLPNECHFINRVVFGFNLGYNITPINDITVTHINEGTVFCDVAFPFAL

SEQ ID NO: 135615 - protein, 73 aa, Heterodera glycines; identical to SEQ ID NO: 133467
  Coding regions on vcDNA: vcDNA=SeqID_62038; Strand=+; Position=1-461

SEQ ID NO: 135616 - protein, 44 aa, Heterodera glycines
  Coding regions on vcDNA: vcDNA=SeqID_62039; Strand=+; Position=1-134
MRVVLTQPDDVTQVIYDAGFNEAIVMFVGHESTQIAFNKVKNRN

SEQ ID NO: 135617 - protein, 30 aa, Heterodera glycines
  Coding regions on vcDNA: vcDNA=SeqID_62040; Strand=+; Position=1-95
ISNTNEDAVNLGVELGDPNAVIIFDNVDRL

SEQ ID NO: 135618 - protein, 299 aa, Heterodera glycines
  Coding regions on vcDNA: vcDNA=SeqID_62041; Strand=+; Position=1 -229,275-466,514-586,634-811,918-1144
  Homolog annotation: Hit_ID=NP_503052.1; Match level="QueryCoverage =92%, HitCoverage=34%, E-value=1e-55, Identity=45%"; Hit description =cyclin M2 (89.5 kD) (4S142) [Caenorhabditis elegans] gb|AAK77203.1| Hypothetical protein C52D10.12 [Caeno
FNTLHANSKWAIEYWRNYGLPVSTGQGLANLADVQQSVTSFSPIQTSSFITTDKKAQVSGIRIEPEQGAGGFVGYADKGVSIVEPDMDVRVVLFGIHLDEIDLVGFTSTDNCSDAAVLIDRNEFAIQSERRVVVIYHFASNSLYKLCVRQKPHPDYPHELPIHLTDEAHCWVSTNIPPRKYYFSMPLQIVIIAVLLVLSGLFSGLNLGLMSLTPQELTLIKNSGSPKERKYAQTILPVRKSGNRLLCSLLIGNVCVNSAISILFDDLTSGTVALIVSSTGIVVFGEIFPQALCVKKGLA

SEQ ID NO: 135619 - protein, 42 aa, Heterodera glycines
  Coding regions on vcDNA: vcDNA=SeqID_62042; Strand=+; Position=1 -39,119-208
MTILFTCNPMIENYNTIGTVSVQIGTFTASTLASYASFLVLF

SEQ ID NO: 135620 - protein, 48 aa, Heterodera glycines
  Coding regions on vcDNA: vcDNA=SeqID_62043; Strand=+; Position=1-145
MDELCEGKWIGRTVGDDGEGMFGGGMRNGKRGRSVSEQRETRPLLGKS

SEQ ID NO: 135621 - protein, 39 aa, Heterodera glycines
  Coding regions on vcDNA: vcDNA=SeqID_62044; Strand=+; Position=1 -5,351-465
MNIFKSIKNRILNANTQSYENVDVILSFSNMRMELFWRI

SEQ ID NO: 135622 - protein, 127 aa, Heterodera glycines
  Coding regions on vcDNA: vcDNA=SeqID_62045; Strand=+; Position=1 -72,117-400,444-471
  Homolog annotation: Hit_ID=NP_507780.1; Match level="QueryCoverage =82%, HitCoverage=7%, E-value=4e-09, Identity=36%"; Hit description =predicted CDS, DNA polymerase type B, organellar and viral family member (5T899) [Caenorhabditis elegans]
MERKFARKKCNILIKNGNRLLEMKVKSRKKLNPNISFRDSWNLVPGPLASMVPMFGLDVQDKPFFPHLANRPENYGCQIFPTKSNYLADGMNPEKRKEFDIWYDQNRNQPFLLDEALASIVKMTWIF

SEQ ID NO: 135623 - protein, 177 aa, Heterodera glycines
  misc_feature (153)..(153): Xaa can be any naturally occurring amino acid
  misc_feature (157)..(157): Xaa can be any naturally occurring amino acid
  misc_feature (161)..(161): Xaa can be any naturally occurring amino acid
  misc_feature (171)..(171): Xaa can be any naturally occurring amino acid
  Coding regions on vcDNA: vcDNA=SeqID_62046; Strand=-; Position=1 -33,547-971,1343-1416
  Homolog annotation: Hit_ID=AAL40415.1; Match level="QueryCoverage =90%, HitCoverage=15%, E-value=4e-24, Identity=38%"; Hit description =endonuclease/reverse transcriptase [Branchiostoma floridae]
FFYTRRFFPSNVNQCFISDIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLITVVQDXSTHXSDGXLINLFVLKSXKGIPPP

SEQ ID NO: 135624 - protein, 384 aa, Heterodera glycines
  Coding regions on vcDNA: vcDNA=SeqID_62047; Strand=-; Position=1-1157
AQQHHQQQQQQQQQQQQKQQVVRFVKIDEESDDEALRIDISESESEEEDDDDEEEAAAALEAAVASAAPSPVVQEVKKPRIQGPMEAPKTKRVAAAEGPFVKRARIVGPLNAQKSRCNKCGLLGHLSGDEARCPKTNALVKAEMDRKKAAAFAKRAEATMECSAPPIIQLPVKGGGQARAARAGGVAASMVAGGRASAEGAFRASKKRARQELMAAMEKPKAAAISVAEKKAAARPGLQVPMETNAVLNGLSEIGARIDRERDNHLSMAEELQQRGKRAVAAIDEVIAQGAQIGQMYVEWTRKLGEVLKANEQERADRDALEHRQAAAFMQSLRLKISVLRRELSSPPGVSPLATERVEIGGQPGGSLGGQPGGPLGGPPGGKK

SEQ ID NO: 135625 - protein, 67 aa, Heterodera glycines
  Coding regions on vcDNA: vcDNA=SeqID_62048; Strand=+; Position=1 -73,226-296,445-504
MKQNLSVLSLLLFVQIFASNLSDKAGVDYFQVKYEEIEQKIAQLQKHNLTMDYYNNRIFFSDNLHKR

SEQ ID NO: 135626 - protein, 110 aa, Heterodera glycines
  Coding regions on vcDNA: vcDNA=SeqID_62049; Strand=+; Position=1 -191,244-386
  Homolog annotation: Hit_ID=AAV34698.1; Match level="QueryCoverage =90%, HitCoverage=44%, E-value=3e-11, Identity=37%"; Hit description =IC5 [Globodera pallida]
TISIGIWTKSDDTFYKYSNNGFIFGHSATGLGGYPSFAEGDTIGCGANLTSMEIIYTKNGQKLNTSNLFVFDNELLPFVQVNTLGDVIEADFGPVFEYKNVSDLFATQIT

SEQ ID NO: 135627 - protein, 42 aa, Heterodera glycines
  Coding regions on vcDNA: vcDNA=SeqID_62050; Strand=+; Position=1-339
  Homolog annotation: Hit_ID=AAM50039.1; Match level="QueryCoverage =95%, HitCoverage=11%, E-value=1e-18, Identity=100%"; Hit description= putative gland protein G26D05 [Heterodera glycines]
MNSSFVICCCFHNFVLFLLLSCVVPHAFACCPHGNLRVKGKK

SEQ ID NO: 135628 - protein, 280 aa, Heterodera glycines
  misc_feature (10)..(10): Xaa can be any naturally occurring amino acid
  Coding regions on vcDNA: vcDNA=SeqID_62051; Strand=+; Position=1 -38,1418-1471,1521-1570,1846-2029,2190-2296,2406-2561,2656-2851
  Homolog annotation: Hit_ID=AAM50039.1; Match level="QueryCoverage =97%, HitCoverage=75%, E-value=1e-143, Identity=91%"; Hit description= putative gland protein G26D05 [Heterodera glycines]
EGKVKETSHXDIVRAPLAVDQGGYLSNPEQEYAKVKSVVQAAIDKCIEYAKVKSVVQAAIDKCIYVLIDWHYTSSEKYTDKAKEFFGRISTLCAGKCNCLYETWNEPIQNDWSSQLKPYHEELVKVIRQNDKNGVIIAGTPNYDQDVKAVVNDPIKEHNIMYTLHLYAASHKQELRNTAQQAIDAGVPLFVTEYGTSSYTGDGGPDLVETQNWYDYDFFNKNSLSYINWAIDDKQEASAALQNTQPPVGPADVCSTDRLTKSGKFVHDHLIGVNQKPDGC

SEQ ID NO: 135629 - protein, 124 aa, Heterodera glycines
  Coding regions on vcDNA: vcDNA=SeqID_62052; Strand=+; Position=1 -152,585-807
MKEKKMGLNSNRKMSLIVPVWGHLGWQKAIWAYLRLIKVPKNSETSTKVPRDNKRGKVIGNIMPRLRAFLSKLLPVFEGDQKDANVHQNAGDDDSIEQRCREDEHWGMARVFVLDPQLTKHWLT

SEQ ID NO: 135630 - protein, 46 aa, Heterodera glycines
  Coding regions on vcDNA: vcDNA=SeqID_62053; Strand=-; Position=1-370
LPLITSLYHKTVIGLATVVLIEGNSVFDEFYLCTILISRLNLNYLF

SEQ ID NO: 135631 - protein, 44 aa, Heterodera glycines
  Coding regions on vcDNA: vcDNA=SeqID_62054; Strand=+; Position=1 -106,307-335
MMKLSKKRKQLQHQEQSQSLVNPRPLNKWKATHWLITTGGYQQD

SEQ ID NO: 135632 - protein, 275 aa, Heterodera glycines
  Coding regions on vcDNA: vcDNA=SeqID_62055; Strand=+; Position=1 -92,154-613,671-946
MEIVNSVREALPLFQNPLPNKVIGFRSIAIDFINQNVLTFLGRFHRFFASCETTLHINKEKSIKGRKAIIDGRILKFVVLTIWPMFKDTIRVMSFNTNTFRQMRKLAPSILDDCPSLRVVAFDGTILPKLPPYDSASASNDKTVAKWLFTPRPDNLRKVLIIENSSVENSAVDQWLATLEQIKAAFSSASSPVSFVISVNSNSESSSSLSSFVPFELTNQLTGEKLALSHYGNGIMLVRCPIGEGSDLEEEIEQLIDGRKNKIEISITKDCVDNG

SEQ ID NO: 135633 - protein, 21 aa, Heterodera glycines
  Coding regions on vcDNA: vcDNA=SeqID_62056; Strand=-; Position=1-65
MIENLWGQIVLIAYFIPIFAV

SEQ ID NO: 135634 - protein, 118 aa, Heterodera glycines
  Coding regions on vcDNA: vcDNA=SeqID_62057; Strand=+; Position=1 -74,395-674
MMLSNWGGQCTKIFIICMSTWAIVGWGSILLVKTVLGLAWNSFPDLYKNLMELKVFQTAAIFEVSFLSESVRFGGTGPLLGVLSAFHSDFGHQYFICSKIVHNIVGLVRSLVFNTIVQ

SEQ ID NO: 135635 - protein, 647 aa, Heterodera glycines
  Coding regions on vcDNA: vcDNA=SeqID_62058; Strand=+; Position=1-1944
  Homolog annotation: Hit_ID=XP_320889.1; Match level="QueryCoverage =93%, HitCoverage=72%, E-value=1e-91, Identity=33%"; Hit description =ENSANGP00000012033 [Anopheles gambiae] ref|XP_313651.1| ENSANGP00000013044 [Anopheles gambiae] ref|XP_314
MDAQQLQQILDAALKKSAEVFAAALNIQNQNPNPGSSTTASLAASINARLEKFNYNPEVGQTYDAWLNRYGKIVQQDGASLPEQSKVQLLVGKLDEEEYKRYVDSIAPKATEQFNWLETVANLKKIFGETRSLFLRRFDCFQIRQSQNQDLSSLLAQINSSCENAELDLKKEELKCMILIISLRDEFSDLKQRCLQRMEEARTNGKSITLQELGEECKKYQILKESTLALSTKQYNANAIRAKPQQVKDKADATKQYAKPKAVPKPYESKHKLPNRPCQSCGSTNHWRSDCGHRDAKCPKCGKIGHLGKVCRSNSSIRHIQTVNTTERHAQINTVIIDLNCMEINADHPKWWKIPIKVNGADYPMHVDSGAQITLFTIQTWIQMGKPPLTSANIRVKNCNDQTFAINGQFMCKVQYMDRPPMKLLAYVSPEISHNLLGMPWIEALEVIPKEIMHPNLHPKINTISTKTNEIKDTETLISALKSTHSDVFSPELGHCTKFKANLILKNGAKPIYCKARPVPHGALDDVNAEIDRLLKMEAIKPIEFSHWAAPILAVKKRNGRTRVCIDFSTGLNDALELHRHPLPRPEDIYNAIAGSKYFSRLDLRDAYLQLELSDESKKLCTINTHRGLFHVSVTVRRKSAPAFFKV

SEQ ID NO: 135636 - protein, 159 aa, Heterodera glycines
  Coding regions on vcDNA: vcDNA=SeqID_62059; Strand=-; Position=1 -20,75-189,310-384,990-1142,1469-1585
  Homolog annotation: Hit_ID=CAE69823.1; Match level="QueryCoverage =95%, HitCoverage=10%, E-value=1e-46, Identity=49%"; Hit description =Hypothetical protein CBG16142 [Caenorhabditis briggsae]
MFMKHSSSRHSSKATTPRLSLKFRGKDKTDGVFEWGKSKLSSKHSVVRRGKEVEVKLDGLKLGKEDVLRVPHPQTPFPIRVYDAGQIVVEDIVTEATVNDTVEFTVDAGRAGFGNLEMAIKDHDGIIIPSHVSQIESGTAKFLVTFNPATAGTHTVHIT

SEQ ID NO: 135637 - protein, 230 aa, Heterodera glycines
  Coding regions on vcDNA: vcDNA=SeqID_62060; Strand=+; Position=1-693
MKGCLLTSLFVFLISSLISINYVGSEKKKMEQKTFEEIFGEKWEEKRTEEQKRREIIGKFNKIKEKIKQKGKKYSKREWEKIERKIAKKLGTNRKYIYEWTKELGLNQKNCYKSKTDEEKLEIVQKFIEMSNEFKEKGRTYSKKEWNKNYEEICNKIGVGLRIIKKWKNQFGISRKFITEKEKTEKMKIYWQIKGENPKMSDKEIGKILKIHQNSIFNWKKQFGKEIMEE

SEQ ID NO: 135638 - protein, 54 aa, Heterodera glycines
  Coding regions on vcDNA: vcDNA=SeqID_62061; Strand=-; Position=1 -32,124-256
MPFKNIPWSMRHSIFSALALSQWNCFCRIHFFDSFRCRDFLFNADLLNTIICEK

SEQ ID NO: 135639 - protein, 148 aa, Heterodera glycines
  Coding regions on vcDNA: vcDNA=SeqID_62062; Strand=+; Position=1 -220,382-608
MAYFAPFPPICLFHLIFIFQLLGPVFCANVYLKKQYGENEFRIESWGKTNCSLNGIDIAQLGIGRPCEEWPDFVNYWGERMLFMRDSKHFVDRPLLKDAKKVVDEFKTIFDVTEWNKFVVSEMNEAQVDKLAKFVQQNFGMADGALIE

SEQ ID NO: 135640 - protein, 93 aa, Heterodera glycines
  Coding regions on vcDNA: vcDNA=SeqID_62063; Strand=+; Position=1 -84,268-465
MAPFIHLFWVIVNDVNDNAPRFGHILYLSLNRSTPVGSVVFRVRIEDPDLAENARNWFSLSGEGVEEAERLFSIDKWTGEMTLIRELTGEKVF

SEQ ID NO: 135641 - protein, 177 aa, Heterodera glycines
  Coding regions on vcDNA: vcDNA=SeqID_62064; Strand=+; Position=1-534
MTENLKCHKTQIYKASKFMRGIQLSESDKGKALAVKVVSTGVINRTIHLAKPTVMIKHEMKMLEFMNQHEDENPIEEHSVVKLYGGGEVENGSAFAMIYIMEFGDSTLDKYLEQWDEKIGGLNFKEGKPFESAWATKIKNEAQELLPKLADTLLKFHKSEPIKHISYRPISTHDSIF

SEQ ID NO: 135642 - protein, 88 aa, Heterodera glycines
  Coding regions on vcDNA: vcDNA=SeqID_62065; Strand=-; Position=1 -110,320-476
MSCNVTMWSFSPVTPDRTRRNSCICAPTPSIRPRWTIHLIQCLAYGLHRFNWVVQFENGDVFFASILLRLCQTSGAVDAHNENTGNLS

SEQ ID NO: 135643 - protein, 158 aa, Heterodera glycines
  Coding regions on vcDNA: vcDNA=SeqID_62066; Strand=+; Position=1-477
MRAERVVTMAAAPNHHYQPNNATDDDEAVDADPDVAGSLSQRAAEIEKRREWRHARLRSMDVESKRTDELVRMITAAAAAAGAAGTASGGNGAATDSNKNNNNGTGSATATTTTTRALANGGGGGAVNFGTTAPTSTPTVNPSSNNSNSTPSPIPIAP

SEQ ID NO: 135644 - protein, 32 aa, Heterodera glycines; identical to SEQ ID NO: 127531
  Coding regions on vcDNA: vcDNA=SeqID_62067; Strand=-; Position=1-224

SEQ ID NO: 135645 - protein, 57 aa, Heterodera glycines
  Coding regions on vcDNA: vcDNA=SeqID_62068; Strand=+; Position=1-173
  Homolog annotation: Hit_ID=AAG23825.1; Match level="QueryCoverage =100%, HitCoverage=4%, E-value=5e-18, Identity=79%"; Hit description =guanylyl cyclase [Heterodera glycines]
MPGNSVIDFTTPSTPVANQTLIKIAILTAQNSTDFGLPRKNSALRDSGGAIPMALEQ

SEQ ID NO: 135646 - protein, 200 aa, Heterodera glycines
  Coding regions on vcDNA: vcDNA=SeqID_62069; Strand=+; Position=1-603
  Homolog annotation: Hit_ID=XP_550305.1; Match level="QueryCoverage =87%, HitCoverage=12%, E-value=3e-18, Identity=36%"; Hit description =helicase-like protein [Oryza sativa (japonica cultivar-group)] dbj|BAD68127.1| helicase-like protein [Ory
MCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTI

SEQ ID NO: 135647 - protein, 158 aa, Heterodera glycines
  Coding regions on vcDNA: vcDNA=SeqID_62070; Strand=-; Position=1-496
RLDQTHNPKGFIAFSSSVRAMSELLRISIAPMVVRLKMYIETAQENLGKELTDQSVRADLIAERQNLCKTISLLEKYNGKWEAIFLRVKGQALQDEEQNYRDFKPEGKAFMHWVDQARGLVDTIEGDLGLSELGDAIPQPNQPAQMCSRHQWCISVMM

SEQ ID NO: 135648 - protein, 124 aa, Heterodera glycines
  Coding regions on vcDNA: vcDNA=SeqID_62071; Strand=+; Position=1 -25,355-509,673-867
MGQDSGTNDVQLTLVNGCPYKIYVAGAVQVNLTVNERQTKNVPSVSTAQRLWANTDCDSEGNSRYWTNCQSQGNSHSWALSVSILGQFSVSTLETITCLGIIVGLFFGNSRSGLIVDLENNSLS

SEQ ID NO: 135649 - protein, 112 aa, Heterodera glycines
  Coding regions on vcDNA: vcDNA=SeqID_62072; Strand=-; Position=1 -204,337-471
MDRDRQTNGQRQTDKWTETDRQMDRDRLGALEQRMANDCNGQAERDEHNEQNGDEQGEVDANGGSQLIALCQRPLLLPQRRRCALRRRRLLHPQRVRPERTHIEKSNLHRPS

SEQ ID NO: 135650 - protein, 75 aa, Heterodera glycines
  Coding regions on vcDNA: vcDNA=SeqID_62073; Strand=-; Position=1-226
MPKRGFRFAFELPPTAPPAVQTHWLQQHVAQLARPHVCVDCDAGFTTARSVACPQGNATRGKNGAEGTANFEQKR

SEQ ID NO: 135651 - protein, 262 aa, Heterodera glycines
  Coding regions on vcDNA: vcDNA=SeqID_62074; Strand=+; Position=1 -38,87-158,404-617,876-968,1104-1195,1334-1407,1506-1579,1683-1793
  Homolog annotation: Hit_ID=AAN32888.1; Match level="QueryCoverage =100%, HitCoverage=75%, E-value=1e-129, Identity=94%"; Hit description=annexin 4C10 [Heterodera glycines]
LKKEFKSDFEELIISLMQTPISLMQTPAVYDANQMRAALSGSNEAVLIEILATRTNRQITALKQAYEQLDRRHQHNQLEEDIKAKTKLLPKSVGVFAQLLSRRKAPASIVLAHDEAMKLFREGEGRRGVNAVVFNQVLATRSFAQLRETFEFYRQAAHHEIEEGIKQEFSVHNETGFLALIKYVRNASVFFADLLFNSMKGLGTRDSDLIRLVISRSEIDLADIKHAFHTLHKKSLEESIKGDTSGAYRDALLALVKGNTEQ

SEQ ID NO: 135652 - protein, 143 aa, Heterodera glycines
  Coding regions on vcDNA: vcDNA=SeqID_62075; Strand=-; Position=1 -101,232-372,453-642
MCEKSLVCFDSVMNIFGLLLLLSAGVNSQMETIPIRLTGQKSSWANIQLGLFDQCLPSEESKTFGIEFRLPKNGGSCDKEGISICYASTLSSRTLNVMHTADEFSVTSELFNVPEMVRVLTEHRTIADFKKGNLFYTWLNQKL

SEQ ID NO: 135653 - protein, 95 aa, Heterodera glycines
  misc_feature (67)..(67): Xaa can be any naturally occurring amino acid
  Coding regions on vcDNA: vcDNA=SeqID_62076; Strand=-; Position=1-729
  Homolog annotation: Hit_ID=XP_453836.1; Match level="QueryCoverage =98%, HitCoverage=98%, E-value=7e-28, Identity=67%"; Hit description =unnamed protein product [Kluyveromyces lactis] emb|CAH00932.1| unnamed protein product [Kluyveromyces lac
LIRQVSCYTLLSGFRLPWPPSCCLYQPTPFMRSNERALWHLNSTFGSSHIASSAYQKWPTWSSNIQXPGFRVKQPWLHTHLEFENRLRTFRPQVL

SEQ ID NO: 135654 - protein, 44 aa, Heterodera glycines
  Coding regions on vcDNA: vcDNA=SeqID_62077; Strand=-; Position=1 -23,403-514
MNNVQQLRVQLEKIYENMGGPNLDADSNKVLNNLQKKVGDHQII

SEQ ID NO: 135655 - protein, 191 aa, Heterodera glycines
  Coding regions on vcDNA: vcDNA=SeqID_62078; Strand=-; Position=1 -315,765-1025
MHDLDEESRAKVKERFQAWKIGGGIVGSGSSAGYGIPALGSPAGHSGTVYGRPHLDRAESSKSAEQRARAAAAQQKTESEKHKKVEMQESKKRELLVLKILKNLVQTDAEDESENGSELDDFEKDIFGGMNSDNYDEALLNAQLILQSEKKVAKVVKAWKKLQQKKQNSQRTVNDWNSNLFGWGNAEQQVN

SEQ ID NO: 135656 - protein, 75 aa, Heterodera glycines
  Coding regions on vcDNA: vcDNA=SeqID_62079; Strand=+; Position=1 -25,195-397
MTNFYCLYGPTTCIGTANETAVGKIMRFHNIDDIEMGPVKHDFSRELDEMGKRNLIEKALRFYSFKTRVPKCAYF

SEQ ID NO: 135657 - protein, 78 aa, Heterodera glycines
  Coding regions on vcDNA: vcDNA=SeqID_62080; Strand=-; Position=1 -87,232-290,439-529
MVLLLFEGCVVCANQKMTASLSLRQYMPEQCTVGGEAWQLCFGITLMERLCAERKTTEPEPKENATTPAPVYDMQQLK

SEQ ID NO: 135658 - protein, 38 aa, Heterodera glycines
  Coding regions on vcDNA: vcDNA=SeqID_62081; Strand=-; Position=1 -82,231-265
MYGLNKTEGPEENFKNMTEFDKYGFMHGVFVTKCTQIV

SEQ ID NO: 135659 - protein, 138 aa, Heterodera glycines
  Coding regions on vcDNA: vcDNA=SeqID_62082; Strand=-; Position=1-416
MPKCLRRVVAAYFFRRAKSVPLTVFRAIANFASVQIQRRHLRKSAALEGCRVPNSVQWVFHPLARHFLSCPVRVGTILSQSGVQKTPNFPFSALTQPPKPLEVLKEAFKMHLLGQLLCRLESADGRTLRLADFVEQSQ

SEQ ID NO: 135660 - protein, 88 aa, Heterodera glycines; identical to SEQ ID NO: 124691
  Coding regions on vcDNA: vcDNA=SeqID_62083; Strand=-; Position=1 -96,135-305

SEQ ID NO: 135661 - protein, 198 aa, Heterodera glycines
  misc_feature (20)..(20): Xaa can be any naturally occurring amino acid
  misc_feature (33)..(33): Xaa can be any naturally occurring amino acid
  misc_feature (182)..(182): Xaa can be any naturally occurring amino acid
  Coding regions on vcDNA: vcDNA=SeqID_62084; Strand=+; Position=1 -317,540-616,701-855,1211-1270
  Homolog annotation: Hit_ID=NP_503966.1; Match level="QueryCoverage =91%, HitCoverage=31%, E-value=6e-46, Identity=49%"; Hit description =CNT-like nucleoside transporter (63.5 kD) (5D941) [Caenorhabditis elegans]
KNQAYKVKLPHFILFFNKFXIRSLKERFDIILXSQNLIDLNKLFFFQTIQVIIYVGAIVSVLYFYGIIQAVLKRMAMLMQLTLGTTATESLNACACVLLGNAESPLLIRPYIEKMTASELHAVMTTGFACIAGAVFAAYISFGACPRYLLSAAVMSAPGSLACSKLLYPETEKSSVKSEIFXIEFNDKTVQQRKQCDG

SEQ ID NO: 135662 - protein, 23 aa, Heterodera glycines
  Coding regions on vcDNA: vcDNA=SeqID_62085; Strand=+; Position=1 -54,722-739
MRVCDPLCSLNGPFHLVAEIFEI

SEQ ID NO: 135663 - protein, 46 aa, Heterodera glycines
  Coding regions on vcDNA: vcDNA=SeqID_62086; Strand=-; Position=1-138
MARLVQIAQVVHDEGIHQPLAVQLQRSDYMAHWDPSDGSMALKQVL

SEQ ID NO: 135664 - protein, 29 aa, Heterodera glycines
  Coding regions on vcDNA: vcDNA=SeqID_62087; Strand=+; Position=1-87
MDENAEPLHPPNPLEIGIIGSSANNSLSE

SEQ ID NO: 135665 - protein, 132 aa, Heterodera glycines
  Coding regions on vcDNA: vcDNA=SeqID_62088; Strand=-; Position=1 -108,152-232,295-363,402-439
  Homolog annotation: Hit_ID=NP_492437.1; Match level="QueryCoverage =93%, HitCoverage=62%, E-value=6e-37, Identity=65%"; Hit description =sorting nexin (1J640) [Caenorhabditis elegans] emb|CAA22253.1| Hypothetical protein W06D4.5 [Caenorhabdit
FAMSAAATQRLQAKRQTLDEAYAPPANFLEIEVVNPITHGVGKNRYTDYEVITHGVGKNRYTDYEVRLRTNLPVFKHKESSVRRRESSVRRRYSDFEWLRNELERDSKIIVPPLPGKAFKIIVPPLPGKAFK

SEQ ID NO: 135666 - protein, 179 aa, Heterodera glycines
  misc_feature (19)..(19): Xaa can be any naturally occurring amino acid
  misc_feature (36)..(36): Xaa can be any naturally occurring amino acid
  Coding regions on vcDNA: vcDNA=SeqID_62089; Strand=+; Position=1 -39,77-302,363-552,829-867
  Homolog annotation: Hit_ID=NP_501064.1; Match level="QueryCoverage =94%, HitCoverage=15%, E-value=1e-29, Identity=42%"; Hit description =proteasome Regulatory Particle, Non-ATPase-like, S2 (107.4 kD) (rpn -1) [Caenorhabditis elegans] gb|AAF986
DPRIPCFECIGLIGIGRNXRKLLDYLLWIAGIGRNXRKLLDYLLWIAHPTHTEMMLLRITQGLMHLGKGTQTLNPFHSDRQLMCPAAVAALLTTCFAFIDGEKLILNGRQHYLFYTLVAAIQPRMLITVLQEQWRSSKRGVLSPERKAGEFVAIFGNKKKANLHLGFQIHVFVYILYHC

SEQ ID NO: 135667 - protein, 1038 aa, Heterodera glycines
  Coding regions on vcDNA: vcDNA=SeqID_62090; Strand=+; Position=1 -239,289-493,547-924,972-1760,1965-2115,2157-2491,2998-3152,3202 -3485,3536-3818,3873-4170
  Homolog annotation: Hit_ID=NP_507780.1; Match level="QueryCoverage =58%, HitCoverage=43%, E-value=2e-21, Identity=26%"; Hit description =predicted CDS, DNA polymerase type B, organellar and viral family member (5T899) [Caenorhabditis elegans]
MAGGGGKAAFNLFASRQDQHGPAAAQMLTRAGIAANSDMYTLDDVQRLQQWLNNQHGVGQIRLAVFEKEQEYRIVFKGDGLAARFNLCLVLERGHFNYIGRVEQLFDVPNYCIDCERRADARYHAFGCKVVCRLCLRYGPGYPWQTEQLPNGGSSARKCAECLFIFPNGGCYDYHLSNHSPAPMDGRGQRQRRPICQWRRVCRACGRIAYVATHQCHMTSQPTMESVGAAMGPTPSMSLATSSPLTTAQFDNVHRLLLTTTILMTTTTMKNCRFLNNRTVQKHVPLLIVAEVICERCLQAGISVSDGLGRRAPGCVCMTGMVRGQLFRQWSSPPFANAPGDNSASPVGAPAFNQRRFFFHSFDNDGNDPVDQFLDFLLQHGPKKAHTVCIAHNGGKYDFHLVLEALHRRNRPPKHLCTTGLKIYSMRLSGRNQRRITFKDSINYFFCALDALVKSFQVPDHLATVKPFFPYLYIRRQHLSQRLNGLPAQEFYAPDTMKAEKRAQFLRWHADNNGNGFQLREQLIMYCVNDVAILRESLEHPEAQVQCASWSVGEAHIEDSGYRVDGLWRREAPLRPLAIEWLGCYYHGCPACFPDRQQQLAAGRTAEDLYERTERRLFELEHDHGCEIHKVWACQWTERLRHDPDLKRRYDAVFVPCPLDPRNDALRGGRTEPFKLHHVCSDDEEIMCIDIVSLYPYVMATGWPEGCVTDEQQKAFVDDFERTEGIRLDSTKMEFNPGLRLIAKTLANSLWGKLAQRVGQTEIRYTRTPAEFHALLDDPTVDKLDFVHVSEHMDRCVVRKRPEFAKAPLTNCLPVAAFVTSYGRLHLYDYMEQVSAIVGAELLYCDTDSIYYVSKMGGPCVAEGEALWQMKREHTDRRIVEFVAGGPKNYGIRHTARDGTDERANLKIRSFRLSYTAQQLLTFEAMKDLTLATYNIDGPIDDALDNDDLYVYGGGEHRAIRVNFPQIDRNVYADLYTHEAHKDYRPFYAKGRVRPGMQTRPFGYLEDDGQPNEGQRTHRRKRNFVEQDPTQPGHSGWF

SEQ ID NO: 135668 - protein, 101 aa, Heterodera glycines
  Coding regions on vcDNA: vcDNA=SeqID_62091; Strand=+; Position=1 -118,365-480,829-898
MTSFIIITIAFSFCAISMAHVPFWWEQLSDAEEQWRINTTINECCPPATYCCVNNLFVPRELDEMGMDRCIDDGTMGKEQSYNTIKCAQRKYLGDESTDIC

SEQ ID NO: 135669 - protein, 87 aa, Heterodera glycines
  Coding regions on vcDNA: vcDNA=SeqID_62092; Strand=+; Position=1 -105,156-203,252-361
GAFGCVNEAKWTLSCAKEAEKQQGKTGKASKSSKRVAIKTFTNFADMEKEAGLLKQLDHPNILRMFGVTKLDDKNAMVIELMNLGDL

SEQ ID NO: 135670 - protein, 88 aa, Heterodera glycines; identical to SEQ ID NO: 124691
  Coding regions on vcDNA: vcDNA=SeqID_62093; Strand=-; Position=1 -96,135-305

SEQ ID NO: 135671 - protein, 108 aa, Heterodera glycines
  Coding regions on vcDNA: vcDNA=SeqID_62094; Strand=+; Position=1 -162,276-440
MPYNFETLLPLCSNEMDAPNLMNAALFIVKSTADVVQKCAALSRTPMEKFKILQGSDKTDKHRKFCPILTVTPHLRPGHLRPKGKSDICARTFAPRHLRLRLLRPSEN

SEQ ID NO: 135672 - protein, 944 aa, Heterodera glycines
  Coding regions on vcDNA: vcDNA=SeqID_62095; Strand=-; Position=1-2835
  Homolog annotation: Hit_ID=XP_318550.1; Match level="QueryCoverage =76%, HitCoverage=71%, E-value=1e-162, Identity=42%"; Hit description= ENSANGP00000020240 [Anopheles gambiae]
MFENVEEAEKSGTRISLGQIEEELKAMQLIKDSALALLSPPISTNAIQLRPQQWREPKSKKGNYNSGKTTANQHTTGGKANQRKPTYPCGACGNSDHWRSDCRFFSAICHKCQKQGHIAKMCPQRSASTSNSRRQNRAVHTVKVTSHCLNVGLNRGHWWKLQVKINDNDCEMNGDTGAQATIITIQTWIKLGRPKLELSDIEMHNCNEEPFPTEGMFQCVVSCFDKPPKRLTAYVSSAVNYNLFGLPWIMAFDLIPREVMFPKVQQKKMCEPISIHATLAPMPKANIKDEASLIEALKTDFSEVFEPGLGECSKIKAHLILKQDAKPIFCKARPIPHGATEAVNAELDRLLEIGAIKPIDFSHWAAPILAVKKKNGKTRVCIDFSTGLNNALELNRHPLPRPDDIYAALNGASYSSNLDFRDAYLQMELDEESKDLCVINTHRGLFQCQRLPFGVKSAPSIFQHLMDQICAGIPGVFAYLDDGLIASKTLEGHISALYQLFTKIKEFGLRIQLEKCKFFQKELLFLGHIVSSKGIRPDPARSEAISKMPAPHDKTSLLSFLGALNYYGRFVKKMREILTPLDQLLIKDENWNWSEEQQKAFEKAKKIMTSDLLLTHYNPALPIIVAADASKKRIGATIGHVFPDKSEKVIEHASCVLSNSQQNYSQIEKEALALVFAVQKFHRMLFGRKFTLFTDHKPLLAIFGSKKGIPVYSASRLQRWALIMANYDFDIKYTNTASFGQADVLSRLANYPKPEEDVLIANICVETDCYINTILQSQTVHLTVTAQEIAESTTKDETLQKIVNFVISGWPTKCREPEIAPFHPKRNEILEIGGCLLYKSRVIVPSQLRGRILKSLHFAHPGIVRMKALARQYVYFSKWPEVYQMSSITAKSTVFTLRSIIHRRTIKIGLKRCCSLTGRRQIMPLMVILPINYSSDENSERNWH

SEQ ID NO: 135673 - protein, 261 aa, Heterodera glycines
  Coding regions on vcDNA: vcDNA=SeqID_62096; Strand=-; Position=1 -539,726-795,853-1029
MSQLTSDRAQRLKYVESSLRHSKSPIETFFIYAENPKHHRKQHGATKNIQIQKCYFAFQNILKCYFANCQFPKCRITKCWARKCKILFRCEVDLPDPACNIFHRNCVICQVEIGKDKSKQCFLSATRCSCYYCCDKKYAAHCPQGCKNCINDGFYEEGGCPENHTPMARLASSNYSSEIGLTENSPFVHSLKKVETARKHFDTVDADKSGAISMKEAIAYLVETKNGTSADHLAKNSEWFGHMDSNGNSQIEPVEFDRSLI

SEQ ID NO: 135674 - protein, 80 aa, Heterodera glycines
  Coding regions on vcDNA: vcDNA=SeqID_62097; Strand=-; Position=1 -138,443-546
  Homolog annotation: Hit_ID=NP_494926.1; Match level="QueryCoverage =100%, HitCoverage=26%, E-value=1e-18, Identity=52%"; Hit description= g-protein beta WD-40 repeat (2F320) [Caenorhabditis elegans] gb|AAK31511.1| Hypothetical protein F33G12.
VLDEARDGVLCLDANASEIVTGSADGNVRLYDLREGRLFIDYMKDSVISVHLTADNQCFLVASMGGTIRLIEKTNGQLLA

SEQ ID NO: 135675 - protein, 149 aa, Heterodera glycines
  Coding regions on vcDNA: vcDNA=SeqID_62098; Strand=-; Position=1 -116,176-485,695-718
MSEFGQDYDLMVTLVSGNRSMPNNPSVPMPPVLFIFAQWSNIGGPSQQFDANATDWFKGIAAAFERGGSVRLSGDPRDMDWNVTTPLSQMHLRWTFRSVREFAMPYEKRLYLSNWDSAELQKRGWSDWMAEQWNKFVGARNECNLHDDE

SEQ ID NO: 135676 - protein, 228 aa, Heterodera glycines
  misc_feature (226)..(226): Xaa can be any naturally occurring amino acid
  Coding regions on vcDNA: vcDNA=SeqID_62099; Strand=-; Position=1 -213,647-846,1184-1460
  Homolog annotation: Hit_ID=NP_492273.1; Match level="QueryCoverage =98%, HitCoverage=42%, E-value=3e-88, Identity=74%"; Hit description =adrenergic receptor (1I963) [Caenorhabditis elegans] emb|CAB01500.1| Hypothetical protein F16D3.7 [Caenor
VGADVTFCTCSVVTICIISVDRYLAVTRPLRYKSVVTKLKVIVVIVLIWSFSLGILLATVRWESQQHTVENTCYVGDEIRYLAHSVVFAFFLPASVTLTLYWRIYSLARNRQRALDRGFLMILGHNMNFLTNTLSQTVVNHHKYRYHIYNSQIFTIIFHTQTALRVHIGKNNGMVEHQRRVLRTHERIAKTLGVVSCSFLFCWLPFFTLYLLSASSLLALARIIFXKL

SEQ ID NO: 135677 - protein, 226 aa, Heterodera glycines
  Coding regions on vcDNA: vcDNA=SeqID_62100; Strand=-; Position=1-679
  Homolog annotation: Hit_ID=NP_507780.1; Match level="QueryCoverage =98%, HitCoverage=14%, E-value=4e-23, Identity=31%"; Hit description =predicted CDS, DNA polymerase type B, organellar and viral family member (5T899) [Caenorhabditis elegans]
MTIASACVKNFALNHLKPNSLAIVPEKGYTPQQNQSALAIKYLDWYSHINNVNIQTAHSRYGEYVFKREGEVYQVDGYIKGTNGRRDKIIEVNGCVWHGCEICFGNMDEESRMPNGKTLREIREREKRKHKTLRRYVDLEVIWEHEINEELRRNKQMRGFFNNWKDNSPIRIRDAFHGGRTDVKKLLHTAKPGQKISYKDFTSLYPWTNFTADYPLGHPKIISIQP

SEQ ID NO: 135678 - protein, 49 aa, Heterodera glycines
  Coding regions on vcDNA: vcDNA=SeqID_62101; Strand=-; Position=1-162
LALIMGMYKGDCRRNWKRKNCLRSFLSVITDFYFHHFFLGLDHMRFSAL

SEQ ID NO: 135679 - protein, 93 aa, Heterodera glycines
  Coding regions on vcDNA: vcDNA=SeqID_62102; Strand=-; Position=1-345
LRSKSFSNILTLPIPSTIAFIHPIMSAKIIRVPKIACDLSLEKNGVSKNRNYAQKASQTILAHPIPSTIAFIHPIMSAKIIRVPKIACDLSLA

SEQ ID NO: 135680 - protein, 244 aa, Heterodera glycines
  Coding regions on vcDNA: vcDNA=SeqID_62103; Strand=+; Position=1 -90,160-369,518-638,700-860,928-1080
  Homolog annotation: Hit_ID=AAR85527.1; Match level="QueryCoverage =99%, HitCoverage=98%, E-value=4e-62, Identity=50%"; Hit description =14-3-3b protein [Meloidogyne incognita]
MGEQRDELVQRAKLAEQAERYDDMAKAMKKLVEMDAKLDEEERNLLSIAYRKAVGARRTSRRIITSTEQRPTLTKKQKQIANELKKKVEHDMEQKGSEALDLLDKILIPKVDEPVAKVTYLRMKADFHRYMAEIKEAENDDPQKAKQSYEEAWDIAQQKIRPSHPIRLGVALNFAVFLYEFMKMPEEGRKLAQKAHDDGNADLLADTSGDSYLESIGILEKLDENMRIWASTQERDGSSERGNF

SEQ ID NO: 135681 - protein, 84 aa, Heterodera glycines
  Coding regions on vcDNA: vcDNA=SeqID_62104; Strand=+; Position=1-399
FLCLNNQNPVTFSQILLILWLIHLLLMAHFIHSLLCLTLVTKLRRILGPISNSIWQFSEGRINYSLMFSINLLFLIIFVSFFFN

SEQ ID NO: 135682 - protein, 125 aa, Heterodera glycines
  Coding regions on vcDNA: vcDNA=SeqID_62105; Strand=-; Position=1-378
MDQSKALVNQNEDKLTLAIDFTVDEANTELKPLEFQWHGRVSDWIIANANWGTLTMKIEKFSEFTKEVGNRRNSEAVQMKGFEWKISAEITTDKEDGTDKNLGFYLLCFPPSKNGENMRISNCIH

SEQ ID NO: 135683 - protein, 140 aa, Heterodera glycines
  Coding regions on vcDNA: vcDNA=SeqID_62106; Strand=-; Position=1 -93,149-478
MSEAENSIGTLCDYNKQMNYSWGFGNFISFEELMDPEKGFYTKCEDKVTLVIDVMTVDEPKMDKFMLDQSKSKGTLFMEIEKASEFSREVFGSDRKSETVHIKGLPWKIMAKILTKNGSVNNEKWLGIYLSCGAPEEGVN

SEQ ID NO: 135684 - protein, 214 aa, Heterodera glycines
  Coding regions on vcDNA: vcDNA=SeqID_62107; Strand=+; Position=1-645
MAPALDLDPNTVALAEQERQRTLVFIGLPESNAIRPSERVQEDREAATKILDHLEVEAQPTAVFRLGRYDPQRTTPRPLKVIMPTTTHQHMALGGWKRERARLRSLQNLNRLFVRPALTKEQLKEEYEARFRKRQQNPAPVAPAMRPRQTNVPTPVKENGPKPKEASDDISKPPEIFDQTILVCYEALKSLPPNDKIVHQIQSLEKQYPRLFNK

SEQ ID NO: 135685 - protein, 52 aa, Heterodera glycines
  Coding regions on vcDNA: vcDNA=SeqID_62108; Strand=-; Position=1 -27,81-212
MARKMQFFEVNRHYQAGMYGFIWTKNAKYGFIWTKNAKYGFIWTTKLTKSKF

SEQ ID NO: 135686 - protein, 91 aa, Heterodera glycines
  Coding regions on vcDNA: vcDNA=SeqID_62109; Strand=-; Position=1 -192,247-331
ALFEWMNEMSNEKLTMTANDGSVCQWLMKRCQIEGTESIQWEDENLGNLNTVIFSISDLQSCIVPLSPPPPAAEEEEAGQSSEKGASSDNE

SEQ ID NO: 135687 - protein, 23 aa, Heterodera glycines
  Coding regions on vcDNA: vcDNA=SeqID_62110; Strand=-; Position=1 -15,161-217
MNNFISGKKVKKDDETDWIEESK

SEQ ID NO: 135688 - protein, 114 aa, Heterodera glycines
  Coding regions on vcDNA: vcDNA=SeqID_62111; Strand=+; Position=1 -249,682-777
MPKPNKCCFKVVVVVVGVVVVVGVVVVVVLVEVVVVVVVVVVVVGVVVVSSELSVVSFVAELSVFPSVAELSVFSSVVAGIVNLDREKRSLRAIKCGVGQNVVSRNVVERIFRP

SEQ ID NO: 135689 - protein, 62 aa, Heterodera glycines
  Coding regions on vcDNA: vcDNA=SeqID_62112; Strand=-; Position=1 -58,481-611
MAFMLFCSIIASQIFYVAYAPQCVDEIFHNKWIKGSADEFNLCNEGVRCYSMICEYGTQLKG

SEQ ID NO: 135690 - protein, 277 aa, Heterodera glycines
  Coding regions on vcDNA: vcDNA=SeqID_62113; Strand=-; Position=1 -650,754-878,1336-1394
MSGSLSVGSSNVGIPNCRVPKCRVPKLQIPKSRVASSRTQHALFACTAFMGLINEVKNEGIGWVKDQLKSYCRLVPFFSSDCYRLVADALLNTIVNKLNCIKLEKLNPTIICKEHGMCNEEQGNSTARLLHASMGPMAAPRSRHSILLPNDGPVMPPGSLEALAEFNYERLLMDQLGDDSIEGNYWQKSGGKFILRRGKNFKISCAIRFDRKLCFVPGDVITVEHPGVLKCQAECLFGSARFLIKHTYHSNKCFAWLNDGWAAITEKRCDQFQRSYW

SEQ ID NO: 135691 - protein, 181 aa, Heterodera glycines
  Coding regions on vcDNA: vcDNA=SeqID_62114; Strand=-; Position=1 -235,277-587
MKKFLFLTIIILLLLNTHSSNKQRHRKQREVSALARLTVALSRISTYIKAHPYITASTILMEMGSVSLNIYLLIQEIKACEEKQILKDFFPFVLTLNSYEFSVNVDDYNPGYIFGKINTEIGRPVEEICFAGQPQKINSLKNSFKAPNKVTRKIRNRKDDLGILLLYAIRQQSRLELFECP

SEQ ID NO: 135692 - protein, 420 aa, Heterodera glycines
  Coding regions on vcDNA: vcDNA=SeqID_62115; Strand=+; Position=1-1263
MSLEDHNYCGELGGNETPTKRRRRNDDDDGEGEPKFQKNCIRTLSADKQYSQKFKVQSVKSTFIIENLPANPESMLRALFAHCMSTALDESQQNGITPDQLGATISSDLLNPSIWIPIRRISDNTADSIMNRFLEVAQSKSREGSLWGSPFTVTITTLDVAQLPQRQQVRGSGKRTTNSVQHIVKESALLRINNSDDAYCLFYALEASRKYHIKEMSRRNFCYYINHQNGRRLEDVFGLMSSANIRTDLREYDAVVYVPIVVDYWNRKYATANQRFKVFIFGATGTYRPKFQYGPDNYNVEIPLYHHNGHFDGIRCGVGKAVFGRDYYCFSCECPYDNANGHTLQCKAKCINCGRIGAGRQQRQLLQRMHSMWQGFHEPRLFQSSFVEQCVSTVQKMQTVRSCVECQTKPTKRTQRTRLR

SEQ ID NO: 135693 - protein, 341 aa, Heterodera glycines
  Coding regions on vcDNA: vcDNA=SeqID_62116; Strand=+; Position=1 -542,595-1078
MYFKSATAILFFLIVFIGIGKCASANANKTKSRGAVSTTTTAITTTTTVNPQKIGVPRLASSTRMGKGSVTGKPLKIVTANTNTNRNITTANTNTNRNITTAKNNKNSSSKITTPTTKTAKLVVDEQLPVATLLPTLIHQMCKDRPGEENFYQQAVCWALFALYLMVFVSLVLHQLCSICWQSRETARVFRGCFPSDQLPAPDTLRYPAALVVNNDPHYKQGSHWCAIYAPSKMEEAVIYFDSLTKTIPPIVKTSFMDKFPKGFVTNKHPYQSPLTTTCAIHCIVFIYHMALGHPFDAFLRILDASESPDMYSLCVLNKMINPYLCARVPILPPFGKGHRE

SEQ ID NO: 135694 - protein, 346 aa, Heterodera glycines
  Coding regions on vcDNA: vcDNA=SeqID_62117; Strand=+; Position=1-1041
  Homolog annotation: Hit_ID=NP_507780.1; Match level="QueryCoverage =97%, HitCoverage=21%, E-value=2e-29, Identity=29%"; Hit description =predicted CDS, DNA polymerase type B, organellar and viral family member (5T899) [Caenorhabditis elegans]
MPVPLGALPGAFGLNVQDKEFFPHLANVEANYGHILQSLPPKADYLYGGMTPDRQRRFDQWYAEHRHQQFDLCEQLAAYCTNDTRILIEALVAFRTEFLTISDPLERHGCLDDDNDDEDEEEEVDDDNAFEVIGGGIDITWEPMTIASASMRHFRLNHLKRDQLAIVPECGYDTTNTQSLVALKFMDWYAKKNGVSIQTAHSPGGEKKIGQYTVDRYITATDTVIEVNGCHWHAHDHPRHRFQPQTVMANGKTAQRIREDDARRMAFITSQVQQVRVFWECEINAEKRNNDEMKRAFAQYKDSGPIRLKDCYHGGRVGPQRLHYEVPEGWRMKYYDVRSLTPTRMP

SEQ ID NO: 135695 - protein, 310 aa, Heterodera glycines
  Coding regions on vcDNA: vcDNA=SeqID_62118; Strand=+; Position=1-933
  Homolog annotation: Hit_ID=NP_001004509.1; Match level="QueryCoverage= 99%, HitCoverage=20%, E-value=4e-25, Identity=26%"; Hit description =si:busm1-180o5.3 [Danio rerio] emb|CAD60788.1| novel protein similar to DNA polymerases [Danio rerio]
MAMKTHASGFPDEIGTTEEDQQQFIEECEEKFGIRIERENMVHNKAKRTIAKLCNNSLWGRFSLRNGLSKTIVTDSPAELRALLDNPAVEVSSVDQLTDECVLVTYAAGNEWVEEHECSNIVLSLWTTSVARLHLLRLMQTVARAPNSVLIYTDTDSVCFAHREADGCPLETGPHLGDLSDEWPDHELVEFVSGGCKQYALRMRHRQSGEEKTVLKVRGITLSADACQLLHFDTFKRSVLRYAMCHSNEDDDEEGDDIFSILIEYPNFLRPNIKDGTVISVKLSKRYRPIVTKGVVGMNAIVHDFGFIKA

SEQ ID NO: 135696 - protein, 221 aa, Heterodera glycines
  Coding regions on vcDNA: vcDNA=SeqID_62119; Strand=-; Position=1-666
MHLLIAFSRILDCSPDEVGARICCSVADREKLLKEFAHRKLITTYYDRNGFTHTLFFAGLTEEGANSVLAYGNLRRPYNVCVAAHYYSRHRIMLKYPHYPCVIEKCFGQRDDGPLHKYYPLELVKVVDDCFPPVYVNSLSQKRDGASSSSSSSSSSLLRNLPSPSSDDADYDDHGLWFGSMPTQNSVAETPPPPSCGFVKGIIWIEKEQIKNILSQAVKHD

SEQ ID NO: 135697 - protein, 145 aa, Heterodera glycines
  Coding regions on vcDNA: vcDNA=SeqID_62120; Strand=+; Position=1-438
  Homolog annotation: Hit_ID=AAO53180.1; Match level="QueryCoverage =97%, HitCoverage=9%, E-value=8e-10, Identity=30%"; Hit description =hypothetical protein [Dictyostelium discoideum]
MPEESNNNSTNYNNNNISNINYNNENAQLWKLVRKKYILTFNLCYGCSQKLFESTKNNNNISNNNNYAFETDQFGGVKVQFHMCKGCVWLNMKLSDLNSAPKSGNNHMKTTRNFPNTNNATYSTDNNFGSFFNNTNPQNNANEWI

SEQ ID NO: 135698 - protein, 175 aa, Heterodera glycines
  Coding regions on vcDNA: vcDNA=SeqID_62121; Strand=+; Position=1 -129,236-634
MNSQQRQIEREQLRARLNLLVDEVDMVVQGLINNYRSDGLINEEAAIGQAPETVELQNVTIGSHLPAQQGEEWEIGPHMPLQQHYEHQPWELDPPMPEQHLEIGPQLPDAWELVPYQPPPQWDQVVHVEQQQQQQQHHQQQQQHQQGAWDEGWEEQLSPNAIAQIQDEADGCARD

SEQ ID NO: 135699 - protein, 43 aa, Heterodera glycines
  Coding regions on vcDNA: vcDNA=SeqID_62122; Strand=+; Position=1-129
MNSERRRNEREQLRARLSLLVDEIDTVVQGLITNYQDDGLING

SEQ ID NO: 135700 - protein, 238 aa, Heterodera glycines
  Coding regions on vcDNA: vcDNA=SeqID_62123; Strand=-; Position=1 -168,221-415,448-543,616-870
  Homolog annotation: Hit_ID=P35549; Match level="QueryCoverage=25%, HitCoverage=17%, E-value=4e-11, Identity=66%"; Hit description =Fibrillarin gb|AAA67420.1| fibrillarin
MDLNTLHMDMMELASSAGDEGTVGKANALLERAGDKLDLSMEHIGILKRRVQLSNQLAEFKDRRANASEKIIQMETIRESIGDKAEQVKQLEQLIAATGCELSETERQLRTMERSKQAKIDELETTVQQNLRKMALDVDSINGTLGKITEMGEVFLLLLTAIVICECGAGRKNGQAGCERHTVGRGGGGATGRNGAGSKRGGGRGGGRGGGKGNGRGGGRGGGGRGGQALQQPQDEDE

SEQ ID NO: 135701 - protein, 299 aa, Heterodera glycines
  Coding regions on vcDNA: vcDNA=SeqID_62124; Strand=+; Position=1 -174,397-594,1000-1119,1179-1294,1858-2035,3186-3299
  Homolog annotation: Hit_ID=CAE62158.1; Match level="QueryCoverage =68%, HitCoverage=5%, E-value=1e-25, Identity=41%"; Hit description =Hypothetical protein CBG06205 [Caenorhabditis briggsae]
ERTASGGGRRRVGSTAADRSAQAAAAACAAGEEATDEVDNNEEERQNMAVVTKRMAILDLETSGTPARIVEIPENVTVVEGELAIIKCVVEGNPAPTIVWKKGGRKMPLTDDRVRCQTDGDTGHVSLIISKCRPQDGGEYTLMVKNAHGKHKVGAKLLVTPAAESNLDIRAKQKKRGTGISNSEQEKQRQRSDAEPKSKAERRKRQVYVVEEPRDTFVVPLNSQHANEKENATFECEVNDKEIDVKWFHDGAEIGMDGRHFKFYLDFKDVNPSWSLIGCALIYGITPHLESFSIHLSLL

SEQ ID NO: 135702 - protein, 121 aa, Heterodera glycines
  Coding regions on vcDNA: vcDNA=SeqID_62125; Strand=+; Position=1 -79,920-1206
MKERWFQNNIHPSSGGFGLVVITTDPNKSILNFVVFNLLNFLYCLLVDSNDCDSIGRRLNLGVSRYRISGIFIPVFAKRRNGDPRTATPEDGDKNTPLRRRMDSTTKIVKLAVSQSNIGLF

SEQ ID NO: 135703 - protein, 458 aa, Heterodera glycines
  Coding regions on vcDNA: vcDNA=SeqID_62126; Strand=+; Position=1 -12,342-1289,1353-1769
MTSKNNRGNFRGNGNEKQRYRINMVGDEQTQSSSSRRSPTPTFTFLTISMVLSILFGTFSLSNAQYQICSERVQTTAILLPNITKCSIPKYQKVAENKITLFLPVRLPKQFAVYKCYQKLTKICTGNFLFLWKGVKSQETTVRGVSHETCQKFKHKMGGSMNRLSENLWATENPEKLTYAWTGEKCETTVNDFLEEGKGGILDFFLVTSFGHNLNPYKNWEELPRKTFIWEIPEPNEKYWATHFSVGEFKAEITENAVVIESEQSVFYFEKEANDEREGIIGVPENAYKMSNDAFIVLSKTEIREKRETPKIEPKRKESPEQNATVSVLPKSTVKLVKDSQQKISNPIKILPQSTQSTVITTSKPQVKLSTTVMPVTTSTTPKPITVQRVITSTSSPNVNYDGHFETISVKRPQNERIYQAKGREFKNLGSRSESTTTKKPITVTKVGTNISKKFDRV

SEQ ID NO: 135704 - protein, 64 aa, Heterodera glycines
  Coding regions on vcDNA: vcDNA=SeqID_62127; Strand=-; Position=1 -73,110-231
MFSPISDLITSVTFSNPEKIFELIVGNTVISLAFCVTFVEIVVTEVLVTMGFTVEVVMVVVTIF

SEQ ID NO: 135705 - protein, 19 aa, Heterodera glycines
  Coding regions on vcDNA: vcDNA=SeqID_62128; Strand=+; Position=1 -36,103-126
MAAANPALRWFANKIKKYM

SEQ ID NO: 135706 - protein, 78 aa, Heterodera glycines
  Coding regions on vcDNA: vcDNA=SeqID_62129; Strand=-; Position=1 -141,484-579
MVLMKPNLAMKAIKRKEGWDDRKGIRVNAKCAGGKACTVITESDVAKQKFAQTKRQKTTLIQKLSRISLVKTEEPISS

SEQ ID NO: 135707 - protein, 179 aa, Heterodera glycines
  Coding regions on vcDNA: vcDNA=SeqID_62130; Strand=-; Position=1 -250,321-470,561-700
MGGLNGFDVRLIFDQHNTQQEMAVHCWEDCMPRLANNIQCGQIVEFSRLKVREQGKNAKGFFPFNLLYNNESRHRVLSASGHIGANLASSSNTPIIVEAAVEQQQPGMNTLSNVVRHNSSSSGANNQHIHGQNSTGVVTADDGQSEGEPDEAAAATNLTNAGARDADVEEGTSETVSGN

SEQ ID NO: 135708 - protein, 71 aa, Heterodera glycines
  Coding regions on vcDNA: vcDNA=SeqID_62131; Strand=+; Position=1-216
MQIVPFELVNEWTKEKLTLAKAKENEWYIDWIMKRSKIIGETAAVNWKDGNWDNNCNCVFFWLDSDTNCIV

SEQ ID NO: 135709 - protein, 56 aa, Heterodera glycines
  Coding regions on vcDNA: vcDNA=SeqID_62132; Strand=-; Position=1-171
MDNSKNGETRKEEEKEGNSIREGGETEEKERKRKNSAEGRGENEAEKRKEQQQIGT

SEQ ID NO: 135710 - protein, 153 aa, Heterodera glycines
  Coding regions on vcDNA: vcDNA=SeqID_62133; Strand=+; Position=1 -36,101-251,315-442,505-648
  Homolog annotation: Hit_ID=CAE69090.1; Match level="QueryCoverage =58%, HitCoverage=23%, E-value=2e-24, Identity=63%"; Hit description =Hypothetical protein CBG15109 [Caenorhabditis briggsae]
MAVMLAKLHQQQGSDIDSGGEGGGRASLPDSPIPSASAFTTTLAASGGLNLDDEFFAIPSSEDSPRKLLYFIGLVDILTYYGVKKRTEMAAKTVKYGSSAENVSTYAKRLLEFVNRNVVCPTQQSSSTADAFSPLTIADPPPSQRQIGRTELM

SEQ ID NO: 135711 - protein, 75 aa, Heterodera glycines
  Coding regions on vcDNA: vcDNA=SeqID_62134; Strand=-; Position=1 -100,145-272
  Homolog annotation: Hit_ID=A26892; Match level="QueryCoverage=93%, HitCoverage=50%, E-value=2e-10, Identity=51%"; Hit description=Mopa box protein - mouse (fragment) gb|AAA39860.1| mopa protein
MSSAQPLQMRQQTAQMGGFAHNQQQMMQQQQQNMQQMHPQQQQQQMGMLNAQQQFMMAQQQQQQRAMNQQQHRQY

SEQ ID NO: 135712 - protein, 38 aa, Heterodera glycines; identical to SEQ ID NO: 130624
  Coding regions on vcDNA: vcDNA=SeqID_62135; Strand=-; Position=1-160

SEQ ID NO: 135713 - protein, 135 aa, Heterodera glycines
  Coding regions on vcDNA: vcDNA=SeqID_62136; Strand=+; Position=1 -178,383-612
MEILNKLKSEKRKKAYNTFDSQDVSVPSTKKAQRCLTCQIGRDGVLSTWYGRKRKESNEKAVPAEKKTKNFSKKAKKIENLNKFTSEKRKKAYNTFDSQDVSVPSTKKAQRCLTCQIGRDGVLSTWYGRKRKESN

SEQ ID NO: 135714 - protein, 48 aa, Heterodera glycines
  Coding regions on vcDNA: vcDNA=SeqID_62137; Strand=-; Position=1-354
TFSNFHLINLRRILPFLINSLVKRQKNSSFKYAYLNYFHCFPFAYDHT

SEQ ID NO: 135715 - protein, 51 aa, Heterodera glycines
  Coding regions on vcDNA: vcDNA=SeqID_62138; Strand=-; Position=1-359
NRRCCKLFFLFSLVNLFKFSIFSFFSKNFLFVFFSAGTASDNVFYLFRKIN

SEQ ID NO: 135716 - protein, 35 aa, Heterodera glycines
  Coding regions on vcDNA: vcDNA=SeqID_62139; Strand=-; Position=1-107
LPFLINSLVKRQKNSSFKYAYLNYFNCFPFAYDHT

SEQ ID NO: 135717 - protein, 136 aa, Heterodera glycines
  Coding regions on vcDNA: vcDNA=SeqID_62140; Strand=-; Position=1-409
MDTFETKEKFIEVEEEIGKVSNHMERYETFTKVRFGKIVEKMKEEVRKITENLDALKGRVQLLEFEQDNPEGFGEWFDDGQSQEHNRLPDDKGATEGEDNIPIGDGSCEIMVADPFLGGITPLERVMMETQVYHSH

SEQ ID NO: 135718 - protein, 660 aa, Heterodera glycines
  Coding regions on vcDNA: vcDNA=SeqID_62141; Strand=+; Position=1 -162,221-509,667-1340,1625-2207,2254-2528
  Homolog annotation: Hit_ID=CAE56395.1; Match level="QueryCoverage =40%, HitCoverage=36%, E-value=7e-42, Identity=36%"; Hit description =Hypothetical protein CBG24082 [Caenorhabditis briggsae]
MRVPRSNAHYIFLMRAPNDMLSIRNLASQMFPREQGFLMDAYRQACALPYGYLLTTRRESFLPPKMVKREQKIGERVVHNYDYLKKLGKTTSEKKRRHLLNSAGCEELLTLVEICLNVLNGSFCLSRKQKQRLEPFAKDIRQLARVRSERARETKNDDDIAERTNLGFVKRQVTAAVQKRKGNVSERNAMYNQQLRRYLKMRKEHKERPVRVQLSNGAQLLNKTVETGVQVRPGPDEPKDKSVMVTDEDEEEEIEVPKFLTPTSQTQGSRRSPRTNKKAAKQQKLIEKKDHLLAIIMSDPQRFGATDRGKIINPKTGREFIDSDLAWSIERLVDPRPENAPSPSGTKELKRKLAQNPLASSLLNRLFVGSGFVGQGSDVQADLADFQALSRKNSGYRYLLLAVDVLSRRMFGAPVKSKRPVDMKRAFEELFEQMPRVPDTLYTDCGLEFVAKPLKEFYAEKGIQKFETSSKKKAAVAERAIRTLKTRLYKYFSSNNTSVWVDVLPKFLSAINNSVCRATGLRPREISDTNAREVWKRVYGEGLVQSNKTPKIRAGETVRIPEPKHIFEKGYIPNYSDHVYTVDEARSTNPQHYLLKDYYGTKLKRKFYLPELTKVQVDESTMYRIEKKYKEQVRDGKREMLVKFIGFPEKYWVTNEEINE

SEQ ID NO: 135719 - protein, 110 aa, Heterodera glycines
  Coding regions on vcDNA: vcDNA=SeqID_62142; Strand=-; Position=1 -68,322-586
MDHLCCANPLAGIAEKGVWPCTSRTQGVRTVAAQQRNGGGRVQAQGARHHARLGCLRAHNFREDEGHGEEQAGTAGQQRPLQLPNEELSDHQEGRDFHRPLGQAVQPDRE

SEQ ID NO: 135720 - protein, 270 aa, Heterodera glycines
  Coding regions on vcDNA: vcDNA=SeqID_62143; Strand=+; Position=1 -172,661-846,1076-1530
MKIIFISIFLIVFSSTTKNVRGVLIGGNINNRGTQIVGRVTVNGPSKDDIGRNINNGGFSEKFNRNDSDNEDTAEGNSSNDSEIEKGAKAKGVRHNSKNKGISESSRGSGDFGHWKGWKDFDQKFNHKDSDSEDDESNSSNDSGGGDVQEKTGQPTRNYWKYLKKVPVPFLNTFRNSFKGNSEHVAGEERPSRENVLVPNINTGGGSQHIAPVNFGEGAKGNQVGGNYCSGGSQNIAPVNLGAGLNLARVGNNKNSGGKQTIGAVTIRRS

SEQ ID NO: 135721 - protein, 77 aa, Heterodera glycines
  Coding regions on vcDNA: vcDNA=SeqID_62144; Strand=-; Position=1-230
FPTIPTHWYEEKANEHKQNTVKQREQKTRAGGARPVGWSNWEKERSERRNERDSQPKEWTKNASEWHREGQQRDIGR

SEQ ID NO: 135722 - protein, 60 aa, Heterodera glycines
  Coding regions on vcDNA: vcDNA=SeqID_62145; Strand=+; Position=1 -130,385-437
MAEQFAQPETQEHQVKEAKEARVDDRFLWKITRGQFMFAIRLKGRRDQRAQTGPSGKGAG

SEQ ID NO: 135723 - protein, 35 aa, Heterodera glycines
  Coding regions on vcDNA: vcDNA=SeqID_62146; Strand=+; Position=1-108
AAGPGGPAEHRTGPPSSGAFVHWLTNWGAIDLVAE

SEQ ID NO: 135724 - protein, 125 aa, Heterodera glycines
  Coding regions on vcDNA: vcDNA=SeqID_62147; Strand=-; Position=1 -33,780-822,887-954,1317-1430,1537-1641
  Homolog annotation: Hit_ID=CAE68703.1; Match level="QueryCoverage =95%, HitCoverage=19%, E-value=1e-39, Identity=65%"; Hit description =Hypothetical protein CBG14624 [Caenorhabditis briggsae]
KKKGTEIFYFQPLDAHSLLRPEAFEAWFYMYRLTGDKQYQDWGWDAFQAIERYAKRSNGDGYASVQNVKRIPVQHRDLMESFFLAESLKYSLKYLYLLLSDDQQMLSLDQWVFSTEAHPLPIRTF

SEQ ID NO: 135725 - protein, 51 aa, Heterodera glycines
  Coding regions on vcDNA: vcDNA=SeqID_62148; Strand=+; Position=1 -24,296-427
MPRDEAENVRHCCCCCFTPLNILRTHQLFMLNTSNIEPYYNTLAKQHLVCS

SEQ ID NO: 135726 - protein, 94 aa, Heterodera glycines
  Coding regions on vcDNA: vcDNA=SeqID_62149; Strand=-; Position=1-285
MPKITDTTMTSSMTAARLPKRTLAAIRVHPTVSSSPMPCRKMSRPTMCPMSTQPWFWVYKNDGSTTATTMATTVFVGELGGVVVVVNCRQKCRE

SEQ ID NO: 135727 - protein, 25 aa, Heterodera glycines
  Coding regions on vcDNA: vcDNA=SeqID_62150; Strand=+; Position=1-77
SKSSLTTAQKNMFFVRFRPRGAQEK

SEQ ID NO: 135728 - protein, 23 aa, Heterodera glycines
  Coding regions on vcDNA: vcDNA=SeqID_62151; Strand=+; Position=1-71
MPLAAARHRNGAKDGGAAHLYTP

SEQ ID NO: 135729 - protein, 91 aa, Heterodera glycines
  Coding regions on vcDNA: vcDNA=SeqID_62152; Strand=+; Position=1-276
SARGSSDWRRQRAAIRARQRRQRQWAPRTEATATTMARATIAATAETEEVSGDCPVVVVGDGISAADAVLHCLSIEQPVLHIVRRTERELR

SEQ ID NO: 135730 - protein, 129 aa, Heterodera glycines
  Coding regions on vcDNA: vcDNA=SeqID_62153; Strand=+; Position=1 -366,623-646
MVMVPESEYLALINLLKGSSGVSPPLADPLQGEKTLLDVQIQRNLADPKTNAEIKMKRHSWLYKRRHQLKDIIENKPQKVIVESGSVTAPNVAPYMGIQKQQTPSNVNAQHRNSTSIQSYGGALISPNR

SEQ ID NO: 135731 - protein, 26 aa, Heterodera glycines
  Coding regions on vcDNA: vcDNA=SeqID_62154; Strand=+; Position=1-80
MKASFGRWADRMKECFGDGTFSLAPP

SEQ ID NO: 135732 - protein, 101 aa, Heterodera glycines
  Coding regions on vcDNA: vcDNA=SeqID_62155; Strand=+; Position=1 -3,837-1139
MVAPQREQSVDDSGGPSAAETVPLIEHQLLMTDQDQLNNNIVQQQNLYQQHQHNFVAPSILVSSSSMEKSASAQDLAGTAAALIRRHRSASKVWTQQITEY

SEQ ID NO: 135733 - protein, 112 aa, Heterodera glycines
  Coding regions on vcDNA: vcDNA=SeqID_62156; Strand=-; Position=1 -99,662-898
  Homolog annotation: Hit_ID=NP_496987.1; Match level="QueryCoverage =91%, HitCoverage=11%, E-value=2e-17, Identity=45%"; Hit description =IMportin Beta (imb-2) [Caenorhabditis elegans] emb|CAB05586.1| Hypothetical protein R06A4.4a [Caenorhabdi
MFLYDGTQQWPELLPTLCQFLDQNQQHDANVFEGTLGALQKICEDSADRLSHEEINQVVARVLPFFNSQLARLRALSVSTVNCILLVQNESISAVIDPFLECLFRLANDQDQ

SEQ ID NO: 135734 - protein, 51 aa, Heterodera glycines
  Coding regions on vcDNA: vcDNA=SeqID_62157; Strand=+; Position=1 -142,335-348
MKWKKEFGMSWKITEKEKMNKMKMYWQIKGENQKISDENIAKMLKISEADP

SEQ ID NO: 135735 - protein, 299 aa, Heterodera glycines
  Coding regions on vcDNA: vcDNA=SeqID_62158; Strand=+; Position=1-898
  Homolog annotation: Hit_ID=AAG00551.1; Match level="QueryCoverage =100%, HitCoverage=94%, E-value=1e-53, Identity=33%"; Hit description= retinitis pigmentosa GTPase regulator [Homo sapiens]
ERKKKRGGGTTDEKQTEGESDEKQTEGESDEKQTEGKSDEKQTEGESDEKQTEGKSDEKQTEGESDEKQTEGESDEKQTEGESDEKQTEGKSDEKQTEGESDEKQTEGESDEKQTEGKSDEKQTEGESDEKQTEGESDEKQTEGKSDEKQTEGKSDEKQTEGESDEKQTEGESDEKQTEGESDEKQTEGESDEKQTEGESDEKQTEGESDEKQTEGKSDEKQTEGESDEKQTEGKSDEKQTEGESDEKQTEGESDEKQTEGKSDEKQTEGESDEKQTEGESDEKQTEGESDEKQTEGKS

SEQ ID NO: 135736 - protein, 66 aa, Heterodera glycines
  Coding regions on vcDNA: vcDNA=SeqID_62159; Strand=-; Position=1 -86,223-337
MRDVVVQRSGTVPGFCIRHQIYDSSVSYEVSGSLTDYEYDIHFDKFRKSGPEFEQTSRIFKVMLEL

SEQ ID NO: 135737 - protein, 40 aa, Heterodera glycines
  Coding regions on vcDNA: vcDNA=SeqID_62160; Strand=+; Position=1 -45,237-314
MGYGNPSLFLLLWLPHEKKNIISFLKKKFYYPFFVHYLAH

SEQ ID NO: 135738 - protein, 47 aa, Heterodera glycines
  Coding regions on vcDNA: vcDNA=SeqID_62161; Strand=+; Position=1 -78,290-355
MCHQIGETRRPLLLCGCQREMPPPQMLFCPQQSRFEFSLILLMQKRK

SEQ ID NO: 135739 - protein, 97 aa, Heterodera glycines
  Coding regions on vcDNA: vcDNA=SeqID_62162; Strand=+; Position=1 -166,220-347
MYYCFGVTVQQDYDQQMEMVLVPFTTVLNKPKYQAIVAQLNTMPKSAADCATFGYDVFLVDPLIEYAKHFALEGMFKAYKKVQFNFCQFSKRNEAKY

SEQ ID NO: 135740 - protein, 103 aa, Heterodera glycines
  Coding regions on vcDNA: vcDNA=SeqID_62163; Strand=-; Position=1 -153,625-783
MAPKIGIRVGLFFLLPSLLLLPSAGNAQYYSPPMMTGSGCVATGNKLYSHGKVDDAYASLEQAVQRNSTTLPTIPPRPQLPTFCTSNQVPILGTLSSRIFVYK

SEQ ID NO: 135741 - protein, 103 aa, Heterodera glycines
  misc_feature (13)..(13): Xaa can be any naturally occurring amino acid
  misc_feature (17)..(17): Xaa can be any naturally occurring amino acid
  Coding regions on vcDNA: vcDNA=SeqID_62164; Strand=-; Position=1 -59,243-331,647-730,1108-1189
  Homolog annotation: Hit_ID=AAH68717.1; Match level="QueryCoverage =83%, HitCoverage=90%, E-value=2e-39, Identity=73%"; Hit description =MGC81158 protein [Xenopus laevis]
SADCKLSLCQCFXSIFXSKLFAIKRWNLVSTWSWDVECDTCAICRVHLMEACLRCQADSKAQECVVIWGECNHCFHLCCMSWVKQNNRCPLCQSDWAVQRVGK

SEQ ID NO: 135742 - protein, 159 aa, Heterodera glycines
  Coding regions on vcDNA: vcDNA=SeqID_62165; Strand=+; Position=1 -54,146-345,411-636
MRGLQIPANLHNLSERYQLAENIRTGRQLAPTFLFHFINICGSVFTPFVVYFHLITDPILLNLIVFTYYSVLSLSNALIELTLMRRHQILKKNALKILAKFLPNRCFSNNRITDSGKSQKMVQRIDGQKRWEKPQQKRDNKSNEMTEMHFKKLKEQWQK

SEQ ID NO: 135743 - protein, 33 aa, Heterodera glycines
  Coding regions on vcDNA: vcDNA=SeqID_62166; Strand=-; Position=1-176
GLKLFLTFFSFSFIRQKSIIKWSNDYQNDQFHF

SEQ ID NO: 135744 - protein, 153 aa, Heterodera glycines
  Coding regions on vcDNA: vcDNA=SeqID_62167; Strand=+; Position=1 -293,565-724,1186-1194
  Homolog annotation: Hit_ID=NP_499173.1; Match level="QueryCoverage =76%, HitCoverage=23%, E-value=4e-26, Identity=47%"; Hit description =suppressor of bimD6 (58.6 kD) (3K892) [Caenorhabditis elegans] emb|CAA80180.1| Hypothetical protein ZK632
MATKSGTVQEVEEEQDEGRQQIVGLSADETAEHLAPPAERQKMPTAAARQTHFAVKVYRATLAGFRNRAEYVKDDFRFKNPRRVMKIWAEKEFLNLKRLKNANIMCPTPIKLRKHVLLMSMVGETYPAPKLKELEWVDDAMRRDAFERVRRGH

SEQ ID NO: 135745 - protein, 98 aa, Heterodera glycines
  Coding regions on vcDNA: vcDNA=SeqID_62168; Strand=-; Position=1 -193,286-389
MAARHFKKKTPKEELPKGAAEGDGEGTTERMPSTTEEAEDLEEDEEERHNATEAGNSVVNTHYCYLESPFNDDLFAIMVIESYCPRIVFSNFSRTAGI

SEQ ID NO: 135746 - protein, 18 aa, Heterodera glycines
  misc_feature (13)..(13): Xaa can be any naturally occurring amino acid
  Coding regions on vcDNA: vcDNA=SeqID_62169; Strand=+; Position=1-55
LFYVRKIAKYVNXICIKN

SEQ ID NO: 135747 - protein, 52 aa, Heterodera glycines
  Coding regions on vcDNA: vcDNA=SeqID_62170; Strand=+; Position=1 -7,229-380
MKREFNPILRGVKVVFRAKMRNAKAKVPKKRNMRMRNANAKRESESLSLIST

SEQ ID NO: 135748 - protein, 62 aa, Heterodera glycines
  Coding regions on vcDNA: vcDNA=SeqID_62171; Strand=+; Position=1 -141,837-884
MVIRRGTKVIIRGTTVIRRGTMVIRRGTKVIIRGTTVIRSGTTLLGENFWNNFFHIDVRKPK

SEQ ID NO: 135749 - protein, 132 aa, Heterodera glycines
  Coding regions on vcDNA: vcDNA=SeqID_62172; Strand=+; Position=1 -76,155-266,311-400,452-572
MDSTKPIVFLKVSLKGKPATVVGRVDTKTSVLSKAFASKIGDIDSNLRGHVTLPTADVPVVGWVDDVSVALLNAEPYVFAQRFGVVADHHMIAFCERKVDGVFGADLLKRMGILNEEQIDAIPLASGDVPEE

SEQ ID NO: 135750 - protein, 161 aa, Heterodera glycines
  Coding regions on vcDNA: vcDNA=SeqID_62173; Strand=+; Position=1 -25,314-436,704-838,1106-1204,1409-1512
MSTNSQKYVSVEQFQNGQKALLERIGELEKQLKERPHKQEEETEPMAKKALVDEQFAQLQNGQKAILERIGELEKQLKDRPHKQEEETEPMAKKALVDEQFAQLQNGQKAILERIGELEKRGQPDNYVSVDQFKRRIEAIETFFYASICWGCCLNLKNKNT

SEQ ID NO: 135751 - protein, 96 aa, Heterodera glycines
  Coding regions on vcDNA: vcDNA=SeqID_62174; Strand=-; Position=1-612
FVAFIYFFFLLPNFLPIFLQVSLFSFLLQFQFVQLKVKNQTINIYSNEKNKYEEQLSEKLAFIMINHLSLLNNSFTSHFQTNFLCSFDPPFVETMA

SEQ ID NO: 135752 - protein, 27 aa, Heterodera glycines
  Coding regions on vcDNA: vcDNA=SeqID_62175; Strand=-; Position=1 -57,511-537
MLRSFSRLTGAGECDSFAYIKANNFIH

SEQ ID NO: 135753 - protein, 79 aa, Heterodera glycines
  Coding regions on vcDNA: vcDNA=SeqID_62176; Strand=+; Position=1-544
GKVNVKYIIGQIQNMMLKHRISGSFLRIEFSYKKKQLHFLPFLFDFLVKKIIETEQLFFSSYFLPMFEWFYFLVYKILN

SEQ ID NO: 135754 - protein, 162 aa, Heterodera glycines
  Coding regions on vcDNA: vcDNA=SeqID_62177; Strand=+; Position=1-489
MEHLADLRTVRRTLEDVEKLSQLSSGTRSGTGDSLPAGDDLAIRRTPPAQQIHDPTDHQSDEWLFGQFPRRFEQLNIQEGRRAVTPVMRSVAQVAQYPVLNAGGAGANIREWVNQASDRRERRQAHPGLRKASSSPSLLKGGIPSQEGCRGLPSFGRELSRE

SEQ ID NO: 135755 - protein, 421 aa, Heterodera glycines
  Coding regions on vcDNA: vcDNA=SeqID_62178; Strand=-; Position=1-1266
MGENIEKIRPKYRNIQNPLILKAGALFESDNVRFEETIREYRSKMNNLHTPILRLVEKPNITEAIKLVKSEANETLGVIIGRSGDWLEIVKKIPEKTKEAISYLKGLSYALIAIPLLILLVLMGYIGIKYRLIIFAGVRAGSVLARVLRAIMGTKKRSTRVLAVPTAPELDSIDEEAYVLDYLPPRRVAAITNDPRRLPSISVRLNDLLTAALVDSCASVSYCRERTARKAGLKILEQNDGKGNLTAANDSSIEILGKTMAKLRIEDNVTGNVREWEVVLLVSVDEHCPGPLLIGLPLLMELKGVISLGEKRVRLGDVWTNIVSVIGSEKPKPPSVILEKTEVLEPRSENILSAKVNECFPMEQNFLVKGIKLKYPGIIVGRTLVSPGNSKNVTIQILNAGNSAVKLYGKSHLADFGNRSN

SEQ ID NO: 135756 - protein, 63 aa, Heterodera glycines
  Coding regions on vcDNA: vcDNA=SeqID_62179; Strand=+; Position=1 -91,675-775
MLIKKGSNTKLIRSLLHGDLISPFWRLGTRENVRNILSKWGIEPRRKIMKGRKFNHYTTCACV

SEQ ID NO: 135757 - protein, 17 aa, Heterodera glycines
  Coding regions on vcDNA: vcDNA=SeqID_62180; Strand=-; Position=1-68
HKHLFDLFYHIHNLIKI

SEQ ID NO: 135758 - protein, 25 aa, Heterodera glycines
  Coding regions on vcDNA: vcDNA=SeqID_62181; Strand=+; Position=1-75
TCTCGVVVKLSTFHNFSPGFNSPLG

SEQ ID NO: 135759 - protein, 39 aa, Heterodera glycines
  Coding regions on vcDNA: vcDNA=SeqID_62182; Strand=+; Position=1 -42,298-375
MELARERLAKEQETLKERQIEEEQRGKTSQLNFNQSMAF

SEQ ID NO: 135760 - protein, 68 aa, Heterodera glycines
  Coding regions on vcDNA: vcDNA=SeqID_62183; Strand=+; Position=1 -87,160-279
MSQMMASENKGLREEKGALEEKLNELRQRLHAKDSRVHRLAELLGEFLEKYRQNAQRARHQIGRQTEE

SEQ ID NO: 135761 - protein, 46 aa, Heterodera glycines
  Coding regions on vcDNA: vcDNA=SeqID_62184; Strand=-; Position=1-139
FEYPKRTLEKIDFFVFGAVPPSRCAQIYGETESFRNSFPIACTLIL

SEQ ID NO: 135762 - protein, 29 aa, Heterodera glycines
  Coding regions on vcDNA: vcDNA=SeqID_62185; Strand=+; Position=1-90
NGTFTSKNDCHGDELQKKITSQEQATIAV

SEQ ID NO: 135763 - protein, 110 aa, Heterodera glycines
  Coding regions on vcDNA: vcDNA=SeqID_62186; Strand=+; Position=1 -138,556-711,954-994
CLPRLLPRHYTLCCYLSAQPHKQQQLRFRFVYSVLQMPPSVIIDEYHPKGAVQIPLFAPSFVPSPASMPSPDSTMVDQPDHALLLLNMPLMMVGPGTGISCNEWAAIVDE

SEQ ID NO: 135764 - protein, 99 aa, Heterodera glycines
  Coding regions on vcDNA: vcDNA=SeqID_62187; Strand=-; Position=1 -21,591-869
MPDRTGLTLCQIDIFKEKRTNVKVFWLRPSRTGSGQKFAGPDRIGIFKNDRIRDPVSHNPVNLCNPVNPYFSKKSPDRIPDPGKSGTGSGPVRSLINIL

SEQ ID NO: 135765 - protein, 41 aa, Heterodera glycines
  Coding regions on vcDNA: vcDNA=SeqID_62188; Strand=+; Position=1-123
MILSFLPILIAFIAHFRLFSCLSPKGEKLTDKTEKEIPLQI

SEQ ID NO: 135766 - protein, 136 aa, Heterodera glycines
  Coding regions on vcDNA: vcDNA=SeqID_62189; Strand=-; Position=1 -148,615-712,765-929
  Homolog annotation: Hit_ID=CAE62006.1; Match level="QueryCoverage =99%, HitCoverage=17%, E-value=1e-52, Identity=73%"; Hit description =Hypothetical protein CBG06014 [Caenorhabditis briggsae]
MEDPSNRNRLAKLLRFHSSADSAKQTTLEAYVERMKEKQQAIYYIAGSSREEVENSPFVERLLKKGFEVLYLTEPVDEYCIQSMPEFEGKKFQNVAKEGLKLDEGSKSEEQHKLLEEQFKPLCDWLKEKGLKDRVS

SEQ ID NO: 135767 - protein, 25 aa, Heterodera glycines
  Coding regions on vcDNA: vcDNA=SeqID_62190; Strand=+; Position=1-77
CFMSKVNGIIYALWIKGPSINSEAC

SEQ ID NO: 135768 - protein, 152 aa, Heterodera glycines
  Coding regions on vcDNA: vcDNA=SeqID_62191; Strand=+; Position=1 -115,352-548,632-742,857-892
  Homolog annotation: Hit_ID=CAB66341.1; Match level="QueryCoverage =96%, HitCoverage=91%, E-value=2e-44, Identity=57%"; Hit description =putative amphid protein [Globodera rostochiensis]
MANKLQFSLFVVLVLCYGSTAFPRLNQQQQHKQKQKHGENDGKQQQMARRVPFPHPGQAPEYFQEASDKAQMEYKQIFEDEKGQMPKGELKEKLKKWAENNGIKDEYEMSQEENEQKKESFHKIMSANLGGDALKVFKKIWEITHTDELSRQ

SEQ ID NO: 135769 - protein, 58 aa, Heterodera glycines
  Coding regions on vcDNA: vcDNA=SeqID_62192; Strand=-; Position=1 -126,409-459
MNSDMDCDELTKQCIEDGGKPSKCGKCRGQRDIPCNHMESDQRSPVQMKCHWTDCASV

SEQ ID NO: 135770 - protein, 52 aa, Heterodera glycines
  Coding regions on vcDNA: vcDNA=SeqID_62193; Strand=+; Position=1-159
FFIFFFFNLITQRSRLIRSSPNFAGKLLRTLQMLINFLRIFCLEEHSSSHLP

SEQ ID NO: 135771 - protein, 40 aa, Heterodera glycines
  Coding regions on vcDNA: vcDNA=SeqID_62194; Strand=-; Position=1-120
SPAVSLMFRRCGRLLCSLQLLKWVQLRDQCRHVQQPCDAR

SEQ ID NO: 135772 - protein, 48 aa, Heterodera glycines
  Coding regions on vcDNA: vcDNA=SeqID_62195; Strand=-; Position=1 -83,334-397
MILLLKPLIVQPNVRYHSFFIRTSRLYRTQRIGCPTAAHQVVVGTQTG

SEQ ID NO: 135773 - protein, 146 aa, Heterodera glycines
  Coding regions on vcDNA: vcDNA=SeqID_62196; Strand=-; Position=1 -234,484-690
MLVGGGKATTNLTDSSGDDERQRKESPPQSHGLTSFPETLNSTNFDEKEMKDVQLYDENTPTSFDGKKDESQNEGGTEESLAVSINGQFGKTVVIHATDEDPSETFERLKEACINATLPYKDIIDSLFNTVRNGSIILSRKLQSNA

SEQ ID NO: 135774 - protein, 48 aa, Heterodera glycines
  Coding regions on vcDNA: vcDNA=SeqID_62197; Strand=+; Position=1-145
MKIWPYKTTVECVSCHCGRRVRSHSRDGHVGHGLEENGHNTLMAFLLD

SEQ ID NO: 135775 - protein, 159 aa, Heterodera glycines
  Coding regions on vcDNA: vcDNA=SeqID_62198; Strand=-; Position=1 -87,200-328,399-533,581-694,1013-1027
MSAVVQSNNALALPTRLKQPLSPPPQIAQDFGSVDGRQLVAFVRKTNESGETAVLPVDAISFLRRLVAQFGGHHLEPDDLFLGTLPTADNRAMALECLQMDDDDTHSQQTKHSRAKEVIDRLGLVANCRHVFAGSNKWVKTRFFNFQLTLVFRISKKIS

SEQ ID NO: 135776 - protein, 42 aa, Heterodera glycines
  Coding regions on vcDNA: vcDNA=SeqID_62199; Strand=-; Position=1 -56,163-233
CCAPPQSCCALPGRTYVPSQLAWTVRIWPTYPNKKNQAHPGT

SEQ ID NO: 135777 - protein, 22 aa, Heterodera glycines
  Coding regions on vcDNA: vcDNA=SeqID_62200; Strand=+; Position=1 -21,90-137
MARKFQKANREFLGLSNNTKNV

SEQ ID NO: 135778 - protein, 42 aa, Heterodera glycines
  misc_feature (17)..(17): Xaa can be any naturally occurring amino acid
  Coding regions on vcDNA: vcDNA=SeqID_62201; Strand=-; Position=1-129
VRNTTSKYTIPPEYTSXWLIKTPFDQLLLLLILFFLQNLNYK

SEQ ID NO: 135779 - protein, 38 aa, Heterodera glycines
  Coding regions on vcDNA: vcDNA=SeqID_62202; Strand=-; Position=1-114
MAKVPQISIVSPAKIKQMEKGDQQIGEEGKKGTEAQIE

SEQ ID NO: 135780 - protein, 62 aa, Heterodera glycines
  Coding regions on vcDNA: vcDNA=SeqID_62203; Strand=-; Position=1 -30,413-571
MGARTKEKRLKVSPTFAHFGALSGHLEVPVMLFSPGKYPHGFLGPGRAMWTEDGSEFVDFLT

SEQ ID NO: 135781 - protein, 192 aa, Heterodera glycines
  Coding regions on vcDNA: vcDNA=SeqID_62204; Strand=+; Position=1 -100,162-339,905-1133,1185-1255
  Homolog annotation: Hit_ID=AAH75452.1; Match level="QueryCoverage =89%, HitCoverage=54%, E-value=2e-20, Identity=34%"; Hit description =UDP-Gal:betaGlcNAc beta 1,4- galactosyltransferase, polypeptide 3 [Xenopus tropicalis] ref|NP_001006719.1|
MQQLMAYQIVVVNQAFPAGNETKDRFNRAKLLNVGFVEMLKQFCNHSAQCWDCVVFHDVDFVPENITNIYQCDRNAPKRLISATDEWDNYKYEFKLANKSVLFVHGPIGHYKSIELAHKDNDTTNAEMDCACRQLLINNLSNTWKMDGLSSLNYAHLSTTDEILYTNITVDLLMDESLKKGHPCGKKINGIY

SEQ ID NO: 135782 - protein, 24 aa, Heterodera glycines
  Coding regions on vcDNA: vcDNA=SeqID_62205; Strand=-; Position=1-80
RTLSTAVRQRSSKIYSMPQILWAG

SEQ ID NO: 135783 - protein, 24 aa, Heterodera glycines
  Coding regions on vcDNA: vcDNA=SeqID_62206; Strand=-; Position=1-80
RTLSTAVRQRSSKIYSMPQILWAG

SEQ ID NO: 135784 - protein, 65 aa, Heterodera glycines
  Coding regions on vcDNA: vcDNA=SeqID_62207; Strand=+; Position=1-195
MVVTPGGTSDNYCSSAAELEQYAEDGGDDCGDGDNDGGDSVIVHRRCSSGLSTEIVNDAMANAIR

SEQ ID NO: 135785 - protein, 24 aa, Heterodera glycines
  Coding regions on vcDNA: vcDNA=SeqID_62208; Strand=-; Position=1 -22,71-123
MIAAVPFDLLLVETDSDEVSIFNF

SEQ ID NO: 135786 - protein, 697 aa, Heterodera glycines
  Coding regions on vcDNA: vcDNA=SeqID_62209; Strand=+; Position=1-2092
  Homolog annotation: Hit_ID=CAB39733.1; Match level="QueryCoverage =84%, HitCoverage=50%, E-value=1e-83, Identity=31%"; Hit description =protease, reverse transcriptase, ribonuclease H, integrase [Drosophila buzzatii]
MAEVGFRLKPEKCRFALGEIRYLGHLISEKGVRIDPKDLEPIQKIKKPKNITELRSLIGVLSYFRKFIYGFAEILQPIYELTKNESTTEWGQLHEQALEELKERLMTAPVLAPPRFGHPFVVETDASTKAIAGCLLQKNKKEEIHPICYFSRVLTKHEKRYSVVELEALAICASLKNFRPYLEGAGRSTVVTDNSALTSLFRRKDLEGRLSRYQLAIMAFDVDIIHRPGKRNQFCDYLSRYLHDKTEQEVNSLKLDQKIKREEMITAQKQDKESQRICELIKNADEKGNSEGTFGRWKLFEGLLCITDRGEWKVYVPECMRQRLMSEYHSDPFQGGHLGEKRTKEKIRRSLFWEGMDKDIQNQVKNCDPCQRRKIIGVNKSVEPICPIEPAARPFERLHLDLMGPLRMTKGGFQYVLMIIDSFSKLMAAIPLREQTATIINSAFVDKFLCLFGLPKIVVTDCGTQFLSATFESLAENWGFKHQTTVPYHQSANGQVERYNRTLVDMLVTTTGGKDWASALPMLCFAYNSSINSQIGHSPFYVIHGFDPRIPSEAIFDKKEEQFSDMAIYVQELTKRMGEVRKVVQERLNKCAGRMINQQKWTKEINWMEGMLVLKTKNDKKHKLEANYEGPFRIIKIEKPNLILRALNPDDESFAAHMNQCKPYYTEPEEATEKGVGPIPKGPRKIGDRNIEESDEE

SEQ ID NO: 135787 - protein, 171 aa, Heterodera glycines
  Coding regions on vcDNA: vcDNA=SeqID_62210; Strand=-; Position=1-556
  Homolog annotation: Hit_ID=NP_921502.1; Match level="QueryCoverage =96%, HitCoverage=9%, E-value=5e-31, Identity=39%"; Hit description =hypothetical protein [Oryza sativa (japonica cultivar-group)] gb|AAP53789.1| hypothetical protein [Oryza s
HLKDIETFLKTMAEVGFRLKPEKCRFALGEIRYLGHLISEKGVRIDPKDLEPIQKIKKPKNITELRSLIGVLSYFRKFIYGFAEILQPIYELTKNESTTEWGQLHEQALEELKERLMTAPVLAPPRFGHPFVVETDASTKAIAGCLLQKNKKEEIHPICYFSRVLTKHEKR

SEQ ID NO: 135788 - protein, 249 aa, Heterodera glycines
  Coding regions on vcDNA: vcDNA=SeqID_62211; Strand=+; Position=1-750
MTEEEKEEKTKREEAQEAARKEREEVGKKANQKGPLIGADAKKLFMTTVEQPYDHGRVIGQVFDPRAEVEAPWDMTKALANREKEDEIRVKRKDEREEGWRNFVGGERRPETGNESWKERQRNEGNSGERWRERPRVVDAFARNTIWSAENDVSTNPGIPPEGFRGRRPTPNPCWNRFRKRRYMSPIRYNTEQHGVGTQTPTWPTTESSVEQLRSIRLMLDVAIAGLVQRNGKKEGEETENGEDSKGPK

SEQ ID NO: 135789 - protein, 109 aa, Heterodera glycines
  Coding regions on vcDNA: vcDNA=SeqID_62212; Strand=+; Position=1 -43,142-242,518-703
MKSEKNDVGHRGSQTEAAKKTQQSRFIVLKFSPTAVPGSVSAPCRPLQNIFINLLGIYMDLIVRMRGRQFATGTEEGTTRVCTALAELARRWTTLCAIVSTDTQVGEAK

SEQ ID NO: 135790 - protein, 163 aa, Heterodera glycines
  Coding regions on vcDNA: vcDNA=SeqID_62213; Strand=+; Position=1-490
  Homolog annotation: Hit_ID=CAH81944.1; Match level="QueryCoverage =99%, HitCoverage=98%, E-value=3e-18, Identity=29%"; Hit description =conserved hypothetical protein [Plasmodium chabaudi]
MKRGGKRRRIKGGKEESERKGRRKRRGERKEGKGGKRKDEEEEKRWRRRMKRGAKRSRIKGGKEESERKGRRKRRGERKEGKGGKRKDEEEEKRWRRRMKRGAKRSRIKGGKEESERKGRRKRRGERKEGKGGKRKDEEEEKRWRRRMKRGGKRRRIKGGKEE

SEQ ID NO: 135791 - protein, 281 aa, Heterodera glycines
  Coding regions on vcDNA: vcDNA=SeqID_62214; Strand=-; Position=1 -83,968-1729
  Homolog annotation: Hit_ID=DAA04499.1; Match level="QueryCoverage =93%, HitCoverage=19%, E-value=1e-62, Identity=46%"; Hit description =TPA: pol polyprotein [Schistosoma mansoni]
VVQEEATPEAFCRGVQLSSEIAEFFANDQTDLVSHQIATGNSAPIRSRMRPVPYAYREKVAEMIQNYLGRGIIRPSSSPWASPIVIVPKKDGTLRFCVDYRGLNSVTVKDAYPLPNIDNILLALGGKKIFSTLDFISGYWQIKMSPESIDKTAFATEFGLHEFVVLPFGLCNAVATFQRFMSQLFEGLINDFVFIYIDDILIASESWEKHQEHLKIVFERIREAGLKLKISKCHFSANELPFLGHILTTEGIKMDVNKVRPIMELPIPTSKKALQSLLGFL

SEQ ID NO: 135792 - protein, 95 aa, Heterodera glycines; identical to SEQ ID NO: 125597
  Coding regions on vcDNA: vcDNA=SeqID_62215; Strand=-; Position=1-817

SEQ ID NO: 135793 - protein, 16 aa, Heterodera glycines
  Coding regions on vcDNA: vcDNA=SeqID_62216; Strand=-; Position=1-48
MATVLWRHRRVNFPRI

SEQ ID NO: 135794 - protein, 63 aa, Heterodera glycines
  Coding regions on vcDNA: vcDNA=SeqID_62217; Strand=-; Position=1-191
MHILKSLTVIIVFVMFGWTLNGLSTFYVPLLKLSPENSISFAAGLVQLTLVASASNTPVLYVV

SEQ ID NO: 135795 - protein, 66 aa, Heterodera glycines
  Coding regions on vcDNA: vcDNA=SeqID_62218; Strand=-; Position=1 -62,370-508
MKNILSQWGIEPKRKIMKGKRSKIERNVKRYKIVLNLISFTYGLINNSIVYIGILNEFQNKLHLKF

SEQ ID NO: 135796 - protein, 42 aa, Heterodera glycines
  Coding regions on vcDNA: vcDNA=SeqID_62219; Strand=-; Position=1 -91,516-553
MCPRPWGWPSDECTRHGQPNGGRPTEKRTKKLIVLALIIRSG

SEQ ID NO: 135797 - protein, 132 aa, Heterodera glycines
  Coding regions on vcDNA: vcDNA=SeqID_62220; Strand=+; Position=1 -47,343-540,856-1009
MGQTKRLESVGRKRMGAFGSVSSYGGYGVPSPIGTGEAEEQAQADGVTAFGPGFLSNQLGEGPLRVGRDPPGEKRASKKQFGRLFGLRDGRDSAAQSDGFAGQPSAGGYKCAKPAKDVPRLSDRPKDTFAWL

SEQ ID NO: 135798 - protein, 28 aa, Heterodera glycines
  Coding regions on vcDNA: vcDNA=SeqID_62221; Strand=+; Position=1 -43,199-242
MFAFFLAYHNFIEPETVLKRTKIYLRVE

SEQ ID NO: 135799 - protein, 116 aa, Heterodera glycines
  Coding regions on vcDNA: vcDNA=SeqID_62222; Strand=-; Position=1-349
MDRIDLSQWLQQKCASDAASVHVVSRLCSNRAKVAEFTAFAFRESLKMSQQLRGHFCNLKMPTEEKGRFEEINESKQIEFIGGMSEIEIAKNKLLILVGGLHFIRFEEEFPEVLRI

SEQ ID NO: 135800 - protein, 348 aa, Heterodera glycines
  Coding regions on vcDNA: vcDNA=SeqID_62223; Strand=-; Position=1 -430,730-959,1047-1125,1204-1511
MQADVITFCRWLHRQLVGERNMQILWDRMNKLFDLEHDALFVCLEEQNWDAMETILKLGRIFTKTEQFMDDEILGKKLGQSSNYEQEMLKSKWEKAIGQKGDEKGGEKATKMEGWNKFLNKIHQAEIFGLMGRHEHIMDKFREFYTEEIFSRFSLFVKISEFINEWETLYGMDEHKKNAKRNKTGKIGKIGKTEKSESEKEIEEEKIAKSNNSKGRQKEKNQNFGCPDRKTPSELSPFNEENFILKADQSLASDFIEFFQVENDDAQIIMNKIGQCFSIELSTILWALTNFLQQMEKEMEKGFTNQSKSVQICVAYHLIEYTVKSEAKTLDQWRQSLLYEEFIIDEAS

SEQ ID NO: 135801 - protein, 228 aa, Heterodera glycines
  Coding regions on vcDNA: vcDNA=SeqID_62224; Strand=-; Position=1 -20,501-861,1037-1342
MQCFLPCDNLEKEDSIITDYKKYLSKPIIQGMVVVHVEKLLFYAEDDSHKIFEIQAVNWHFQALAMEIVEEALPNLNIAKLDEEHKKIVAKNGKMKGIDGTKKALCYHYNFVEEIVANGYKLAKDKTVNSFDTFEVPTIKWLDIICNSKDEYEKTVEELSSSEQKLSIIHAENLARAIRKSEQFRHFLCSKDMDDLQIIVKPRIEKLVGTLELMRLEEQFPEHLRIGI

SEQ ID NO: 135802 - protein, 157 aa, Heterodera glycines
  Coding regions on vcDNA: vcDNA=SeqID_62225; Strand=+; Position=1 -299,783-957
MQNLLPAEADDGRDNNPIRDIRRRVHFSDRSQRVLDDSDHLLKSIRTRRAAPLATSMSMSTLPTSLERNGDQSLQDHARKTLIRAQRSVSPEEPLLSASTSRYLQHTPKFPRIDFDDWIEEETQAKKPAWKVLQENVKSSYNKVRNVVAHKTISLIL

SEQ ID NO: 135803 - protein, 37 aa, Heterodera glycines
  Coding regions on vcDNA: vcDNA=SeqID_62226; Strand=-; Position=1 -55,211-269
MQSGGDSPDNAVLMIASKRDNYRREQRSTPNIGNELA

SEQ ID NO: 135804 - protein, 114 aa, Heterodera glycines
  Coding regions on vcDNA: vcDNA=SeqID_62227; Strand=-; Position=1 -153,227-282,331-464
LGYVIGSSATSLAKSALGSVDCPFCWQWGIRVTPLLGFFCIITLLIFVKEPVRGQSEQSVAQLMPTNYETGTISPSSRRTVASAEAPNENIWKEYYHRIRTHTKSYCADIGHLI

SEQ ID NO: 135805 - protein, 112 aa, Heterodera glycines
  Coding regions on vcDNA: vcDNA=SeqID_62228; Strand=-; Position=1-339
MNYYFLADLRNALADLRNALADLRNALADLRNALADLRNALADLRNALADLRNAHSGGFTKRPRWRIYETPIVAEFTKRPSTISNGQTKCVFLLLSEAVERSVIKINIYSCE

SEQ ID NO: 135806 - protein, 277 aa, Heterodera glycines
  Coding regions on vcDNA: vcDNA=SeqID_62229; Strand=-; Position=1 -293,490-1028
  Homolog annotation: Hit_ID=AAK30600.1; Match level="QueryCoverage =100%, HitCoverage=58%, E-value=2e-11, Identity=27%"; Hit description= fibroin 1 [Euagrus chisoseus]
ATNLAAATALATSAAAAAAAASSTSSSCANNSNSNSTAQQQQQQHSHSMKSIEQQMMLLQQTMALGGLGNSSGGTASSMMNHPYASFLYQQNPAELFDIKNGQQQSLFGTVASGGGGTSNTTNSLSASALLSSVTQQQQHNQQQHQASSSAMVEQQAIAALAAAAAAAGFPSIGSMVPSAAATTGGGGIAKSGASASAADMNALSSAAAALNSADLYLAAMASSFQSLIGGGSGGNAAAAAAACANPSAMANNIFMPNQQQHVRNSAAAMATNPASA

SEQ ID NO: 135807 - protein, 24 aa, Heterodera glycines
  Coding regions on vcDNA: vcDNA=SeqID_62230; Strand=+; Position=1-76
ITGVSIIAVLFLVFLMPSQNLVRF

SEQ ID NO: 135808 - protein, 192 aa, Heterodera glycines
  Coding regions on vcDNA: vcDNA=SeqID_62231; Strand=+; Position=1 -90,200-361,421-550,679-800,953-996
  Homolog annotation: Hit_ID=CAE68348.1; Match level="QueryCoverage =100%, HitCoverage=22%, E-value=2e-50, Identity=51%"; Hit description= Hypothetical protein CBG14081 [Caenorhabditis briggsae]
YVFLFCLAHFMHGVGATPLYTIGVSYIDENVGPLLSSLYIGVFYAFAIFGPAIGFFASSKFLLWHTDFLVWPKITKIVWKASAYETDPKWVGAWYLETDPKWVGAWYLGFLLASILGLMAVFPTLIFPKLLPESLKWHRTRLQEETLGQKKRSPECCGIPPSAIEQQSFLALGAPILMSSALKPRSGPIWYQ

SEQ ID NO: 135809 - protein, 1074 aa, Heterodera glycines
  Coding regions on vcDNA: vcDNA=SeqID_62232; Strand=+; Position=1 -412,461-2716,2769-3128,4501-4697
  Homolog annotation: Hit_ID=NP_507780.1; Match level="QueryCoverage =42%, HitCoverage=30%, E-value=9e-43, Identity=29%"; Hit description =predicted CDS, DNA polymerase type B, organellar and viral family member (5T899) [Caenorhabditis elegans]
MSNFNQNDFAITSVHQMRNRPRNTIGEIAEVRFAPLEEVERPDRVLERLVQRLFDRVLDGRPAPMLIGLQLHPPTFENPFTIPLRPPEQNNPAAIADLIQRLNDQSAAGIDLTGGTTVTKVLAVWPMQSDHSESGRAGACSLEEEHRLVNTVRSLIRIKNPNDRLCLARAVLLGLHDWRSRSPGGGGPTAFKSFANRQHTHGPEARNLLRRAAIPRNKHMYTIDDVQKVQDWIDQRYGPAEIRIAVFEKEREYRIVFKAASGEAAKFNLCLLFENQHFNYIGRIEQLFRVQGYCIDCERRVTRWYHPQECKVVCRLCLRFGAGYPCKQQQQQQSRADGSTGNRLCRDCQFVFPNDDCFAYHLSNQAPASMYNQGGRTFRPICEWRRACRQCGAITYANYPHKCPAQIGQTEWVRCARCSGPHQSGDPCFIQPLKDEPMRRRRRRRGQQQQQQNNNNDDEDDDDDNDGNEEGDDDHGHDADNEEEEEVGTNRSVRLCFFDAETSQDLPLQLRTKVVQKHVPMLIIAEIICEACINEGISVHSGVGQYANGCVCGPPAGPRGRRWCSPPFLNAPGDDNALPANVHYNPRRLFFHSFDDATNNDPVDDFINFLTGSGPHGVKTICLSHNGGKYDIHLILEALHRRNLPPKRICTTGLKIFSMTLKGNHQRHVIFKDSLNYFFCELDALPRTFGLNAEVATAKPFFPYLFIRRENLHQRLHGLPGKEFYQPDHMKASKRDSFMSWWEVENRSARFQLREQLILYCMNDVAILRESVLQFRQIIAENTRGLDPFKISSTAAGLALATLRRCFLPMNKLVNAPEGGYLRGRRASAESARYIRYYEMTHPGVHVRSAQWSIGEANVEDTGYRLDGLVTREPPQRNLAIEYMGCFYHGCPTCYANDRQQKLAGGRTAEDLYERTKRRLFELQNQHGFELEVVWGCEMKQRLRADPEFRRVYNDSFVPRPLDPREDALRGGRTEPFILQYTCSPDEEIILIDIVKKVRRNKKYFFIVKAWMNASFRDAFLRVLPFRKWHKNAISMKRKTTEGKARERDKGEKRGEDKTKGQTEKKRRGGTEKR

SEQ ID NO: 135810 - protein, 37 aa, Heterodera glycines
  Coding regions on vcDNA: vcDNA=SeqID_62233; Strand=-; Position=1-190
LISDHFAKFSSDRSLFPTPLLFSIRPSVLSARFPPLF

SEQ ID NO: 135811 - protein, 159 aa, Heterodera glycines
  Coding regions on vcDNA: vcDNA=SeqID_62234; Strand=+; Position=1 -151,202-530
  Homolog annotation: Hit_ID=NP_507780.1; Match level="QueryCoverage =85%, HitCoverage=8%, E-value=3e-12, Identity=34%"; Hit description =predicted CDS, DNA polymerase type B, organellar and viral family member (5T899) [Caenorhabditis elegans]
MTHPGVHVRSAQWSIGEANVEDTGYRLDGLVTREPPQRNLAIEYMGCFYHGCPTCYANDRQQKLAGGRTAEDLYERTKRRLFELQNQHGFELEVVWGCEMKQRLRADPEFRRVYNDSFVPRPLDPREDALRGGRTEPFILQYTCSPDEEIILIDIVKKS

SEQ ID NO: 135812 - protein, 209 aa, Heterodera glycines
  Coding regions on vcDNA: vcDNA=SeqID_62235; Strand=-; Position=1 -93,162-255,303-604,659-799
MDAILATDWLHNAYPEQKMTTGNEEEDKATQEGQMSWLKIIEEEEERARELQNDQMELEQVKDNIELPKHPQPQTKCSCNEKQKSVPLIDFLCKHYKCSMNELHVLLQTLSKRREISEMLRSNLHLRTNHLRPAWKNIRVHCNELTIHPAQTAYAMRGYLGITVRVYYYVKHGIKLAYPQLPCVLQFGGGDHSSLFPLECLSVIVVKEP

SEQ ID NO: 135813 - protein, 56 aa, Heterodera glycines
  Coding regions on vcDNA: vcDNA=SeqID_62236; Strand=-; Position=1 -72,554-649
LRGVGQGRAPNARFTTTHQPNGRTEKTLRRISVSIKKFSFAEKTKPTFGLQHLNGP

SEQ ID NO: 135814 - protein, 184 aa, Heterodera glycines
  Coding regions on vcDNA: vcDNA=SeqID_62237; Strand=-; Position=1 -79,164-342,402-698
MVPEVFRQFTFHLGNKNNLSAYITVDEEVIEVEDAKVEQYKNKSLSGAKLRDFVGFWVLGLDMIPWDEQTMRLFVIRHCNCSLEAWFLRPSDSEPTDPKKASMGTGRFEDRYGQHLNNLNPACVKFELRNFVCLNDCLRGPVNWTPENWTPSGKMDTAGILDIKGKLDTGKVDTKFFLKNEPRN

SEQ ID NO: 135815 - protein, 249 aa, Heterodera glycines
  Coding regions on vcDNA: vcDNA=SeqID_62238; Strand=+; Position=1 -222,1286-1813
MVQEGAGTSSSSSKTSKDYVRKLDNTIEHVPRFQYTKVKSRFSIEDVPANPEGLLAGIFQYSIDAAVADSHERGGHKCHETYCQLCNTYHNPERGCFIQPIEPKEHDPYRIVAFDLETMQHQPVNPREPEKKEHQPNFIAARVACPDCIESGKWRRATAGCQICGLHRTVAFCQRRFMDTQVDKQVVADNPLEAFVDWLVYQLPKKYDTYAYSHFGGRFDMVLVFRELFRIGFNPEMLRRVQCYFSKFG

SEQ ID NO: 135816 - protein, 36 aa, Heterodera glycines
  Coding regions on vcDNA: vcDNA=SeqID_62239; Strand=+; Position=1-111
FGFQFNVYPFYYKFVVNRLNGKITEHAQGMVSKIDG

SEQ ID NO: 135817 - protein, 82 aa, Heterodera glycines; identical to SEQ ID NO: 129243
  Coding regions on vcDNA: vcDNA=SeqID_62240; Strand=-; Position=1 -186,329-391

SEQ ID NO: 135818 - protein, 50 aa, Heterodera glycines
  Coding regions on vcDNA: vcDNA=SeqID_62241; Strand=+; Position=1-154
LQIYWLKLHMRYISKFFDSVRRFDKDGFRFAISRSTFGNWSRIFSAITCN

SEQ ID NO: 135819 - protein, 76 aa, Heterodera glycines
  Coding regions on vcDNA: vcDNA=SeqID_62242; Strand=+; Position=1-228
MTSTSADISSDFDQPNQKQDPDDSGEFQRDPDEFVESIQNEVTQWLDELRRIKKPGERDGPKLGTLEKSLNDLQAA

SEQ ID NO: 135820 - protein, 58 aa, Heterodera glycines
  Coding regions on vcDNA: vcDNA=SeqID_62243; Strand=+; Position=1 -159,208-225
MLENGNGMLNIRIFSSYFKSFFDQWSIAFVLFFETFMEKNIYFVMWSAGLNLITLRID

SEQ ID NO: 135821 - protein, 38 aa, Heterodera glycines; identical to SEQ ID NO: 130624
  Coding regions on vcDNA: vcDNA=SeqID_62244; Strand=-; Position=1-348

SEQ ID NO: 135822 - protein, 38 aa, Heterodera glycines; identical to SEQ ID NO: 130624
  Coding regions on vcDNA: vcDNA=SeqID_62245; Strand=-; Position=1-348

SEQ ID NO: 135823 - protein, 177 aa, Heterodera glycines
  Coding regions on vcDNA: vcDNA=SeqID_62246; Strand=-; Position=1-532
  Homolog annotation: Hit_ID=XP_307604.1; Match level="QueryCoverage =43%, HitCoverage=22%, E-value=2e-10, Identity=38%"; Hit description =ENSANGP00000015459 [Anopheles gambiae]
MYRAKNACEELSEILEEIKRKRVEMAESLQKIAVAARENKERVYVDFCTQLDIEAKINRAVIKKNEWQNKKEQLEDIFDINPQNSLNSTILTPRNQPIKRVKIPQIQLKKFDGSVEKWIPFWETFRVHVHEDDSVTKIEKHNLLESNLEGEAKELIEGIPISEDGYQIAIDLLLEKY

SEQ ID NO: 135824 - protein, 18 aa, Heterodera glycines
  Coding regions on vcDNA: vcDNA=SeqID_62247; Strand=-; Position=1 -37,200-219
MLILEVKPANFYALVKLI

SEQ ID NO: 135825 - protein, 47 aa, Heterodera glycines
  Coding regions on vcDNA: vcDNA=SeqID_62248; Strand=-; Position=1 -129,468-482
MNIIDKIGNNIVRPTLDFLSKTKLSLSHLSGGFDFDGKMPQKEIIGC

SEQ ID NO: 135826 - protein, 280 aa, Heterodera glycines
  Coding regions on vcDNA: vcDNA=SeqID_62249; Strand=-; Position=1 -328,607-733,864-991,1089-1204,1347-1481
  Homolog annotation: Hit_ID=NP_509934.1; Match level="QueryCoverage =83%, HitCoverage=20%, E-value=7e-84, Identity=62%"; Hit description =FERM domain (protein 4.1-ezrin-radixin-moesin) (frm-3) [Caenorhabditis elegans] emb|CAB10024.1| Hypotheti
NLRIKPFRKSIYFMRSSRSDQFHFSPKVNFIKNGSIIKIRWKLNKFPAQIRRDLSCGELICTNENTAALLVALIVQSECGDFSPLDYPDAGAYLAGTHFVPHQTPTFAQAVLEQHRRLIGMEPAEADFVLLETARRCDFYGLRLHPARDIEGTEVALAVAHMGIKVFHQMNCVTTFSWAKVRKLSFKRKRMMIKVHVHPDSFQFYKETIEFSFENRDDCKNFWKKCVEHHSFFRCTQQQQHHQQHNLFTRGSNFQYRGRTQKQLIDYVREHRKRREPFQR

SEQ ID NO: 135827 - protein, 156 aa, Heterodera glycines
  Coding regions on vcDNA: vcDNA=SeqID_62250; Strand=-; Position=1 -24,82-144,265-467,757-937
  Homolog annotation: Hit_ID=CAE70613.1; Match level="QueryCoverage =96%, HitCoverage=13%, E-value=3e-49, Identity=61%"; Hit description =Hypothetical protein CBG17296 [Caenorhabditis briggsae]
TSNIPRGVGGCPPPPGMDPRKGKGKLMCIKVRMLDDSVGVFHLGVGYSKAVKYKKSIMLIIQHKAAGQALFEEVCRYLNLLESDYFGLEFIDSYGNRCWLDKDKSILRQIMVAQSDARFFFVVKFYTPNPAELEEEYTRYLFALQVNIGKFHQKRL

SEQ ID NO: 135828 - protein, 190 aa, Heterodera glycines
  misc_feature (177)..(177): Xaa can be any naturally occurring amino acid
  Coding regions on vcDNA: vcDNA=SeqID_62251; Strand=-; Position=1-592
  Homolog annotation: Hit_ID=AAN73844.1; Match level="QueryCoverage =99%, HitCoverage=70%, E-value=1e-28, Identity=39%"; Hit description =reverse transcriptase/RNaseH [Solenopsis invicta]
LLSEKGVRDPNKVSVKFTAPKSLQELKSLLGALTYFRRFIKNFAHIARHQILTQEKIKEHWGNEQSEALETLKNVLTTAPVLQSPRFGKPFIIECDASRKAIGAVLLQENGQVAFASRALNRHEANYPSIEREALALVYSVKEFSPYIVGSGITKVITDCSALTGMMKAKGLKGRLXKYQVTFQSYDIEK

SEQ ID NO: 135829 - protein, 33 aa, Heterodera glycines
  Coding regions on vcDNA: vcDNA=SeqID_62252; Strand=+; Position=1-101
WLSLFLINFIHIQMLSSMIGRAVRNRPFIFEGF

SEQ ID NO: 135830 - protein, 95 aa, Heterodera glycines
  Coding regions on vcDNA: vcDNA=SeqID_62253; Strand=+; Position=1-305
GGRCAIDLLFLREFLNLYSIPEKCLSLFFEKFYTSQKRLRMRRRAVHNRHFISQRIFIFRGYPRKMAISFFDKFYTHTNALEHDREGGAQFTFYF

SEQ ID NO: 135831 - protein, 95 aa, Heterodera glycines; identical to SEQ ID NO: 135830
  Coding regions on vcDNA: vcDNA=SeqID_62254; Strand=+; Position=1-305

SEQ ID NO: 135832 - protein, 34 aa, Heterodera glycines
  Coding regions on vcDNA: vcDNA=SeqID_62255; Strand=+; Position=1-104
KMAISFLINFIHIQMLSSMIGGAVRNRPFIFEEF

SEQ ID NO: 135833 - protein, 67 aa, Heterodera glycines
  Coding regions on vcDNA: vcDNA=SeqID_62256; Strand=+; Position=1-204
MEQYEHGMEQQQNTDEGAEPMAVEEHTNDGENEQLKGGAELDGEKPKQRPMVDEQNVVGAQLLFNLI

SEQ ID NO: 135834 - protein, 169 aa, Heterodera glycines
  misc_feature (78)..(78): Xaa can be any naturally occurring amino acid
  misc_feature (95)..(95): Xaa can be any naturally occurring amino acid
  misc_feature (106)..(106): Xaa can be any naturally occurring amino acid
  misc_feature (145)..(145): Xaa can be any naturally occurring amino acid
  Coding regions on vcDNA: vcDNA=SeqID_62257; Strand=-; Position=1-578
  Homolog annotation: Hit_ID=T02995; Match level="QueryCoverage=87%, HitCoverage=27%, E-value=2e-29, Identity=55%"; Hit description =unspecific monooxygenase (EC 1.14.14.1) - common tobacco dbj|BAA10929.1| cytochrome P450 like_TBP [Nicotiana t
PDLTPKWTPFRAHSRAYRLCKESRKVVEFHWCLEAPTYATPLMILHKVRLESSSTGSSFPAKFAKPVPLAVVSLDSRXGTVGISLIHSCASVVSXTRHLATLRETXVTPAVYPRLIKVPWLNIQSTEQKSDSDNVHKDHPSPLFXLDRRITRARASSKLVVQRQAKRIP

SEQ ID NO: 135835 - protein, 155 aa, Heterodera glycines
  Coding regions on vcDNA: vcDNA=SeqID_62258; Strand=+; Position=1-466
MKVFLMISLFVFLIIILININYVGSEKNKLEQKSFEEIFGEKWEEKRNEEQKKREIIGKYNKIKEKIKQKGRKYPRKEWSKIERKIAKKLGTNRQNIYEWIKELGLNQKTKKCYKSKTDEEKLEIVQKFIEMSNEYKQKGRTYSKKEWQQNYEEI

SEQ ID NO: 135836 - protein, 514 aa, Heterodera glycines
  Coding regions on vcDNA: vcDNA=SeqID_62259; Strand=+; Position=1 -87,173-266,859-1041,1126-1171,1295-1403,1455-1607,1655-1793,1840 -2039,2422-2493,2538-2690,2735-3043
  Homolog annotation: Hit_ID=NP_502244.1; Match level="QueryCoverage =53%, HitCoverage=41%, E-value=5e-26, Identity=27%"; Hit description =BTB domain containing (67.7 kD) (4M616C) [Caenorhabditis elegans] emb|CAB01179.1| Hypothetical protein F3
MSSSSKQGNPIERMKHLLSSGEDADIQFLLLSAHKLILKHASEVFEAMFRFDSQKEKTENDFLSLKIPSLAIITFQLASVESAIVEVPDVEPTAFRVMLSFIYSDDLSELDGDNAMAVLYAVLYAGQKIWSKLILIGQKYGIDRLVSPCLQIPIPKLSNVFLAFAQARLFDLEDFSHQCLRFICQNAVQLFGSEEFLQIDQNLLCDLFEHDQLMINDEFDLWNAALNWADEKCRQNAIECSDENRRAALGPALFKIRFPLIPPYAFVKAIVPSGIFTNDEFVGVYQFNFYPNFRGVPELYPLKLPWHGRISDWNTAKGNRGTLAMEIEKFSEFAREEELMDPCKGFYDKDGDKVTLVIDAVQDYLDSAYFPVNEQLFSSEFFMEILQYLCFGKYNKNLAPNDILIHTTNNDVCAAVSKLCGRVIEYVVGSSNPFSVRKRISLGTMQPTDLPACLKQPARVMVRGGIHPQIRSDENEVYHLYNSNLMKKVGYISMFYHVRIGDCVWLSIDLVLYY

SEQ ID NO: 135837 - protein, 139 aa, Heterodera glycines
  Coding regions on vcDNA: vcDNA=SeqID_62260; Strand=+; Position=1 -233,392-578
MKAKEKQQQQQHNQPKIDDLLKDLARLQLNQSQQSAGVLMTVPSPQTTMSCWPKFNSIEFDGVVTVDSGSSTRQHCGGNRLRRGATCEKKNALLDCIALAEESAKLLSADARIRCLLDLGEELEAGFQRILSGFLKKEK

SEQ ID NO: 135838 - protein, 99 aa, Heterodera glycines
  Coding regions on vcDNA: vcDNA=SeqID_62261; Strand=-; Position=1 -81,295-387,512-605,659-690
MSVSTPIFPTRPEWIIVQNCSGCPGLTCAVLAAILCVRRPRRRPQCSEPILRSYRRGKEDVVIELGSPMANRDNDEDGAKKEISEQELEVILEGNEKEC

SEQ ID NO: 135839 - protein, 139 aa, Heterodera glycines
  Coding regions on vcDNA: vcDNA=SeqID_62262; Strand=+; Position=1 -202,243-370,413-502
MAVCKCKVCDECRRKQRLHEISERKKIIESCGGDHHYIKMIELRMRDLKLYKRAYRRIKSVIDQVVEGPFHVKCTSKCKEEFTYYLIKWECCTEDYGWGVGCTYAEISDIRQNELLAYYDQERVLGDIIVGRQGRDAPS

SEQ ID NO: 135840 - protein, 113 aa, Heterodera glycines
  Coding regions on vcDNA: vcDNA=SeqID_62263; Strand=-; Position=1 -84,355-456,556-711
MRFEVVSIAEKEQRTNEDGTKIKLRKFLKDSFISSGFLLNRRGTVNFCFRLSLFYLYYRQITFSAEFVKAKSRYEIQEIVKVICDCPFDVVKLTKEEDAFAVCSSESSDGFSR

SEQ ID NO: 135841 - protein, 200 aa, Heterodera glycines
  Coding regions on vcDNA: vcDNA=SeqID_62264; Strand=-; Position=1 -160,211-655
  Homolog annotation: Hit_ID=CAD22154.1; Match level="QueryCoverage =82%, HitCoverage=52%, E-value=2e-52, Identity=59%"; Hit description =pherophorin-dz1 protein [Volvox carteri f. nagariensis]
KGEGLSAPKYCASNVYYACSGGVSTKLNCPKGLVFDQANQVCNYPSDCGKKQPPQPQPPSKGYGKYGRGKRDASGAPPAPPPPPPPPPPPPPPPPPPPAYEPPEPPSYGAPPQPPSYGAPPPPPPPPPPPPPPPPPPPPPPPPAYEPPEPPSYEPPQPPSYGAPPPPPPPPPPPPPPPPETSQPKDERAVLPLPQPEPTA

SEQ ID NO: 135842 - protein, 98 aa, Heterodera glycines
  Coding regions on vcDNA: vcDNA=SeqID_62265; Strand=+; Position=1 -107,163-352
MHESNGHRIAVEADEEEEAAIADEERIEREKERTTYKRKIAIEPPLKFTYVNCFKKLYYDYNKREWKEYVQQERAGQKLCRLKTVSPSHMQLFVPFIN

SEQ ID NO: 135843 - protein, 47 aa, Heterodera glycines
  Coding regions on vcDNA: vcDNA=SeqID_62266; Strand=-; Position=1 -97,615-661
MAPFEYLFGSKVFINRGKLNKLMANSLFECADTPLAFLWRRAAPSTF

SEQ ID NO: 135844 - protein, 34 aa, Heterodera glycines
  Coding regions on vcDNA: vcDNA=SeqID_62267; Strand=-; Position=1-185
LISGIYFYQSPSPRPEFEQKFEKSNFMNFEFYIN

SEQ ID NO: 135845 - protein, 210 aa, Heterodera glycines
  Coding regions on vcDNA: vcDNA=SeqID_62268; Strand=-; Position=1 -484,556-588,681-796
MNLIIFFCFIRLMPTTFSAKLWTNTENDSLIDSSNRSAADAHLSNVLPSANGDKIMAIQIKTDQKQIDQFLEEIYDECSEKGEKNSQIINKILIIQRKKSLEYNKMRTDEQRIEIVHQICEMRNEFDENGKRKYKNVNEIAKILDVSLANIYRWMDKFGLSHLKKDLPHTKKPRHRTSEVWTFFEQMPNSLNAPNVARKFEFSGTDRHRI

SEQ ID NO: 135846 - protein, 95 aa, Heterodera glycines; identical to SEQ ID NO: 125597
  Coding regions on vcDNA: vcDNA=SeqID_62269; Strand=+; Position=1-658

SEQ ID NO: 135847 - protein, 53 aa, Heterodera glycines
  Coding regions on vcDNA: vcDNA=SeqID_62270; Strand=+; Position=1 -108,315-368
MESLDSPAFKLEADESDESGDYVQINKKMRESPYVKKSPDDAGPYVNSPITLD

SEQ ID NO: 135848 - protein, 63 aa, Heterodera glycines
  Coding regions on vcDNA: vcDNA=SeqID_62271; Strand=+; Position=1-191
WNWIWSSVHSTITRQCLGVDFHLCVALRGLQFHKIGVPAMVLSCDRNVEANESFFQQMHKLFM

SEQ ID NO: 135849 - protein, 73 aa, Heterodera glycines
  Coding regions on vcDNA: vcDNA=SeqID_62272; Strand=+; Position=1 -19,68-185,689-773
MRGGSSRASTPLQSLVQSESKQPLHTQQIPAIYHGHIPTEATSRLRHHLAVEMEAEPRRYGLGMPTCNILKCD

SEQ ID NO: 135850 - protein, 92 aa, Heterodera glycines
  Coding regions on vcDNA: vcDNA=SeqID_62273; Strand=-; Position=1 -168,895-1005
MPMPFNAAIGQQRDRRYVGSANWPFPLEFVPVPMPSDGALAFQSPAFSTGDVVGCGDVSVPSTKKAQRCLTCQIGRDGVLSTWYGRKRKGSN

SEQ ID NO: 135851 - protein, 21 aa, Heterodera glycines
  Coding regions on vcDNA: vcDNA=SeqID_62274; Strand=-; Position=1 -54,384-395
MRTRPIWQVKQRLLTSQKKML

SEQ ID NO: 135852 - protein, 95 aa, Heterodera glycines; identical to SEQ ID NO: 125597
  Coding regions on vcDNA: vcDNA=SeqID_62275; Strand=+; Position=1-845

SEQ ID NO: 135853 - protein, 408 aa, Heterodera glycines
  Coding regions on vcDNA: vcDNA=SeqID_62276; Strand=+; Position=1 -109,166-1282
  Homolog annotation: Hit_ID=NP_001004509.1; Match level="QueryCoverage= 74%, HitCoverage=20%, E-value=3e-46, Identity=36%"; Hit description =si:busm1-180o5.3 [Danio rerio] emb|CAD60788.1| novel protein similar to DNA polymerases [Danio rerio]
MKTRPFPIGTPSVWTGEQLWHQQQPQTAGGHPHTDCAGPPPPVLRPPALPWCRPEDNPFRGFLFCRVLPPSADELGDREPLLPYRTQADGRLTFGLCARCAELRQQRTCRHTERERAWTAAYTHVEVNRAMLLGYRVLQVHEVWHYEQWASPESGNGLFSDYVNTFLRLKAEASGWPAGCDDEPARAEHVRQFGEQEGVHLRRDNIGHNPGLRQLAKDLLNSLWGKMAERPERDEVVYTDSARAFHELLMDARQEVVSFTHINEQLDRCVVRKREPFARAPEHNNLAVACFVTSHARLNLYEWLEEVRRVGGRALYCDTDSVLYVRRLGAAGVREGNALGDMKRELPGRRIIDFFAAGPKNYGFQHVDARTGQDLRAERKVRSFELTYAADQQLQYGRMRQLVINHFG

SEQ ID NO: 135854 - protein, 221 aa, Heterodera glycines
  Coding regions on vcDNA: vcDNA=SeqID_62277; Strand=+; Position=1 -148,279-479,700-792,848-969,1019-1119
  Homolog annotation: Hit_ID=CAE64964.1; Match level="QueryCoverage =85%, HitCoverage=60%, E-value=2e-30, Identity=36%"; Hit description =Hypothetical protein CBG09798 [Caenorhabditis briggsae]
MSLPGGESHPKSLPLNWFPTVNFSIVNGLRWAITDAFVRLPFRATPKLASKCLLPGSCDPTDANSCDLRKRELCLRTTPQQSQSHPQVQQVRLPTAPPATDQSYRKKHRDTETYETKNPISYVSSQLPDYTCQCVSGEKRHPITGVCLRNECLRKEDNDCDTHAQCIDTDEGFLCICLPGFMDNSQDKLRKPGRVCTPLVDECSSGIAKCSPHAKCTDTPE

SEQ ID NO: 135855 - protein, 238 aa, Heterodera glycines
  Coding regions on vcDNA: vcDNA=SeqID_62278; Strand=+; Position=1 -275,590-672,736-790,839-970,1409-1579
  Homolog annotation: Hit_ID=AAN32885.1; Match level="QueryCoverage =100%, HitCoverage=39%, E-value=1e-133, Identity=97%"; Hit description=glutamyl transpeptidedase [Heterodera glycines]
EPMCGGDGSADDQSQANSLQNDPKFYHRLIEAQKFAYAQRANLGDQAFVPEAKKLAKHMTSNTFLHNVHKKMLDKAMPDEHYTDDRPIKADKDHTGTSHTSILDADGNAVSVTSSINQWFGAVIQSENLGIIWNDEMEDFSFPDVKNWFGYAISPTNFVAPGKRPMSSFSPMVIYNKHTGKVKFVIGGSGGAKIPSSVAKTVLHVLCLNQTVKEAIDAPVLHNQFTPNHVIYENGTPP

SEQ ID NO: 135856 - protein, 52 aa, Heterodera glycines
  Coding regions on vcDNA: vcDNA=SeqID_62279; Strand=+; Position=1-159
  Homolog annotation: Hit_ID=AAN32885.1; Match level="QueryCoverage =100%, HitCoverage=8%, E-value=2e-24, Identity=100%"; Hit description= glutamyl transpeptidedase [Heterodera glycines]
KLIKDLNENFGHIMKSYDNNNVVVQAIHVADDGFIYANGDFRRRTYMHPAGF

SEQ ID NO: 135857 - protein, 111 aa, Heterodera glycines
  Coding regions on vcDNA: vcDNA=SeqID_62280; Strand=-; Position=1 -159,531-657,1136-1185
MDEAQRLIKSELNVPHDCFTDENGKFKLEYEIENKSREVARWRLPPVHLYIFGASVWTKEYVHVTDWHHVHIFDLKNGKKYALSADKVAEKLYELMRSRSRVRFADSDSDY

SEQ ID NO: 135858 - protein, 54 aa, Heterodera glycines
  Coding regions on vcDNA: vcDNA=SeqID_62281; Strand=-; Position=1-165
RKGTHYEKKIRVDDWDNHYIVDLATNDVQDVLKQNLDLEFLKLRDSVASGESWL

SEQ ID NO: 135859 - protein, 75 aa, Heterodera glycines; identical to SEQ ID NO: 127026
  Coding regions on vcDNA: vcDNA=SeqID_62282; Strand=-; Position=1 -160,276-343

SEQ ID NO: 135860 - protein, 108 aa, Heterodera glycines
  Coding regions on vcDNA: vcDNA=SeqID_62283; Strand=+; Position=1 -84,129-371
MYVNQSRTEIRMEILSEKCQNFSIGEVWECDVREELKKNKEMKKFFESVPDKGPINPRDAYAEGRTMPFCLYAKATEEIEISMFDIISLYPFVNYGKNLLAFLILPFT

SEQ ID NO: 135861 - protein, 86 aa, Heterodera glycines
  Coding regions on vcDNA: vcDNA=SeqID_62284; Strand=+; Position=1 -66,127-252,569-637
MVVPTQAPPVTAAAEGTFRALPLPAPADPDLQSLTFEASMAVDKALLKWKEIDPQVANWLNNFKEMLNRLGNDADKYRPRKPPRAN

SEQ ID NO: 135862 - protein, 211 aa, Heterodera glycines
  Coding regions on vcDNA: vcDNA=SeqID_62285; Strand=-; Position=1 -12,136-354,692-829,1175-1441
  Homolog annotation: Hit_ID=AAD30271.1; Match level="QueryCoverage =96%, HitCoverage=16%, E-value=2e-20, Identity=34%"; Hit description =EH- and SH3-domain containing protein EHSH1 [Rattus norvegicus] sp|Q9WVE9|ITN1_RAT Intersectin 1 (EH domai
MLAQIWQLADVNKDGKLDRFEFSIAMKLVLNCLSGISLPSVLPESMLRIGGGMPIPSTPSSYSLSNGGGPSTALPSSARGVLGESQLPTNILAQIWTMSDVNKDGCLGIEEFCTAMFLIEMVKEERRRAEIERREREEAERKEHERQELERRREAEMEEERQRELERERERAEQEQRLKARREEIRERMEQERIRELEKIRIRDLGVGIRF

SEQ ID NO: 135863 - protein, 62 aa, Heterodera glycines
  Coding regions on vcDNA: vcDNA=SeqID_62286; Strand=+; Position=1 -139,415-464
MGPNPKPGQKNFVLNLRIATGCYGWKFSGEFGPNCWASCCAERNGHMYFMGVKMRDDHQGVI

SEQ ID NO: 135864 - protein, 67 aa, Heterodera glycines
  Coding regions on vcDNA: vcDNA=SeqID_62287; Strand=-; Position=1-203
LVGRSGDDKYKYSNDVSVAPPIALLPSPFPRELYEQATDAQQSLNELYYRIACDHEFLMEAYKDVIK

SEQ ID NO: 135865 - protein, 267 aa, Heterodera glycines
  Coding regions on vcDNA: vcDNA=SeqID_62288; Strand=-; Position=1 -322,381-497,796-1160
MNNFDQLKSEQQEKLDDQMAEMEILMNGAQEEKNNEGTEQWQTEEKQWQSVKEKIKFKKEIFENGKMLLTKASANDFDLIIKENLFNLHEAAIRKLTQFQPFIDKLKIIEIEPKRVELILVKNTEIFKQLSQKPVEIPKNEQKLFTEEAFELNLVHNYQKLLSEEGRPIAQSLLTQIGTDAIYFHHKILLHDYITNVSQMNAPNAQFKESFAAIRKKIDELALSEALNDNGEKQRKIFLMGMFIKKLSKVNLTSLAMSDELMHLKTV

SEQ ID NO: 135866 - protein, 82 aa, Heterodera glycines
  Coding regions on vcDNA: vcDNA=SeqID_62289; Strand=+; Position=1 -32,124-340
MSDTLHFLFVRVADHESAINFDEFRIPDQDSNKNPNSKFNLKINFELNWPKLRHIRDQRLRKLQNACSHVFLHEICFKKSTT

SEQ ID NO: 135867 - protein, 266 aa, Heterodera glycines
  Coding regions on vcDNA: vcDNA=SeqID_62290; Strand=-; Position=1 -435,521-884
  Homolog annotation: Hit_ID=EAL48061.1; Match level="QueryCoverage =81%, HitCoverage=12%, E-value=4e-09, Identity=28%"; Hit description =Viral A-type inclusion protein repeat, putative [Entamoeba histolytica HM-1:IMSS]
MPQINFVIILFIFLFVLIDGIDEDLFDDLWKNQKPSTSKNFKKQKFGEINAIKEEIIVKDEIYNQQKANKIEIEDTKPKELQKIKKEKTLEEQNNNLNRKLKLPRKEMELLEEESYENEFNEEADQNVSSTDQSNSGNDEDYNNLNTEEINEMQIVNEFNLRNNELRKENVYNKRTNTQFECEIAKKFDTNPDTIYKLKKELGQKRVKTEESEETKMELIRKFDKMRKEKICGFKYDEKKRSVIEREIANELGIKRNKIYNLKKEF

SEQ ID NO: 135868 - protein, 47 aa, Heterodera glycines
  Coding regions on vcDNA: vcDNA=SeqID_62291; Strand=-; Position=1 -84,136-195
MHAIRVRTSGSRDEPKWQRRQKPDGPTKTRDRIRTRSVYVLLRIRSP

SEQ ID NO: 135869 - protein, 46 aa, Heterodera glycines
  Coding regions on vcDNA: vcDNA=SeqID_62292; Strand=-; Position=1-140
MALAVNFAPCRTPSSALSPLSSVVTAIFPTTLIPTLNQSLSLKRNE

SEQ ID NO: 135870 - protein, 47 aa, Heterodera glycines
  Coding regions on vcDNA: vcDNA=SeqID_62293; Strand=+; Position=1-143
MGFIRKLILTNMPHAYVLSLQLGSSVAEDIGRGYFANMNDEVAAVCQ

SEQ ID NO: 135871 - protein, 17 aa, Heterodera glycines
  Coding regions on vcDNA: vcDNA=SeqID_62294; Strand=-; Position=1-51
MFDRARQEKATVCTKFA

SEQ ID NO: 135872 - protein, 61 aa, Heterodera glycines
  Coding regions on vcDNA: vcDNA=SeqID_62295; Strand=+; Position=1-187
SPLKIYYHGIAEKLLACTRSCMVNYVISITLKSVKRGVIGGYPTFGDLQLWDPTVDDLDIR

SEQ ID NO: 135873 - protein, 35 aa, Heterodera glycines
  Coding regions on vcDNA: vcDNA=SeqID_62296; Strand=-; Position=1-107
SKSSLTTAQKNMFFVRFRPRGAQEKNSLLPKNWSP

SEQ ID NO: 135874 - protein, 62 aa, Heterodera glycines
  Coding regions on vcDNA: vcDNA=SeqID_62297; Strand=+; Position=1 -87,521-622
MLINFGGYIRILVRFHQLSSQQKKLKFNKNKRQASANLLILIGRQFDELERQTIYFFVVTTN

SEQ ID NO: 135875 - protein, 44 aa, Heterodera glycines
  Coding regions on vcDNA: vcDNA=SeqID_62298; Strand=+; Position=1 -21,348-461
MRQKKLKFDHDDVPKLCDEVSEKMVKVYEAISAEVRTASKEAAH

SEQ ID NO: 135876 - protein, 56 aa, Heterodera glycines
  Coding regions on vcDNA: vcDNA=SeqID_62299; Strand=-; Position=1 -26,80-126,179-479,527-555
SNKFVLKIFAIFLFYFGFHFLPCSVHPCRHCIGIYLIFLKKQIRNANLSFCRSRNL

SEQ ID NO: 135877 - protein, 85 aa, Heterodera glycines
  Coding regions on vcDNA: vcDNA=SeqID_62300; Strand=+; Position=1 -130,804-931
TFLQVIVISLFNSIACVIYVSMQLVRISKTYIIVGTYAWLFSHALCYAETSAEMLLAINRCMELLRPQLAHAIFSGKVLSYTAFH

SEQ ID NO: 135878 - protein, 18 aa, Heterodera glycines
  Coding regions on vcDNA: vcDNA=SeqID_62301; Strand=+; Position=1-56
YREAIPEGFGLPINLGAS

SEQ ID NO: 135879 - protein, 104 aa, Heterodera glycines
  Coding regions on vcDNA: vcDNA=SeqID_62302; Strand=-; Position=1 -212,252-355
MKLSILTTFLLLLLTIAFASFTATDGTENIGRRKLVISEKAKQTKDLNSKRTNQCFVISERLKKSKKTDQIGFWLVPSETVTERIAIPAFACWAVVRLAEQSTE

SEQ ID NO: 135880 - protein, 52 aa, Heterodera glycines
  Coding regions on vcDNA: vcDNA=SeqID_62303; Strand=+; Position=1 -45,973-1086
MPIVCRRKYLSEGIGPGNFKFGLRTGILQNPAQDPVLFRALVKISCLTVCGD

SEQ ID NO: 135881 - protein, 128 aa, Heterodera glycines
  Coding regions on vcDNA: vcDNA=SeqID_62304; Strand=-; Position=1 -80,367-670
KIALGKLVGMQLLLLLEFENPLIFSLDIFCDKQLALDYAILFCTNPTVSSDAENRLSIRLYFAKIMAIFTKIFNFITTSTEKENKQKYLLVFVEIWNKFVRVFIQNSNRMTFHRLVAYCTTFGRELHP

SEQ ID NO: 135882 - protein, 84 aa, Heterodera glycines
  Coding regions on vcDNA: vcDNA=SeqID_62305; Strand=+; Position=1 -14,444-607,828-904
MTSLYLNFKIFKVALPDLPVEVTNTLLSSVKKKLMNIKSHKYTFYPAGQYEIIVALGPYDFWASIQLENNYVLKKLKYFKTVDF

SEQ ID NO: 135883 - protein, 309 aa, Heterodera glycines
  Coding regions on vcDNA: vcDNA=SeqID_62306; Strand=+; Position=1 -99,242-400,449-678,726-1167
MSEFLNYADMTKTMEDTKGQLCNSKSINFNKLAVAPYDTFSPEKMNKKFGEVEQKLNNVHEQLILKQADIEELINREKSPLKLEGQNEQQSIEQSAVETQIRNEQTAEPKSFGLPVLVDVKDLTPTHLIEPPIDQIAASPNHKEPKLKPRYHKVIGDGDCFYRAICYSIFQVDEIENSDALRVAASRAIEKIVNNKEIFPRKLYETHAEFIKELELALLERPSTKDYNQSLSAYAKHIAKPARNGKGQWAQLEDARVASILLKRTVVILHPNEEKELLEEQRPKYDDPSIKKRINVYFPDGDTMVTIYF

SEQ ID NO: 135884 - protein, 44 aa, Heterodera glycines
  Coding regions on vcDNA: vcDNA=SeqID_62307; Strand=-; Position=1-135
RKKMLSKQFILQLTKCDCMRLSFFPAVRQVHQMHTQSAVEKAKG

SEQ ID NO: 135885 - protein, 353 aa, Heterodera glycines
  Coding regions on vcDNA: vcDNA=SeqID_62308; Strand=+; Position=1-1063
  Homolog annotation: Hit_ID=XP_319741.1; Match level="QueryCoverage =72%, HitCoverage=58%, E-value=2e-15, Identity=25%"; Hit description =ENSANGP00000006515 [Anopheles gambiae]
PEIGDHNADLRQRCLKSLEENATFEQLLAECKQIIGLRHSTAALARGKEFNAVQLRPQILKDKPRVSKSPIRTRTFSTNTRHNSTSSPSQPPSACTRCGGNHWNSDCRFQREVICNKCGRKGHIAKICHNQNNTPQHSGFKYSRTGSNKQNANIIDCLHIMPSDWKTENEPYIERHVRLNGKVHKMVVDSGSKLRIVRKLIWVKLGQPFLTETKLKGRSFTGNIFTFMGKFKVQAALDDGMPLDLECFVIDSTDTLDLMGLPWIRAFERAYNQVVATTLSIENVPTVVGATDQTARRRNWRWIYRTHFQTFLRKHWDFAPKSGPISKLKKIHLPFFVQHDQFPSALSKKWTRN

SEQ ID NO: 135886 - protein, 21 aa, Heterodera glycines
  Coding regions on vcDNA: vcDNA=SeqID_62309; Strand=-; Position=1-63
MRMELFNQNMSSSAAKRSFPM

SEQ ID NO: 135887 - protein, 64 aa, Heterodera glycines
  Coding regions on vcDNA: vcDNA=SeqID_62310; Strand=-; Position=1-192
MFCVAMNSDNYDEALSMLPDRKSEAKVIEAYARRRSKKRNRRRMVEEWKRPMLFGWNRKSEEKV

SEQ ID NO: 135888 - protein, 268 aa, Heterodera glycines
  misc_feature (161)..(161): Xaa can be any naturally occurring amino acid
  misc_feature (186)..(186): Xaa can be any naturally occurring amino acid
  misc_feature (202)..(202): Xaa can be any naturally occurring amino acid
  misc_feature (227)..(227): Xaa can be any naturally occurring amino acid
  misc_feature (231)..(231): Xaa can be any naturally occurring amino acid
  Coding regions on vcDNA: vcDNA=SeqID_62311; Strand=+; Position=1-820
  Homolog annotation: Hit_ID=T02995; Match level="QueryCoverage=98%, HitCoverage=48%, E-value=5e-62, Identity=53%"; Hit description =unspecific monooxygenase (EC 1.14.14.1) - common tobacco dbj|BAA10929.1| cytochrome P450 like_TBP [Nicotiana t
CTAFSQTPRLTLSSARVGVARLNTKMDTLSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIGT

SEQ ID NO: 135889 - protein, 67 aa, Heterodera glycines
  Coding regions on vcDNA: vcDNA=SeqID_62312; Strand=-; Position=1 -42,284-445
MILLTAVYLLSLNETILFKSIITIKNLYSPSVTIITYQAIIKFFINEYFVANYAKTPRGANHNHERQ

SEQ ID NO: 135890 - protein, 25 aa, Heterodera glycines
  Coding regions on vcDNA: vcDNA=SeqID_62313; Strand=-; Position=1-77
IDGFLSVFLSRVERVRVQLQRLPFG

SEQ ID NO: 135891 - protein, 140 aa, Heterodera glycines
  Coding regions on vcDNA: vcDNA=SeqID_62314; Strand=-; Position=1 -249,723-898
  Homolog annotation: Hit_ID=NP_502576.1; Match level="QueryCoverage =64%, HitCoverage=38%, E-value=1e-10, Identity=41%"; Hit description =RAB family member (rab-19) [Caenorhabditis elegans] emb|CAB60605.1| Hypothetical protein Y62E10A.9 [Caeno
TKADLVEEDGVDVNHGKNDEDGEEDNGGGGSTPPAAAGGGGGAVTGRCRRRVDELEAEQLCRAHAMLAQLEVSSKTNVNIDTIFHELAHHLKRHYDELGHLDASGTGGGPKSTADAAFRLGYPNATNLSARWRRCCNYYA

SEQ ID NO: 135892 - protein, 138 aa, Heterodera glycines
  Coding regions on vcDNA: vcDNA=SeqID_62315; Strand=-; Position=1 -57,362-453,635-782,1030-1147
  Homolog annotation: Hit_ID=NP_502575.1; Match level="QueryCoverage =100%, HitCoverage=59%, E-value=2e-50, Identity=68%"; Hit description= putative protein of eukaryotic origin (26.5 kD) (4O146) [Caenorhabditis elegans] emb|CAB60598.1| Hypothe
MTDLLLDPAIRTWVFVPIVLITFLVGIVRHYVFLLLVTKKSADLQSVRDSHWLLKARLLRENGRFLPADSFAQRRWLLCDEQHGQLVKRQDKQNTQPNPDPSTMTEMVKGNMLNMVPMLVIGGWINWTFSGFVTTRVP

SEQ ID NO: 135893 - protein, 101 aa, Heterodera glycines
  Coding regions on vcDNA: vcDNA=SeqID_62316; Strand=-; Position=1 -107,413-529,789-867
  Homolog annotation: Hit_ID=NP_502576.1; Match level="QueryCoverage =68%, HitCoverage=31%, E-value=1e-27, Identity=82%"; Hit description =RAB family member (rab-19) [Caenorhabditis elegans] emb|CAB60605.1| Hypothetical protein Y62E10A.9 [Caeno
RRSAAEVPPPKLGRQKCTTTKPIRWTLTTRSTTCSSVVQRFKNGTYIEKQGTTIGVDFTMKTLMVEGKRIKLQIWDTGGQERFRTITQSYYRSANGIILSY

SEQ ID NO: 135894 - protein, 65 aa, Heterodera glycines
  Coding regions on vcDNA: vcDNA=SeqID_62317; Strand=-; Position=1-349
VNLSGAPGDGLGQRWRTPAEAVARDACDIVVVGRGITGAADVGAEAKRYARVAWDALRAARAWTD

SEQ ID NO: 135895 - protein, 39 aa, Heterodera glycines
  Coding regions on vcDNA: vcDNA=SeqID_62318; Strand=-; Position=1 -18,282-383
MKVPISASAAPAAAEKKEEKKKEEVKEESDDDMGFGLFD

SEQ ID NO: 135896 - protein, 258 aa, Heterodera glycines
  Coding regions on vcDNA: vcDNA=SeqID_62319; Strand=-; Position=1 -87,129-818
MLINSVFMIPFFISIFQQFLITFSIANSSVEDNMLIAFLKGQKEIQFSEYSRQKYEAHLGIMHFMRMNWQCDKIAEEFEEYERTECQKYRKYLDILHEYLYREYLGIPTVKPKFVFKERIEINGPLIYAVNCLAKISQFYFKLYWSNYCEYKLNKLFNNYFELKLLNEKRLNYKQKLPINEMILQLAIEKANNYKTNESLDGIIKQKFDENLEKMFKKAEERAKKNPLEINLINNDKHLIIKHSEFDNKWTWVRLNNQ

SEQ ID NO: 135897 - protein, 207 aa, Heterodera glycines
  Coding regions on vcDNA: vcDNA=SeqID_62320; Strand=-; Position=1-623
MAAVKKVGKGPGPFLPEMCWATWWERFEFFIQLKGVTDVATKRLLLFNEMGQVYEELRRMAQPDDVRTMDLAEIEQLMVERFGEAKSIAACRHELFSAKQQTGQSIRDYSVQLRSLIAKAEWSRDSIDMCLCALFINGISNDAIRVELIKKGDKDLKFKDAVESAVLLEQSNLDAQAIGSNAIPEVAKVGTQQRGPRTPTKSTRGCF

SEQ ID NO: 135898 - protein, 70 aa, Heterodera glycines
  Coding regions on vcDNA: vcDNA=SeqID_62321; Strand=-; Position=1 -151,680-740
MLIGLLLLNVFAILFWNFVWKRRKLPPGPSPLPLMGNLHQLANFPDHGGAGTHGLYGITKTHGEVWLYLR

SEQ ID NO: 135899 - protein, 208 aa, Heterodera glycines
  Coding regions on vcDNA: vcDNA=SeqID_62322; Strand=+; Position=1 -124,176-475,674-875
MGKRKLLPKIHGKNGVKERQKKREERKAQTAKATEARLVKKTAAQPNTDAEMAQPSEEEPSTSEAPARDNNGRPPSTPTPMTPQEMDVPSVEMMEIGVPFPSTPADGDQQAEPVPSTSTARCDLLSTPSTSKGAGNFGLDDACRQRKALSDVTNNQQMDIRLSAAKDLLITLDAGISFKAREALKRSFTGQGLDVWAPTRAVKRLKTE

SEQ ID NO: 135900 - protein, 48 aa, Heterodera glycines
  Coding regions on vcDNA: vcDNA=SeqID_62323; Strand=-; Position=1 -112,164-198
MAVISAVTVAGNLVVLLSFVLDRAIRQPSNYFIASLAVSDLVSMIIRL

SEQ ID NO: 135901 - protein, 169 aa, Heterodera glycines
  Coding regions on vcDNA: vcDNA=SeqID_62324; Strand=-; Position=1 -115,187-411,456-625
MGKMKIFILLINWMEKMEMVQLINKKEKQFKNLKQLKKGQNRQKIYKWKKELNLNKTKKKSFYEGKKNEFIERFDEFKSLYGQRKQKEFAKELGISKDTFLKWKKELAPNYRKIQKNYSNKDKLRKMKQYFKLKERNPKISDVIIAGKLGIGSETLRRWKKKFALISTL

SEQ ID NO: 135902 - protein, 177 aa, Heterodera glycines
  Coding regions on vcDNA: vcDNA=SeqID_62325; Strand=-; Position=1 -270,1184-1445
METLKNFTLDDLFKVLALQDKEFEEWLKELKLLHTTRFCDCGNEMSYKWKQDRQQPLWICYSRKNHDGKRPTAGYFTGTFFEGAHLSPKQRLSHFRLNLFDFLQIASHPPIMSSPPTPNAALILEAQADFALNLLREVSTDDRSCVVSPFSVAVTLSMVYAGAEENTGEEMGQLLAK

SEQ ID NO: 135903 - protein, 82 aa, Heterodera glycines
  Coding regions on vcDNA: vcDNA=SeqID_62326; Strand=-; Position=1 -188,244-304
MMQNGFGAERSWTNMKQGRKFANWREGPSKWRKPDGSSTLQSFSKGKRWRKNVERSASLTNSRGDDTEEAERTVEQKIEEAL

SEQ ID NO: 135904 - protein, 279 aa, Heterodera glycines
  Coding regions on vcDNA: vcDNA=SeqID_62327; Strand=-; Position=1 -379,424-732,785-934
  Homolog annotation: Hit_ID=CAE57362.1; Match level="QueryCoverage =86%, HitCoverage=34%, E-value=3e-19, Identity=28%"; Hit description =Hypothetical protein CBG00306 [Caenorhabditis briggsae]
KPFILPSMPSATTLLSTLFCCVIWLICSNGLGTLRANDSINSRRVPGCPDLEAFQTSSSLDLLSSPQLTKINCLCGPEQSIDETLAQKELAYNEEIISITCIYGTKITDLRKTLEFVAKANKSVGRMILDHVDFSEEEMTNSEEHFHLSHEIAHLTHLEVKKCKGIPNLEFETNSTAKFDSLVELVIEECNLEKVPTKLLRKGPKLKKISLANNKISTLRKADFDGVEMTLNIAGNSLSSSIEKGSLSQLNNLKNLVIGDHNYGSLSLLTEIGQLKNLE

SEQ ID NO: 135905 - protein, 54 aa, Heterodera glycines
  Coding regions on vcDNA: vcDNA=SeqID_62328; Strand=+; Position=1 -33,135-266
MTFQNYSLVNEAFNRFGVGTFSMELFLTHFFRWLVSLPGMLFNAALLNTIIREK

SEQ ID NO: 135906 - protein, 131 aa, Heterodera glycines
  Coding regions on vcDNA: vcDNA=SeqID_62329; Strand=+; Position=1 -145,675-925
MSQRLTGDVPYFRTVPSSPSNEDDGLADEDEPVDHQSPTAQQQKAAQNVEDDEETILRRRLLEKKLEKEKTKAAATVGQQMTKERDGAEQKGAKDGSRKEHPQKVFGIFVGIYTLICGFGFVLIPSLGPKK

SEQ ID NO: 135907 - protein, 59 aa, Heterodera glycines
  Coding regions on vcDNA: vcDNA=SeqID_62330; Strand=+; Position=1 -93,140-226
KSVGSIAHLVWFNSYHKCLLKILPLEKEGRFGVEEGHRKPEFTTQMDNGTIFGGKLTDH

SEQ ID NO: 135908 - protein, 47 aa, Heterodera glycines
  Coding regions on vcDNA: vcDNA=SeqID_62331; Strand=-; Position=1-144
  Homolog annotation: Hit_ID=CAE65966.1; Match level="QueryCoverage =95%, HitCoverage=22%, E-value=3e-11, Identity=66%"; Hit description =Hypothetical protein CBG11149 [Caenorhabditis briggsae]
NRGFNVQSFGSGNYVKLPGPKEDKPNIYEFDSTTYEHILQDLKQKDS

SEQ ID NO: 135909 - protein, 64 aa, Heterodera glycines
  Coding regions on vcDNA: vcDNA=SeqID_62332; Strand=-; Position=1 -69,877-999
MWEKYAVNKFKPNKGVGGEYEVQRSSQAQVNAFNMTKQIFNDPLRGQKEAIEAIVDGTLITMHM

SEQ ID NO: 135910 - protein, 264 aa, Heterodera glycines
  Coding regions on vcDNA: vcDNA=SeqID_62333; Strand=-; Position=1 -732,779-841
  Homolog annotation: Hit_ID=NP_507780.1; Match level="QueryCoverage =96%, HitCoverage=19%, E-value=4e-14, Identity=26%"; Hit description =predicted CDS, DNA polymerase type B, organellar and viral family member (5T899) [Caenorhabditis elegans]
MSTHSKSCKARCVLCSRVGPAFPCPSSAGFFKKCKECNKKFTNNGCYQHHLQSGFCKRSKKCKDCGAVWDVADNKRNGRKGHVCGERFCKMCNNYHNTERGCYIQPIEPKERDPYRIVAFDLETMQHMPSEKPEKREHLPNFIAARVACPDCIENESWREASGGCEVCGPNRTVAFCQRRFTETTVDKQVVAENPLDALVSWLINDLPLAYDTYAFSHFGGRFDMVLVFRELFKRGYNPDMLRKGNKMYEMRIRRQKKRNPNIG

SEQ ID NO: 135911 - protein, 45 aa, Heterodera glycines
  Coding regions on vcDNA: vcDNA=SeqID_62334; Strand=-; Position=1 -43,248-342
MKSAPMDIVVLWYHHNILSFYIISYIYKISVSITKINEICGDKKC

SEQ ID NO: 135912 - protein, 16 aa, Heterodera glycines
  Coding regions on vcDNA: vcDNA=SeqID_62335; Strand=+; Position=1 -43,410-417
MRSLRAFFHSRHGEVN

SEQ ID NO: 135913 - protein, 16 aa, Heterodera glycines
  Coding regions on vcDNA: vcDNA=SeqID_62336; Strand=-; Position=1 -34,915-931
MKWNKLIKMEKNKEIN

SEQ ID NO: 135914 - protein, 145 aa, Heterodera glycines
  Coding regions on vcDNA: vcDNA=SeqID_62337; Strand=+; Position=1 -132,168-473
MMIILSTKLLTMSVLLLPILLGNANAAGIGDRQKRAVEEEEQRIKFKELFNAENGSAEKEVLWMENIEMKADKEEEKEQQKKNEKQEEREKREEKAAEVTMDAKNEASLSTLLRNLTHSYHFGFCLSSFRLTKMLFWNMEKKLQP

SEQ ID NO: 135915 - protein, 48 aa, Heterodera glycines
  Coding regions on vcDNA: vcDNA=SeqID_62338; Strand=-; Position=1-144
MDLRHGLRLLLLFCLAHALAQSNDSQQSADCADGEFCALNDPDSSHFI

SEQ ID NO: 135916 - protein, 20 aa, Heterodera glycines
  Coding regions on vcDNA: vcDNA=SeqID_62339; Strand=+; Position=1-60
FTILRIFNSSIASLINFVSE

SEQ ID NO: 135917 - protein, 57 aa, Heterodera glycines
  Coding regions on vcDNA: vcDNA=SeqID_62340; Strand=+; Position=1-172
MTTYLFDKLKKKEDLLGMVRTIEQYADIGVLDFKEFMPSNQFSTEGLKVNEIHDIVS

SEQ ID NO: 135918 - protein, 117 aa, Heterodera glycines
  Coding regions on vcDNA: vcDNA=SeqID_62341; Strand=-; Position=1-466
PKMVISFFSFFLPQNLYQQLPSLVWPYQTILRYLKRKQKKFLTKNGYLFFLIFLPQNWYQQLPSCLALSNNLTIFETQTKKILDQKMAISFFSFFYRKIGTNSCLLLSGPIKQSYDI

SEQ ID NO: 135919 - protein, 51 aa, Heterodera glycines
  Coding regions on vcDNA: vcDNA=SeqID_62342; Strand=-; Position=1-152
TANLVPTVAFSCLALSNNLTILKRKQKKFLTKNGFSFFSFFHRKLGTNSCL

SEQ ID NO: 135920 - protein, 154 aa, Heterodera glycines
  Coding regions on vcDNA: vcDNA=SeqID_62343; Strand=+; Position=1 -82,159-357,405-741
SIIIYLCLNFFLLWHLFTHLPINFRHLLFMCQIGIIMVPFFVPFCRNFLALFCPLFPNLFLANFWHCFAQIFNPLFCQFLHIFVPNFPIYFLPIFRIILPQFLTLSFANFCTFLCQISLFISCQIFAHFCAKFPYLFLANFLHLFSPFSHLKNI

SEQ ID NO: 135921 - protein, 114 aa, Heterodera glycines
  Coding regions on vcDNA: vcDNA=SeqID_62344; Strand=+; Position=1 -28,400-716
  Homolog annotation: Hit_ID=NP_501528.2; Match level="QueryCoverage =63%, HitCoverage=3%, E-value=3e-15, Identity=54%"; Hit description=M protein repeat and RepA / Rep+ protein KID (4J603) [Caenorhabditis elegans] emb|CAA90998.2| Hypothetical
MAAEVERLKDAIFAQDEFIGMLEGDLLVYEAHVGILRDSLGATKREDRQHIKSKAFSAKLNALEMEKREIAKRNNGGVQVYYFFNSKKITNFFLIACHIPKIANKIPIQIPIIS

SEQ ID NO: 135922 - protein, 109 aa, Heterodera glycines
  Coding regions on vcDNA: vcDNA=SeqID_62345; Strand=+; Position=1-330
MLVVTVPPPPQSPSAVAVTTVAAVFGEWSSTVAVVSTVFPTTNTKLLLVLLLPQAFAAVAVPPPPPPPPKPPPPPQLGPIENVPAVLIDGRCCAVSIYLMRLNDYFFKH

SEQ ID NO: 135923 - protein, 46 aa, Heterodera glycines
  Coding regions on vcDNA: vcDNA=SeqID_62346; Strand=+; Position=1 -124,798-814
MPIPNKLHIFFSRIFIEKFRWATGNWNSELKKKTGFRHIPAENKTS

SEQ ID NO: 135924 - protein, 177 aa, Heterodera glycines
  Coding regions on vcDNA: vcDNA=SeqID_62347; Strand=-; Position=1 -167,680-799,869-934,1496-1681
  Homolog annotation: Hit_ID=NP_491095.2; Match level="QueryCoverage =94%, HitCoverage=24%, E-value=2e-57, Identity=58%"; Hit description =MODulation of locomotion defective MOD-5, serotonin reuptake transporter (75.0 kD) (mod-5) [Caenorhabditi
CICVFIMFPQFPCIEAFITGFCDESRLLARRREIFVACVIAVHYVGSLPATTYGGSYVIPFLDEYGVSLSVLFIVMCEMIAVCWFYGIRRFSEDIHSMLGFYPGLYWRCCWTLCPLFIGIIFVLALYSTSFSPMQIPNYTYPAWSVWLGWLFRLLSCASVPAYALYLFIFSRGNVMQ

SEQ ID NO: 135925 - protein, 298 aa, Heterodera glycines
  misc_feature (15)..(15): Xaa can be any naturally occurring amino acid
  Coding regions on vcDNA: vcDNA=SeqID_62348; Strand=+; Position=1 -192,240-472,523-700,892-959,1009-1114
  Homolog annotation: Hit_ID=NP_506927.1; Match level="QueryCoverage =94%, HitCoverage=33%, E-value=4e-68, Identity=49%"; Hit description =HAlF transporter, PGP related (haf-3) [Caenorhabditis elegans] emb|CAB09418.1| Hypothetical protein F57A1
YALVLIDKSSIRNFXLASERLSNVKTVKIFSAEAKELQSYKNKIMEIWEISKKEGTTKGLMFGGFQLTGYLALTFQLTGYLALTSMLYYGSVLIADGCLTYGDLSSFMLYSALCFGGITNFQLFYTELMRGLGASARIFELRDQKPSISSEGGLVINALNKEVRFESVGLVINALNKEVRFESVAFSYLNRESIFSDITFRIPKASVTAIVGASGSGKSTIAHLLLRLYSPTAGRIMVDDIDLKQLDLSSWRRMIGTVSQEPILWRRMIGTVSQEPILFSTLIRDNILYGGENSHLIT

SEQ ID NO: 135926 - protein, 32 aa, Heterodera glycines
  Coding regions on vcDNA: vcDNA=SeqID_62349; Strand=+; Position=1-104
ESASRSGTRLRRVARKCVNLAIHRSLRTGASR

SEQ ID NO: 135927 - protein, 95 aa, Heterodera glycines; identical to SEQ ID NO: 124528
  Coding regions on vcDNA: vcDNA=SeqID_62350; Strand=+; Position=1 -787,954-1261

SEQ ID NO: 135928 - protein, 58 aa, Heterodera glycines
  Coding regions on vcDNA: vcDNA=SeqID_62351; Strand=+; Position=1 -120,792-848
MEIKQDKCQNLLQCLENVAFELTEHVCQLPDVPSSSSVEKKFLKNIRKELRTTNFFKK

SEQ ID NO: 135929 - protein, 53 aa, Heterodera glycines
  Coding regions on vcDNA: vcDNA=SeqID_62352; Strand=-; Position=1-206
NFLPGGTQFFTLTTPALFFLNYFLHLITQRSRLIRSSPNFAGKLLRTLQMLIN

SEQ ID NO: 135930 - protein, 201 aa, Heterodera glycines
  Coding regions on vcDNA: vcDNA=SeqID_62353; Strand=+; Position=1 -33,81-173,265-590,700-853
  Homolog annotation: Hit_ID=XP_417149.1; Match level="QueryCoverage =84%, HitCoverage=18%, E-value=6e-10, Identity=33%"; Hit description =PREDICTED: similar to M-phase phosphoprotein, mpp8 [Gallus gallus]
MPVNNFLQKDDISLSGESAGEEYEVDQILGVRVLEDGTKEYKVRWKNYGSNDDTWEPMDNLVGAKDALDKFLKANKQAKKTPKASRTPVSTFSRTNKRKAQFKKATKLGRKRGGGDISQEAEDGENNRSSNEDESDDDFSVSSASKKKKTTDKKSKKAPVRRAVTASSGRPSSRPTPHNGDSLVPTDSALPPAFVVTSLHP

SEQ ID NO: 135931 - protein, 100 aa, Heterodera glycines
  Coding regions on vcDNA: vcDNA=SeqID_62354; Strand=+; Position=1 -111,181-374
SKASEHHLKFDGIYFDKNGVLKLVEKGGTQRVFTFEEAKDKNSSALCDYMCDMVTFTEKGKPQIQVAPQEMETEEGQHEEEEEKVLERTHDDDGKLNFDD

SEQ ID NO: 135932 - protein, 51 aa, Heterodera glycines
  Coding regions on vcDNA: vcDNA=SeqID_62355; Strand=-; Position=1 -106,737-786
MAFIGLEVPPNPNFNPALLGFDDVGLQPPLDQQNGDFVLSNDTKKIGFVRT

SEQ ID NO: 135933 - protein, 210 aa, Heterodera glycines
  Coding regions on vcDNA: vcDNA=SeqID_62356; Strand=-; Position=1 -176,238-280,344-396,700-858,1371-1487
  Homolog annotation: Hit_ID=NP_503056.1; Match level="QueryCoverage =90%, HitCoverage=34%, E-value=8e-37, Identity=47%"; Hit description =somatostatin receptor family member (4S168) [Caenorhabditis elegans] emb|CAA16290.1| Hypothetical protein
TNSPLFMLYTFGVGFLVPALLITFFYLRVILKLRADAISVRKHSDGQNWALSSARFHKVTKRIVAVILFYFVTKRIVAVILFYFLCWTPYWTLNIMSQFGIIIWTPYWTLNIMSQFGIIIVSWSTLTLSSVFFVAHLLVCFNSAANPVLYALINRELRQQNAQALQKRRRSLNAKRGRRLFRLRMAVFLRSAASGAGRKSGGPFVRMEKK

SEQ ID NO: 135934 - protein, 20 aa, Heterodera glycines
  Coding regions on vcDNA: vcDNA=SeqID_62357; Strand=-; Position=1 -33,99-128
MRKIIIKIKMKKCILLKLLK

SEQ ID NO: 135935 - protein, 49 aa, Heterodera glycines; identical to SEQ ID NO: 130195
  Coding regions on vcDNA: vcDNA=SeqID_62358; Strand=+; Position=1 -110,199-238

SEQ ID NO: 135936 - protein, 38 aa, Heterodera glycines; identical to SEQ ID NO: 130624
  Coding regions on vcDNA: vcDNA=SeqID_62359; Strand=-; Position=1-217

SEQ ID NO: 135937 - protein, 38 aa, Heterodera glycines; identical to SEQ ID NO: 129423
  Coding regions on vcDNA: vcDNA=SeqID_62360; Strand=-; Position=1-364

SEQ ID NO: 135938 - protein, 94 aa, Heterodera glycines
  Coding regions on vcDNA: vcDNA=SeqID_62361; Strand=+; Position=1 -97,264-451
MKTVSVALVLCLNIGPRPAPTCRSRSRARARRQTGRDRDPAGFLRDPAGLNSGSRPRDPSRTIFKFIGIDRDFIGIPKRDPSRPFYQSRGIPRD

SEQ ID NO: 135939 - protein, 19 aa, Heterodera glycines
  Coding regions on vcDNA: vcDNA=SeqID_62362; Strand=+; Position=1-61
FGREILFFETKLKTYITYI

SEQ ID NO: 135940 - protein, 308 aa, Heterodera glycines
  Coding regions on vcDNA: vcDNA=SeqID_62363; Strand=+; Position=1-924
  Homolog annotation: Hit_ID=EAL49477.1; Match level="QueryCoverage =91%, HitCoverage=21%, E-value=2e-11, Identity=22%"; Hit description =hypothetical protein 42.t00003 [Entamoeba histolytica HM-1:IMSS]
MDDLFENLFENNSQNLKRLKSDEQPEKQQQKLSVKAEQNKKWDESSQKMTKKLKIEIKEEEEEEEEEWHTDKVPMGEQIHKIKSEPNFDQNEIANRTQKLKFVKKEPKMENDDHFISNDGTVQAENESDQQQNECSSPSQNDQNASSDQSMDEKQDESEDERKLKQIEKFDKMRKAYWAKNGHKREERMKVERKIAREMGIYRTQIYKWKKELGQNAYDKRESEETKKRTIYLFEEIKQQMKDNKLYICKYRRKIEQKIAIKLGTYHCQILKWKKEFVISRGRKVIEESDQDDQSSSADEVLMVLGPG

SEQ ID NO: 135941 - protein, 80 aa, Heterodera glycines
  Coding regions on vcDNA: vcDNA=SeqID_62364; Strand=-; Position=1-323
FLPGGTQFFTLTTPALFFFNYFFHFITQRSRLIRSSPNFAGKLLRTLQMLINFLRIFCPEEHSSSHLPHQHYFFLIIFCI

SEQ ID NO: 135942 - protein, 87 aa, Heterodera glycines; identical to SEQ ID NO: 129152
  Coding regions on vcDNA: vcDNA=SeqID_62365; Strand=+; Position=1-940

SEQ ID NO: 135943 - protein, 74 aa, Heterodera glycines
  Coding regions on vcDNA: vcDNA=SeqID_62366; Strand=-; Position=1-222
MSIAMVDDASVHSESVELRSRNTKMHGPIGGTEMAYRNDNCTTSGGNGGRMPLIEHVVKNGESLMQISLQYSVP

SEQ ID NO: 135944 - protein, 97 aa, Heterodera glycines
  Coding regions on vcDNA: vcDNA=SeqID_62367; Strand=+; Position=1-291
  Homolog annotation: Hit_ID=AAH84329.1; Match level="QueryCoverage =76%, HitCoverage=22%, E-value=5e-25, Identity=67%"; Hit description =Unknown (protein for MGC:83943) [Xenopus laevis]
MGLDPKVLTSVINSSSGRCWSSDTYNPCPGILPNTPASSNYEGGFGCKLMAKDLGLAQNSSTQFKVPTPMGSLAPNLPFALRSTKIREQRLHRGLKN

SEQ ID NO: 135945 - protein, 17 aa, Heterodera glycines
  Coding regions on vcDNA: vcDNA=SeqID_62368; Strand=+; Position=1-53
LIRQKRLPGVFGVADHE

SEQ ID NO: 135946 - protein, 59 aa, Heterodera glycines
  Coding regions on vcDNA: vcDNA=SeqID_62369; Strand=-; Position=1-279
QGWAEVSLFAFRLSHFLAFRISLFAFRFLARNATFTPLRIGLNSHKIFQNFTYKLANFQ

SEQ ID NO: 135947 - protein, 45 aa, Heterodera glycines
  Coding regions on vcDNA: vcDNA=SeqID_62370; Strand=+; Position=1 -103,196-230
MNGWEEAIMDYEKRKTKRKNWFLEFERRWIRMHIQYEKKYNLVDE

SEQ ID NO: 135948 - protein, 25 aa, Heterodera glycines
  Coding regions on vcDNA: vcDNA=SeqID_62371; Strand=-; Position=1-77
SKSSLTTAQKNMFFVRFRPRGAQEK

SEQ ID NO: 135949 - protein, 66 aa, Heterodera glycines
  Coding regions on vcDNA: vcDNA=SeqID_62372; Strand=+; Position=1 -186,230-244
MKIINKVQKMCQVKTTGLIEYEQKIGYFYLNEEIFNSSELFLFLCFVKCFKNYPYGIILLTAYCNV

SEQ ID NO: 135950 - protein, 46 aa, Heterodera glycines
  Coding regions on vcDNA: vcDNA=SeqID_62373; Strand=+; Position=1 -33,1126-1230
  Homolog annotation: Hit_ID=XP_242982.2; Match level="QueryCoverage =86%, HitCoverage=1%, E-value=8e-10, Identity=71%"; Hit description =similar to talin [Rattus norvegicus]
MGIANHEEYSLVRRWAASFKTFTLDFGDYKDGYYSVQTLEGERIGQ

SEQ ID NO: 135951 - protein, 193 aa, Heterodera glycines
  Coding regions on vcDNA: vcDNA=SeqID_62374; Strand=-; Position=1 -184,299-424,466-527,568-657,894-1013
MLSEEQWEQLLMRRDTVFGRRARIFRDSKGEFGTINLFAIVGAADLIVRRGGSSQISDITEYFNNLGEDEQGRILRRAQLIGAIWNIAFGSGSAEFSLQEYLGDMDLLGLWDVYFEEGAHQDQEFDEDYPIPPGIVELIAQQTQGVPPNPQSDEEQLNVGIATPNCKGVRKSRTPVGTAMNLCAVGIVALDIG

SEQ ID NO: 135952 - protein, 62 aa, Heterodera glycines
  Coding regions on vcDNA: vcDNA=SeqID_62375; Strand=+; Position=1 -173,204-219
MVHHTDRIGNYNELPLYEQGRKLNKAQIVGLIWNIWFGTGSKPFSPEEYLRGLKIEKRNGPS

SEQ ID NO: 135953 - protein, 56 aa, Heterodera glycines
  Coding regions on vcDNA: vcDNA=SeqID_62376; Strand=-; Position=1 -96,139-213
MCKDFADKWALRGQAELIPLAQKMNKAKYKNQWDTLPAGAIRKRMRLDSDKDLMVV

SEQ ID NO: 135954 - protein, 371 aa, Heterodera glycines
  misc_feature (4)..(4): Xaa can be any naturally occurring amino acid
  misc_feature (228)..(228): Xaa can be any naturally occurring amino acid
  Coding regions on vcDNA: vcDNA=SeqID_62377; Strand=-; Position=1 -335,378-567,876-1066,1108-1353,1393-1432
  Homolog annotation: Hit_ID=EAA11999.2; Match level="QueryCoverage =81%, HitCoverage=49%, E-value=5e-56, Identity=43%"; Hit description =ENSANGP00000016092 [Anopheles gambiae str. PEST]
IYKXVNLSIQFPSVGASLESQKLIKLLTIMSKGERYAITTIFISVFVQLLNGTVLSAASTGIAALLLIGGGTVHRQFSVPNDIDDDSPPKIAFESARAKQLRAVELIIIDEISMLSKKVLRYVDEISMLSKKVLRYVDRLLRDVCAVDKPFAGKVVVLGGDWRQLTPVVEHGTREDQVQESIKMETLYDVQRINDLAIDRLAGAPILYESIDSPLEAQEEFHFSLGLXSEAIHNETPSGVPPHKLILKAFAPVMLIRNLDVAPVMLIRNLDVTCGLCNGTRLQIKTMTDENLHCRILTGSREGQDFLIPRVKFEYGQGRHHRGLRFRRIQFPVRPCFAMTVNKSQGQTLQKMGLVLNSQGQTLQKMGLVLN

SEQ ID NO: 135955 - protein, 102 aa, Heterodera glycines
  Coding regions on vcDNA: vcDNA=SeqID_62378; Strand=-; Position=1-309
  Homolog annotation: Hit_ID=EAL25299.1; Match level="QueryCoverage =86%, HitCoverage=37%, E-value=4e-12, Identity=42%"; Hit description =GA10635-PA [Drosophila pseudoobscura]
MEKGGKVCDFWCQTAKKGRTEMATKGRTEMATKGRTEMATEGRTEMATEGRTEMATEGRTEMATEGRTEMATEGRTEMATEGRTEMATKGRIESAEEMVPCH

SEQ ID NO: 135956 - protein, 118 aa, Heterodera glycines
  Coding regions on vcDNA: vcDNA=SeqID_62379; Strand=+; Position=1 -34,381-495,606-650,739-765,842-959
  Homolog annotation: Hit_ID=XP_357091.1; Match level="QueryCoverage =94%, HitCoverage=18%, E-value=4e-37, Identity=65%"; Hit description =similar to PR domain containing 14; PR-domain zinc finger protein 14 [Mus musculus]
CLQPIAAIGVPFGLTNEEKAQIRATEANGERAEGYSCCRCGKVFSYEYYRDKHLKFTRCVDSGNRRFPCSLCSRSFEKRSFEKRDRLRIHILHVHERYRPHECSMCSKAFSQSSSLNK

SEQ ID NO: 135957 - protein, 24 aa, Heterodera glycines
  Coding regions on vcDNA: vcDNA=SeqID_62380; Strand=+; Position=1 -52,295-317
MEKACKIWRDYIDFSALELLELAS

SEQ ID NO: 135958 - protein, 220 aa, Heterodera glycines
  Coding regions on vcDNA: vcDNA=SeqID_62381; Strand=-; Position=1-662
MQHTKRYLLVPEEIYQSLAAPPPSDGTPIGLVRTRIKQIKNDDAINEAERAVKYEQEVKRLNKLTKDEDERPVGVKLENLSDVVDAMPKPVNVTRPIVVSTRRHLKVGRARKENVEQLEDTDDDDYQNPRSSSSNKRQPTQTEILKLIYKNAQSLGVSEEGQVLRAGGRPFITSSVDDIVSHLFNKDKRENKEPTAFKEFVERARQNPLLSRHLFPEGQS

SEQ ID NO: 135959 - protein, 49 aa, Heterodera glycines
  Coding regions on vcDNA: vcDNA=SeqID_62382; Strand=+; Position=1-152
SENPFLIFISSLENPNSNKIRKFIPQLEILFLMLTSSRRAHLYTINYPQ

SEQ ID NO: 135960 - protein, 287 aa, Heterodera glycines
  Coding regions on vcDNA: vcDNA=SeqID_62383; Strand=+; Position=1 -413,549-996
  Homolog annotation: Hit_ID=XP_313035.1; Match level="QueryCoverage =100%, HitCoverage=38%, E-value=4e-57, Identity=39%"; Hit description= ENSANGP00000011760 [Anopheles gambiae]
MPAPTDEQTLRSFLGAINYYSRFVSQMHEIRAPLDELLKKDVQWRWGPDQQQAFEGAKKIITSDLLLMSYDPAKPIVVAADASNKGLGATISHTFADGSEKVVEHASQSLTPAERNYSQIEKEALAIIFAVQKFHRMFIRYISTKNFGQADVLSRLIKQHRDTLQEEDKVIASAQMAQNLDYSENANIEFCAAAVDYMFQTTIDQLPVTADEIAEHIERDEEMKKVIEHCRNGWPKTANELTMAAFYTHRLRISEVNGCLLMGDRVIIPSALRFRILKALHFTHPGM

SEQ ID NO: 135961 - protein, 50 aa, Heterodera glycines
  Coding regions on vcDNA: vcDNA=SeqID_62384; Strand=+; Position=1 -24,76-203
MADFNNDTFYLTFKDANPSWSLIGCASVLGLIALFGIISNSSVIYVTIMT

SEQ ID NO: 135962 - protein, 265 aa, Heterodera glycines
  misc_feature (182)..(182): Xaa can be any naturally occurring amino acid
  Coding regions on vcDNA: vcDNA=SeqID_62385; Strand=-; Position=1-805
  Homolog annotation: Hit_ID=NP_508646.1; Match level="QueryCoverage =98%, HitCoverage=13%, E-value=2e-35, Identity=36%"; Hit description =predicted CDS, RNA-directed DNA polymerase  and Integrase, catalytic domain containing protein family mem
HLVELLRKLIQFRATKYPIWADIEKAFLMVSLKESDREFSKFLWVKNIFAPLSGENLLVFRFRRITFGIVSCPFLLAATLQHHLEAFPSELAEEIRDLLYVDNLLLLADSPEEARRKAAEAQKIFAAAQMRLCEFIAADPSSLDEIPENDRLRNEAPLGLKWTICEDNLSLTFPTVPVRTVXPGVASFFDPLGLCSPCLVGAKLFFQKLWDGSKGWDDPIPAEETKEWDEIKALWAAKTMHIARFTPRINLEKIQLHVFTDASPN

SEQ ID NO: 135963 - protein, 681 aa, Heterodera glycines
  Coding regions on vcDNA: vcDNA=SeqID_62386; Strand=+; Position=1-2043
  Homolog annotation: Hit_ID=CAA82797.1; Match level="QueryCoverage =51%, HitCoverage=44%, E-value=5e-16, Identity=24%"; Hit description =gag protein [Ascaris lumbricoides]
MAMERGLGEVKRIFEGHFEKGIAEAGAAPEERQDFFYDSIAAPLPAATKYLRLREHPTPAELLQIAAEHLGDLRAMRQTFEDEERESISRSSRSVETENNQAEEELPRAMPRRSMQEWETSFREAYVRQHDELFGQQQPLVNQAERVATPVMSNMAALIQRRSNAPSVASVRVNNPVREWMARNQGVGNGPPAQAQQPTQAQRPLQAVQQRLEQLTLNDPRANFPRAAPHFHVRREEPPTRDRTRAQGVFPSRPHRPDESAGMLTTFEAVRLQPPTFSGRPEDWTTFWAYFQRAVDDKQIPGFEKQLHLLRCLKEGSPARRAVEVYPPSDGNYPVVVQLLKERFGDTNDLQRAIRAQLLHLQPAKDNVSSLTAVIDEFERGVCQLEQLGANVDDESFGPLLEAKLPVHILTELRIRESTMGAKWTVREFRKAVGVQVKCMRAAESALAAMKGPERRHEQRSEPERGGRNARTGQGFQRAFMIRDQPPEKRTTNEAHTRTEVAMPPTRPANPNRVPLGSYSRPMGAHSQTQNGQEGQPRQGCSLCGQTGHQPSRCGKYGSAQAKRRRLIEQRRCLKCLGSDHTAQQCTRKTACRTCEQMDHHWLICWKGERRNEPPSHSRTEDAQQNRTMIIREIEAKHVRTPPPTESSKDGMGAKGEDPPLLDGEQRAFTTVGQQLPAYLM

SEQ ID NO: 135964 - protein, 66 aa, Heterodera glycines
  Coding regions on vcDNA: vcDNA=SeqID_62387; Strand=-; Position=1 -56,204-348
MEGQLKRRKILKTLMHLIKLTEDSWDNRIILRYFVLKFGFNYNFKRGTGPQGRRGTGPQGSRLSAN

SEQ ID NO: 135965 - protein, 368 aa, Heterodera glycines
  Coding regions on vcDNA: vcDNA=SeqID_62388; Strand=-; Position=1 -374,618-1351
  Homolog annotation: Hit_ID=NP_494302.1; Match level="QueryCoverage =61%, HitCoverage=16%, E-value=3e-27, Identity=34%"; Hit description =predicted CDS, putative protein of ancient origin (2C878) [Caenorhabditis elegans] gb|AAB95006.1| Hypothe
STSTNTQRNDGLKAPGKSGELNKRVKRSLKKQFEQIGDSIELNKDELEVNDCLFKRRKVDRELINLDEVSNDFFVGTSNKQNSDVKFYELSDFNFKCLHCPAVHFLEERNTSKINVEFGNCCSYENEDLPTNGQLYFIDTDQSLNYRMQMCNENPKEKEKMGFLMSYIENYLRENYIFAKSYEMMKDVIESSKKTENEFEIPDVTMLFSVREGVDLRRYNIPRSNEVCAVLFRDANEEIPAANIVVHSKGQKQIKNIYPLDKLVEPLIYPIFYPNYYEGWHYKLKDQKGNPISLCDFTKYKLFYRNEGKFLPHHFARKLFQQWVVDQAARIEWNRLNYIKIHQKEICKESYSNIGKILESRAIEEGIS

SEQ ID NO: 135966 - protein, 95 aa, Heterodera glycines
  Coding regions on vcDNA: vcDNA=SeqID_62389; Strand=+; Position=1-931
MFEYPKRTLEKIDFFVFGAVPPNRCAQIYGETESFGNSFPIVCTLILRWSFAPHKCLSTPNGHLKKSIFLFSGQSPRTDAPRFMGRPNPSGLASL

SEQ ID NO: 135967 - protein, 28 aa, Heterodera glycines
  Coding regions on vcDNA: vcDNA=SeqID_62390; Strand=-; Position=1-85
MLPNWDPVLQALFASLFTWGVTALGASL

SEQ ID NO: 135968 - protein, 55 aa, Heterodera glycines
  Coding regions on vcDNA: vcDNA=SeqID_62391; Strand=+; Position=1 -53,195-309
MSTSFFVCQHGKEKGQGKIAQQIEHAQPYVLRNTQMALENVRRIVDGSAKNASFI

SEQ ID NO: 135969 - protein, 169 aa, Heterodera glycines
  Coding regions on vcDNA: vcDNA=SeqID_62392; Strand=-; Position=1-512
  Homolog annotation: Hit_ID=NP_045241.1; Match level="QueryCoverage =96%, HitCoverage=6%, E-value=1e-13, Identity=37%"; Hit description =24 [Equid herpesvirus 4] gb|AAC59539.1| 24 [Equine herpesvirus 4] pir||T42567 tegument protein 24 - equine
TSTLGTASQKTAAAPAGGTSPLGTASQKTAAAPAGGTSALGTASQKTAAAPAGGTSALGTASQKTAAAPAGGTSALGTASQKTAAAPAGGTSALGTASQKTAAAPAGGTSALGTASQNLTYDFPLDYLNMSSQWGGGRPVKPAAAPKAGQAPHGGGGPAQTPSEKMPKF

SEQ ID NO: 135970 - protein, 61 aa, Heterodera glycines
  Coding regions on vcDNA: vcDNA=SeqID_62393; Strand=+; Position=1 -170,641-656
  Homolog annotation: Hit_ID=AAO33473.1; Match level="QueryCoverage =91%, HitCoverage=60%, E-value=2e-26, Identity=98%"; Hit description =gland-specific protein g4e02 [Heterodera glycines]
MSLLRPQSLLLLAALCLSFALLFVTSSEEGGRVKRGGWPWDWAGKQLCKTSANCKCNAFIF

SEQ ID NO: 135971 - protein, 205 aa, Heterodera glycines
  Coding regions on vcDNA: vcDNA=SeqID_62394; Strand=-; Position=1 -95,169-387,1259-1559
  Homolog annotation: Hit_ID=BAD62488.1; Match level="QueryCoverage =32%, HitCoverage=83%, E-value=7e-17, Identity=50%"; Hit description =putative glycine-rich protein 1 [Oryza sativa (japonica cultivar -group)] dbj|BAD62129.1| putative glycine-
MKNILLSILLALLVFSVLADDKAQKTEDGQKNPAIARPKRGHGYGYNNWGGNGGYGYGGGWGNNGGWGNGGWGNGGYGYGGGWGNNGGWGNGGYGYGGGYGYGWNAITLFDSLALAICRCFAQLFAGPIPRPSAALHSPSLFRRSDKEQRKGQAKSGQKKQRLRTEKGHFADWQMKRMIGWMDGFAFEGMNAFALLLRLFIRPKK

SEQ ID NO: 135972 - protein, 117 aa, Heterodera glycines
  Coding regions on vcDNA: vcDNA=SeqID_62395; Strand=+; Position=1 -127,186-322,369-544
FYFFISYFKTFSTFAPLKFYLSFHKFHLKFSPFSVFLWHPFIFGPLFLNWPRRLRLRRLPQHLLFGCSKTFCRRRKVRRRLSRRRHRRRRLCPIGWQSAVFPAQVAHCSQLAQRRLR

SEQ ID NO: 135973 - protein, 126 aa, Heterodera glycines
  Coding regions on vcDNA: vcDNA=SeqID_62396; Strand=-; Position=1-381
MPMERMCRRKRGKRRGEDMARNTSDGEVTSDGGMPLVKKRMVTRRQAMKEATTTAARPHRMKRFPSPTSPVAFVSSNDLLHQLDFGIVSIQPPLFSLNDAATFSVLKRIGEEQKLSLEERRLISDD

SEQ ID NO: 135974 - protein, 114 aa, Heterodera glycines
  Coding regions on vcDNA: vcDNA=SeqID_62397; Strand=+; Position=1 -167,558-592,839-981
MDGEETTSTEEEEAEEAAGETEEEHEEEEEEEEDEEEDDTGEDIDMLLNSSEGNKATNLSLPILGTVGGSVSEDGRVNGGNESLFIKNRVIGLKFLKSVWENPLLLFHPKEPHY

SEQ ID NO: 135975 - protein, 95 aa, Heterodera glycines
  Coding regions on vcDNA: vcDNA=SeqID_62398; Strand=+; Position=1-827
LFEYPKRTLEKIDFFVFGAVPPNRCAQIYGETESFRNSFPIACTLILRWIFAPHNCLSTPNGHLKKSIFLFSGQSPRTDAPRFMGRPNPSGLASL

SEQ ID NO: 135976 - protein, 98 aa, Heterodera glycines
  Coding regions on vcDNA: vcDNA=SeqID_62399; Strand=+; Position=1-296
LILRWIFAPHNCFEYPKRTLEKIDFFVFGAVPPNRCAQIYGETESFGNSFPIACTLILRWIFASHNCLSTPNGHLKKSIFLFSGQSPRTDAPRFMGRP

SEQ ID NO: 135977 - protein, 105 aa, Heterodera glycines
  Coding regions on vcDNA: vcDNA=SeqID_62400; Strand=-; Position=1 -246,291-360
TSSIPMGPVLPCIGQNNKKDEVMKKKEKNDEKMTLETNKMASEKRKRPPSLSEKSFPYNAGLEKNKLFVKKLDWSCTGEELKKFFEKFGTVVDARIVTKWNGRSE

SEQ ID NO: 135978 - protein, 33 aa, Heterodera glycines
  Coding regions on vcDNA: vcDNA=SeqID_62401; Strand=-; Position=1 -67,668-702
MTNEKDSIWFYFDKIHNSSYAKWLPFLSIKNHE

SEQ ID NO: 135979 - protein, 73 aa, Heterodera glycines
  Coding regions on vcDNA: vcDNA=SeqID_62402; Strand=+; Position=1-222
MKLCLIFSLILFLLIIFDQIGAEKKKLQQKTFDEIFGEKWEEKEEKERNEKKKREIIRKFYKIKEKIKQKERK

SEQ ID NO: 135980 - protein, 72 aa, Heterodera glycines
  Coding regions on vcDNA: vcDNA=SeqID_62403; Strand=-; Position=1 -122,230-324
ATSKGCTPPIGMGPRAATSKDCTPPIGLGSCGIKGLRPSHRHGFVRGGNIKGLRPSHRHGFVRETPVRNRAL

SEQ ID NO: 135981 - protein, 77 aa, Heterodera glycines
  Coding regions on vcDNA: vcDNA=SeqID_62404; Strand=-; Position=1-232
MDGGIAWPGMAWVTECHGEKGVESGTHAGKSATAWHGSAAVGKGVELHGLLSWHNSKGFNGAEEMPNDRPKGHTEMG

SEQ ID NO: 135982 - protein, 138 aa, Heterodera glycines
  Coding regions on vcDNA: vcDNA=SeqID_62405; Strand=+; Position=1 -110,154-211,317-566
  Homolog annotation: Hit_ID=NP_729142.1; Match level="QueryCoverage =70%, HitCoverage=20%, E-value=9e-38, Identity=75%"; Hit description =CG7018-PA, isoform A [Drosophila melanogaster] gb|AAF50697.2| CG7018- PA, isoform A [Drosophila melanogast
AVNPFPLADNGQIQLWQFLLELLSTGDSCITWEGTKGEFKLLKPDEVAKKWGERKSKPNMNYDKLSRALRYYYDKQFMSKVHGKRYTYKFDLDTLAKACEAAAEGPKEMPKEGRKGTAETMAEDERAANWGGTTAGKN

SEQ ID NO: 135983 - protein, 101 aa, Heterodera glycines
  Coding regions on vcDNA: vcDNA=SeqID_62406; Strand=+; Position=1-306
MEVKFEEEEEADGRVAMALAFWALLSCCWTEWCREDERDKKLCPLMLWFILALKKAKKINPKNGESDSPQLRLVPNVKTEIQSAETEEGTQTETERQKNAN

SEQ ID NO: 135984 - protein, 409 aa, Heterodera glycines
  Coding regions on vcDNA: vcDNA=SeqID_62407; Strand=-; Position=1 -186,227-307,432-548,664-801,855-986,1054-1292,1342-1678
  Homolog annotation: Hit_ID=CAE63272.1; Match level="QueryCoverage =50%, HitCoverage=29%, E-value=6e-20, Identity=32%"; Hit description =Hypothetical protein CBG07649 [Caenorhabditis briggsae]
MDRDGGKGGDGEGKEGGTEWTMPNGTKLIGDEQRQHGTDQKETKDESAKNVAAATNASSAGDPIEVRPSSPPTDQSADLRRRVQLRSPPLNRPSPSMPISTNGAQMPRPKSRIQADGEQLRFEVLVSEDSGNYTCRVNGAVVVLRLLVEKPVIELSAVEIGSHYVALAWNDSLKIRAAERVHLSLEVRDAITQQRRTIQLSLHNPWRSYNVVRLRPLTNYTFCLEYHLVHFLLHLADSSSSIFKTCIDVQTEEPLGFWTSLSPISIGILLAFCFCLSALLCFRALYLRFYIWHEAKLRARMNQSMSGQSFLSRSSSLHHSVQQQLNSAQNANAIATRPSASSSSSNFTSIWEERSSPAQCLQTPGNEKRIKKKRKDKTTALRLGAKKSADNDARGDGEGMGVAESIVLC

SEQ ID NO: 135985 - protein, 100 aa, Heterodera glycines
  Coding regions on vcDNA: vcDNA=SeqID_62408; Strand=+; Position=1-303
MAKVQFFNCRTEAQNMFTDSLKKAKNGEKIREKGKANQKAISAEGKAPQAKQSKGLPFDANDAIGVQANFFGIRKGNETVPGNTLREKSDRSLNIQSYRN

SEQ ID NO: 135986 - protein, 64 aa, Heterodera glycines
  Coding regions on vcDNA: vcDNA=SeqID_62409; Strand=+; Position=1-197
IKNAIGKCQEVTDGQSEQINAERIDKTTSRRNSQFEDEERENEQEIRKALLPKAQQKDIYLSEI

SEQ ID NO: 135987 - protein, 280 aa, Heterodera glycines
  Coding regions on vcDNA: vcDNA=SeqID_62410; Strand=-; Position=1 -235,297-605,775-1073
MTDIYYKIASFDHSYLNKINQSELFSMIDEIVENFQLCNVEETRSLSRWVYCMLLVLLWIALVMTGIFLYFNSLIRNLSGNTKTRELYLGCFPCDKLPNIINKYPSTLVANNDPSNKEGTHWIAMFIVDDRTVYYFDSFGRKPNRCISQFLRNYEKVISNKPAIQSVFSENCGYYCIYFIYYTIIASLLNCPARNLCDCLNHPDEIQKVEKYLKGKTLQTTYKNQLDEYKDFEYGGITRESARKQMAYNGFKNVTVDQHFYVRHRICLRYANNPCVIEKR

SEQ ID NO: 135988 - protein, 116 aa, Heterodera glycines
  Coding regions on vcDNA: vcDNA=SeqID_62411; Strand=+; Position=1-568
KLFKEFIINSFIKMDRLDTIIASLLNCPARNLCDCLNHPDEIQKVEKYLKGKTLQTTYKNQLDEYKDFEYGGITRESARKQMAYNGFKNVTVDQHFYVRHRICLRYANNPCVIEKR

SEQ ID NO: 135989 - protein, 71 aa, Heterodera glycines
  Coding regions on vcDNA: vcDNA=SeqID_62412; Strand=-; Position=1-268
ITAQINENHLPIVLSFFLFSHNPISDSAPSSGFIECACLSHFLLSVPPPQKGASAVVVLPKPSAGQSICDH

SEQ ID NO: 135990 - protein, 122 aa, Heterodera glycines
  Coding regions on vcDNA: vcDNA=SeqID_62413; Strand=-; Position=1 -255,296-406
  Homolog annotation: Hit_ID=NP_508627.3; Match level="QueryCoverage =96%, HitCoverage=24%, E-value=2e-40, Identity=68%"; Hit description =sensory AXon guidance SAX-1, ndr protein kinase family member (55.5 kD) (sax-1) [Caenorhabditis elegans]
MTSASQYVRDKANRTRLSIESYYAQAVVHLAEREQRAEKLEKQMAEEGLNELEKEDRRKIHAAKENDFLRQRRTKLSANDFQSLKVIGRGAFGEVRLVQKIDTGHIYAMKILRKSEMLEKEQ

SEQ ID NO: 135991 - protein, 91 aa, Heterodera glycines
  Coding regions on vcDNA: vcDNA=SeqID_62414; Strand=-; Position=1 -128,174-321
  Homolog annotation: Hit_ID=CAI24701.1; Match level="QueryCoverage =49%, HitCoverage=10%, E-value=6e-13, Identity=68%"; Hit description =novel protein (3300001P08Rik) (Luc7a) [Mus musculus] emb|CAI25944.1| novel protein (3300001P08Rik) (Luc7a)
LLDPEARQREVYQAGYKDPNAPKPMRVCEVCGSFLIIGDVQQRIDDHMQGRQHLGYAKITATLAELKVFNLNVMWRNAWIYYFGKDLYHSF

SEQ ID NO: 135992 - protein, 136 aa, Heterodera glycines
  Coding regions on vcDNA: vcDNA=SeqID_62415; Strand=-; Position=1 -284,341-467
TFLRATTSVSYQMNFKLNNSTQIELFELVNERTNEKLTLIMDDGEVINYYGMLKRCPIIVGEMAAAVQWENDEHLDDNLNSVQFFLWDIAVNFIGPLSPPADEEEKAGQSNDEMFSTTPGAKWNSGGMSDYFENVV

SEQ ID NO: 135993 - protein, 19 aa, Heterodera glycines
  misc_feature (2)..(2): Xaa can be any naturally occurring amino acid
  Coding regions on vcDNA: vcDNA=SeqID_62416; Strand=-; Position=1-59
TXAFSSLALPNTHTIFEML

SEQ ID NO: 135994 - protein, 19 aa, Heterodera glycines
  Coding regions on vcDNA: vcDNA=SeqID_62417; Strand=-; Position=1-59
TFAFSSLALPNTHTIFEML

SEQ ID NO: 135995 - protein, 19 aa, Heterodera glycines
  Coding regions on vcDNA: vcDNA=SeqID_62418; Strand=-; Position=1-59
TFSFSSLALPNTHTIYVML

SEQ ID NO: 135996 - protein, 19 aa, Heterodera glycines
  Coding regions on vcDNA: vcDNA=SeqID_62419; Strand=-; Position=1-59
TFAFSSLALPNTHTIFEML

SEQ ID NO: 135997 - protein, 19 aa, Heterodera glycines
  Coding regions on vcDNA: vcDNA=SeqID_62420; Strand=-; Position=1-59
TFAFSSLALPNTHTIFEML

SEQ ID NO: 135998 - protein, 19 aa, Heterodera glycines
  Coding regions on vcDNA: vcDNA=SeqID_62421; Strand=-; Position=1-59
TFAFSSLALPNTHTIFEML

SEQ ID NO: 135999 - protein, 19 aa, Heterodera glycines
  Coding regions on vcDNA: vcDNA=SeqID_62422; Strand=-; Position=1-59
TFAFSSLALPNTHTIFEML

SEQ ID NO: 136000 - protein, 19 aa, Heterodera glycines
  Coding regions on vcDNA: vcDNA=SeqID_62423; Strand=-; Position=1-59
TFAFSSLALPNTHTIFEML

SEQ ID NO: 136001 - protein, 19 aa, Heterodera glycines
  Coding regions on vcDNA: vcDNA=SeqID_62424; Strand=-; Position=1-59
TFAFSSLALPNTHTIFEML

SEQ ID NO: 136002 - protein, 34 aa, Heterodera glycines
  Coding regions on vcDNA: vcDNA=SeqID_62425; Strand=+; Position=1-199
KIEEQSKKEKKLKILLIYKKQHRCKKILLTLEKF

SEQ ID NO: 136003 - protein, 444 aa, Heterodera glycines
  Coding regions on vcDNA: vcDNA=SeqID_62426; Strand=-; Position=1 -1023,1569-1877
MTLNTIPNLDGSRGSDSVNAIFKQFDIATEEWPEQKRVRALRSKCFGKAERAFNSAVAENRHDYQLIRTSIIRQLDDTDAKQLTAFDQLMKGVWLRPNEGIDQLGERVSRLVRCAYPGLSEQLYDEYSAMHFIRALPNSELAMNLEMTRKPGATFDEFIAQAARAEAVQNAARNSWRNSQNNGCFQNQRRHIVCYNCGRVGHTSRNCYSQPTHQTHQISKNCNLQSTPPPLLNQQNDEPPKKGNLLVGAINLEHRPEIEKFFGKATNESDKGRFLEESPAVGIILTTKVSVFGRKLDAMLDGGSQISLISAKFFSQIMDKVSKKDVISRSESQVIDINGKELGTTENLGRGKASPTTASSANGRLDLCDRRPDSRPQSSFHRGETNTKFGQRIFYRGGKCRKEPDRGMLGDGRRHKLNSPTTYWMRMSIKGRGRLFLGGSGCVN

SEQ ID NO: 136004 - protein, 44 aa, Heterodera glycines
  Coding regions on vcDNA: vcDNA=SeqID_62427; Strand=-; Position=1 -93,141-182
MENRSNLRKNWAFTEKHSENGKKNLASKLAKKQMPIQMKKKQSK

SEQ ID NO: 136005 - protein, 213 aa, Heterodera glycines
  misc_feature (10)..(10): Xaa can be any naturally occurring amino acid
  misc_feature (37)..(37): Xaa can be any naturally occurring amino acid
  Coding regions on vcDNA: vcDNA=SeqID_62428; Strand=-; Position=1 -197,780-871,943-1142,1256-1404
  Homolog annotation: Hit_ID=XP_422708.1; Match level="QueryCoverage =91%, HitCoverage=24%, E-value=4e-30, Identity=41%"; Hit description =PREDICTED: similar to hypothetical protein FLJ11301 [Gallus gallus]
AYARGGRGTXGGGAAGGRAPPGRGPAPAGGRGGRGKXRRAGPAAGAAPEKTFAGFYRSGGPSRRSKTHESDVQELLTNAELANSTFEAERGDIKFNGNGNVAISSTKQMDLANSLDRLNADYGHLLRIPRRPRPNTYEDAEQLNALEAEEFVAWRRQLAKLSEERNIVITPFERNLEIWRQLWRVVERSHLVVQVNFYFKGHFITYQILFLLL

SEQ ID NO: 136006 - protein, 68 aa, Heterodera glycines
  Coding regions on vcDNA: vcDNA=SeqID_62429; Strand=+; Position=1-207
MPRYLFAFYGGRAVAEPKGTERSPTRKNALLQPAEAHNDVEDEERSPTDEKGREHDDEHLKGADSLPA

SEQ ID NO: 136007 - protein, 87 aa, Heterodera glycines
  Coding regions on vcDNA: vcDNA=SeqID_62430; Strand=-; Position=1-264
MCLKYVCGELLVGYSARSPLIPSPLPPPHNRQQRVGWGQRTLPRLRMPMPDPECNGHGESTCPAETPCHRLPFLCQGEKLGNGMEKN

SEQ ID NO: 136008 - protein, 29 aa, Heterodera glycines
  Coding regions on vcDNA: vcDNA=SeqID_62431; Strand=+; Position=1 -66,123-146
MAIYFFEKFSMQQTLSNMKRSAKNGYLFF

SEQ ID NO: 136009 - protein, 29 aa, Heterodera glycines
  Coding regions on vcDNA: vcDNA=SeqID_62432; Strand=+; Position=1 -66,123-146
MAISFFEKFSMQQTLSNMKRSAKNGYLFF

SEQ ID NO: 136010 - protein, 73 aa, Heterodera glycines
  Coding regions on vcDNA: vcDNA=SeqID_62433; Strand=+; Position=1 -61,123-185,247-344
MAIYFFEKFSMQQTLSNMKRKKWLSFFEKFSMQQTLSNMKRKKWLSIFLRIFYATNALGHETKCGAPWPFYFQ

SEQ ID NO: 136011 - protein, 103 aa, Heterodera glycines
  Coding regions on vcDNA: vcDNA=SeqID_62434; Strand=-; Position=1 -113,155-290,1182-1246
SLDPCDEYGADCVPIRNLLLKIEALANCGKNESENNAIFKKPDWAPLPPEMPWKKPSETLICDGDMACDKQTLREQYNRLREMPKDGYQQWKDAIGIGAALIM

SEQ ID NO: 136012 - protein, 36 aa, Heterodera glycines
  Coding regions on vcDNA: vcDNA=SeqID_62435; Strand=-; Position=1-110
MAVRKRRYENGGTKTAVRKWRYENVLARNIHYGYRN

SEQ ID NO: 136013 - protein, 17 aa, Heterodera glycines
  Coding regions on vcDNA: vcDNA=SeqID_62436; Strand=-; Position=1-66
HKHLFDLFYHIHNLIKI

SEQ ID NO: 136014 - protein, 29 aa, Heterodera glycines
  Coding regions on vcDNA: vcDNA=SeqID_62437; Strand=-; Position=1 -6,280-363
MQKKFVGVSNFHYVITRAAFFFCALVSIY

SEQ ID NO: 136015 - protein, 28 aa, Heterodera glycines
  Coding regions on vcDNA: vcDNA=SeqID_62438; Strand=+; Position=1-84
IKVNVEASNQVENVLFMLNISKLMRRKK

SEQ ID NO: 136016 - protein, 60 aa, Heterodera glycines
  Coding regions on vcDNA: vcDNA=SeqID_62439; Strand=-; Position=1 -46,82-218
MVGGCWSAKFNGDEHSLGWHCSNDVRVARVSDGQHGHSEQFAASGAQLDVVAMVLVHARL

SEQ ID NO: 136017 - protein, 22 aa, Heterodera glycines
  misc_feature (19)..(19): Xaa can be any naturally occurring amino acid
  Coding regions on vcDNA: vcDNA=SeqID_62440; Strand=+; Position=1-67
SGRGVNSHLVTAWPSDALXLSS

SEQ ID NO: 136018 - protein, 23 aa, Heterodera glycines
  Coding regions on vcDNA: vcDNA=SeqID_62441; Strand=+; Position=1-73
ITGRSIIAVLFLSFDALANLARF

SEQ ID NO: 136019 - protein, 45 aa, Heterodera glycines
  Coding regions on vcDNA: vcDNA=SeqID_62442; Strand=+; Position=1-135
MRKGKIQTQQHEVHMRMGLRTDIAKGRDRLLLSVRGKLRKSAQHG

SEQ ID NO: 136020 - protein, 54 aa, Heterodera glycines
  Coding regions on vcDNA: vcDNA=SeqID_62443; Strand=-; Position=1-176
INLNFFKFFEFLKFPGWSRFPVPDKNRGPGPGFSGPGKSRSRFCSKFPVPLYSS

SEQ ID NO: 136021 - protein, 158 aa, Heterodera glycines
  Coding regions on vcDNA: vcDNA=SeqID_62444; Strand=-; Position=1 -39,1787-1838,1911-1987,2041-2225,2353-2433
  Homolog annotation: Hit_ID=AAC15708.1; Match level="QueryCoverage =91%, HitCoverage=41%, E-value=7e-40, Identity=54%"; Hit description =beta-1,4-endoglucanase-2 precursor [Heterodera glycines]
SARVLLRLFGWSQDVDVAAANPITGYSNLMYTFHFYTGTYTFHFYTGTHTVSGLGAKLKTAYTKSLPIFLLPIFLTEYGACESSGDGTIATSSMNEWWSFLDGYKISYCNWSVCNKGESCSALTTSASASNVGSSSYWTTSGKLIQAYYKEQSNGKFF

SEQ ID NO: 136022 - protein, 227 aa, Heterodera glycines
  Coding regions on vcDNA: vcDNA=SeqID_62445; Strand=+; Position=1 -311,370-462,517-796
  Homolog annotation: Hit_ID=EAK84263.1; Match level="QueryCoverage =66%, HitCoverage=30%, E-value=3e-10, Identity=26%"; Hit description =hypothetical protein UM03276.1 [Ustilago maydis 521] ref|XP _400891.1| hypothetical protein UM03276.1 [Usti
MKSVVSPTPFRRPLSLRCVCSVLVLLICAFDVSLAAKDKEKNGKEEPGGPFNTLSIILLIPLVIFTGAFVYLLFMKPKSEGTGDDDGEGEGDADVEKGPTEETKTEPRIESPATLLGVTVPLEQDEEEQKKDDEGGDQTAEKKEEDAAAADEQPKEGAAEAAEAEKSATKEETTEDTEETTEGSTTETSDSGSGSGSSSASGSEGSSGTSDATSEATEDASSSSEGS

SEQ ID NO: 136023 - protein, 33 aa, Heterodera glycines
  Coding regions on vcDNA: vcDNA=SeqID_62446; Strand=+; Position=1-121
INLRIDPSFFAALLSILQPLHDHNSFTVVINRK

SEQ ID NO: 136024 - protein, 46 aa, Heterodera glycines
  Coding regions on vcDNA: vcDNA=SeqID_62447; Strand=-; Position=139 -192,591-677
MGFLLYMFVAAVAFGGGAYCGMIYTTKGARASAGGGGSKKDKKQKA

SEQ ID NO: 136025 - protein, 56 aa, Heterodera glycines
  Coding regions on vcDNA: vcDNA=SeqID_62448; Strand=-; Position=109 -162,230-346
MGFFFYLIVAAAMFGGGMFVGMSLGGKKSSDGASGGGAKKEKKHKGSKSSSSEKSQ

SEQ ID NO: 136026 - protein, 232 aa, Heterodera glycines
  Coding regions on vcDNA: vcDNA=SeqID_62449; Strand=+; Position=1 -311,370-462,517-811
  Homolog annotation: Hit_ID=NP_040275.1; Match level="QueryCoverage =65%, HitCoverage=33%, E-value=4e-10, Identity=27%"; Hit description =ORF 73~ECLF1 [Saimiriine herpesvirus 2] emb|CAA45696.1| unnamed protein product [Saimiriine herpesvirus 2
MKSVVSPTPFRRPLSLRCVCSVLVLLICAFDVSLAAKDKEKNGKEEPGGPFNTLSIILLIPLVIGTGAFVYLLFMKPKSEGTGDDDGEGEGDADVEKGPTEETKTEPRIESPATLLGVTVPLEQDEEEQKKDDEGGDQTAEKKEEDAAAADEQPKEGAAEAAEAEKSATKKETTEDTEETTETTEGSTTETSDSGSGSGSSSASGSGSEGSSGTSDATSEATEDASSSSEGS

SEQ ID NO: 136027 - protein, 256 aa, Heterodera glycines
  Coding regions on vcDNA: vcDNA=SeqID_62450; Strand=+; Position=1 -156,862-1024,1074-1288,1332-1480,1969-2056
  Homolog annotation: Hit_ID=NP_507780.1; Match level="QueryCoverage =67%, HitCoverage=11%, E-value=2e-11, Identity=30%"; Hit description =predicted CDS, DNA polymerase type B, organellar and viral family member (5T899) [Caenorhabditis elegans]
MFFTIFLENFKKLVITLYAHYKKVLSGLNFNLSVPYSMQFLRRYRFYDLPSKAENYGTVLDTMPPIENYYPGGLFPADRAKFEQWYDENRETGFELTEVIADYCKTDVQILAHGMVKMRQLFLSETRHDITDSVTIPSGCMKYWVQLAHHDKERVAIIPHLGYEKRGKQSSIARKYLKWRAEEELRENGRVQRHVESPGGEFKFGNYSLDGMMERPDEDKNLAIEVNGNMFTNYPVGQTGRCSPSVGRVRKCTRAA

SEQ ID NO: 136028 - protein, 393 aa, Heterodera glycines
  misc_feature (143)..(143): Xaa can be any naturally occurring amino acid
  misc_feature (386)..(386): Xaa can be any naturally occurring amino acid
  Coding regions on vcDNA: vcDNA=SeqID_62451; Strand=-; Position=1 -201,244-841,887-1182
  Homolog annotation: Hit_ID=AAA93301.1; Match level="QueryCoverage =90%, HitCoverage=90%, E-value=2e-48, Identity=33%"; Hit description =HASI
LKMDKKINKIYTDPANPGGYAGASALRGGEEEAPKLKRTEFEDFLQRNTTYTLFKPKREKFRRLRTFRTIQGSDVQADLAFRTIQGSDVQADLADFQALSRKNSGYRYLLLAVDVLSRRMFGAPVKSKRPVDMKRAFEELFEXTRVPDTLYTDRGLEFVAKPLKEFYAEKGIQKFETSSKKKAAVAERAIRTLKTRLYKYFSANNTSVWVDVLPKFLSAINNSVCRATGLRPREISDTNAREVWKRVYGGLAQSNKTPKIRAGETVRIPEPKHIFEKGYIPNYSDHVYTVDEARSYIPNYSDHVYTVDEARSTNPQHYLLKDYYGTKLKRKFYLPELTIVQVDENTMYRIEKKYKERVRDGKREMLVKFIGFPEKYWVTNEEINEXKYYKFNE

SEQ ID NO: 136029 - protein, 45 aa, Heterodera glycines
  Coding regions on vcDNA: vcDNA=SeqID_62452; Strand=-; Position=1-431
LNLKKCQRLLFLKFFEILTFSLIIYYFAKLIHKYFLERALKLTKC

SEQ ID NO: 136030 - protein, 22 aa, Heterodera glycines
  Coding regions on vcDNA: vcDNA=SeqID_62453; Strand=-; Position=1-114
LDFLFISLFDSKSIREPYLTFN

SEQ ID NO: 136031 - protein, 30 aa, Heterodera glycines; identical to SEQ ID NO: 130616
  Coding regions on vcDNA: vcDNA=SeqID_62454; Strand=+; Position=1 -52,452-492

SEQ ID NO: 136032 - protein, 64 aa, Heterodera glycines
  Coding regions on vcDNA: vcDNA=SeqID_62455; Strand=+; Position=1 -38,387-543
MNVQLRRIDPSVVPDDYSLGYELSYASDTNSQNSVFFRPDFQNPAQGIRSDSGSFLSETWKTNT

SEQ ID NO: 136033 - protein, 90 aa, Heterodera glycines
  Coding regions on vcDNA: vcDNA=SeqID_62456; Strand=-; Position=1-638
IIFIQKIFFGVFGAVPLNRCAQIYGETESFGNSFPIVCTLILRWIFAPHNCLSTPNGHLKKSIFLFSGQSPRTDAPRFMGRPNPSGIATL

SEQ ID NO: 136034 - protein, 89 aa, Heterodera glycines
  Coding regions on vcDNA: vcDNA=SeqID_62457; Strand=+; Position=1 -61,352-557
MSAVAMYINRPFQQRFSFLSRFYREANRYFAIKITDLEAVSDRFKHKFVPRELKVWRELSHPNHVRLYKDFMKNDFLFEIIDLAVGGDM

SEQ ID NO: 136035 - protein, 26 aa, Heterodera glycines
  Coding regions on vcDNA: vcDNA=SeqID_62458; Strand=-; Position=1-80
MKASFGRWADRMKECFGDGTFSLAPP

SEQ ID NO: 136036 - protein, 76 aa, Heterodera glycines
  Coding regions on vcDNA: vcDNA=SeqID_62459; Strand=-; Position=1 -3,867-948,1014-1159
MIISQCFSSHSSPFFFFSLPLTRPTMPMSPPPPVATNATSRSEIVSASVWTISRRIWCACRTAKLPWEIARPTNAD

SEQ ID NO: 136037 - protein, 30 aa, Heterodera glycines
  Coding regions on vcDNA: vcDNA=SeqID_62460; Strand=+; Position=1-92
IKYTFIISLTIFHFKWRVANAKSWSTIRQL

SEQ ID NO: 136038 - protein, 119 aa, Heterodera glycines
  Coding regions on vcDNA: vcDNA=SeqID_62461; Strand=-; Position=1-360
MGQGRKEKEEGKEEEKEEGKKEKEKGRGKGGGNEEERGRKRKLSKRKASSCPTPPTFPGEEHSVPSQQQQQHPQALCSLLFFSAASFIRIANSQRMRPPWPPFECPPRTAESVAEQNDY

SEQ ID NO: 136039 - protein, 309 aa, Heterodera glycines
  Coding regions on vcDNA: vcDNA=SeqID_62462; Strand=+; Position=1 -182,243-363,523-663,956-1148,1273-1563
  Homolog annotation: Hit_ID=CAF92967.1; Match level="QueryCoverage =100%, HitCoverage=18%, E-value=2e-90, Identity=48%"; Hit description= unnamed protein product [Tetraodon nigroviridis]
MANLTFLNEASVMSNLKQRYGSMMIYTYSGLFCVVINPYKMLPIYTESVIKAYIGKRRNEMPPHLFAVADEAYRNMVQDRENQSILITGESGAGKTENTKKVISYFAIVGATQQAAEKEKKEGQKGGTLEEQIVQTNPVLEAFGNAKTAELTIEGVDDKDEFRVTQEAFDVMGFTDDEINNLYKNVAGIMHMGEMKFKQRPREEQAEVDTEDDAKNASFCFGIDHEAFLKALVKPRVRVGNEWVNKGQNLEQVSWAVAGLAKAIYARMFRWLIFRCNKTLDQRSTDRKLWIGVLDIAGFEIFDLNSFEQ

SEQ ID NO: 136040 - protein, 91 aa, Heterodera glycines
  Coding regions on vcDNA: vcDNA=SeqID_62463; Strand=-; Position=1 -139,522-658
  Homolog annotation: Hit_ID=NP_504486.2; Match level="QueryCoverage =97%, HitCoverage=11%, E-value=2e-28, Identity=69%"; Hit description =adenylyl CYclase (acy-4) [Caenorhabditis elegans]
MAASGLTGNSTGTNSHVVAVVNFALALFGWMEEFNENSFGNFNLRIGINVGPVVAGVIGTEKPHYDIWGNTVNVASRMDSSGIPGRIQVEK

SEQ ID NO: 136041 - protein, 52 aa, Heterodera glycines
  Coding regions on vcDNA: vcDNA=SeqID_62464; Strand=-; Position=1 -13,429-574
MSNNVLVFLRVRIPLLTCVYAQFFAVTANINTFINLFWISVDRFVALAFPVL

SEQ ID NO: 136042 - protein, 31 aa, Heterodera glycines
  Coding regions on vcDNA: vcDNA=SeqID_62465; Strand=-; Position=1-95
MVAELKRRLRSSQMQLRPSQRRHPCHRLRLR

SEQ ID NO: 136043 - protein, 59 aa, Heterodera glycines
  Coding regions on vcDNA: vcDNA=SeqID_62466; Strand=+; Position=1 -21,774-932
MFDHAGLKYIIFKMKFFLIIFLFGKLDQWIKNCNSKLLMKYLEKNGKKKKKKIWKKKEK

SEQ ID NO: 136044 - protein, 179 aa, Heterodera glycines
  Coding regions on vcDNA: vcDNA=SeqID_62467; Strand=-; Position=1-539
CFMMVRKGDYPQARAANSTPIRFISALANIKLGDFEGKFPILVSEDDSCPCTAIIGTDLMDFISEQGEEEIGLNFKRGLLRVGNTQLPMIAAVSIEKQPIEVQLIETQTLPPLSDSLVWGKINRSLGLDEVFITVEREHDYFPLRVGNCLTSPGSTRIVPLRLLNFGNSVIKVYEGSRL

SEQ ID NO: 136045 - protein, 17 aa, Heterodera glycines
  Coding regions on vcDNA: vcDNA=SeqID_62468; Strand=+; Position=1-52
MEHFYRFGIRGRAGPIK

SEQ ID NO: 136046 - protein, 494 aa, Heterodera glycines
  Coding regions on vcDNA: vcDNA=SeqID_62469; Strand=+; Position=1-1485
MGEAQDQRDEAVQEEELGAVAGTEAEGQPGEDNNAPRGLSGSEGEKTVEAEEVAQDEAEEGPIPPSFVQNEVGSTSPVSQTNEQIRETVNQKTEAEKADSPEGSNSMREVEPRRSRRVRRTREVWSPERCATKRRGIGGPLVSLAMMTMLVYPTLTSGCQPTIRPEIVGQQSQELPTTMLPCHMRCTERGVKVLSGQRLEKMEICCPDGCWAIVPTSTEISYELPTELLVHDYQCSGQCWRGSGPPYNITQRCPARAECDLINCSFCGKQLANPTCNPRWASSLFGFGAAILLAIIGCFCSIFGRFLSGAKLLSRAVAWGVRCPIGLINWATGRDFRKPTTEQIERKVRKGARKARTEIRELQQQLQLGRRARAMARAWQNPDGTRKAFPAKAVAALIPLLLIIGPATANKPLSVMVRSEDCSRTAAGLKCAGTAATVLTLLPADQTNSFVIRTQQDELLGAVRLRLASLTMVCVPKTESWLRSYSISTTAVKR

SEQ ID NO: 136047 - protein, 142 aa, Heterodera glycines
  Coding regions on vcDNA: vcDNA=SeqID_62470; Strand=-; Position=1 -403,838-863
CARKFSQVRRDHRLSAAPQRQQAAAPYAAAPRYYAAPYYHAAPLAGRQLQAALLPAAPQRQAAAPYAAAPRYYAAPYYHAAPLAGRQLQAAPLPAARQLQAVPLPAARQLQAVPLPAATRLSAALLRDPAGIMHEYFYYWQL

SEQ ID NO: 136048 - protein, 50 aa, Heterodera glycines
  Coding regions on vcDNA: vcDNA=SeqID_62471; Strand=-; Position=1 -106,523-569
MCRFFCYQWFCVIYAILFLPTQIRCCHPEGRAPREGRFLGVVFLVFIVFS

SEQ ID NO: 136049 - protein, 94 aa, Heterodera glycines
  Coding regions on vcDNA: vcDNA=SeqID_62472; Strand=+; Position=1 -141,585-728
MDLLLFQRDKYALAYNCTNFDANLVPIGQRIHTVHGIILIIMFFVFELSPKRRHKNDLFICHMGMSIFFPLVVVHSLHDVHVPQFDNWYHRHGK

SEQ ID NO: 136050 - protein, 73 aa, Heterodera glycines
  Coding regions on vcDNA: vcDNA=SeqID_62473; Strand=-; Position=1 -98,401-524
MSSFSLKNYMQIGLITLKKMIALYCFLDRIVLKFAKLNQYPNLYVKTQNHSNFVISKKSGLVSVGNGFQRENE

SEQ ID NO: 136051 - protein, 139 aa, Heterodera glycines
  Coding regions on vcDNA: vcDNA=SeqID_62474; Strand=+; Position=1 -261,381-539
MPSPSVTIVNIAYLILSFEMFTDLSVLAIACLNLAVIVPNKLLHTNLKSILITQSFAVLYFGILRLVIICQRLIYVEPLMSDDVILSILMNFNSVFRRLLGHMLIIERFLATFRTNSYEKFSKTYFTVTWFSITVFILI

SEQ ID NO: 136052 - protein, 49 aa, Heterodera glycines; identical to SEQ ID NO: 130195
  Coding regions on vcDNA: vcDNA=SeqID_62475; Strand=+; Position=1 -110,199-238

SEQ ID NO: 136053 - protein, 24 aa, Heterodera glycines
  Coding regions on vcDNA: vcDNA=SeqID_62476; Strand=+; Position=1-151
MRIERARFDEVLVSQKNIQIFKNL

SEQ ID NO: 136054 - protein, 38 aa, Heterodera glycines; identical to SEQ ID NO: 129423
  Coding regions on vcDNA: vcDNA=SeqID_62477; Strand=-; Position=1-364

SEQ ID NO: 136055 - protein, 383 aa, Heterodera glycines
  Coding regions on vcDNA: vcDNA=SeqID_62478; Strand=+; Position=1 -199,464-1416
MDDYLQFFRENYEQILLETSQNIAKAQAIQKAQFDAKRNVNPEKYKIGDRVMVYFRPSVKTDHKKLDPEETSGMCHNSLCSGIEEHSNCAAITLADLHPALAVMDKLRNVKIEMLGELISLMIAKDVPIAQIRNWATNRNTHGPDFLLKFSSNLSPSSQEFISIISLWIDRCDFAFHNLQASGCKKIKFLIPKENKSYPFQKAIEIAIEDVKARSVLGLSKVIRSPFIVFSDSVGEVMKNKLEAEIFLERSYTALSNEIVTTYFGEEVKKILIMAGTDDIIGNVPIEETKKAIKKISFHLSKFSIKTFIIPLPFISKKSMAHEKFLDLLDEIVPKSGNVILALTRGHRSIAEITRYGDKEENRNVDESGKLKDGGAKITLKFL

SEQ ID NO: 136056 - protein, 294 aa, Heterodera glycines
  Coding regions on vcDNA: vcDNA=SeqID_62479; Strand=-; Position=1 -179,326-740,806-1095
MCSDVWMDILPSFDHAQLGLKLALLSPRFNVLVDKHFDGKNELTIWRQIRIAKNGTKAKFYIDHSVIEFLRANEQIFDKGIDLDFYVEANDVQPIWDVFAREIWPIFATNIRYLTVSDLHDLDNLRRHTSPTVLTDFNIISIHSGDLPDAIADDGPNATIGQALSKWLNTPTKDGKPKQLSCRVGTSETIGFINNFKEAFLRATISSASYIIRLVLLFDESTPIEPFELKNERTNEMLTLAKEKYDESIDEEDDDDDDGKHIYLVLKRWQIGKTIQWEDEKLNKITFELFENCI

SEQ ID NO: 136057 - protein, 343 aa, Heterodera glycines
  Coding regions on vcDNA: vcDNA=SeqID_62480; Strand=-; Position=1-1031
  Homolog annotation: Hit_ID=NP_920291.1; Match level="QueryCoverage =99%, HitCoverage=22%, E-value=8e-25, Identity=28%"; Hit description =putative helicase [Oryza sativa (japonica cultivar-group)] gb|AAP52578.1| putative helicase [Oryza sativa
MWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPE

SEQ ID NO: 136058 - protein, 190 aa, Heterodera glycines
  Coding regions on vcDNA: vcDNA=SeqID_62481; Strand=-; Position=1 -52,171-278,376-456,624-731,792-926,1008-1096
MEEEKRQQKEREEQSKYVYAEQFNAILEKISDLEGTKQKEEEQQKGMMKAAKNFIVEKCEATNGRMGEIEKRLKSEKGKYVSAGQFEKVLDRTEKLEKQLKQMQQQQKQEAKAAKYATVEKLEETFGQFGEMLKQQKQKLEQLDTAQQKLCEKMASMENFVVDLFSQMQNAQQTEIYAKIDEVKIILKKN

SEQ ID NO: 136059 - protein, 134 aa, Heterodera glycines
  Coding regions on vcDNA: vcDNA=SeqID_62482; Strand=+; Position=1 -103,172-365,1574-1681
MQRSRRDPTPPTSPKRMRAPTPRPIVGLPIPVVESNRPAEDVSSDDDDGYGNVAHQNIVQRQELDIGARAVQRPIARVPPAFRQGPVRRPFPPLLLPRQAPPIVNPLGQNPQQMIRWPRQQWIGRPIDPRSPPH

SEQ ID NO: 136060 - protein, 100 aa, Heterodera glycines
  Coding regions on vcDNA: vcDNA=SeqID_62483; Strand=-; Position=1-333
AGCMALPANTGQGLRRDWEAYVDSHTRTDRPSGCRHWRVIEKIEKVWWRHETTPTKDRLSSGVRLKLSKSNEGQYHSVCEAVARTRTNSNYQFLFFQAFP

SEQ ID NO: 136061 - protein, 109 aa, Heterodera glycines
  Coding regions on vcDNA: vcDNA=SeqID_62484; Strand=+; Position=1 -58,386-657
MSEFLIFLLGFSFAMLLMLCIFYALEFAKLYQTVGREISRDKFRHIMKTGKKQHELALVFMEKAGINTQEKTFGLKHLEFVQNFWDKEFPDIFRIVAFDMVNEHFLNFV

SEQ ID NO: 136062 - protein, 190 aa, Heterodera glycines
  Coding regions on vcDNA: vcDNA=SeqID_62485; Strand=-; Position=1 -198,761-961,1047-1220
MGSSVSAPFFSAMTILANSKLFPLFFVLAIGIPSAVLYCSLLLAIVTNFKHFSSPFFILIIIRAILEINNSELAAFSALIFFIVCLLINLATLLAYKLRSYYQQNGQDLAIERKMTIYAVATFFGQLLMAIHMFFVDITATNFVDEHNNRFSYVQAWFSVSLEQNEILFFANLNQNPWVNDLSTVVIPAW

SEQ ID NO: 136063 - protein, 312 aa, Heterodera glycines
  Coding regions on vcDNA: vcDNA=SeqID_62486; Strand=+; Position=1 -332,796-890,942-1102,1173-1398,1515-1637
GPGFLIIHFLIYHTLSQLHDAGLGSPHCSADREEWRTMLENSQDTSMLCQGNCIPFIRSSTPPATALGTMPMPSSDHGTVVGDGAVEHDQQQQMMYTREELSNPNLDSVQILGIALMQLVHGIRRDCFYNTFMMTIKKNNGTVLKRPTPSFMEWQKGLKACQSPSAVALFETTLEFAINWDFKAEDGTTVSQQQKAKSGGRRRQMPRDGSAKTDDENTENENNASTSAAMAQKQQQRQHTRQREVNNLLVEAGFLGGMAIGARTRKPVTKYGDVEMDVDKLNFDEAEEEEDEQQQRREENAEEMEEEYKEEQ

SEQ ID NO: 136064 - protein, 67 aa, Heterodera glycines
  Coding regions on vcDNA: vcDNA=SeqID_62487; Strand=-; Position=1 -116,364-451
MLYMTYAGAAPTLLKCGQHVFPDAEKANKRCEALAGMAKSNQANCTSQNAEWAIQFRTVNVEFDMHW

SEQ ID NO: 136065 - protein, 18 aa, Heterodera glycines
  Coding regions on vcDNA: vcDNA=SeqID_62488; Strand=+; Position=1-56
YSEAIPEGFGLPINLGAS

SEQ ID NO: 136066 - protein, 49 aa, Heterodera glycines
  Coding regions on vcDNA: vcDNA=SeqID_62489; Strand=+; Position=1 -24,143-268
MNSRNSSALRVATFSLVAMAIGLCFVTVANVVQMHLLTALFADELTPTP

SEQ ID NO: 136067 - protein, 119 aa, Heterodera glycines
  Coding regions on vcDNA: vcDNA=SeqID_62490; Strand=-; Position=1-362
QTLATEENGATRLLGICNLWTRHFGTRLLGIPTFGDPTFGDPDIWGPDFWGSQHLGTRLLGIPTFGDSTFGDPDIWGPDFWGSGHLGTRLLGIPTFGDPTFGDPDIWGSNFWGSRHLGI

SEQ ID NO: 136068 - protein, 404 aa, Heterodera glycines
  Coding regions on vcDNA: vcDNA=SeqID_62491; Strand=-; Position=1-1213
  Homolog annotation: Hit_ID=AAA59875.1; Match level="QueryCoverage =35%, HitCoverage=47%, E-value=3e-11, Identity=35%"; Hit description =mucin
MAAMFLPADGQYQLCPSKPTEGITVTMSFPEEQNCTLPVEKPPLTVKSNLYIPIRISRVFPTFKCWNVTTVTCTESFLRIMTLDHPDKKIEAEASVEDCQASIHHSPMNRVSETRWESLAPIRKEYGWYGVNCFNNVQTVIEEGKAEILDGKRLITSWGDSLKIDKSLGEDGSWIRLPGAVELLMWKIPSDEFWHSHFVIGPVITEIWPKKAVIVDELQYTFPISRNQERKFPVFGVPEDALKTDNNVFVHVIGKVNSTKGARPRRETASLKPGQRKPNVPRIEPTRRPNLRRGQIAEIAMTTRPTITTTNIPPTIRPVSTTRIPSTIPIIATHTPPTTRPIITTNIPSTIRPITMTNIPSTTRPIATTNIPLTIRPIAITNIPPTIRPITTTNIPPTIRPIAI

SEQ ID NO: 136069 - protein, 109 aa, Heterodera glycines
  Coding regions on vcDNA: vcDNA=SeqID_62492; Strand=+; Position=1 -38,412-617,1691-1776
MTEESVILSFSCLYSVDVQSGLLRTLLADAHVLLLALLCAGSKPVAVPLALHLLQKALHQQSLVLAEAVQQEEASGSAGGTQRNIGQFLCPWSERRTKQLQVEDFPENV

SEQ ID NO: 136070 - protein, 95 aa, Heterodera glycines
  Coding regions on vcDNA: vcDNA=SeqID_62493; Strand=+; Position=1 -111,329-503
MGVDGGKLRAVMRHIEIMRREEAQLRNQRHYQLPERKNHTPSVSFLVDRDSFHRSVDVIDSEKVQSKSPFAANTNSHAKFQRNDDGSTKLMAREE

SEQ ID NO: 136071 - protein, 70 aa, Heterodera glycines
  Coding regions on vcDNA: vcDNA=SeqID_62494; Strand=+; Position=1 -145,194-259
  Homolog annotation: Hit_ID=NP_501210.2; Match level="QueryCoverage =92%, HitCoverage=11%, E-value=5e-17, Identity=66%"; Hit description =glutamate transporter family member (4I271) [Caenorhabditis elegans] gb|AAB00621.2| Glutamate transporter
VLRRSLKLCRAHLLLSLTISSVFVGLFLGFALRIFQLSPETVRLVNFPGEIFMQVLKMMILPLIFSSLVS

SEQ ID NO: 136072 - protein, 44 aa, Heterodera glycines
  Coding regions on vcDNA: vcDNA=SeqID_62495; Strand=-; Position=1-133
MGVLTLNIECREKGVKKTMQFEPRTLVHDACRLIRDKLGHMPGN

SEQ ID NO: 136073 - protein, 81 aa, Heterodera glycines
  Coding regions on vcDNA: vcDNA=SeqID_62496; Strand=+; Position=1 -179,1268-1336
IARCIAGEVPPLKKPKHRAADARILRLLQEYNAINNNPAIQNDHNYHANVNPDNIINLLLTLATFFPIAENGEYSFTYVSA

SEQ ID NO: 136074 - protein, 113 aa, Heterodera glycines
  Coding regions on vcDNA: vcDNA=SeqID_62497; Strand=+; Position=1 -147,362-408,481-628
MKRCAAEYERKYCVETDTKLKQQTTKNKEKKQQQQQDESPEEYYPTNYEPAFNYDKLHVSDIILPLTIHQKDKYQAQNGPTKYEPKAEGQHVTSSVTTAGVQYNNILTFQNIF

SEQ ID NO: 136075 - protein, 168 aa, Heterodera glycines
  Coding regions on vcDNA: vcDNA=SeqID_62498; Strand=+; Position=1 -398,686-794
MVFRQRSSPTEAQHQQSAEDQQKAIEEKKEQTRPEQAKNVPPDQQKEEQTEAISKQEQQQQQKKGTDNEQQHQTTSSSATSSSTSTEVPKQQSSSPPPPPPFTQLTDNGSARRHRRPSRCVRKAVEKCSSFSRWPSFVGFRGSKTALTPRPSCAVAYGCCIRGTRRDA

SEQ ID NO: 136076 - protein, 115 aa, Heterodera glycines
  Coding regions on vcDNA: vcDNA=SeqID_62499; Strand=-; Position=1 -13,56-207,307-489
MKSFGLSSADQINRRTLRSLFCIIAVNIGGYFINSFYMNLIKSSISSPITAWFDQYGVSTGIPNAVPICLQTNFQSKSSDTTPAAEWTSTQLVTTNSHLISIYPDIYIKNREKVN

SEQ ID NO: 136077 - protein, 16 aa, Heterodera glycines
  Coding regions on vcDNA: vcDNA=SeqID_62500; Strand=+; Position=1-48
MKMIIKKPWKNRENLS

SEQ ID NO: 136078 - protein, 37 aa, Heterodera glycines
  Coding regions on vcDNA: vcDNA=SeqID_62501; Strand=-; Position=1 -94,311-330
LINWHELSAYKIEKNKKTYLYIVKKSSYQVDCSNYNE

SEQ ID NO: 136079 - protein, 273 aa, Heterodera glycines
  Coding regions on vcDNA: vcDNA=SeqID_62502; Strand=+; Position=1 -93,205-545,599-690,800-1092
  Homolog annotation: Hit_ID=NP_741200.1; Match level="QueryCoverage =93%, HitCoverage=1%, E-value=4e-35, Identity=37%"; Hit description =mesocentin, extracellular matrix adhesion molecule required for proper gonad positioning and sensory map f
MTVGHSDPLVFDGWAEADADALGVIADTICRVIPQARGEQPETAISWPTRATSAPSSATTVEKKYPDLIWHFIKLRLNCAIFQKSDGASRDCTRIEHALDLVLVVDSSTFSAEQFAKVVEGLATLVDESFDLAPDVVRVGLIVYSEMVAVPVALGHYEDKIELLSKMVSATHKINVARAARCAKSGSAADQRQTQVGGWTFALAHVVLLIIILISRIQNHFLIDRGNAAPVAAELREQLGVQIVAVAVAPSLDQLNTLTRIVADPTSVAAATT

SEQ ID NO: 136080 - protein, 41 aa, Heterodera glycines
  Coding regions on vcDNA: vcDNA=SeqID_62503; Strand=+; Position=1 -114,181-192
MKSTFFQLTFSVKKGFLNFLQQNSFVWPEISTLSFLRCGRF

SEQ ID NO: 136081 - protein, 30 aa, Heterodera glycines
  Coding regions on vcDNA: vcDNA=SeqID_62504; Strand=-; Position=1-91
LLQKSEQRLERNGRRLNERRRWRSVVVPIG

SEQ ID NO: 136082 - protein, 35 aa, Heterodera glycines
  Coding regions on vcDNA: vcDNA=SeqID_62505; Strand=+; Position=1-108
VCNDPFGRVRNCRRLLSQKWNYLNANTRPLRRNAK

SEQ ID NO: 136083 - protein, 82 aa, Heterodera glycines
  Coding regions on vcDNA: vcDNA=SeqID_62506; Strand=+; Position=1 -81,206-373
  Homolog annotation: Hit_ID=CAE58643.1; Match level="QueryCoverage =87%, HitCoverage=12%, E-value=2e-27, Identity=83%"; Hit description =Hypothetical protein CBG01811 [Caenorhabditis briggsae]
MSSADSSILSAASMFAHNIWKLTIRPEASEREVIIMMRFGIIAVSILATVMALTINSIYGLWYLCADLVIILMHLIIIDWIS

SEQ ID NO: 136084 - protein, 208 aa, Heterodera glycines
  Coding regions on vcDNA: vcDNA=SeqID_62507; Strand=-; Position=1 -289,350-535,942-1090
  Homolog annotation: Hit_ID=NP_500284.2; Match level="QueryCoverage =28%, HitCoverage=1%, E-value=2e-18, Identity=72%"; Hit description =ubiquitin-associated domain and HECT domain containing protein (4D798) [Caenorhabditis elegans] gb|AAG2337
FQYLCNQLKKVKKQRKKAQLKKKKKNNTEKDGAAAQQQATTSKPQADTHAKEESDEATLVRNMVDELAPLWEELSNCLSLLEKAEDSQPAVLYFQNAAEAFFLSYSLVIPQTAQLAPSALPETAPTGDSSPQLASSAAGGNSGEDELGRYQKEMFTFAGGLLREWYSLITREIFHPDYALFITAPGDRVTYMINKNSYVNPEHLGFFR

SEQ ID NO: 136085 - protein, 155 aa, Heterodera glycines
  misc_feature (30)..(30): Xaa can be any naturally occurring amino acid
  misc_feature (63)..(63): Xaa can be any naturally occurring amino acid
  Coding regions on vcDNA: vcDNA=SeqID_62508; Strand=-; Position=1 -32,437-879
  Homolog annotation: Hit_ID=NP_671477.1; Match level="QueryCoverage =90%, HitCoverage=48%, E-value=4e-30, Identity=56%"; Hit description =rRNA promoter binding protein [Rattus norvegicus] gb|AAK21974.1| rRNA promoter binding protein [Rattus no
AKFAKPVPLAATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 136086 - protein, 55 aa, Heterodera glycines
  Coding regions on vcDNA: vcDNA=SeqID_62509; Strand=+; Position=1-267
PGMCLGFAFRISPFAFFWRFAFRFLARNATFTPLRIGLNSHKIFQNFTYKLANFQ

SEQ ID NO: 136087 - protein, 376 aa, Heterodera glycines
  Coding regions on vcDNA: vcDNA=SeqID_62510; Strand=-; Position=1 -176,223-737,815-975,1026-1304
LFTSSAGVPLPPSVSLKKANQLDASALNLAMQMHPFDAFASGTFLPPNGPSLSNGGDGGVSPTSALSIPALLMACASGQLPQGCLACTYRLKDGQLCGSIFPTEEQLFAHYKNAHIGKQSSPNVVSSTTSQGEQSAGTVTVPSTAVTTSAGKKGPAGSPSSSRSTPTHQTNKVSQNSAKGATPNAKPHSNPGAMFNNNGTAWPSVGLPPGILPMGPPLCLQQQTAQQWKDSSPLPCQSAGGGASASHRFHPYAQQPNGGKQSSQTHQQGVTPNLQQMAMAINNLGLFANLGALPTGGFFPPGVDFAMLAQQQLGQSPAGAHPATPPATTVHQQQSQLAALAAMANSIGSKGGTSNGTTMARQQQTGGIATLEAVDG

SEQ ID NO: 136088 - protein, 373 aa, Heterodera glycines
  Coding regions on vcDNA: vcDNA=SeqID_62511; Strand=+; Position=1 -85,130-225,274-407,491-710,773-925,1001-1102,1161-1310,1357-1383
  Homolog annotation: Hit_ID=NP_492476.1; Match level="QueryCoverage =97%, HitCoverage=28%, E-value=4e-90, Identity=48%"; Hit description =RNA polymerase (1J858) [Caenorhabditis elegans] emb|CAA99827.1| Hypothetical protein F14B4.3 [Caenorhabdi
IRLPNGDAVEFSYSNAKLGNPLLDNSKPRLEVGNRLEVGNEPIFPAECRQRGITYRSPFWVNISLMVNGRCIDNVEVLLAEIPIVNGRCIDNVEVLLAEIPILLRSNKCNLHGLSKEQLIQKGEEGLERGGYFVGGYFVVNGSEKVVRLLVANKRNFPLALRRRAFRDKGKLFSDCAVMMRSIRGNHLASMMTLHYVENCSMILAIQFRRELFYVPLMFRRELFYVPLMYILKCLVDWNDAMIAAQLTAGRPDDVFWEGCVRNMLMMAQEENIVPHGIALRALGNRFRVALGDRIAPWEDDEQACACHFLLHQCLAIHLETNEQKFFCLTLMAHKLVGLVKNEVQAESLDNPQFQEASVTGHILEASVTGHIL

SEQ ID NO: 136089 - protein, 29 aa, Heterodera glycines
  Coding regions on vcDNA: vcDNA=SeqID_62512; Strand=+; Position=1 -66,123-146
MAISFFEKFSMQQTLSNMKRSAKNGYLFF

SEQ ID NO: 136090 - protein, 29 aa, Heterodera glycines
  Coding regions on vcDNA: vcDNA=SeqID_62513; Strand=+; Position=1 -66,123-146
MAISFFEKFSMQQTLSNMKRSAKNGYLYF

SEQ ID NO: 136091 - protein, 29 aa, Heterodera glycines
  Coding regions on vcDNA: vcDNA=SeqID_62514; Strand=+; Position=1 -66,123-146
MAISIFEKFSMQQTLSNMKRSAKNGYLFF

SEQ ID NO: 136092 - protein, 53 aa, Heterodera glycines
  Coding regions on vcDNA: vcDNA=SeqID_62515; Strand=+; Position=1 -66,124-219
MAISIFEKFSMQQTLSNMKRSAKNGYLFFWQMLGTENWTCQVGKHIFKQKLPV

SEQ ID NO: 136093 - protein, 64 aa, Heterodera glycines
  Coding regions on vcDNA: vcDNA=SeqID_62516; Strand=+; Position=1 -121,207-277
MSNNENENVMNGEAVGGVEIKVEANEEVNTESQEDGEEAKIPQFSKEQMERSVMCCTNEGEIVN

SEQ ID NO: 136094 - protein, 74 aa, Heterodera glycines
  Coding regions on vcDNA: vcDNA=SeqID_62517; Strand=+; Position=1 -48,108-284
MDKSAEEIREMLCLEDDLTEEEKAAITREYDIPRDFPTIPLPDQPELSDVPGTSGTSSNSSNNEGKKMNGYAKR

SEQ ID NO: 136095 - protein, 237 aa, Heterodera glycines
  Coding regions on vcDNA: vcDNA=SeqID_62518; Strand=+; Position=1 -107,157-217,345-461,511-609,677-844,1409-1570
MANFPPNSDEEFDRGNFSSLSGMVGMNQRHLDWLMKNISREDMAELQQRTGQCARKCAVTYGGPIVVVTIGFLEFLRRKQNLPITAPRFLIGYPIMCLTSVALGSSIGFKRSGCGAEMRLFLDKLYAKYDSQMNAASAQMAPGVGGGTSPTKTYAQLREANRAGRPIELGQLKQQQTRQQQKKMDGRKATTEGTEGSGGVPSDEWGRFGLDGVFAPSPPASSSADGTAPSPPRPKSF

SEQ ID NO: 136096 - protein, 198 aa, Heterodera glycines
  Coding regions on vcDNA: vcDNA=SeqID_62519; Strand=+; Position=1 -228,367-735
MAAIGDEKERAHFERQILNNSEFRGELKTMEEKEKAISKGQRKMEPNEIAELVEKHFKVMGEHKMEGEEEEKAETKVRLLLLMLFGIMPKNKHMEGKKIWEEKIWGKKWQKHLKDLIKKRQVKVSNTKQLGTDNLEKVKNTTVHLSWAVTFGPARLGPACFSSITFFNFFRCHPSSNIVDIIRKHNMFRSFSKLLSRD

SEQ ID NO: 136097 - protein, 27 aa, Heterodera glycines
  Coding regions on vcDNA: vcDNA=SeqID_62520; Strand=+; Position=1-81
MHRIIAAVKKLVVGSVLAVRCTLCVLL

SEQ ID NO: 136098 - protein, 159 aa, Heterodera glycines
  Coding regions on vcDNA: vcDNA=SeqID_62521; Strand=+; Position=1-480
MPAPGQCLCRRLPFALPLLLLLLFPPPLIPHLPISSASADQCQAPPLRIGVLLPDAYRRRVEPWLALAQRHIRQFSAAPTPKCRKWGSVLRINSLISQLFLGSSSAHFLRAHCLQMIPKNTDCRPSLGLKALFDLMAVSENDKALVGMGSDQSAQNHQN

SEQ ID NO: 136099 - protein, 72 aa, Heterodera glycines
  Coding regions on vcDNA: vcDNA=SeqID_62522; Strand=-; Position=1 -150,999-1067
MPETWHILSCRPRRRRCFIFLLYKAYVAVWRPAAFPLLIGMERQLGALLLGCKSRFSRQKAKCEMRNAKKCE

SEQ ID NO: 136100 - protein, 69 aa, Heterodera glycines
  Coding regions on vcDNA: vcDNA=SeqID_62523; Strand=+; Position=1-386
LLIMQYNAFKPRREAGQFQNFVPHFTVESPSTLLDNYVSISTVAFGQLWNGKMGISDGVRSFLKIPLFV

SEQ ID NO: 136101 - protein, 76 aa, Heterodera glycines
  Coding regions on vcDNA: vcDNA=SeqID_62524; Strand=+; Position=1-362
GGTVPNFCTTFYCGKSKYLIGQLRVNEHSRLWPVVERKNGNIRWGALFSKNSSFRLTIPPFCALFRFKIESFFFVF

SEQ ID NO: 136102 - protein, 107 aa, Heterodera glycines
  Coding regions on vcDNA: vcDNA=SeqID_62525; Strand=+; Position=1 -123,165-264,306-405
  Homolog annotation: Hit_ID=NP_871914.1; Match level="QueryCoverage =92%, HitCoverage=68%, E-value=1e-31, Identity=61%"; Hit description =serine/aRginine rich pre-mRNA SPlicing factor, Serpin (rsp-1) [Caenorhabditis elegans] emb|CAD59160.1| Hy
MSNRVYIGHLASRATDRDVEHFFRGFGRIRDVVLKNGFGFVEFEDSRDADDAVYELNGRELLGERVVVELSRRGGPYGGGGGYSGGGGGGGGYSGGGGGFGGYRGGG

SEQ ID NO: 136103 - protein, 370 aa, Heterodera glycines
  Coding regions on vcDNA: vcDNA=SeqID_62526; Strand=+; Position=1 -50,559-1319,1670-1971
  Homolog annotation: Hit_ID=NP_572232.2; Match level="QueryCoverage =74%, HitCoverage=24%, E-value=4e-15, Identity=25%"; Hit description =CG4136-PA [Drosophila melanogaster] gb|AAF46044.1| CG4136-PA [Drosophila melanogaster]
MALARCPPSPQQQPPPLARYGAPPTLVNGGGGGQHGQAVVAGGGGAGGLHGHTHSHHGSSGGGGTTPTVAGPPTAMAPPPQLHHHHQHQHSLHAQQQHQAAATMGIGGGGGGGGHAALLVNNNHHHAAPAHNNHHHHQLHHHHGSAGALSSMATSSNGINSNGTIMPSLTNGIVSGTGAGGSGAVVSPSLMQQQSQQQHHHHLMPVQSMPSFLAQQQQQQSTHHHQQQQSQGSSAGAAAASTLLSAAMMNGLGGSQQQQKPLFALFDLKMDDHHHQLTSSIHQDGAASAASAGASSSLRSATTGAAAASVPSITTASLPLSGANGSALNGIGGGGSVVTTPTNVCGGGANNIWTYGPSWGEENRNIKCQF

SEQ ID NO: 136104 - protein, 107 aa, Heterodera glycines
  misc_feature (64)..(64): Xaa can be any naturally occurring amino acid
  misc_feature (84)..(84): Xaa can be any naturally occurring amino acid
  Coding regions on vcDNA: vcDNA=SeqID_62527; Strand=-; Position=1 -139,1422-1454,1572-1678,2086-2130
  Homolog annotation: Hit_ID=CAB62280.1; Match level="QueryCoverage =96%, HitCoverage=84%, E-value=9e-23, Identity=45%"; Hit description =hydroxyproline-rich glycoprotein DZ-HRGP [Volvox carteri f. nagariensis]
STNSRFLFPPTPALTATRGDNLAESTVPPPVREAAPLPPAPAPPPPPPPPPPPIPMPPPPDEPXWEWVWPWSPPAPPPPATTAXPCCPPPPPPNPPPATPPPGPFTL

SEQ ID NO: 136105 - protein, 446 aa, Heterodera glycines
  Coding regions on vcDNA: vcDNA=SeqID_62528; Strand=-; Position=1-1339
  Homolog annotation: Hit_ID=EAL50634.1; Match level="QueryCoverage =92%, HitCoverage=79%, E-value=1e-46, Identity=32%"; Hit description =hypothetical protein 19.t00007 [Entamoeba histolytica HM-1:IMSS]
MYKKEYRLAEIDRQIQLMIDAKAKIQEEEEEEEQIKERRAYSEKIKRERKRKEKEQMEAKSEAKRKEAEEKAKEKAKAEKEEWKRALRRPAAKPEEKARKEAENEARKEAEEAVRKELEEEARKETEEKARKEADEKARKELEEEVRKEAKEKAAKEADEKAQKEAEEKAKKDEEEKKKSEKQQQNVEKRAEEKAEETIIARGIKKRRLTEEEKEKKQSMEKVEEAHREIREIVKQAEEDAKKREIRKKIEKLTAKLSGEQNGKRDEKDTAELEREREAFENPPAPPKDRMPFYSSSVARFECQSELDSAPKPREREERSNRERMSLGTSGKRLFENTLKSATQTVNEKPCIPPEGLGLKRRESAMEEAPRGRRPTPVPGQRQLERSPIRKNNSYLKRALALEKPEETIYKIRKLLLEAADRLSELADLLYPYDGQKTKKEETAEE

SEQ ID NO: 136106 - protein, 21 aa, Heterodera glycines
  Coding regions on vcDNA: vcDNA=SeqID_62529; Strand=+; Position=1 -54,734-745
MRTRRICQVKQRLLTSQKKML

SEQ ID NO: 136107 - protein, 22 aa, Heterodera glycines
  Coding regions on vcDNA: vcDNA=SeqID_62530; Strand=-; Position=1-92
NLLKNLKMRIHARFSGNKLNRA

SEQ ID NO: 136108 - protein, 27 aa, Heterodera glycines
  Coding regions on vcDNA: vcDNA=SeqID_62531; Strand=-; Position=1-83
NSALVLIWQKIKPFFLRTHGCSIHPTK

SEQ ID NO: 136109 - protein, 166 aa, Heterodera glycines
  Coding regions on vcDNA: vcDNA=SeqID_62532; Strand=-; Position=1 -436,738-802
MLSNSTKSSFQKLKKRKTQKTETVSSGSSDDHHQRKDKDRPKGNGASANADQQQRRKDRGPMVGDVEQRIRTTTEVAVELAEAVPEGDEAAVTTRRKRRHHQLLESGEVEAVSAATIEEQQIVELPPPPQPPRTMGSTTTTLETSALGLFFISIIGRPIRLTGISN

SEQ ID NO: 136110 - protein, 194 aa, Heterodera glycines
  Coding regions on vcDNA: vcDNA=SeqID_62533; Strand=+; Position=1 -333,718-818,873-934,1749-1837
  Homolog annotation: Hit_ID=NP_495884.2; Match level="QueryCoverage =83%, HitCoverage=20%, E-value=1e-18, Identity=32%"; Hit description =HEAT repeat containing protein (2J132) [Caenorhabditis elegans] emb|CAB03367.2| Hypothetical protein F46C
MRKENNKSSAASADSDANAKSGGDASLTAPTEEEAEEISANEQQKEQRKSLDALYAAAREEFDLDMSPLDSAMKTLREGREIQKLSVLRNLVELVEGEPDEALHRLLPMMQGLLSVTPSNLDIHCEAAIAYKNCIKEKKLQQKCPELSDRFLVAILENIEAQKENVTATAWLESLVDIADCVSMQSIVNMVKQK

SEQ ID NO: 136111 - protein, 72 aa, Heterodera glycines
  Coding regions on vcDNA: vcDNA=SeqID_62534; Strand=+; Position=1 -107,278-389
  Homolog annotation: Hit_ID=NP_495884.2; Match level="QueryCoverage =100%, HitCoverage=7%, E-value=4e-11, Identity=44%"; Hit description =HEAT repeat containing protein (2J132) [Caenorhabditis elegans] emb|CAB03367.2| Hypothetical protein F46C
VVPLAVAQADSGKRVQRRVISTRLIEKLALLVPKEILQRELSPCAQMLCQDPSAAVRTSIAQKLSMLAQSLK

SEQ ID NO: 136112 - protein, 392 aa, Heterodera glycines
  Coding regions on vcDNA: vcDNA=SeqID_62535; Strand=+; Position=1 -145,253-585,875-964,1014-1127,1181-1445,1519-1751
LQLCRTLPKIKQYLMFPNNDESLSNLERVVRELLASEQNALSRQLIQQFACELSRTEMDKKECRANRAKLAEEKRLWTEHEESTDETDEAEAGQQYSTEHTVTGSDAIGSPESGIFFEEDCWLGTGVGNGARPNNHQQMGGRLCRSATTTSISQHMETEAHSNLITAPSASSEMLSAMAIEPFAASSPKAARRRPPPPPPKSWRTTTTIKSANGPKLAIVRPQPQVKVVNQRSSSPMPFVDAEQQRKISNNKLPNETPSAATSKAEANNEQISDKKQHHQSDTDRHYSTTTALGERGKAPAESIRKSKLPLSTNGGRHRSSSSAPPVPPPKPKLPLFTSSSGNSPPSPYTTAASGTSSVTDSIKLKKYRPRDISTTSNYLYIEMDQLPMPSK

SEQ ID NO: 136113 - protein, 79 aa, Heterodera glycines
  Coding regions on vcDNA: vcDNA=SeqID_62536; Strand=+; Position=1 -127,182-291
MVPSPVVVPDVEAEAFRTMLVFIYTDDLSGIDGDNLFDVLYASKKYNIVGLVSACLDFPIPSLPNVFFAFAQARFLEEK

SEQ ID NO: 136114 - protein, 294 aa, Heterodera glycines
  Coding regions on vcDNA: vcDNA=SeqID_62537; Strand=+; Position=1-882
  Homolog annotation: Hit_ID=AAT85232.1; Match level="QueryCoverage =69%, HitCoverage=13%, E-value=7e-13, Identity=29%"; Hit description =hypothetical protein [Oryza sativa (japonica cultivar-group)]
MKPPELQYHHILSRGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLE

SEQ ID NO: 136115 - protein, 18 aa, Heterodera glycines
  Coding regions on vcDNA: vcDNA=SeqID_62538; Strand=+; Position=1-55
MAIRNACDRAGIDHVWGQ

SEQ ID NO: 136116 - protein, 58 aa, Heterodera glycines
  Coding regions on vcDNA: vcDNA=SeqID_62539; Strand=-; Position=1 -139,197-232
  Homolog annotation: Hit_ID=CAE57546.1; Match level="QueryCoverage =98%, HitCoverage=7%, E-value=1e-11, Identity=53%"; Hit description =Hypothetical protein CBG00524 [Caenorhabditis briggsae]
SFLDFLGIPVMMITYIDPKRGQYPLYHTRYELPFVNEHIFDNNQLAVHKAVGEYWAEL

SEQ ID NO: 136117 - protein, 78 aa, Heterodera glycines
  Coding regions on vcDNA: vcDNA=SeqID_62540; Strand=-; Position=1 -70,449-543,812-880
  Homolog annotation: Hit_ID=AAG23825.1; Match level="QueryCoverage =62%, HitCoverage=4%, E-value=2e-13, Identity=74%"; Hit description =guanylyl cyclase [Heterodera glycines]
MAICACPAFPIEMAIYMPNSVLTSNKIHISKETYMLLHNNFDGYAVESRGEVIIKGKGVMETFWLLSNAEIRSNNQMM

SEQ ID NO: 136118 - protein, 16 aa, Heterodera glycines
  Coding regions on vcDNA: vcDNA=SeqID_62541; Strand=-; Position=1-49
EAIPEGFGLPINLGAS

SEQ ID NO: 136119 - protein, 254 aa, Heterodera glycines
  Coding regions on vcDNA: vcDNA=SeqID_62542; Strand=+; Position=1 -111,163-293,658-829,933-1059,1445-1665
MPMIRRQLSDHQLHNASSISDLSNPGIMVVGGPSQTPFCPTRGTANGPCYAPAATPADVIYEYVDQGSLSLASTLKAGDFLRSRSKFNVYDPVPPMSNGQQQQRQQQQQHRRVESTSIGTQQIADNDHQQQQRREIYGDNEYLQPKSLTSNESDDNNLASSSTVRHQKALIVPVDVGTFRAISRECPVVPTTTTTSSSLSSPPSMASAYEHVMPQIPLNTFPNQTPPQRQWEAEILAELKQRQQQKQQQQQRQN

SEQ ID NO: 136120 - protein, 130 aa, Heterodera glycines
  Coding regions on vcDNA: vcDNA=SeqID_62543; Strand=+; Position=1 -62,485-571,730-973
MADRQQQQPYLINPINNRYSRNLSKKRFSGSYNKKCFFKYHFYNIVDNASSADWRRGTLQSEAERSLGSSRAATTFLGSPPEAAATDFGQTVTKTFGQNGGMDNVGQSVDQQFGRRKFFGQNDVSPGTDV

SEQ ID NO: 136121 - protein, 117 aa, Heterodera glycines
  Coding regions on vcDNA: vcDNA=SeqID_62544; Strand=+; Position=1 -92,451-613,668-766
MRKRTTKTGQHGAWIWVCPNICHEIRVSVSSSSELNRDKREEDDDTPMHDGEELDEEGDKSDVGLETTAKNDTETTGEPSTDGEGAEEQQQQQQQETVQENLEIARKKRDENQTGEI

SEQ ID NO: 136122 - protein, 669 aa, Heterodera glycines
  Coding regions on vcDNA: vcDNA=SeqID_62545; Strand=+; Position=1-2010
  Homolog annotation: Hit_ID=NP_508324.1; Match level="QueryCoverage =55%, HitCoverage=15%, E-value=4e-40, Identity=26%"; Hit description =predicted CDS, peptidase family A16 and RNA-directed DNA polymerase and Integrase, catalytic domain and Z
MKRKLFNSIVLHDNSIHIVKTLNLLFSQIDSINNFRCFGEGNLTIGTPIYCREHDCFKNNSFKQINGTKFCFYDPYEKIYLVKSDEELIQIKAWGTIEKIFYLPNNLNQPFIENRRNKREENSSITEESTIECLKGGIIIKAINDIQELQISIENYTIIKKNPQKEEIIYLPPKLTSFEYKPVIKFISNPDKSNEKQITCQSSPVCELINCRFCMEYLKNPQCVDQIHWALMLVIIMIILYVISLSLQIIRILTRFIHWILQFIFNCFKRKPKVNRIRISRPKLKRPLIYLITSSLILFKMIFACDEVTNLVAGTNDCAVTQEGKIECSYDQTTQLSITPEHLTCLKLDNTKTNTTMETLQITIETLTIICTEKSDYFTRGCELSSTSQKRCSGAGKCTGQTCQSVKISDRNPEVNDHANNQPGYSYCVPSCGGWHCQCFLATDGCLFYRTYAESVGDEIFEVVNCPSWTIQATIKLSINPELTYSVDLKPGILTHIGDESNSSISITLTSTSIPPTPLFGSTFIIVREELKAAIVANGNLLKNILRCKNKEEAQSFSCTFPPEACQCHGGDSVVHCECEKSPLTEIFARQENLLPIKTQGSYVYFDSQIKAKIQQTTSLQMQVTLKGHKVKAIYDKIFVILLPYHWKDVIPVLVVLIGLYHAKTCPHG

SEQ ID NO: 136123 - protein, 94 aa, Heterodera glycines
  Coding regions on vcDNA: vcDNA=SeqID_62546; Strand=-; Position=1 -195,620-709
MPVSDFLRASSQIPQFDQHRKQSYDDPKNCPSNFWGPPKNWTSATVWVGQTHALTNGKFTADTHLKIVAKFNTGQMKGDLFTEEKLLKKKRAEE

SEQ ID NO: 136124 - protein, 99 aa, Heterodera glycines
  Coding regions on vcDNA: vcDNA=SeqID_62547; Strand=+; Position=1 -62,247-484
MGCVYPYDEMCQQQRMNEQMRCYTCDYDNCNAISNPYGPGNSPYSNGGYDPYNNAQRYGPNGRYGYYWNGAMKQRQQQTANLLMALTVTLMTQIVLSIF

SEQ ID NO: 136125 - protein, 218 aa, Heterodera glycines
  Coding regions on vcDNA: vcDNA=SeqID_62548; Strand=-; Position=1 -536,1169-1289
  Homolog annotation: Hit_ID=DAA01153.1; Match level="QueryCoverage =72%, HitCoverage=12%, E-value=7e-15, Identity=43%"; Hit description =TPA: RTl1 [Mus musculus] ref|NP_908998.1| retrotransposon-like 1 [Mus musculus]
MVTFSAWISVCTSRIIWSINNCHGSGEREAGDEVEADEGEKEEQDEWGDEAEAEVEDEEEAEVGGGEEEWKREEEEEGDKEAEEGKREEEEEGDKEEEEEGKREDDGDPSEKPTDAGKRRGAPCAAAHQANSAPSDAAHFSHSENAQLEAEKRHSGGGFMSGRALTLMASEAAMMTTLRAQIGAAQQHGIGVAEDVQQGGISVHVFANLFHARHFWMV

SEQ ID NO: 136126 - protein, 91 aa, Heterodera glycines
  Coding regions on vcDNA: vcDNA=SeqID_62549; Strand=+; Position=1 -73,1826-2025
  Homolog annotation: Hit_ID=CAE75129.1; Match level="QueryCoverage =82%, HitCoverage=82%, E-value=4e-25, Identity=65%"; Hit description =Hypothetical protein CBG23057 [Caenorhabditis briggsae]
KAAAPRRLRTGRSVFLSSSPQPPTPCDGAQFAQMPCRCCKMDCWYSVAGSAMHQLGHVPGEAGEREALATLRLIRACMIAECTPLCAHNLM

SEQ ID NO: 136127 - protein, 185 aa, Heterodera glycines
  Coding regions on vcDNA: vcDNA=SeqID_62550; Strand=+; Position=1 -120,328-404,636-751,795-888,942-999,1361-1453
  Homolog annotation: Hit_ID=NP_504300.1; Match level="QueryCoverage =48%, HitCoverage=25%, E-value=2e-20, Identity=53%"; Hit description =anNEXin (40.7 kD) (nex-4) [Caenorhabditis elegans] gb|AAB42365.1| Annexin family protein 4 [Caenorhabditi
MLDSLQLNVPVSGTNGNAIYGVGIGILNGQKETDQQQKRSSVFARQKSSSEEADRKKRLTMPLIYRMYESQSDELCGTVRGPDDDAFHPEEASKRLRHALAAGIQSDDKTLIDVLLEHNNFQRQKIATAYENMYGRILADDIEEESGGHFMESILQLGVIRDTYQVRFTREYRNNPTTTVTLFTE

SEQ ID NO: 136128 - protein, 102 aa, Heterodera glycines; identical to SEQ ID NO: 127888
  Coding regions on vcDNA: vcDNA=SeqID_62551; Strand=+; Position=1 -198,252-362

SEQ ID NO: 136129 - protein, 116 aa, Heterodera glycines; identical to SEQ ID NO: 127487
  Coding regions on vcDNA: vcDNA=SeqID_62552; Strand=+; Position=1-351

SEQ ID NO: 136130 - protein, 115 aa, Heterodera glycines
  Coding regions on vcDNA: vcDNA=SeqID_62553; Strand=-; Position=1-346
FPHGTCSLSDSWPYLVLDEVYHLIWAAIPNNPTPRHVKMGRHRQLDRSCTFSGAPVKGNLNKRANPSSRSIRYTSQPQRSCDSALDSSRVHSPLLRESSLVSFPPLTDMLKFSGC

SEQ ID NO: 136131 - protein, 108 aa, Heterodera glycines
  Coding regions on vcDNA: vcDNA=SeqID_62554; Strand=-; Position=1-327
  Homolog annotation: Hit_ID=AAQ89162.1; Match level="QueryCoverage =65%, HitCoverage=56%, E-value=9e-09, Identity=40%"; Hit description =VLGN1945 [Homo sapiens]
MRKNTAHFMTFILIAVAPLLITFVPLLSLLYLLSNLYLFIKFVPLLISGVPLLITVVPLLITVVPLLITVVPLLITFVPLLITFVPPIITVVPLLITFAPLLITVNLF

SEQ ID NO: 136132 - protein, 88 aa, Heterodera glycines
  Coding regions on vcDNA: vcDNA=SeqID_62555; Strand=+; Position=1-267
MTTCIFGMNESDGIRQDPATDDEVLSGDEKDSMRRKERPVGVVGRGRGAKWTVEDEEGEGMGTEKEQDGAWPSTGSASAAEGRGRCIC

SEQ ID NO: 136133 - protein, 130 aa, Heterodera glycines
  Coding regions on vcDNA: vcDNA=SeqID_62556; Strand=+; Position=1-393
MATRRQVRVFTRVDDAIRHIRDTTPRPQEHDGHQNANNSANLNCGTNTDQSLADQLKQHEKPLTNQKRTALRQILEKQHLVKERTSINLLAHLREAAARGQRLELDLAEIRPDGCISMSIDLNQLRPLAN

SEQ ID NO: 136134 - protein, 77 aa, Heterodera glycines
  Coding regions on vcDNA: vcDNA=SeqID_62557; Strand=-; Position=1-233
MSSSSSPQSRYDYLDFAGKPDQPQQHQLRRQQQRAAPQQRVAVPPPALRRAAASADEPLYATASSQIYSLGGSEDPY

SEQ ID NO: 136135 - protein, 185 aa, Heterodera glycines
  Coding regions on vcDNA: vcDNA=SeqID_62558; Strand=-; Position=1 -75,130-224,1391-1531,1588-1834
MKKELITVAENKDIFDKIKFRTKFEVSHAVWNPKISLIALGSLDGEVVVKRYLWKTGLLDTLLKISADHPAFDPKEILDENCANILNDFEKTFQVLNNYGIHSLVRQPINKNKCYVLAPDEKEAIIQQIGHQIEENSEEETSDEEKMSEDENGVGHRELENDPISLHSFIFGHSEQRITEERMEC

SEQ ID NO: 136136 - protein, 75 aa, Heterodera glycines
  Coding regions on vcDNA: vcDNA=SeqID_62559; Strand=+; Position=1-228
MVESGESENDHNKWYLIFCVCPVSFFSLFVMVVPSAITSDGDDVVVPYDCDDGHGWMPELKKRRRHHGQWKCPGK

SEQ ID NO: 136137 - protein, 38 aa, Heterodera glycines
  Coding regions on vcDNA: vcDNA=SeqID_62560; Strand=+; Position=1-177
FLLLALWTNVPFLQVSFVIFDHFQYLPAFVSFTLLSMF

SEQ ID NO: 136138 - protein, 30 aa, Heterodera glycines
  Coding regions on vcDNA: vcDNA=SeqID_62561; Strand=-; Position=1-90
KEIVRQNERNVFFSALSIYWFMSRFLKRCV

SEQ ID NO: 136139 - protein, 122 aa, Heterodera glycines
  Coding regions on vcDNA: vcDNA=SeqID_62562; Strand=+; Position=1 -138,290-444,532-607
MPACSSSSSTAANVPQPSSSSLSAAEEFAKQKKRNKNNKNKFNKKQPPPPSIRIPKGKTPKKVRPRHPEPDQPDDQYELRAVLATAEVVSGGTTHLCLLSRARGLVFVNEKRRPRTDALPRH

SEQ ID NO: 136140 - protein, 74 aa, Heterodera glycines
  Coding regions on vcDNA: vcDNA=SeqID_62563; Strand=-; Position=1-525
SLGVDVQAFPRVGPPFNAYLGAVKGGRQAFLRVGPPIVFCFSFLSFSLTFPNIWVLMGRPSLVLVPPSMLISEL

SEQ ID NO: 136141 - protein, 133 aa, Heterodera glycines
  Coding regions on vcDNA: vcDNA=SeqID_62564; Strand=-; Position=1 -81,251-388,460-546,777-872
MSEQFPSFYMAIIFGVFLCLGFVKIYEVHGLTCPHGLKSETETRKPISESKNVQCYMMKNWLSMSVICLTARMKFSFYSCPIRLPPSKLNDNKYLNFKYYFNDIKREKNGDALQISLPIWRRLRKNAVTGRPV

SEQ ID NO: 136142 - protein, 92 aa, Heterodera glycines
  Coding regions on vcDNA: vcDNA=SeqID_62565; Strand=-; Position=1 -129,285-434
MPNILFQLHFLVSSLCSAHNVTSPAELSAIAPVNLEESRKWGWPNTNDERDEGNGSELESTVDDDETEEDLEMEDVETAMARQHSADGEVIF

SEQ ID NO: 136143 - protein, 74 aa, Heterodera glycines
  Coding regions on vcDNA: vcDNA=SeqID_62566; Strand=-; Position=1 -17,103-196,505-618
MFLLVPNLGLVGFTGASARYGGPFVTLSELKICLANYFVSGLFRVTRYPKPGIFLDPKPDPMILGRVSGRNKHW

SEQ ID NO: 136144 - protein, 47 aa, Heterodera glycines
  Coding regions on vcDNA: vcDNA=SeqID_62567; Strand=+; Position=1 -83,637-697
MSTFWRLALVQKRLSDYFNAICEFNGKKADDNTIGTMRPQQLSAASA

SEQ ID NO: 136145 - protein, 119 aa, Heterodera glycines
  Coding regions on vcDNA: vcDNA=SeqID_62568; Strand=+; Position=1 -3,127-483
MSQRYRFFADKHLELLRRYHEWMKDSLLLLEKELNLGGGVGDELDNRRRNGQTERQISKFGRKDGGESEKSQRDKWQQKETQREQNGEETDKRGRKVRIIRPNEKVIKREEGSENDQTK

SEQ ID NO: 136146 - protein, 102 aa, Heterodera glycines
  Coding regions on vcDNA: vcDNA=SeqID_62569; Strand=+; Position=1-307
MLTRDLRDSQVWKTVVTVDGISGGQAERRGQRSTAKDEKRHGDTEAVALRRHFYAEKPTNEQWQQNGRVALDEDGHNANQQKLDRGENCLPLTHKFNPLAPN

SEQ ID NO: 136147 - protein, 196 aa, Heterodera glycines
  Coding regions on vcDNA: vcDNA=SeqID_62570; Strand=-; Position=1 -181,457-537,585-910
  Homolog annotation: Hit_ID=CAF92079.1; Match level="QueryCoverage =94%, HitCoverage=19%, E-value=5e-29, Identity=34%"; Hit description =unnamed protein product [Tetraodon nigroviridis]
MFHSSLLYGADSSVRTAAVRAYVAFVCDNEENDAVIRQLSDLVPAVIKVCQHVVDTEDDDGGLEVMVSICESSNIMRKKGALYLPPLIQQCLQLMTELDDELDEWLQMDDAEDELEEETATIGETSLDRIACALGGKAVMNHALQCINELLNNENWKCRHAGLCALSTIGEGCKRQMEPLIPDIVNNFVLPKMADP

SEQ ID NO: 136148 - protein, 276 aa, Heterodera glycines
  Coding regions on vcDNA: vcDNA=SeqID_62571; Strand=+; Position=1 -146,191-385,552-660,716-883,1217-1355,1849-1922
  Homolog annotation: Hit_ID=NP_506712.2; Match level="QueryCoverage =87%, HitCoverage=62%, E-value=9e-38, Identity=39%"; Hit description =UNCoordinated locomotion UNC-76, axonal outgrowth protein, minor form (42.3 kD) (unc-76) [Caenorhabditis
MQSAAVHFSATEDCEIPDAPLAQVDELEMVEGSFAAFSSSLTDISAGDCEKSQSDEGPGEDLSNCSVNLSSSLQDLVESFDDKVAVVLKDFEKDAEKIAPIKIRSQEEIMSESQFWWTLTGNYGNLPPIDFDNSQIRRKQLEALNFNSPKQGTPTDRSVVSDCDSSEDTERIDFHRLATAQTHNENGESLSFNADKVIEEIDEILQAGDLMNQSLATNRTIESVDSMYSSMRSPNVYSDIEAEFKSKEREGIILQAMIDDSVHLPSLLTDYILNGR

SEQ ID NO: 136149 - protein, 171 aa, Heterodera glycines
  Coding regions on vcDNA: vcDNA=SeqID_62572; Strand=+; Position=1 -148,250-464,678-830
  Homolog annotation: Hit_ID=NP_788728.1; Match level="QueryCoverage =80%, HitCoverage=49%, E-value=1e-10, Identity=34%"; Hit description =CG33108-PA [Drosophila melanogaster] gb|AAF56219.2| CG33108-PA [Drosophila melanogaster]
MGNFGRQIASCGFAVLLMALRCSVGDGTLDRLVEMGKHFGITYNGELFSADWMCEFVQKHWSNACELRVAQFPSPNSIVRHLISGKKAHHQCTTTVLVPYDCDKNFEPCNRQGVAAHWAIIIGFVIFDVTAQNGPENQNAKVIAFDENDFRCDGFDNEHLLYLIALQGKSR

SEQ ID NO: 136150 - protein, 125 aa, Heterodera glycines
  Coding regions on vcDNA: vcDNA=SeqID_62573; Strand=+; Position=1 -51,112-232,647-799,938-988
  Homolog annotation: Hit_ID=CAE64016.1; Match level="QueryCoverage =100%, HitCoverage=72%, E-value=2e-40, Identity=57%"; Hit description= Hypothetical protein CBG08611 [Caenorhabditis briggsae]
MDYGRNEGILQIREFQRGGAVSNIPGLVIAAQEGLEAQHAKENKGGDKVNLPTNDITRQPRVNIKEGRKLVTLLVNLLVGISQFFTITFMFVGWFWSIAWGGLIIIHAMQYREALQQRRQEAVAT

SEQ ID NO: 136151 - protein, 310 aa, Heterodera glycines
  Coding regions on vcDNA: vcDNA=SeqID_62574; Strand=+; Position=1 -77,184-263,305-358,419-578,627-683,782-808,869-988,1028-1078,1123 -1173,1710-1740
  Homolog annotation: Hit_ID=NP_506019.2; Match level="QueryCoverage =89%, HitCoverage=37%, E-value=2e-51, Identity=42%"; Hit description =aspartyl(D) tRNA Synthetase (drs-2C) [Caenorhabditis elegans] emb|CAB04081.2| Hypothetical protein F10C2.
ALCLEGVVADRGKERNDKMPTGDIEVSVPFSEVLNSDAPLPVDESSNEYTRITHRYLDLRSEKITHRYLDLRSEKMQRAMRLRARVVSKCRRFLELRARVVSKCRRFLEDSCGFVEVQTPTLAHTTPGGAAEFPIPANKNGDCFSLPQSPQIYKQLLMCGSIDRYYQQSPQIYKQLLMCGSIDRYYQVAICYRDEGAKPAKPDRQPEFTQLDLELSFTSQEMVLSLIEQMIVNSWPDEIKTPKPTIPFPKTPKPTIPFPRMSHREAMDKFGTDKPVSFFSWVTMDKFGTDKPVSFFSWVTDGNGNSEFEI

SEQ ID NO: 136152 - protein, 78 aa, Heterodera glycines
  Coding regions on vcDNA: vcDNA=SeqID_62575; Strand=-; Position=1 -49,216-303,582-680
GGHSETELARASPAALINNLLGRNNGNSAQQQQSEQLTMGGRGTNVIGHQIAQHSAAGLNGALLQGIDFAANQLANYA

SEQ ID NO: 136153 - protein, 89 aa, Heterodera glycines
  Coding regions on vcDNA: vcDNA=SeqID_62576; Strand=+; Position=1 -126,171-314
MSNKTKEPLAFVTGVDDKCVFIWSSEYPLEELRFPVKLGAQRPELGQRVQYVCTKPPHEVQYSGILKRIANPSPIIILRDGEFVVILGF

SEQ ID NO: 136154 - protein, 55 aa, Heterodera glycines
  Coding regions on vcDNA: vcDNA=SeqID_62577; Strand=-; Position=1-167
MTKFDEFSLYSIGIAVPISTSSTICLDGDGGIKIEEDKQPNSFKLLFKPVSIQSM

SEQ ID NO: 136155 - protein, 171 aa, Heterodera glycines
  Coding regions on vcDNA: vcDNA=SeqID_62578; Strand=-; Position=1 -82,289-416,677-981
  Homolog annotation: Hit_ID=CAE61904.1; Match level="QueryCoverage =46%, HitCoverage=13%, E-value=4e-19, Identity=50%"; Hit description =Hypothetical protein CBG05896 [Caenorhabditis briggsae]
MPPSRVTFRHFAGAHGCWNVIDLFLMNLDVFDGEHGEPQITHKRTFIGAISLRNVLKCVKNYAFVQNPYPILGDHLLIPSDDLHTKPLPSPQQLKHKVLLRGKTAGGATTADINGGGTHVETTAATMAPASVAANNGTPCTAAPPMGTDYDTREEREDSPKQSQRNLPVDP

SEQ ID NO: 136156 - protein, 289 aa, Heterodera glycines
  Coding regions on vcDNA: vcDNA=SeqID_62579; Strand=-; Position=1 -388,864-958,1009-1038,1227-1418,1538-1570,2445-2574
  Homolog annotation: Hit_ID=NP_501213.1; Match level="QueryCoverage =51%, HitCoverage=19%, E-value=1e-21, Identity=37%"; Hit description =phospholipase C delta (4I274) [Caenorhabditis elegans] gb|AAB00624.1| Phospholipase c protein 4 [Caenorha
MAAAAADGQMMVENNKNNNNNNRGGGDGENVGATTTAGNNWGGKSGTMTTTTTPLGNHRTEKNNINGGGGVVVPFDLPVRRVKNGRISGVSRVALDIYEDMLSYGATRSSLLSSISGCRKGSAGERRKKVILTDVLEIRQGYRTDGLHKAAKDYKFQRMAPEQRCFSIICKHPRFVCKSLDFVAVDLDQTTNWLNLLQEHFANVLHLSQNTVTNFNEQKWLLQNFRQADLNRNGALSDQYVEALFKFKDVDQRKAEAVIAFCEPANFQQENQKDGEPSSSSSPKVLSVS

SEQ ID NO: 136157 - protein, 19 aa, Heterodera glycines
  Coding regions on vcDNA: vcDNA=SeqID_62580; Strand=-; Position=1 -6,256-309
MKTILLAADHPTIFMAQYA

SEQ ID NO: 136158 - protein, 18 aa, Heterodera glycines
  Coding regions on vcDNA: vcDNA=SeqID_62581; Strand=-; Position=1-55
MLHSKSPYNLEINEAGKK

SEQ ID NO: 136159 - protein, 39 aa, Heterodera glycines
  Coding regions on vcDNA: vcDNA=SeqID_62582; Strand=+; Position=1-117
MKRVIYNLPFPNYRQKIACKRTSVCMLLIAHALHMFLDG

SEQ ID NO: 136160 - protein, 64 aa, Heterodera glycines
  Coding regions on vcDNA: vcDNA=SeqID_62583; Strand=-; Position=1 -105,338-427
MGSPDDMDQPLVRGELSNKLKGGVDVGIAGVQLLAKMLNVRPNERISASDALKEAYFQNAESDA

SEQ ID NO: 136161 - protein, 86 aa, Heterodera glycines
  Coding regions on vcDNA: vcDNA=SeqID_62584; Strand=+; Position=1 -181,259-338
MPGVNHIQHFARVIDAKNGALLRSGERIKIKIPIDKTDGSLEEFKFDINLMYEGLSSHPIIGKTVMKMASEQHRKIPFQQFCQSKI

SEQ ID NO: 136162 - protein, 244 aa, Heterodera glycines
  Coding regions on vcDNA: vcDNA=SeqID_62585; Strand=+; Position=1 -11,73-262,488-862,1273-1431
MNRRWICNDVWMDIFPSFDRPQLGLKLALLSPRFNALVDKHFDGKSELTIWRPIEISKDIGPEPKLSLFWISSPHTTDGQRIWDILTREIWPIFSANIRHLCFSHRDHLDNLLRQISPTILIDLNQLVSIHSFGLLPAAFGDGFDGPNSTTSAGQALSKWLHIPRKAGQPKRLRCEDYNAQANTDWINSFKEHFLRANAISSVSYEIHFSVRAPSMEMVPFELVNEWTKEKLTFAKAKGWDKAK

SEQ ID NO: 136163 - protein, 173 aa, Heterodera glycines
  Coding regions on vcDNA: vcDNA=SeqID_62586; Strand=-; Position=1 -212,393-462,2652-2891
MQIVPFELVNEWTKEKLTLAKENENEWGIGWIMKRSKIIGETAAVHWKDGNWDNNCNNVIIWLFSTTNCIGMIDRPIIFIRDQMHFMKKKLSISLNTSRNNNISRSKNIGRRRDGREREEKEGEKGAATEQVLLMDVGNPPPKSRKIIVTFLKGKFIHSIDSKPFYTPDLFSN

SEQ ID NO: 136164 - protein, 137 aa, Heterodera glycines
  Coding regions on vcDNA: vcDNA=SeqID_62587; Strand=+; Position=1 -130,267-484,900-965
MDDEDEYEEEEEEAEGMGVLAYQTVEGAQSTDNVQLIGTSSNTGTNEKKNEDRVLENGTFGQRSSVQESDYVIRQIRTDNNPRLFNEVPTVPGELFLLRHQNEEIPHYCIRPQGIEGHICGYRKSLSWRCLLLISVN

SEQ ID NO: 136165 - protein, 17 aa, Heterodera glycines
  Coding regions on vcDNA: vcDNA=SeqID_62588; Strand=-; Position=1-54
YREATPEGFGLHKSGRI

SEQ ID NO: 136166 - protein, 117 aa, Heterodera glycines
  Coding regions on vcDNA: vcDNA=SeqID_62589; Strand=-; Position=1 -235,303-420
MATLVDPRFKNNPNIFSTKERAQNEVLLLDTVEMLTNPSRRGSESEQPKINSDSPNLLESFIGATQSIDFTDSQTNKILDTSTVGIGPTAFLEGKLAISYNKKACPKIFMSTSKQRR

SEQ ID NO: 136167 - protein, 155 aa, Heterodera glycines
  Coding regions on vcDNA: vcDNA=SeqID_62590; Strand=+; Position=1 -55,110-165,286-500,560-650
  Homolog annotation: Hit_ID=NP_497062.1; Match level="QueryCoverage =98%, HitCoverage=7%, E-value=2e-33, Identity=48%"; Hit description =DEAD/DEAH box helicase and Sec63 domain and helicase, C-terminal (2P63) [Caenorhabditis elegans] emb|CAA21
QNAHSQCHSVEDLLQCLADCPEYEEIPVRHNEDCPEYEEIPVRHNEDQINSEIQSFLPIRLSTSDWGSPHVKAHLLYQAHFSRMKLPVDYTTDQRSIIESCIRIIQANRSLSFLPKWITFRINVLINVLVLLQQIYQARWYSDHPLLCLPHFSSH

SEQ ID NO: 136168 - protein, 63 aa, Heterodera glycines
  Coding regions on vcDNA: vcDNA=SeqID_62591; Strand=-; Position=1 -82,381-490
MKQRDETADKGGKGTNGSDKKRKGICVVPVNECADETLNDCDQKVISSKKANKSNGSDLGTMH

SEQ ID NO: 136169 - protein, 84 aa, Heterodera glycines
  Coding regions on vcDNA: vcDNA=SeqID_62592; Strand=-; Position=1-259
CVLTRFIHQKKHEMNEVFEKRKAPAHKTISISETKAPNVSGKLSYLCSSDHASLPLSLSSDDDAPTRPSPSSSMLPLGAVDVLC

SEQ ID NO: 136170 - protein, 175 aa, Heterodera glycines
  Coding regions on vcDNA: vcDNA=SeqID_62593; Strand=-; Position=1 -99,972-1155,1414-1500,1905-2062
GIMTFLLGPKWRSFFDMIIVDACKPSWFGEGTEKTTGWHTFLVVPELSRELAVWTDNRELYEQLQQLESELVELHKRDKPTEAVTDPVFKAIQARSYTVNGTTVRRFRLSVRKRNAHLLFRLSTGTVCRFVCRLLLQLGPLFGLLFLPRSNGTDAAPVDGGPWGRNAGHRVTPKH

SEQ ID NO: 136171 - protein, 383 aa, Heterodera glycines
  Coding regions on vcDNA: vcDNA=SeqID_62594; Strand=+; Position=1-1149
  Homolog annotation: Hit_ID=NP_507408.1; Match level="QueryCoverage =96%, HitCoverage=22%, E-value=2e-53, Identity=33%"; Hit description =predicted CDS, polyprotein family member (5R896) [Caenorhabditis elegans] pir||T25352 hypothetical protei
MNAAQEPAYDPVAASRIQKLYRQSRPRAYREITEQSSPFCQIEGNDLFNQFSQVFEENAPIDEEMPPEIPRHGPPTERNPLGPQFTQKEVWERLKRCSNTAPGPDGIRYSVWKKYDQGAHILTTIFNCVKRSKHIPQSWTKSVTVLLHKKGDRNEVSNWRPIALSNTIGKLYSSVLANRLAMWSIAFNRVSSSQKGFMPVDGCAEHNFVLQSIIQDARRTKKRCSIAWLDLTNAFGSIPHQTIFTALKWSGLSDQSIAVIRQLYATNSTQIRHSNGLTPEIPIRAGVKQGCPLSPIIFNLGIEPILRTIGQLRTGYKLQKKRIDVLAYADDLVLVAESAEELQRMLDATSTIATWAGLSFNARKCATLDIDGRRKAALNTEFT

SEQ ID NO: 136172 - protein, 167 aa, Heterodera glycines
  Coding regions on vcDNA: vcDNA=SeqID_62595; Strand=-; Position=1 -204,560-760,976-1074
  Homolog annotation: Hit_ID=NP_494593.1; Match level="QueryCoverage =91%, HitCoverage=14%, E-value=4e-11, Identity=27%"; Hit description =eukaryotic initiation factor 2C2 family member (2D895) [Caenorhabditis elegans] gb|AAF60724.1| Hypothetic
MAYTISKHMLKLNGTYWMQQPRVTTVQTSAPMVNAIKQALLAFLDQNGFFPEHIFVFRAGASEGEYKKVAHWEGGAFMTAFAELMAEQQSMAKKPALTMVVCQRNSNYRIIPTNVQPGGRAQEQNCQPGTVLDKQVMHSSLTEFLLVGHRTIASGLRLRLTLIPAQT

SEQ ID NO: 136173 - protein, 111 aa, Heterodera glycines
  misc_feature (4)..(4): Xaa can be any naturally occurring amino acid
  misc_feature (7)..(8): Xaa can be any naturally occurring amino acid
  Coding regions on vcDNA: vcDNA=SeqID_62596; Strand=-; Position=1 -70,115-242,264-399
SFAXHQXXSFGSFSTCTNFTSQFVLKIGNISQPFAEATFKFIRNFDGTFGRIADFLLFFDWRRSAEIRLAGQSHRKQNSVFVCLNISAFSFFSRSFFVNCKRMLRLSIFIY

SEQ ID NO: 136174 - protein, 151 aa, Heterodera glycines
  Coding regions on vcDNA: vcDNA=SeqID_62597; Strand=-; Position=1 -355,681-781
MSSARCRMALGPALFRLRQHVTTAENLLDEPVSNAETIENLEQERGHITRILSRMEVELEAWGAIMNGLQGPAREAEEVLFTAFIRDDRHLTEWLEHAREMLAHIAAELADDKIHNGKNHRLLVFPFLFVLYVSLQDYNVYLVISIFFYLY

SEQ ID NO: 136175 - protein, 206 aa, Heterodera glycines
  Coding regions on vcDNA: vcDNA=SeqID_62598; Strand=-; Position=1 -233,751-841,1235-1531
MSSSSSPQSRYDYLDFAGKPDQPQQHQLRRQQQRAAPQQRVAVPPPALRRAAASADEPLYATASSQIYSLGGSEDPYRVPPATTMLARAAMNKNNANNFAELDQLYAKINRKISAADQQQPTTSAAIAKQLLRQQSFQHQQSTTTTDFGGESGSGSICSSTQPSYRYLTVREDAAVIRERIRLREEQEQQQQSEQQHQQRANLWVK

SEQ ID NO: 136176 - protein, 47 aa, Heterodera glycines
  Coding regions on vcDNA: vcDNA=SeqID_62599; Strand=+; Position=1-290
ILFLLSKSFLLIAVANQPFHTHSRWLNNMRHHGPVVPTVDPLKNAPK

SEQ ID NO: 136177 - protein, 64 aa, Heterodera glycines; identical to SEQ ID NO: 129150
  Coding regions on vcDNA: vcDNA=SeqID_62600; Strand=-; Position=1-873

SEQ ID NO: 136178 - protein, 76 aa, Heterodera glycines
  Coding regions on vcDNA: vcDNA=SeqID_62601; Strand=+; Position=1 -135,1506-1601
MQLCVLLVLPDRADAVLLRRRHHHQLGTTTIAAATTQHGVNGVMMRWKKVGQIFGEWAPFNDMVNQLVILPKCHKL

SEQ ID NO: 136179 - protein, 87 aa, Heterodera glycines
  Coding regions on vcDNA: vcDNA=SeqID_62602; Strand=-; Position=1 -94,185-241,595-707
MHTFCARAIYHRACQSKTKQQRCCFERIKGIESVHRLLEKYICNLSTILRKSVHRLLEKYICNLSTILRSELEMINFTIQTNFRCSN

SEQ ID NO: 136180 - protein, 15 aa, Heterodera glycines
  Coding regions on vcDNA: vcDNA=SeqID_62603; Strand=+; Position=1-49
LKAIHCLPVLGTAKH

SEQ ID NO: 136181 - protein, 43 aa, Heterodera glycines
  Coding regions on vcDNA: vcDNA=SeqID_62604; Strand=+; Position=1-505
CFAVPRTGRQWIALNLQEIRLAISGCKKLLGNELFFEVSQTPY

SEQ ID NO: 136182 - protein, 169 aa, Heterodera glycines
  Coding regions on vcDNA: vcDNA=SeqID_62605; Strand=+; Position=1 -69,113-202,256-491,734-847
DTDEPIFPRNDQNKPIVPVDENDQPIFPVDKTGTFIFPVDESNCPIPALTVYGTRVVPKDEFGNAVIPRDRDGKALIHIASDGVTPLSMGEWKQWKKYYKEQAQVRNFYQQRQQQPVAVEPAAAAGIGIGAMFHPLNLEQQSAYFAADMEMLQRVRRVRPEDVDLPGQM

SEQ ID NO: 136183 - protein, 130 aa, Heterodera glycines
  Coding regions on vcDNA: vcDNA=SeqID_62606; Strand=-; Position=1 -3,106-495
  Homolog annotation: Hit_ID=NP_701061.1; Match level="QueryCoverage =61%, HitCoverage=6%, E-value=4e-23, Identity=59%"; Hit description =hypothetical protein PF11_0201 [Plasmodium falciparum 3D7] gb|AAN35785.1| hypothetical protein [Plasmodium
MAHVLHINYNGGRRKTSDERHRRLTAGARRGPVNQKLKNDQKLKNDQKLKIDQKLKNDQKLKIDQKLKNDQKLKNDQKLKNDQKLKIDQKLKNDQKLKIDQKLKNDQKLKNDQPSNYGEPSLAGDFDFKN

SEQ ID NO: 136184 - protein, 184 aa, Heterodera glycines
  Coding regions on vcDNA: vcDNA=SeqID_62607; Strand=+; Position=1 -92,526-722,1094-1359
MPTVGGGGRRQRAGLRGRRRASRAIAGRISRRRGGRPPRQQSSTSASAAGRPKRPWEGSEDEEDELSKRYGFGRSFLFSEEEEDEEEEEEDEGMGSDQTDLDTDDDDRGSEAKALPSSAAVAPSASSPFGPFSSLDDEDDDMEEELLAQLPPDQIPPLVLSDSSVDLLIYKEHLMDTLEVMGSL

SEQ ID NO: 136185 - protein, 95 aa, Heterodera glycines; identical to SEQ ID NO: 130684
  Coding regions on vcDNA: vcDNA=SeqID_62608; Strand=-; Position=1 -799,1130-1158

SEQ ID NO: 136186 - protein, 77 aa, Heterodera glycines
  Coding regions on vcDNA: vcDNA=SeqID_62609; Strand=+; Position=1 -72,295-456
MSALISEQDTAVPESIPDQIATLLPWKAADEVFERIHLDSAGPCEDGQTYLVVVDAYSNWPGVWEMSRATAKDRRYA

SEQ ID NO: 136187 - protein, 71 aa, Heterodera glycines; identical to SEQ ID NO: 134376
  Coding regions on vcDNA: vcDNA=SeqID_62610; Strand=+; Position=1-262

SEQ ID NO: 136188 - protein, 65 aa, Heterodera glycines
  Coding regions on vcDNA: vcDNA=SeqID_62611; Strand=-; Position=1-197
CHWDDVPFIQPDSATYICAENDAVREPGIRQQLDTLLREKKYESRMLLAKTYLMVQNRPTAAGCL

SEQ ID NO: 136189 - protein, 221 aa, Heterodera glycines
  Coding regions on vcDNA: vcDNA=SeqID_62612; Strand=+; Position=1-666
MNQWILFFLIVLFLIIQIEIGAEKKKLEQKTFDEIFGEKWEEKENEQKKREIVQKFNKIKEKILQKERKYSTKEWNKIELKIGKKLGTNRQYIYQWIKELNLQKIKSYKSKTDEQKIEFVQKFITMKNEYKQNGRKYSRKEWHQNYAEICKKIGVSYGTIEKWKKQFGIRERMTEKEKMEKVKIYFHIKRENPKISDEKIAKIVKINRRTIDKWKKRFGEE

SEQ ID NO: 136190 - protein, 103 aa, Heterodera glycines
  Coding regions on vcDNA: vcDNA=SeqID_62613; Strand=+; Position=1 -171,597-737
MLLAELEDGGQSDGAVPATQQHQHQQQQSQHIVAMLERALRERDEFANGMMEMAQEMDNDENGGGGSSAALTTCSSSCNGDIGPAAGGKSVKQHNAIASTFGP

SEQ ID NO: 136191 - protein, 90 aa, Heterodera glycines
  Coding regions on vcDNA: vcDNA=SeqID_62614; Strand=-; Position=1-273
MTLGLIEHREMTLELIEHREMTLELIEHREMTLELIEHREMTLELIVHREMTLELIEHREMTLEFDRTSRNDPRVDRTSRIDPRLDRAEN

SEQ ID NO: 136192 - protein, 135 aa, Heterodera glycines
  Coding regions on vcDNA: vcDNA=SeqID_62615; Strand=-; Position=1-408
  Homolog annotation: Hit_ID=NP_702739.1; Match level="QueryCoverage =67%, HitCoverage=39%, E-value=7e-14, Identity=32%"; Hit description =hypothetical protein [Plasmodium falciparum 3D7] emb|CAB62860.2| hypothetical protein [Plasmodium falcipa
MTLELIEHREMTLELIEHREMTLELIEHREMTLELIEHREMTLEFDRTSRNDPRVDRTSRNDPRVDRTSRNDPRVDRTSRNDPRVDRTSRNDPRVDRTSRNDPRVDRTSRNDPRVDRTSRNDPRVDRTSRNDPRV

SEQ ID NO: 136193 - protein, 130 aa, Heterodera glycines
  Coding regions on vcDNA: vcDNA=SeqID_62616; Strand=+; Position=1 -225,663-758,837-908
  Homolog annotation: Hit_ID=AAH60037.1; Match level="QueryCoverage =95%, HitCoverage=19%, E-value=8e-19, Identity=33%"; Hit description =KIAA1212 protein [Homo sapiens]
MLVDLQDELERQRVEIGRLQAERLELVKDARAAKDLRDEMECMQHKLTRLERLETEAEKMRTKLGELDFYKSRMNSLKEDNRLVQETCRVMEEQLEQCQRKLTAHLEVETKLIESQANNKSLQLDLTKVN

SEQ ID NO: 136194 - protein, 173 aa, Heterodera glycines
  misc_feature (1)..(1): Xaa can be any naturally occurring amino acid
  misc_feature (13)..(13): Xaa can be any naturally occurring amino acid
  Coding regions on vcDNA: vcDNA=SeqID_62617; Strand=-; Position=1 -191,247-375,604-753
  Homolog annotation: Hit_ID=NP_490967.1; Match level="QueryCoverage =89%, HitCoverage=23%, E-value=2e-27, Identity=40%"; Hit description =nima -related kinase (1C941) [Caenorhabditis elegans]
XQFFGCVLICEIXFYIYSLKCEGRSYNAKSDMWAMGCCLYEMCTLRKPFDADNLTILIHKIINCEYEPLKGPYSQDIRLICEYEPLKGPYSQDIRLIVRELFRADPEQRPSASDLLEQVDKQTQRRRGANGAAAKAVYSALYRFDTEKFTLLAMSELPDRAQIKQVAKPMNER

SEQ ID NO: 136195 - protein, 404 aa, Heterodera glycines
  Coding regions on vcDNA: vcDNA=SeqID_62618; Strand=-; Position=1-1214
  Homolog annotation: Hit_ID=XP_319741.1; Match level="QueryCoverage =91%, HitCoverage=83%, E-value=1e-40, Identity=28%"; Hit description =ENSANGP00000006515 [Anopheles gambiae]
MNAEQIQQLLTALLQGNAASSISQANLASSIDSRISKFVYDPENGQTFEQWHKRFGILIEEDGKDLTEQAKVRLLLGKLGDEDYTKYRDTISPELPDKASWAESINRLKELFAETRSLFVRRYECFRIRRHPNQVISSLVAQINAACEHANLSLTKEQLKCMILVISLRDEYHDLRQKCLKMMEEAEKSGTTVTLKKLEEELKAIQIVKDSALSLLSTPASTNAIRTRPQQWRESKSKANSANAVQQNHPAQQKPATGGKAIRGQPTQPCGSCGGTDHWRSDCRFREATCHKCQKQGHIANVCRKGAFTTKNQRRSFHTVQVKATCLQIGTTQGRWWTILVEINGTKIEMNVDTGAQATVLTIETWTKLGQPKLLPTDIETRNCNDVTFKTKGKFICLVSIVGP

SEQ ID NO: 136196 - protein, 87 aa, Heterodera glycines; identical to SEQ ID NO: 129152
  Coding regions on vcDNA: vcDNA=SeqID_62619; Strand=+; Position=1-1137

SEQ ID NO: 136197 - protein, 67 aa, Heterodera glycines
  Coding regions on vcDNA: vcDNA=SeqID_62620; Strand=+; Position=1-210
SPSSFFTLFFGCGTHGLSQIIISLNSLLFHFLLIILKILILFTFSCYKFSNKFSHFIIYKQKKKKNL

SEQ ID NO: 136198 - protein, 88 aa, Heterodera glycines; identical to SEQ ID NO: 124691
  Coding regions on vcDNA: vcDNA=SeqID_62621; Strand=+; Position=1 -96,135-305

SEQ ID NO: 136199 - protein, 110 aa, Heterodera glycines
  Coding regions on vcDNA: vcDNA=SeqID_62622; Strand=-; Position=1 -61,794-1065
MFFAVSISLKKEYKCKKREEHSASCKRCRLNKCLSVGMNSLRVSIKSKRVSGQSAPAKSSNLGEIGTDLSAITTLNNAPPKWAVPNSVGCPRQGMFLGSEGARRTYCKND

SEQ ID NO: 136200 - protein, 121 aa, Heterodera glycines
  Coding regions on vcDNA: vcDNA=SeqID_62623; Strand=-; Position=1 -325,632-672
  Homolog annotation: Hit_ID=NP_871792.1; Match level="QueryCoverage =94%, HitCoverage=18%, E-value=3e-14, Identity=38%"; Hit description =calcium-activated SK potassium channel and Calmodulin binding domain containing protein family member (75
MFFNPSSQFRMHVNSIKRWHCAVHLRQRVLILLELVLCAVVPLPLLRLPCGGDAFACALMFLRLYWLPRVLHLRSRLSTDAAAKSIAGLNCVKTDTRFLLKRMLFLHPGPTLSAFVVSTFI

SEQ ID NO: 136201 - protein, 12 aa, Heterodera glycines
  Coding regions on vcDNA: vcDNA=SeqID_62624; Strand=+; Position=1-63
KLGFAFGFGFEC

SEQ ID NO: 136202 - protein, 96 aa, Heterodera glycines
  Coding regions on vcDNA: vcDNA=SeqID_62625; Strand=+; Position=1-291
MTDGKEGWEGGGGHHASTTGRKTKEELEMRNERMGKNGNGRKDGEKEKRKRKRKREEKEEQEEEKLGRTMKKEELRERNKEGRSDAFDQFLGKHSS

SEQ ID NO: 136203 - protein, 35 aa, Heterodera glycines
  Coding regions on vcDNA: vcDNA=SeqID_62626; Strand=+; Position=1-105
MAESWSLCRECWLSLPCWWSCLFCVLALPNSSIGE

SEQ ID NO: 136204 - protein, 165 aa, Heterodera glycines
  Coding regions on vcDNA: vcDNA=SeqID_62627; Strand=+; Position=1 -154,347-690
MEPKSDVCADSDNSLVSGMGTPQTEVIRVGGLANEGRTEAQLNGAGGGGGADRLAAGSLDAQPSPVVMVNHILVWSSICSQSPPQKTFIMCNFLDSDHHHFGLKPGTSASLTFVLQKLSAKTEPSGCISTPYSVNVVLDELSALGYRAIGMVNKRADEVLWTLAK

SEQ ID NO: 136205 - protein, 146 aa, Heterodera glycines
  Coding regions on vcDNA: vcDNA=SeqID_62628; Strand=-; Position=1 -59,152-286,356-555
  Homolog annotation: Hit_ID=CAE59244.1; Match level="QueryCoverage =91%, HitCoverage=12%, E-value=9e-38, Identity=55%"; Hit description =Hypothetical protein CBG02570 [Caenorhabditis briggsae]
KKETVKIKSNFSFHSPTMHWPLPLHDCLMLEPTESEDKAEMDRYCEALIAIREEIEDIARGELHIDLNPKNAPHTLSVLANPKNAPHTLSVLAASVWDRPYSREQAGWPKPWCHTSRKVWPTVGRIDDSFGDRNPFCSCPPVKGDE

SEQ ID NO: 136206 - protein, 213 aa, Heterodera glycines
  Coding regions on vcDNA: vcDNA=SeqID_62629; Strand=-; Position=1 -216,305-504,837-916,963-1108
  Homolog annotation: Hit_ID=CAE59244.1; Match level="QueryCoverage =99%, HitCoverage=24%, E-value=1e-45, Identity=41%"; Hit description =Hypothetical protein CBG02570 [Caenorhabditis briggsae]
MSTRCEPIGAELRPIDNVSTLAVGDLSAEAAAIIIQYPNTEGKLYDHLERLIRAAHRHNVTKLILSLSSLSLILVILVCDLLSLTLIRSPGDLGADIAVGTSQRFGLPLGYGGPHAGFICVKDLALARQMPGRIVGVSRYAVYHGPRRLVQIAKIVHKSAAYLAQKLKANGIEVEHKEFFDTIKAKPKEMDDFRKRCEEQQINVIHSCSSDLN

SEQ ID NO: 136207 - protein, 91 aa, Heterodera glycines
  Coding regions on vcDNA: vcDNA=SeqID_62630; Strand=-; Position=1 -120,185-340
MGSPTKFSASLTRTARRKWSSCRVALSRLFAVNWQRRPKLGMEFGEQYNCAQRRIRGTIPASEQEEERREQAAEDRTNEESDQDADIDVVD

SEQ ID NO: 136208 - protein, 45 aa, Heterodera glycines
  Coding regions on vcDNA: vcDNA=SeqID_62631; Strand=+; Position=1-170
NHRNTSIACTGYRTWDPPFGDLLTNHFATHTNLFWYSSSVSGRRV

SEQ ID NO: 136209 - protein, 24 aa, Heterodera glycines
  Coding regions on vcDNA: vcDNA=SeqID_62632; Strand=-; Position=1 -25,975-1024
MKNVENNGMSPTRANRTMPMCESE

SEQ ID NO: 136210 - protein, 283 aa, Heterodera glycines
  Coding regions on vcDNA: vcDNA=SeqID_62633; Strand=+; Position=1 -288,339-383,923-1039,1212-1610
  Homolog annotation: Hit_ID=CAE75288.1; Match level="QueryCoverage =98%, HitCoverage=68%, E-value=2e-43, Identity=47%"; Hit description =Hypothetical protein CBG23256 [Caenorhabditis briggsae]
ASATIVDYKLSLLGVDSESAEYKERIWQCHQRGADRLLSLARRNGGVFIKVGQHIASLQYLLPEPYTSTLSILHSKAPESSLDDMKTVFYRSLHKNFDDVFDEFDPRPCGAIPKIHYNYSSDKVLTMEFCEGGQINDLDYFQVHQLDRHKICRLLGALYSEMIFRRGYVHSDPHPGNVLVRRSANTGREEIVLLDHGLYCVKSPFGNANVKTSANCQTLPDELRIDYAKLWLALMKPDQDEIRRVCERMNIGQNYGLFACIVTMRSWKSVTAGIARTEIDDRE

SEQ ID NO: 136211 - protein, 152 aa, Heterodera glycines
  Coding regions on vcDNA: vcDNA=SeqID_62634; Strand=-; Position=1 -384,856-927
  Homolog annotation: Hit_ID=AAR24087.1; Match level="QueryCoverage =75%, HitCoverage=21%, E-value=2e-11, Identity=39%"; Hit description =atherin [Homo sapiens] ref|NP_612361.1| atherin [Homo sapiens]
APSAQLPAKAPQQPQAPKAAVAPAQQQQQPKAAAPPPPKAAAAPQQPKATAVAAPPKPTAPPAVAPQKRAPPPVVREVQLPEAPTQPILRHAEYTPKLVDASVNKLPPGQEPDEEQLEASAVPRNPIIKSIVPEAVGYSKTKWNEFPEEEEK

SEQ ID NO: 136212 - protein, 67 aa, Heterodera glycines
  Coding regions on vcDNA: vcDNA=SeqID_62635; Strand=-; Position=1-254
SQSTALSTSAEIDEENIYKCVGYPHPNVVKDIFRALLDNSIEIAYKSKLKILNIFLFMSFFVARFIF

SEQ ID NO: 136213 - protein, 60 aa, Heterodera glycines
  Coding regions on vcDNA: vcDNA=SeqID_62636; Strand=-; Position=1 -55,109-145,208-298
  Homolog annotation: Hit_ID=NP_496907.1; Match level="QueryCoverage =98%, HitCoverage=30%, E-value=7e-12, Identity=56%"; Hit description =NADH dehydrogenase 1 beta subcomplex 8 19kDa like (23.5 kD) (2O171C) [Caenorhabditis elegans] emb|CAA2166
MVLSKIPIRRSLHTSAPLCRGAVSQPGWYPRDHMPGPYPRNEEERRAAAIKYGLRPEDYK

SEQ ID NO: 136214 - protein, 41 aa, Heterodera glycines
  misc_feature (32)..(32): Xaa can be any naturally occurring amino acid
  Coding regions on vcDNA: vcDNA=SeqID_62637; Strand=-; Position=1-131
SLFIKGRIKQRKIRRQSSALVHRLLIFFYFFXFSMPDDFFS

SEQ ID NO: 136215 - protein, 47 aa, Heterodera glycines
  Coding regions on vcDNA: vcDNA=SeqID_62638; Strand=-; Position=1 -46,200-297
MTFYASLVGYTGRNNKILSVQSGILMSKSVTEDAILCFSCWIRGQVE

SEQ ID NO: 136216 - protein, 48 aa, Heterodera glycines
  Coding regions on vcDNA: vcDNA=SeqID_62639; Strand=-; Position=1 -46,200-300
MTFYASLVGYTGRNNKILSVISAFGILMSKSGTVNEILCFSCWIHGKK

SEQ ID NO: 136217 - protein, 204 aa, Heterodera glycines
  Coding regions on vcDNA: vcDNA=SeqID_62640; Strand=+; Position=1-614
  Homolog annotation: Hit_ID=XP_498263.1; Match level="QueryCoverage =88%, HitCoverage=20%, E-value=5e-10, Identity=22%"; Hit description =PREDICTED: similar to Mucin 1 precursor (MUC-1) (Polymorphic epithelial mucin) (PEM) (PEMT) (Episialin) (
MFMCHNSLQTDSRKTHGMFMCRNSLQTDHRKAQGMFMCHNSLQTDHRKAQGMFMCHNSLQTDHRKTHGMFMCRNSLQTDHRKAHGMFMCRNSLQTDHRKAQGMFMCRNSLQTDHRKAHGMFMCRNSLQTDHRKAHGMFMCHNSLQTDHRKAHGMFMCRNSLQTDHRKAQGMIMCHNSLQTDHPKAHGMFMCPHSLQTTNRKTME

SEQ ID NO: 136218 - protein, 51 aa, Heterodera glycines
  Coding regions on vcDNA: vcDNA=SeqID_62641; Strand=+; Position=1-153
MSRNRLPPELLLEIVLCVRRGHNTPNICFSSRILRTFMEPRVALWRRVWIS

SEQ ID NO: 136219 - protein, 107 aa, Heterodera glycines
  Coding regions on vcDNA: vcDNA=SeqID_62642; Strand=-; Position=1 -149,191-365
MQTALLPVGKRSQFTSIKCVNCKQELDAMDGYALVDCSHKWHFEKPFADWYAESSIKKCMNDACKKKFTKVRCRECKENLGAGVFETGCYCSVTSASHLHADELEIK

SEQ ID NO: 136220 - protein, 107 aa, Heterodera glycines
  Coding regions on vcDNA: vcDNA=SeqID_62643; Strand=-; Position=1 -145,206-381
  Homolog annotation: Hit_ID=CAH72257.1; Match level="QueryCoverage =83%, HitCoverage=17%, E-value=2e-10, Identity=46%"; Hit description =OTTHUMP00000059032 [Homo sapiens]
GGYLSSKILNFLLLRYYQPDEIAKVGLPLGDIEIAELSSEEEKEAPTNVLPTVRTDAPSSLLSQSPKVIASPVDRRLIREYGIDTVGLTGSGRDGRILKEDILNLAH

SEQ ID NO: 136221 - protein, 63 aa, Heterodera glycines
  Coding regions on vcDNA: vcDNA=SeqID_62644; Strand=+; Position=1 -11,76-128,206-240,356-448
MLVWVLSSFPAKFGELLISLEENALKRTKFYLHKLIRSAPNFAGILKGREITYFKYYLVSSFK

SEQ ID NO: 136222 - protein, 109 aa, Heterodera glycines
  Coding regions on vcDNA: vcDNA=SeqID_62645; Strand=-; Position=1 -252,303-380
ADAEHPTDAAVVDNFETRARRFFDLINDGNIQQLRVLIDALDADELNILLRWMVDPVERDYTRSRSALWSAFFRQHIDIVDLLVLEKGADPNEPVVGRENDINTSGWCC

SEQ ID NO: 136223 - protein, 421 aa, Heterodera glycines
  Coding regions on vcDNA: vcDNA=SeqID_62646; Strand=+; Position=1 -241,414-529,580-1184,1659-1962
MFNHPSIAERQINIGLFSQKGQQNSVQFDNPSAKKTKSYAEAVRFELADGGNSDEPMMEWEGPQNQREDSTHDDGTLSDNVHSLQPVAPPVTEFGIDLFPIVSAKQTGDDFGARNVQQQDQSRRNDGSDIGLFEKKKCVASLEIHRMDNPNERCVVKKYEFFMVTDNEQHQMNSAAFATSERCNPTVGQMTQKILSEHFETPIDKLIAQFDMQMQIFDTDFADGRFVDMEKNWSAELVQNNGAYKVLLHSKMDARSGRGYEDVSTSQMANRGPRQQREMFGNQTYNEYESDMFDQQTVGNRSKCGRPIGDPSFCDSNLEQIGRFLLSEVKAPLANLYDVSTDNFVTLNDHGFVNKMAKNDENLTMQDRPNMREQLIEIESFDDLKERTKILDFDQKVANTILTKAIYAFVIVECDQPTCAF

SEQ ID NO: 136224 - protein, 184 aa, Heterodera glycines
  Coding regions on vcDNA: vcDNA=SeqID_62647; Strand=-; Position=1 -145,472-627,680-829,1052-1155
  Homolog annotation: Hit_ID=NP_956276.1; Match level="QueryCoverage =78%, HitCoverage=9%, E-value=2e-14, Identity=33%"; Hit description =Unknown (protein for MGC:63531) [Danio rerio] gb|AAH61450.1| Unknown (protein for MGC:63531) [Danio rerio]
MTPLFLAVRHANLPLCRVLVARGANIDLGTDFATTPLMHACKRSQTEIGFHFALKSAAIGGSLEVCRLLVEEWAADVNQQTIQERYTPVICAASKGHLAIVNFLIEHGADLQHVDVVGNNALMWAVISGKTEMARHLVAIGADINQRDTADSKMISNRCDSSTERANRWPKAADGFIRKTLIDH

SEQ ID NO: 136225 - protein, 76 aa, Heterodera glycines
  Coding regions on vcDNA: vcDNA=SeqID_62648; Strand=+; Position=1 -117,294-407
MSKDEMEEKKEEREGNRECGRKKWTKKKKGIMEDRGEEERKKKWKMKKKEREDEEAKIKWKRKKRMNYRRWGRGEW

SEQ ID NO: 136226 - protein, 92 aa, Heterodera glycines; identical to SEQ ID NO: 124679
  Coding regions on vcDNA: vcDNA=SeqID_62649; Strand=-; Position=1-665

SEQ ID NO: 136227 - protein, 65 aa, Heterodera glycines
  Coding regions on vcDNA: vcDNA=SeqID_62650; Strand=-; Position=1 -14,334-517
MPIVGSDNNQIILGFIRTDYPFGEQKAQQNGGAKCDAKEEKENGKKEAAKNENVSKKSEMAKEFT

SEQ ID NO: 136228 - protein, 109 aa, Heterodera glycines
  Coding regions on vcDNA: vcDNA=SeqID_62651; Strand=-; Position=1-330
MRNGSYENKLTLAIDVTLKEAEAMDKKASATEQNNSFGTISMEIEKVSEFSREILYSDRISETVHLKGFPWQLMANFNPDPNGVSSTDGSTELYLGFYLWCTSLKRGEN

SEQ ID NO: 136229 - protein, 127 aa, Heterodera glycines
  Coding regions on vcDNA: vcDNA=SeqID_62652; Strand=-; Position=1 -162,605-826
MNCTVINKLTTLSKVRDAFRITNLLICIAFMILCAFPMYRLARERLTLYMVISKLFPGILFFLSKIISFPSTGFIIPNVVLDIVAKIAFICQNYGVICIRLHYVVMAANRAHAVLFPFNYAQNITKK

SEQ ID NO: 136230 - protein, 63 aa, Heterodera glycines
  Coding regions on vcDNA: vcDNA=SeqID_62653; Strand=+; Position=1 -64,251-378
MWHFSIGIAVIFGTLCCSNGNVFNDVEGFVSEFASMTDAGADVLEKLGHIGKGTFSLLKFAGC

SEQ ID NO: 136231 - protein, 83 aa, Heterodera glycines
  Coding regions on vcDNA: vcDNA=SeqID_62654; Strand=-; Position=1 -184,466-533
MHLNYKNIFHILSEAEQFDKVLDMLQMPNINNITTNSLSSGTDCAAVGGVLGFYSNKFYVHGKNVNTLIINTLLTRLFAHFES

SEQ ID NO: 136232 - protein, 32 aa, Heterodera glycines
  Coding regions on vcDNA: vcDNA=SeqID_62655; Strand=-; Position=1 -28,117-187
MPTLSKMIVGKFFKADQFKARQIEYQNKYSKN

SEQ ID NO: 136233 - protein, 59 aa, Heterodera glycines
  Coding regions on vcDNA: vcDNA=SeqID_62656; Strand=+; Position=1-281
RDVPRFRFSHFALFAFLAFRISLFAFRFLARNATFTPLRIGLNSHKIFQNFTYKLANFQ

SEQ ID NO: 136234 - protein, 133 aa, Heterodera glycines
  Coding regions on vcDNA: vcDNA=SeqID_62657; Strand=-; Position=1 -132,164-433
MTPIIFRKVREEFKNSANYIKELQIIMRRTNTKNFLSVLIEINQVELAGISLAEFVHPDDATLLHNQLALNLPASALLVLQPELRFTLRFRCTPGRRAMMGCNGIGMQPGYKPIHFVGTLHADDDGRFLVKAW

SEQ ID NO: 136235 - protein, 24 aa, Heterodera glycines
  Coding regions on vcDNA: vcDNA=SeqID_62658; Strand=+; Position=1-76
ITGVSIIAVLFLVFLMPSQNLVRF

SEQ ID NO: 136236 - protein, 57 aa, Heterodera glycines
  Coding regions on vcDNA: vcDNA=SeqID_62659; Strand=+; Position=1 -57,961-1077
MTIEQLKQCMEDAKRFLAEVIVVGQSTDEATQKMLKAIRAKFLPMATLIFIDKDRPG

SEQ ID NO: 136237 - protein, 36 aa, Heterodera glycines
  Coding regions on vcDNA: vcDNA=SeqID_62660; Strand=+; Position=1-109
FLCLSVMRYFVAISAAFSWPLSVDSNHSSGIFMPPP

SEQ ID NO: 136238 - protein, 195 aa, Heterodera glycines
  Coding regions on vcDNA: vcDNA=SeqID_62661; Strand=-; Position=1 -289,347-415,473-601,1202-1301
MPTVTVPTVSQPTVTPRCLFGPDGKCLPTPSYSTADPVTNTYSTQPVTNTYSTADPVTNTYSTRPVTFSTQPVTTYSTRPVTYTRRTYSTTDPPSSRDDENNKETVTPAGIASNISANLDKVAETNFHDSPIQVQLDDIDDIELQTGPDNYDVKLRSPLENGVCLQQIDKDRMAPLIYNAHQPGITTVSASLPSE

SEQ ID NO: 136239 - protein, 114 aa, Heterodera glycines
  Coding regions on vcDNA: vcDNA=SeqID_62662; Strand=-; Position=1 -27,400-567,619-737
  Homolog annotation: Hit_ID=CAE67304.1; Match level="QueryCoverage =100%, HitCoverage=8%, E-value=1e-42, Identity=72%"; Hit description =Hypothetical protein CBG12757 [Caenorhabditis briggsae]
KGRAVLIGAAERQKLVYILNRDAHANLTISSPLEAHKNYSICFAITGIDVGFENPTFSCLEIDYEDSDHDPTGDDSDHDPTGDAAKQIQQTLTFYELDLGLNHVVRKYAEPLAD

SEQ ID NO: 136240 - protein, 29 aa, Heterodera glycines
  Coding regions on vcDNA: vcDNA=SeqID_62663; Strand=-; Position=1-87
MDNQQGKDDVLSSNAFAYQQIVGPQNITA

SEQ ID NO: 136241 - protein, 94 aa, Heterodera glycines
  Coding regions on vcDNA: vcDNA=SeqID_62664; Strand=-; Position=1 -93,180-371
MEKQRIGEKCDDEREKRISGKEEEAEMAIIKAELCRERAEKNRRHSELSKVHQELMQSLQKAEQLQKKLDREMRERTKEREATDILQKANSNGQ

SEQ ID NO: 136242 - protein, 95 aa, Heterodera glycines; identical to SEQ ID NO: 128210
  Coding regions on vcDNA: vcDNA=SeqID_62665; Strand=-; Position=1-662

SEQ ID NO: 136243 - protein, 87 aa, Heterodera glycines
  Coding regions on vcDNA: vcDNA=SeqID_62666; Strand=+; Position=1 -52,249-460
MTNEAKGNHRNEQGEKVISKKRRVLLHLQSTRQAATLRVIRKTMAVAVTKALALEDGERAGDEVIECETIHVADSNEQNDKFMCVYY

SEQ ID NO: 136244 - protein, 43 aa, Heterodera glycines
  Coding regions on vcDNA: vcDNA=SeqID_62667; Strand=+; Position=1-131
FFFLGDLCSLLRDFSSFSRLIPRPRSSRSRRERLVDSSTRALT

SEQ ID NO: 136245 - protein, 408 aa, Heterodera glycines
  Coding regions on vcDNA: vcDNA=SeqID_62668; Strand=-; Position=1 -292,783-1066,2020-2113,2186-2325,2852-2989,3099-3248,3378-3457,3509 -3556
  Homolog annotation: Hit_ID=AAH56482.1; Match level="QueryCoverage =42%, HitCoverage=16%, E-value=7e-33, Identity=42%"; Hit description =BC023754 protein [Mus musculus]
MENANNAATNNNKMPKTAGAPEQKNGGRKTKTTTKGAKNLSGSSSPDGLYPKLAAAANNKSSPDRGELCVSFKVLKTRDELLVDEEHEEEEEDTNTLARLFSEDDVHFSDSFCAKLNLADANEQQQKQQQQQEEDEEGEEEDDESDTSDSTAKAGPSTGGLAAKDTFIKWASFIHNPYLFIFMLDPNEMKKNFVINEWVKDIMNKQFPNVVGSLAPINALVQLAQGFHDLFALPYDELRKENGQLIRGIQRGTTSFGLNAATAAIDATQRNVAELAFDIVNPNFQRHRRLLSGPQRVQVAGDLREGFSLAYNAVREGVLDTAQTLQAAAAEDRALGGLGMGVLRHMTPSAIKPFVIASKATSLVLGRGEGNENWTTKEKLFGEKSGRVWLNFMPRKNPEVAENGLGPA

SEQ ID NO: 136246 - protein, 324 aa, Heterodera glycines
  misc_feature (307)..(307): Xaa can be any naturally occurring amino acid
  Coding regions on vcDNA: vcDNA=SeqID_62669; Strand=-; Position=1 -100,169-277,324-697,757-985
  Homolog annotation: Hit_ID=NP_495324.2; Match level="QueryCoverage =97%, HitCoverage=24%, E-value=7e-43, Identity=35%"; Hit description =human WeRNer syndrome related (118.5 kD) (wrn-1) [Caenorhabditis elegans] gb|AAA68410.2| Human wrn (werne
KEFAIDRATTCVATIAFGMGIDKKDVRRVIHYGAPGCIESYYQEIGRAGPGCIESYYQEIGRAGRDGFPSRCLVFYAVSDIMMQKRRIMNNNLSKEYENHKLEMLRRMKRRIMNNNLSKEYENHKLEMLRRMEQFLTTTSCRRYLILSYFDNSIQHPDVPNSDCCDNCEKRCQIGGNDDGEPTTVDFGEEAKKLFNALELFNGRSGLKKPIDFLRGSENVKKKRKELMTIKLFGSGKNKSENWWTEFGKLFGSGKNKSENWWTEFGKMLRNNGFLSESKSTFAQYCYLTKLAPKAIEWLSSGSKVGXGERGIHVQGVSRHTPSS

SEQ ID NO: 136247 - protein, 32 aa, Heterodera glycines; identical to SEQ ID NO: 127531
  Coding regions on vcDNA: vcDNA=SeqID_62670; Strand=+; Position=1-248

SEQ ID NO: 136248 - protein, 271 aa, Heterodera glycines
  Coding regions on vcDNA: vcDNA=SeqID_62671; Strand=-; Position=1 -146,333-477,531-750,1095-1146,1193-1313,1366-1435,1486-1547
  Homolog annotation: Hit_ID=XP_396048.1; Match level="QueryCoverage =99%, HitCoverage=15%, E-value=1e-42, Identity=40%"; Hit description =similar to ENSANGP00000003051 [Apis mellifera]
MRLECSTFTNILALYLKTKGDVVLVADLMRSVTVLGYKAVDSTFEELARDYSTEWTSACEIIDSETFLAAENNHNIYCCKIDVNAESDEDRSRLKVSQVGLYYLGEMINVFRRGSIVSAQQRERDCGTAHGLMEIEDGGAATFCENGGKTGRNGTPTATSAPLFSNPIIYVFSMNCKRQSQQKHTIGNLRVDHNIYRSFFTERRNEQPIGFIDGDLVETVTEMVGLSFPREMLEIVVDGLRLWREPDTMDESVTARPEDVLKLVEDLAQIR

SEQ ID NO: 136249 - protein, 50 aa, Heterodera glycines
  Coding regions on vcDNA: vcDNA=SeqID_62672; Strand=-; Position=1 -54,85-184
LECHGTGNFCQNRDRDLPGPEKPGPGPGPRFFFGTGTNREILKIQKNFKN

SEQ ID NO: 136250 - protein, 244 aa, Heterodera glycines
  Coding regions on vcDNA: vcDNA=SeqID_62673; Strand=+; Position=1 -577,637-794
MLFLLFIFVFLIINNSTDKTLSVNLCKKCRPTFAEIFGEEWQNEIRIGGDENENETDQNANFHQNDQNELTDRTDQLDVQQKIEIIHKFHAIREAIKKGKYSAKNWNKIEQKIAEKLGINRPKIYKWKKEIGLNIKNDQNYYEMKKKEFIERIDEIKRTSENGKQKQFAKELGISKVTLRKWKKEFGIEMSKSRIRFTDEQKMSKMNDYYEMKKGNPSLSDKEIADILKIGTATLTRWKKENNS

SEQ ID NO: 136251 - protein, 211 aa, Heterodera glycines
  Coding regions on vcDNA: vcDNA=SeqID_62674; Strand=+; Position=1 -86,347-584,659-968
VYLKTLAVMSQQQFAERKVMPKREYQKELTMVPSWMISASTTTTAAASSSTSAASGQSSPGPDSHLPPFHQHGDVGFCELPLEVEGTSKLGSALLKHTATRSYSSNPREFFKFGRKPTIAKSRGVIEQQQTDAVTGGAVGASVGDSAAGPSGSSGGVSQLRYRKSGGSGMGAGRSGAVSKDAESRRKSLGAAAAANAVAAGTILHRDSPVG

SEQ ID NO: 136252 - protein, 213 aa, Heterodera glycines
  misc_feature (179)..(179): Xaa can be any naturally occurring amino acid
  misc_feature (184)..(184): Xaa can be any naturally occurring amino acid
  misc_feature (200)..(200): Xaa can be any naturally occurring amino acid
  Coding regions on vcDNA: vcDNA=SeqID_62675; Strand=+; Position=1 -161,610-762,1204-1552
  Homolog annotation: Hit_ID=AAF98217.1; Match level="QueryCoverage =78%, HitCoverage=38%, E-value=1e-33, Identity=45%"; Hit description =Putative mannose-6-phosphate isomerase [Arabidopsis thaliana] pir||E96694 probable mannose-6-phosphate iso
DELAQAEHHEPDWGERALRRMFCQVWTSPAEQIVHVVAQIVDRIGTSGHHTDPSPVDALVLRLNSQFPGGDIGVLAPFFLNFFTLRPGQATFLGPNEPHAYLSGDCVECMALSDNTIRAGLTPKFKDVPTLCSSLTYRMYAPPIFEPMLPDGVIEYGPPVDEFAVHKIDVIFGKRALDXLASIXIYCVALHIDFIFAQKXLSFFSYNFCPKNM

SEQ ID NO: 136253 - protein, 177 aa, Heterodera glycines
  Coding regions on vcDNA: vcDNA=SeqID_62676; Strand=-; Position=1 -68,119-186,376-513,580-837
  Homolog annotation: Hit_ID=CAE58657.1; Match level="QueryCoverage =81%, HitCoverage=36%, E-value=2e-23, Identity=40%"; Hit description =Hypothetical protein CBG01826 [Caenorhabditis briggsae]
MALTRKWPRENGHAKTTPTAILKLRTLQEVSSKSNTVVRASVVLLGNERCGKSLLANRLTRGERSGQSSVLEYNYLQIQADTDASYAYQLGGGAANGLLGPTDSTDLPLWILDGKDECAPLLRFTFPPSLSKCVVCLCASMEQPGNIMPALSKWYRLLDEQIRLHYQPEEIVQARQA

SEQ ID NO: 136254 - protein, 68 aa, Heterodera glycines
  Coding regions on vcDNA: vcDNA=SeqID_62677; Strand=-; Position=1 -94,185-297
MHAFCARAIYHRACQSKAKQQRCCFERIKGIESVNRLLEKYICNLSTILRSELEMINFTIQTSFRCSN

SEQ ID NO: 136255 - protein, 48 aa, Heterodera glycines
  Coding regions on vcDNA: vcDNA=SeqID_62678; Strand=-; Position=1 -94,185-237
MHAFCARAIYHRACQSKAKQQRCCFERIKGIESVNRLLEYIFAIYQQF

SEQ ID NO: 136256 - protein, 202 aa, Heterodera glycines
  misc_feature (33)..(33): Xaa can be any naturally occurring amino acid
  misc_feature (54)..(54): Xaa can be any naturally occurring amino acid
  misc_feature (93)..(93): Xaa can be any naturally occurring amino acid
  misc_feature (135)..(135): Xaa can be any naturally occurring amino acid
  misc_feature (156)..(156): Xaa can be any naturally occurring amino acid
  misc_feature (195)..(195): Xaa can be any naturally occurring amino acid
  Coding regions on vcDNA: vcDNA=SeqID_62679; Strand=+; Position=1 -306,837-1140
  Homolog annotation: Hit_ID=CAD22154.1; Match level="QueryCoverage =100%, HitCoverage=52%, E-value=1e-31, Identity=41%"; Hit description= pherophorin-dz1 protein [Volvox carteri f. nagariensis]
PEFPKPEFEKPSFPKPPPPPEVGLVTEGRRSDXPNPPPEEKSLLEKPPPPSLSXRFCRPNPPPPPPPRPPPRPPPPPSFQRLPLPPRRLPSDXFCVSPSPKPPEFPKPEFEKPSFPKPPPPPEVGLVTEGRRSDXPNPPPEEKSLLEKPPPPSLSXRFCRPNPPPPPPPRPPPRPPPPPSFQRLPLPPRRLPSDXFCVSPKP

SEQ ID NO: 136257 - protein, 40 aa, Heterodera glycines
  Coding regions on vcDNA: vcDNA=SeqID_62680; Strand=+; Position=1-122
VDILLLFAVLMSDTRAYRICSNYSPVSIKPAVSNYPPVYE

SEQ ID NO: 136258 - protein, 143 aa, Heterodera glycines
  Coding regions on vcDNA: vcDNA=SeqID_62681; Strand=+; Position=1 -63,940-1098,1142-1351
MGQNGSEMLGKMTVLTDHSTKKNQGITKFFGNEDPQKKADEQIARLMIRTNCSFLFVEAPELQNLFSLAYPKLQLRRKDYFRRNVIPKMADEIQQKIVQGIGQDFFSVTSDGWSQITKSPALLRFYNPFHGLYKQTLALPYII

SEQ ID NO: 136259 - protein, 145 aa, Heterodera glycines
  Coding regions on vcDNA: vcDNA=SeqID_62682; Strand=+; Position=1-438
NGVSKNRNYAQKASQTILALPIPSTIAFIHPIMSAKIIRVPKIACDLSLAKNGVSKNRNYAQKASQTILALPIPSTIAFIHPIMSAKIIRVPKIACDLSLEKNGLSKNRNYAQKASQTILALPIPSTIAFIHPIMSAKLSECRKS

SEQ ID NO: 136260 - protein, 197 aa, Heterodera glycines
  Coding regions on vcDNA: vcDNA=SeqID_62683; Strand=+; Position=1 -89,142-403,643-885
  Homolog annotation: Hit_ID=NP_495615.2; Match level="QueryCoverage =90%, HitCoverage=28%, E-value=7e-45, Identity=41%"; Hit description =predicted protein of function (82.4 kD) (2H986) [Caenorhabditis elegans] gb|AAA62531.3| Hypothetical prot
MSSMTKSFTNKLASEKSPYLLQHSGNPVDWYPWGDEAFKKAKELNRPIFLSGKYQTFLHKVSLHLVGYSTCHWCHVMEHESFEDEAIGKLLNENFVSIKVDREERPDVDKLYMSFVQWNNNSQEVKEQGRELAEAIREGIQQAKSSQLPIADEAVQKSYARLVRQFDKENGGFGSAPKFPKAGPLKTFNSTVIEHFS

SEQ ID NO: 136261 - protein, 182 aa, Heterodera glycines
  Coding regions on vcDNA: vcDNA=SeqID_62684; Strand=-; Position=1 -89,276-339,575-830,1132-1271
  Homolog annotation: Hit_ID=NP_497982.1; Match level="QueryCoverage =28%, HitCoverage=4%, E-value=6e-16, Identity=63%"; Hit description =latent transforming growth factor beta binding protein like (3F865) [Caenorhabditis elegans] emb|CAA86058.
WKGAPICDEDIDECQDESVSCPNEQPDCMNTPGAYLCLCYEYDNSTGKCMGSSEEADDDNAALSLSSQRRIPVPIPSMVLTPQLGPLLDKMSHQISTQMPTKVTRPSAPKLLLLGTEKAAPMQACFLNRRILKNFILLDKSRMRRTISKPKILVKEKKFVGGIMCIKCAEILGICLKRILIF

SEQ ID NO: 136262 - protein, 15 aa, Heterodera glycines
  Coding regions on vcDNA: vcDNA=SeqID_62685; Strand=+; Position=1 -36,398-409
MKKIIKKNNAGVKML

SEQ ID NO: 136263 - protein, 18 aa, Heterodera glycines
  Coding regions on vcDNA: vcDNA=SeqID_62686; Strand=+; Position=1-54
MSSTKLKNGREAPVLRPG

SEQ ID NO: 136264 - protein, 24 aa, Heterodera glycines
  Coding regions on vcDNA: vcDNA=SeqID_62687; Strand=+; Position=1-76
VTGVSIIAVLFLVFLMPLQNLVRF

SEQ ID NO: 136265 - protein, 40 aa, Heterodera glycines; identical to SEQ ID NO: 126546
  Coding regions on vcDNA: vcDNA=SeqID_62688; Strand=+; Position=1-180

SEQ ID NO: 136266 - protein, 289 aa, Heterodera glycines
  misc_feature (163)..(163): Xaa can be any naturally occurring amino acid
  misc_feature (181)..(181): Xaa can be any naturally occurring amino acid
  misc_feature (276)..(276): Xaa can be any naturally occurring amino acid
  Coding regions on vcDNA: vcDNA=SeqID_62689; Strand=-; Position=1 -377,865-1356
  Homolog annotation: Hit_ID=XP_311331.1; Match level="QueryCoverage =97%, HitCoverage=98%, E-value=5e-30, Identity=34%"; Hit description =ENSANGP00000001657 [Anopheles gambiae]
ITVNAIFECPLSNLCCTSFNLCCTSSNHCCTSSHHCCTSSNQICTPSNNCTSFNHCCTSFNHCCTSSNHCCTSSHHCCTSSNHHCTSSNHHCTSSNHHCTSSNHHCTSSNHHCTSSNHHCTKTCLNALFECPLSNLCCTSSNLCCTSSNHSSNLCCTSSNHCXTSSNHSSNLCCTSSNHCXTSSNLCCTSSNHCCTSSNHCCTSSDHCFTSFNHCCTSSNQICTSSDHCFTSFNHSCTSFNHCCTSSNHSCTSSNHSSNHCCTTSNHCCTTSNHCXTSSNHSSNHCCTT

SEQ ID NO: 136267 - protein, 78 aa, Heterodera glycines
  Coding regions on vcDNA: vcDNA=SeqID_62690; Strand=+; Position=1-237
MVVRRGTMVIRRGTMVIRRGTMVIRRGTMVIRRGTMVIRRGTTMMRRGTAVIRRGTTVIKRGTTVIKRGTALLEGVQI

SEQ ID NO: 136268 - protein, 230 aa, Heterodera glycines
  Coding regions on vcDNA: vcDNA=SeqID_62691; Strand=+; Position=1 -127,264-568,641-773,843-946
  Homolog annotation: Hit_ID=NP_649154.2; Match level="QueryCoverage =93%, HitCoverage=10%, E-value=7e-51, Identity=48%"; Hit description =CG8103-PA [Drosophila melanogaster] gb|AAF49099.2| CG8103-PA [Drosophila melanogaster] sp|O97159|CHDM_DRO
AAEAAHVAKEREIEERLHQKKEREHTVCDQTPTVQSTEVEEKDAATELTGSETDRPSSKVGEEKDKEETSEEATTRGNDGGASPSATTAAQRAKALFKFNIADGGFTELHSLWVNEERVAVPGNEYEIWHRRHDYWLMCGIVTHGYSRYNEHGYSRYNEIQNDPRFAIVNEPFKSEQGKGNFMEIKNKFIQRRYKLLLEQALIIEEQLRRAAYLQITPKSEEHLPQKESG

SEQ ID NO: 136269 - protein, 129 aa, Heterodera glycines
  Coding regions on vcDNA: vcDNA=SeqID_62692; Strand=+; Position=1-391
FGVSQSLLTILYNIILQTAEEFKEIAEPNITRRFLTFLMKLFANMLHFLPQNTKASLADHKVLAHGWDWTFHFLTTAGQQLAQLDHYLAASAKQSQNVAKTDTEQSAKRGFWHKNCTNFASGSGTKQQN

SEQ ID NO: 136270 - protein, 124 aa, Heterodera glycines
  Coding regions on vcDNA: vcDNA=SeqID_62693; Strand=+; Position=1-375
MSGPIQKGIINALKALDNAKSATSLLLHPDPDLSNWESAVNLEAQFDRVVKEIRTMEMQMDSLRDSSNAWIELLARLIGDDKDNGEKEYVKFDKNEKIAGDTTQRLFLSAENTINKIEFKLYGL

SEQ ID NO: 136271 - protein, 67 aa, Heterodera glycines
  Coding regions on vcDNA: vcDNA=SeqID_62694; Strand=-; Position=1 -125,339-417
METLVEQIDELKQLQREGVTKLKGVKKGRTCGRKFEGIRNKRAGLRWKRIKRWTKRTHCQQNGEDDE

SEQ ID NO: 136272 - protein, 149 aa, Heterodera glycines
  misc_feature (136)..(136): Xaa can be any naturally occurring amino acid
  Coding regions on vcDNA: vcDNA=SeqID_62695; Strand=+; Position=1 -135,237-320,380-439,497-610
  Homolog annotation: Hit_ID=CAE71208.1; Match level="QueryCoverage =75%, HitCoverage=77%, E-value=2e-33, Identity=61%"; Hit description =Hypothetical protein CBG18071 [Caenorhabditis briggsae]
MSRVIVSYFRQYSLKDWRNYFLSTHFWGPVANWGLPLAAIVDFRKSYCKISGPMSCALTIYSSVFMRFAWQVQPRNMLLFACPRNMLLFACHLTNFVAQQIQIVRFSNYHFLIVRFSNYHFLHLYTDPFATVKKLXRGQNTKVEQRHCA

SEQ ID NO: 136273 - protein, 324 aa, Heterodera glycines
  Coding regions on vcDNA: vcDNA=SeqID_62696; Strand=-; Position=1 -272,332-461,985-1111,1298-1515,1563-1629,1832-1944,1991-2038
MGVESPPHKRGHRYIFVDNIGPNFFDDDPNAWGAQEDIHLLNSLIKAHLDQWAELSKDFGRKKPLMEALERLDRCFLRNEIGKCVLATKNRGIVNICGDDSDVKEENANGWVKFTILFHFFLEFSCNGYQSEFKKATRKEQLLAVAKNAAVEAFRGQRKTSLELSEAMNSVENAGKVSCDGVHNNSAICDEKLAELYASSACSPYFYNAKVPLMKPQTVAKFDEEDLQLLTYLPFRDEFENVQPTFCFLLISRIVFPREGADLGEVDKFINEVIYARFDRYNRIMRIRTTKKAIIREHNLLNEYLNIVKTNMSEKGKYAVFEGK

SEQ ID NO: 136274 - protein, 186 aa, Heterodera glycines
  Coding regions on vcDNA: vcDNA=SeqID_62697; Strand=-; Position=1 -138,285-506,725-871,982-1046
  Homolog annotation: Hit_ID=CAE61308.1; Match level="QueryCoverage =96%, HitCoverage=41%, E-value=2e-55, Identity=51%"; Hit description =Hypothetical protein CBG05143 [Caenorhabditis briggsae]
AAIQTPCTPNLYAEEQTKRKCRKDKCQTAYYKNKYAADKRKGSFAYTLFPRKMSVDQAGNDRVLLPSVVGHFNKTSSAGPLTMEQIRTIIRKELFLYGPTTLALPLTEEFLHYDSGIFHPFPRQHFDDRIIYWHVVRLIGWGHDEDDHLFWVAVNSFGEQWGENGFFRVDTSLLEDYGLEYEAGMP

SEQ ID NO: 136275 - protein, 122 aa, Heterodera glycines
  Coding regions on vcDNA: vcDNA=SeqID_62698; Strand=+; Position=1 -183,259-441
  Homolog annotation: Hit_ID=CAE65033.1; Match level="QueryCoverage =96%, HitCoverage=24%, E-value=1e-22, Identity=45%"; Hit description =Hypothetical protein CBG09873 [Caenorhabditis briggsae]
MTPPHPHHRRQQQQMPSAQSVGSAAQFGRQPFGAGGGPIMANNAIANRKKRRFADKMVAPEIRSLMPELDAYVGLLSYEQKLDAIISRKKMEIQEALKRPMKIKRKLRIYISHSFIQAREPE

SEQ ID NO: 136276 - protein, 25 aa, Heterodera glycines
  Coding regions on vcDNA: vcDNA=SeqID_62699; Strand=-; Position=1 -52,151-176
MEKACKIWRDYIDFNALEKASESLI

SEQ ID NO: 136277 - protein, 62 aa, Heterodera glycines
  Coding regions on vcDNA: vcDNA=SeqID_62700; Strand=+; Position=1-190
KFSDAAVAQNGDDEPQQSPADPEQADGESEQAQQHNPLQYRPRTHRRRIRMAAMAAGAGGNE

SEQ ID NO: 136278 - protein, 58 aa, Heterodera glycines
  Coding regions on vcDNA: vcDNA=SeqID_62701; Strand=+; Position=1 -24,82-234
MFKMYEGEVLKKFPVVQHFLFGSLFSITERKDGKKTDSSGLDKISHGLHPAKLGIIPE

SEQ ID NO: 136279 - protein, 226 aa, Heterodera glycines
  Coding regions on vcDNA: vcDNA=SeqID_62702; Strand=+; Position=1 -255,333-606,766-870,914-960
  Homolog annotation: Hit_ID=CAE59764.1; Match level="QueryCoverage =75%, HitCoverage=68%, E-value=2e-16, Identity=30%"; Hit description =Hypothetical protein CBG03216 [Caenorhabditis briggsae]
MDTKKLQQLASNPTVVAQSNGPNEGTAKDTNNDNTSITSTREKMLEVVYGNKLMGKEKQPKFMCFVVDAQERKIRIMSREEQKKQESSAIILEDLTDDQFSRFGKSVKDKEADNSDAFVHCEKCSLFYEFCCLDHPLYQCKDRVPSSSPTEIEDRAAATLPAFLFIQNSSIPSAGKGPYEGILTQNLSEMEFGAYTWELRVGYGKPSYYIDAKDPRYSNWMVKFIR

SEQ ID NO: 136280 - protein, 267 aa, Heterodera glycines
  Coding regions on vcDNA: vcDNA=SeqID_62703; Strand=+; Position=1 -211,722-823,1016-1070,1122-1329,1370-1401,1625-1817
  Homolog annotation: Hit_ID=CAE57187.1; Match level="QueryCoverage =26%, HitCoverage=21%, E-value=4e-18, Identity=58%"; Hit description =Hypothetical protein CBG00031 [Caenorhabditis briggsae]
MSGQMWNHIRGPPFVMTHPQTRETSLVHGSTQYQLIAETYIVLSLYAAVTLGVVVLNDAASSKTDPGKRKHRIAAISFCDQFVEQALVGERDLATMERNNAIEKACDWDLSLLIKKSVGERDCSNAIRVGALLSRLIRWAFESDLSSQSRTLFAEEPFKFLNSFDRVGASRLFSGWLYARWVLKTDLDGRFPVPPARPTVSNPYFSVDQSLLQAERLSQVTLEVRSRMGEAVNFLRRIVNDRRLGDDDKVEVPGMMCFFQNFDITTK

SEQ ID NO: 136281 - protein, 89 aa, Heterodera glycines
  misc_feature (51)..(51): Xaa can be any naturally occurring amino acid
  Coding regions on vcDNA: vcDNA=SeqID_62704; Strand=-; Position=1-619
  Homolog annotation: Hit_ID=NP_001004212.1; Match level="QueryCoverage= 96%, HitCoverage=20%, E-value=2e-16, Identity=50%"; Hit description =similar to N33 protein [Rattus norvegicus] gb|AAH79193.1| Similar to N33 protein [Rattus norvegicus]
YQLIAETYIVLSLYAAVTLGVVVLNDAASSKTDPGKRKRGDLSPFGTVFYXFNSVMACIGIGLVVVFFSLLLSVFRSKHHGYPYHFLFS

SEQ ID NO: 136282 - protein, 26 aa, Heterodera glycines
  Coding regions on vcDNA: vcDNA=SeqID_62705; Strand=+; Position=1-78
LLLPLCYCLCHLSNKYLPMRNMISLD

SEQ ID NO: 136283 - protein, 72 aa, Heterodera glycines; identical to SEQ ID NO: 125063
  Coding regions on vcDNA: vcDNA=SeqID_62706; Strand=-; Position=1 -83,555-690
  Homolog annotation: Hit_ID=XP_422386.1; Match level="QueryCoverage =95%, HitCoverage=20%, E-value=6e-13, Identity=50%"; Hit description =PREDICTED: similar to DnaJ (Hsp40) homolog, subfamily B, member 4; DnaJ-like heat shock protein 40 [Gallu

SEQ ID NO: 136284 - protein, 223 aa, Heterodera glycines
  Coding regions on vcDNA: vcDNA=SeqID_62707; Strand=+; Position=1 -153,752-939,986-1316
  Homolog annotation: Hit_ID=NP_501545.1; Match level="QueryCoverage =100%, HitCoverage=20%, E-value=3e-46, Identity=36%"; Hit description= steroid receptor-interacting SNF2 domain protein (146.2 kD) (4J665) [Caenorhabditis elegans] emb|CAA9098
RRSVDYDTTETGADGRLLINAGKPDSDPEVFVAEHLTNVLQPHQIGGVKFIIRITGKRHVLLICPVNVLQNWHNEFNRWMPETDAETARPIRHFELFVIGDSVKTLENRAQMIENWYQSGGVLLLGYEMFRLLVHQCELLGEKSAQRKKASKKQPLRTMYDLADDLGKTNEQEKAQMTQKDELQRNIRQALLSPGPDLVICDEGHRIKNLNTEVSCALSAINT

SEQ ID NO: 136285 - protein, 26 aa, Heterodera glycines
  Coding regions on vcDNA: vcDNA=SeqID_62708; Strand=+; Position=1 -29,507-558
MSLFYQGKISAKLFLFFISKKTLKHN

SEQ ID NO: 136286 - protein, 151 aa, Heterodera glycines
  Coding regions on vcDNA: vcDNA=SeqID_62709; Strand=+; Position=1 -38,229-448,529-597,630-758
METRHAYPLPCDLRFARFPREERERYRLHKNFIFEGTCCLVVFDHNVFSTDRNGEHKLMERTNDLVVCNRWVRRCQIVGQSNGMAMVQCVDYPYIGLVDLKNIFQVTIKIPPSLLGIYQTGVYAVLKDCQMASQIEVARHLSQFLFTTVIC

SEQ ID NO: 136287 - protein, 19 aa, Heterodera glycines
  Coding regions on vcDNA: vcDNA=SeqID_62710; Strand=+; Position=1-60
AEIDPNGCHNRVQQPQNPL

SEQ ID NO: 136288 - protein, 215 aa, Heterodera glycines
  Coding regions on vcDNA: vcDNA=SeqID_62711; Strand=-; Position=1 -57,117-399,578-885
MNRGPLASVSDPVSPAFRNCFLFLYSPTISNVTCIQLINCSASPNEVVDAAHRRHAAHNDPDPHPFQLESAHVQTGNALPQQTVSVESTQPVASQKMEKIPRLSSEVLNAFIKTDFTPFFDYTSDIWMDSIKEKEKEEELEEGDKENAPIGGCAKLAQTKCAKGGRRRQIYEKDVQRVILADKKMREKKKRKERKKRRKLLSNLWGKRKVKIKIN

SEQ ID NO: 136289 - protein, 90 aa, Heterodera glycines
  Coding regions on vcDNA: vcDNA=SeqID_62712; Strand=-; Position=1-273
MRFCCRRSRRSGGRVNGKSQRYSDKMQKAKQKKQKQKDKLRRLKTQRAQGHIDDEQYREKKKNYKQKKDKQKLKARKNKRKLNNGHQQMW

SEQ ID NO: 136290 - protein, 174 aa, Heterodera glycines
  Coding regions on vcDNA: vcDNA=SeqID_62713; Strand=+; Position=1 -109,153-447,489-609
  Homolog annotation: Hit_ID=EAA45732.2; Match level="QueryCoverage =51%, HitCoverage=17%, E-value=5e-10, Identity=38%"; Hit description =ENSANGP00000025171 [Anopheles gambiae str. PEST]
MDDNFDVNNFGQVESGIDRTFADQELSPSSNESIEKYDIWAQRKSPCGISIPSTISGDPDSDFLSKIEAELACFKAGQRMEVNGDLFSWWNENTGRLPELSKLARMVHSIPATSVSSERLFSKAGLIFANSLRNRLSGNTVRQILIVKANLDALLLAPTNEYESDEESKEKDDF

SEQ ID NO: 136291 - protein, 256 aa, Heterodera glycines
  Coding regions on vcDNA: vcDNA=SeqID_62714; Strand=+; Position=1 -48,198-326,396-540,585-715,923-1048,1094-1170,1219-1255
  Homolog annotation: Hit_ID=AAG45917.1; Match level="QueryCoverage =100%, HitCoverage=24%, E-value=1e-112, Identity=82%"; Hit description=guanylyl cyclase [Heterodera glycines]
DGRDADAETIGRLAFRWHYDITLSALSNRNYLGFFGRVINRTRGWPFYCPESDCGNVANGSIYSLLLYDAIYNYGMALNESFRQFGIRPEVYRNGTLLAQNNRKPFMGLTGFVTVETSQNTRVLTGFVTVETSQNTRVFVLSNRKSSDKGNALRILMQFAWVEGKLQISLRNGSLSMWSSRGGSIPPAVPICGFDGKGCAASVFEMYKGYLLLGGYLLLGIALFVVTISGSTFTVGFLIHAKFVAKFVEGRRSNMS

SEQ ID NO: 136292 - protein, 15 aa, Heterodera glycines
  Coding regions on vcDNA: vcDNA=SeqID_62715; Strand=+; Position=1-46
MWGGYGGGYYDGYGY

SEQ ID NO: 136293 - protein, 92 aa, Heterodera glycines
  Coding regions on vcDNA: vcDNA=SeqID_62716; Strand=-; Position=1 -75,1011-1214
  Homolog annotation: Hit_ID=NP_493910.2; Match level="QueryCoverage =68%, HitCoverage=10%, E-value=8e-16, Identity=57%"; Hit description =sodium:neurotransmitter symporter family member (67.4 kD) (snf-3) [Caenorhabditis elegans] gb|AAB71293.2|
MPMEHRALHFYLWCFSKWLAWRGDSILFICCLVMYEPLRYPTGVDYPFWAEAFGFFLSACSMVVIPGYALYYMCCAGQDGDRRLSPLQVIKN

SEQ ID NO: 136294 - protein, 193 aa, Heterodera glycines
  Coding regions on vcDNA: vcDNA=SeqID_62717; Strand=-; Position=1 -106,792-839,890-934,1256-1366,1420-1555,1814-1946
  Homolog annotation: Hit_ID=CAE62990.1; Match level="QueryCoverage =90%, HitCoverage=37%, E-value=1e-58, Identity=51%"; Hit description =Hypothetical protein CBG07219 [Caenorhabditis briggsae]
MPIKWFTKNRKAINEEISSTDGKENTAALEGKHDKGQFDFLMSMIAYAVGLGNVWRFPYLCFKNGGGVGIGNVMIAFMCISYFCVIVSWAVFYMISSFNSTFPWETCHNWWNNGQCVTGKETHSEIMRIASNLSRYGMSIESSVEQFWERRVLKQTPSIDDIGGIQWELLGLMFLAWVVVYFALWKGITQARK

SEQ ID NO: 136295 - protein, 69 aa, Heterodera glycines; identical to SEQ ID NO: 130685
  Coding regions on vcDNA: vcDNA=SeqID_62718; Strand=-; Position=1-270

SEQ ID NO: 136296 - protein, 21 aa, Heterodera glycines
  Coding regions on vcDNA: vcDNA=SeqID_62719; Strand=-; Position=1-65
MDAAAYGTHRPFRSASAFSTS

SEQ ID NO: 136297 - protein, 45 aa, Heterodera glycines
  Coding regions on vcDNA: vcDNA=SeqID_62720; Strand=-; Position=1 -16,390-511
MPSLWGSPSAGGREETNNEIEEQMDDEEKGKEEEEEEGDEWEEEI

SEQ ID NO: 136298 - protein, 56 aa, Heterodera glycines
  Coding regions on vcDNA: vcDNA=SeqID_62721; Strand=+; Position=1-168
MCPCLNGASTLQSLCRVGRSESYSVIVPIKQRGIGRHIVCHLRVYLRIHTVGTCPQ

SEQ ID NO: 136299 - protein, 244 aa, Heterodera glycines
  misc_feature (14)..(14): Xaa can be any naturally occurring amino acid
  misc_feature (243)..(243): Xaa can be any naturally occurring amino acid
  Coding regions on vcDNA: vcDNA=SeqID_62722; Strand=-; Position=1 -84,128-269,318-399,518-679,756-851
  Homolog annotation: Hit_ID=NP_491634.1; Match level="QueryCoverage =89%, HitCoverage=31%, E-value=4e-32, Identity=38%"; Hit description =nuclear protein NAP (61.6 kD) (1G149) [Caenorhabditis elegans] gb|AAB37831.1| Hypothetical protein M01E11
FNKGLSTLFPLFMXTPPKMKRKDTSPEDHEEFCCSVVDALLFSCNPTNCTSPEDHEEFCCSVVDALLFSCNPTNCQRVLQKFVDHCFEKIDRAVELFLKYSEKVRRFETKMERRMASLAEKVRRFETKMERRMASLAEEEKPDTEELYLEKLNNGLYTLQRAALILAEICSKGAPGCHERVEKLFRLRLGDGSVGKQLEPILREFHRYLDSEILREFHRYLDSEADTQKQRVELLIAHFTQKXT

SEQ ID NO: 136300 - protein, 27 aa, Heterodera glycines
  Coding regions on vcDNA: vcDNA=SeqID_62723; Strand=+; Position=1 -67,673-689
MAINSKISEKECNFLGSDKPFLNLHIV

SEQ ID NO: 136301 - protein, 466 aa, Heterodera glycines
  Coding regions on vcDNA: vcDNA=SeqID_62724; Strand=-; Position=1-1401
  Homolog annotation: Hit_ID=NP_001004509.1; Match level="QueryCoverage= 99%, HitCoverage=31%, E-value=7e-54, Identity=30%"; Hit description =si:busm1-180o5.3 [Danio rerio] emb|CAD60788.1| novel protein similar to DNA polymerases [Danio rerio]
MKLLHTAKPGQKISYKDFTSLYPFTNFTTDYPLGHPKIISIPPNEQTVNWRSPSDNPYKGLLKVLLLPPNNNINVTVMPIKFDQRLLFPLCEKCAKYITAKYPNGLKDNDYSCPHFNPNDRAFVSTCTHLELNAALEAGYTVRKVFHVLQYDQWSNNVFKSYVSEMMALKIHATGFPSWCESEEEKSEYIEECWMKFGIHLEKEKMKAEPGKRYIAKLCLNSLWGRFSMRNLLSKAVINNDPCVLRQYTDDKKIDIMDIELMDEDNDVFMLTYKPKEEFVDENKYSNVVISLYTTSMARLYLYEVLKKVADTPGCEILYFDTDSIIYVHPEDNDPLPTGKGHLGELTDEKPDHDILEFISAGCKNYGLKLERKDNGEIEYDLKIRGITLDEQTVQTIHYDSVKDQIMRYGSDDPADPIIVTYPHFIRPNLIQGKVYTQSLTKHYQPVFTKGIINDSFQVLEFGYRK

SEQ ID NO: 136302 - protein, 606 aa, Heterodera glycines
  Coding regions on vcDNA: vcDNA=SeqID_62725; Strand=-; Position=1-1821
  Homolog annotation: Hit_ID=NP_507780.1; Match level="QueryCoverage =63%, HitCoverage=27%, E-value=3e-15, Identity=25%"; Hit description =predicted CDS, DNA polymerase type B, organellar and viral family member (5T899) [Caenorhabditis elegans]
MKRFSLSQNSSSSFPKKSQPNKCIRKIDNLTSKSKKYQLVRSKSKFVIEEIDKCADPAAELRSCVHHSIEEAILDGQNTLGAANKVGVIISSELLDQGDIILPITPITANVVDAVFNQFCKVEQSKSKHVNLYGAPFIITVTVLNTNGLPRQRTTKGKGRPPVSSQSHIFKVNNNDNYCLFYALELMRYYSLYKRGIITEKRWRWINNNQTTVLRQKAQQLLRDAGIPTTETEYDAEVYIHQVQGLWNVKYPGEYKIFIFNDYQMRPITKSDITDYQFPILLYHNNNHFDGIKTLSKFFNKRYYCISCESAYSHKFEHSSKCSSLCHRCREVGVDYPCDPQQGYVKNCEHCNNTFYNNNCYGRHLHKDLCTKFQRCEDCGVIYNIKVHGSVGHKCGEQFCKLCKQFHIKEDDDDGMNPCTKCFIQPLKQQRIKSYSIIAYDFEATQDKKVENRFEHEVNFAAATIICTDCIINGYWNKSLQGKKCQICGPHRSITFSPFDYTETTVDQKIITQQPLREFVEWLLFDHNKKFPTVAFAHFGGRYDMTMIIKEVLAQGIHNPDIIKQGNRLYELKIRENEHGPLTIFHDNYNLMPIKLSGLIKSLGFI

SEQ ID NO: 136303 - protein, 66 aa, Heterodera glycines
  Coding regions on vcDNA: vcDNA=SeqID_62726; Strand=-; Position=1 -68,200-332
MKLLFDSIKNSLFMVKISKNFIEYEPVMHRYNCSKTNIAGQSSTNGDLAGSHKAETNSEAKSDYKK

SEQ ID NO: 136304 - protein, 110 aa, Heterodera glycines
  Coding regions on vcDNA: vcDNA=SeqID_62727; Strand=-; Position=1-333
MRKRRNSSWPCHLCSLLVPISLFWFLSLFAISPPLTMALSLFPRQNVPKMLHSPFLQQHDNNNNNNNNVRGPLGYSDQLELLAHSGRMAKKCRHDCSISDPNAEKCWWLF

SEQ ID NO: 136305 - protein, 23 aa, Heterodera glycines
  Coding regions on vcDNA: vcDNA=SeqID_62728; Strand=-; Position=1-71
MEGTIAGANQNNDQTSDGRTAPK

SEQ ID NO: 136306 - protein, 184 aa, Heterodera glycines
  Coding regions on vcDNA: vcDNA=SeqID_62729; Strand=-; Position=1 -103,174-319,485-636,720-873
MKSLLWPFLCLFSFFSLNIFPFISSASLANKIGEDSHHNSSCSTKVQQKCQCGKHFRNLTTTRMIAGKTYDTLVPLGDGMDGKVEHAFSQSLGRCVAIKTCTEDPTRLSKCTRELKVLERMRDMAPHIVRLENYETKSGQPCTEGAVMSDFIRTVLIGSEKRRKRRNVGEESEKKRINIMEKEK

SEQ ID NO: 136307 - protein, 105 aa, Heterodera glycines
  Coding regions on vcDNA: vcDNA=SeqID_62730; Strand=+; Position=1-320
  Homolog annotation: Hit_ID=EAL35225.1; Match level="QueryCoverage =100%, HitCoverage=41%, E-value=3e-25, Identity=49%"; Hit description= hypothetical protein Chro.30409 [Cryptosporidium hominis]
ISERRSPSKRREKRRKRGRTEEEEEEEEDEDEMDEKEGKEKEEEDEDEEGDEKEGEEEGKEKEEEDEEEEEEGEEKEGEEEGKEKEEEDEEEEEDEEEGEGTYDE

SEQ ID NO: 136308 - protein, 164 aa, Heterodera glycines
  Coding regions on vcDNA: vcDNA=SeqID_62731; Strand=+; Position=1 -13,366-490,634-916,986-1059
MQWQKKNLTVFHERIKFIGEMKQIWTIYSENFWFNEKTIRAKIEHLDIDMLWGNGPEDTALFRALFICIGESFTECAEKGGQKSAEHLEEFSATEQLKAINCVAKIVKRKARKDEIVAKLHLEKMEEIIGGEFKEKLKKNTKELAKLLDGNGINKMKELLTEAY

SEQ ID NO: 136309 - protein, 41 aa, Heterodera glycines
  Coding regions on vcDNA: vcDNA=SeqID_62732; Strand=+; Position=1 -48,355-432
MPNCHFFTFFVIVAPKVLPEEVRHAVCLKSNEFLFSQFIGN

SEQ ID NO: 136310 - protein, 85 aa, Heterodera glycines
  Coding regions on vcDNA: vcDNA=SeqID_62733; Strand=+; Position=1 -55,375-574
MLKLNLNEKIKNSNMKAASAPQLNPNAEMPPQDEAGPSTSAASAEEAMEPPPPTPAPVPTPEMDEEILEFGFSLPSTSVTPIGDL

SEQ ID NO: 136311 - protein, 37 aa, Heterodera glycines
  Coding regions on vcDNA: vcDNA=SeqID_62734; Strand=-; Position=1-113
MAFSLMNTIIFGGNGINLSKCPPKEETASANLPKEQK

SEQ ID NO: 136312 - protein, 49 aa, Heterodera glycines
  Coding regions on vcDNA: vcDNA=SeqID_62735; Strand=-; Position=1 -110,199-238
MVAFFLAYQNFIEPGSFYSLSNCPKFFLQPRGREAAENCSETHQNLFTS

SEQ ID NO: 136313 - protein, 49 aa, Heterodera glycines; identical to SEQ ID NO: 130195
  Coding regions on vcDNA: vcDNA=SeqID_62736; Strand=-; Position=1 -110,199-238

SEQ ID NO: 136314 - protein, 145 aa, Heterodera glycines
  Coding regions on vcDNA: vcDNA=SeqID_62737; Strand=-; Position=1 -159,630-906
MVCREEWHRQLDGARLPPFLYQQIGRFAGALITSLSAPGGSSSADLLGTERVRQLLDPLMATTAQLEQLTTESCAELGLPECLVHGNPIGRNVFFDLTIAEQQQHQAVVAAAVNHSTDDDGIKQQQQQAKGGGGGTTVRALIDWT

SEQ ID NO: 136315 - protein, 239 aa, Heterodera glycines
  Coding regions on vcDNA: vcDNA=SeqID_62738; Strand=-; Position=1 -289,336-476,993-1105,1194-1370
  Homolog annotation: Hit_ID=CAF92976.1; Match level="QueryCoverage =91%, HitCoverage=43%, E-value=7e-17, Identity=32%"; Hit description =unnamed protein product [Tetraodon nigroviridis]
MSISLADRMKLLLTNGDGADIQFLVGQGEEKEARIGKKSRNSLNFLNFSFIRPSKVSQIVNIVVFKVLKAHKLILMAASDVFKAMFRFDAQNAKTKTSSSAEQLQSVEITDIDANVFKVMLSFIYAEDSSGLTGDNLIAVLYAAKKYHISLLAKACADFPLENELPNVFLAFDQAQLLDEKDFAIRCLDYINRKAETLFGSEEFLQIGQNLLSKIFASDQLKISGEIALWKAVIIIMFK

SEQ ID NO: 136316 - protein, 61 aa, Heterodera glycines
  Coding regions on vcDNA: vcDNA=SeqID_62739; Strand=+; Position=1 -105,305-385
MFLKVNMPMNFRVSQKAKQEMNSRTVSHAILSLLNIKITLNLLFFSPKLLKMIMGGGKYNI

SEQ ID NO: 136317 - protein, 34 aa, Heterodera glycines
  Coding regions on vcDNA: vcDNA=SeqID_62740; Strand=+; Position=1-105
RPFGVLKQLWGAKIPRRIKVQAIGKLFPKDSVSP

SEQ ID NO: 136318 - protein, 137 aa, Heterodera glycines
  Coding regions on vcDNA: vcDNA=SeqID_62741; Strand=+; Position=1 -132,280-354,523-729
MVQLTRNKSLTSGGGDDGKNGLLRGVCFELIKFVHDSTQGFGQAALEIDTEKVQGIVRDFLRGSPVKIEFILSGTHDIIGAGRLFKRQICKELEDGIVTREGIAKGVRVIDNNGEPKAALFADGLLCILLVECLRIA

SEQ ID NO: 136319 - protein, 51 aa, Heterodera glycines
  Coding regions on vcDNA: vcDNA=SeqID_62742; Strand=+; Position=1-154
MENQLISQLQGYIRNRSQIRNNQVCNQERSGSDSNVRIFQGCSYRHRVQQL

SEQ ID NO: 136320 - protein, 36 aa, Heterodera glycines
  Coding regions on vcDNA: vcDNA=SeqID_62743; Strand=-; Position=1 -70,704-744
MALIWSKLNKDITDAPSVDSFKKVYFGVPDHHEGVI

SEQ ID NO: 136321 - protein, 76 aa, Heterodera glycines
  Coding regions on vcDNA: vcDNA=SeqID_62744; Strand=+; Position=1 -61,123-196,660-753
MRYIICREMKNPTEAKNLLSRVSEYLQQHHNFGPTPPLDVSFPNYLNENVTFAARLVTQFAAQPTTTVEQMRNIGI

SEQ ID NO: 136322 - protein, 47 aa, Heterodera glycines
  Coding regions on vcDNA: vcDNA=SeqID_62745; Strand=-; Position=1 -48,772-867
MPPIHDQSRIEWCQCKANRKHIDLSNDIIEVGPGREFPVIRGPGPGF

SEQ ID NO: 136323 - protein, 117 aa, Heterodera glycines
  Coding regions on vcDNA: vcDNA=SeqID_62746; Strand=+; Position=1-354
MSGYLRTKIAIELKALEKAKTATELYAEPDQTLTSLENAILLESAAERIKSEVEAVNAKIEQIWITASKWHDVIQKMDKDERKSEQTAYEQFQTTEKLNTKMEAANTKLTELKDLWR

SEQ ID NO: 136324 - protein, 106 aa, Heterodera glycines
  Coding regions on vcDNA: vcDNA=SeqID_62747; Strand=+; Position=1-318
MSKSNAEADKGNSRARGNEMTAALYQLPTLRIKPFGGDKREWPMFEEAFKVAVDQKPGSKTEKLNLLKSLVEREAALLIGGLRLEEKNYEIAMKLLKDTYGDKGEY

SEQ ID NO: 136325 - protein, 500 aa, Heterodera glycines
  Coding regions on vcDNA: vcDNA=SeqID_62748; Strand=-; Position=1-1501
  Homolog annotation: Hit_ID=NP_507780.1; Match level="QueryCoverage =97%, HitCoverage=34%, E-value=1e-41, Identity=27%"; Hit description =predicted CDS, DNA polymerase type B, organellar and viral family member (5T899) [Caenorhabditis elegans]
MSRHNKSCKAHCVMCSRVGPQFPCQPTDGFVKECSKCYKRFRNYDCYQHHLHSNFCMRSKMCKDCGAVWDVADNKRNDRKGHVCGENYCGLCNNYHNTERGCYIQPIEPKQHTPYRIVAFDVETMQHMFIGESEQRNHLPNFIAAKLICPGCIENGDWQRGTKGCEVCGPNRTVAFCQRFTETTVDKQVVADNPLEEFVDWLVFQLPLKYDTYVYSHFGGRFDMVLVFRELFRRGFNPSMLRKGNKLYEMKVGNQKKRNPNVVFRDSYNLMPCALAELVPSFGLDVEDKPFFPHMANQPDNYGKQIYPTPEDYLADGMMPDKRQKFNVWYEQHQHKPFLLDEALASYCTNDVEILTAALVAFRMEFFDVSRREEGFVAERAHEGIDVLRECMTIAGACMKHFRINHLPAEHLAIVPERGYDNAQNQSRLARRFLQWYTEEHNVEVRMANSPRGEKKFGQYSVDGWVEAERKAIEVNGCVWHACSECYPDDNMMDANGKTA

SEQ ID NO: 136326 - protein, 327 aa, Heterodera glycines
  Coding regions on vcDNA: vcDNA=SeqID_62749; Strand=-; Position=1-982
MENRSPKRPSNSPFVELLPKKPRQDLVINQILGVVQQGGGETSPSKEAPKDYVQKLGSSVEHVAKFHYTKMKSRFSISDVPSNPERLLAGIFQHCIDSATKDSRERGIEPTHLGCLISSPLLSEGAITIPTRKISDNTIDTILNLFLKVAQSKQQKNVSLWGDPFTVTITTVDRSGLQFKRRVKGGTRRKIAAVHHRINDQCLIKIRNNDNHFCLFYALQATMVDKTCNWPRWKFFDYVNDRHGQQGQLHHDAVELMQQVKAPMDLDGYDADTFVPHVVDYWNNAQRQHRFAVFIFGSLGQYKPLYKYIDNTYDTPLLLYFNEDHFD

SEQ ID NO: 136327 - protein, 31 aa, Heterodera glycines
  Coding regions on vcDNA: vcDNA=SeqID_62750; Strand=-; Position=1-121
NRSLSGTTTQKNEFPSAVSLVIYQNTTHSKI

SEQ ID NO: 136328 - protein, 34 aa, Heterodera glycines
  Coding regions on vcDNA: vcDNA=SeqID_62751; Strand=+; Position=1-104
MVIDSQINKHIMSDQKQLFLFGQTLPGNQSGLLE

SEQ ID NO: 136329 - protein, 301 aa, Heterodera glycines
  Coding regions on vcDNA: vcDNA=SeqID_62752; Strand=-; Position=1-903
  Homolog annotation: Hit_ID=NP_502797.1; Match level="QueryCoverage =97%, HitCoverage=81%, E-value=5e-43, Identity=33%"; Hit description =HASI (4P602) [Caenorhabditis elegans] emb|CAB16520.1| Hypothetical protein Y57G11C.19 [Caenorhabditis ele
MIHHPQRHFAGVTALWKEARKKIKHLRKKDVQHYLEGHRTYTLMRPRRVHFPRARTVAAGFMTDVQVDLVDFQALSRHNRGHRYLLVAVDVLSKRLFVVPLKNKRAEEMLEAFKQLIDQMPMVPHRIFSDKGTEFKNRLLREFFEEQEIEKHEPVHSFVKASVAERAIRNVKQRLYRYFAEKETLNWVDTVQQIVDGINSSPSRVHGMRPIDVNFSNAQRVWKRLYGHPALQRRTPRFHNDQFVRMSREKGQFEKGYLPNYGDEILEIDEVLKAVRPIRYKLRDEHGEKFKGSFYEQELAR

SEQ ID NO: 136330 - protein, 116 aa, Heterodera glycines
  Coding regions on vcDNA: vcDNA=SeqID_62753; Strand=+; Position=1 -158,352-520,611-634
  Homolog annotation: Hit_ID=NP_495694.1; Match level="QueryCoverage =97%, HitCoverage=14%, E-value=1e-33, Identity=57%"; Hit description =glycerophosphoryl diester phosphodiesterase (2I358) [Caenorhabditis elegans] emb|CAA87796.1| Hypothetical
VKYPQLQVDQTNECDVYFERNEFVDIILSNVLSNAGRRRIVFSSFDADICTMLSVKQKKYPVLFLCLGDSSRHVQYADERTRLPMSAVKFAHAIGIVGVNFNTEDLMKDASPVANR

SEQ ID NO: 136331 - protein, 92 aa, Heterodera glycines; identical to SEQ ID NO: 125147
  Coding regions on vcDNA: vcDNA=SeqID_62754; Strand=-; Position=1-304

SEQ ID NO: 136332 - protein, 33 aa, Heterodera glycines
  Coding regions on vcDNA: vcDNA=SeqID_62755; Strand=-; Position=1-101
WLSLFLINFIHIQMLSSMIGRAVRNRPFIFEGI

SEQ ID NO: 136333 - protein, 581 aa, Heterodera glycines
  Coding regions on vcDNA: vcDNA=SeqID_62756; Strand=-; Position=1 -1654,1723-1812
  Homolog annotation: Hit_ID=XP_320889.1; Match level="QueryCoverage =91%, HitCoverage=63%, E-value=3e-77, Identity=32%"; Hit description =ENSANGP00000012033 [Anopheles gambiae] ref|XP_313651.1| ENSANGP00000013044 [Anopheles gambiae] ref|XP_314
MGEAEYKRYCDSIAPKTQNDFNWDETTAKLKHLFGETRSLFLRRFDCFQIRQDAHQDVQSLIALINSSCENADLSLSKEELKCMILIIALRDEFTDLRQKCLQRLEDSRTSGRSTSLQELGEECRKYQILKESALSLGSNPCSTSAIRAKPQQIRDKQKPKTKPQQSHKGQNFLPKNSTAPKGKVDQRDQPCYSCGGKSHWQKDCWFKNSTCEKCGRNGHIAKACKSGTEIRRVRAVATDSVKDTHIHTVSIKLKCMAIEGSSNKWWEVIIQINGMDHPMNVDTAAQITVIKTDSWQKLGKPKLGKTAITVRNCNEKAFPIEGKFKCQVLYKGRTASLIAYVSDEIHQDLLGMPWIEELEIIPKELMFPNSSQIVNSLPTKPISSQISDEKSLISALQTNYANTFGPELGHCTKFRAHLILKKEAKPVYCKARPVPHGALDEVNAEIDRLSKIGAIKPIEFSHWAAPILAVKKKSGKTRVCIDFSTGLNDAIELHRHPLPRPEDIYNAVGGAKFFSRVDLRDAYLQLELSEARKIFACSTRTEACFSASVCRAFVYLDDVVIANKSLTDHTSTIFAVFDKI

SEQ ID NO: 136334 - protein, 137 aa, Heterodera glycines
  Coding regions on vcDNA: vcDNA=SeqID_62757; Strand=+; Position=1 -64,159-278,831-1060
  Homolog annotation: Hit_ID=CAE63485.1; Match level="QueryCoverage =58%, HitCoverage=13%, E-value=8e-16, Identity=56%"; Hit description =Hypothetical protein CBG07953 [Caenorhabditis briggsae]
MNYQQQQPQFFSSYPTENSGDINWAQLAQRWIQTQHSQQQSFPPQPPPPPPPPPSRLPYSQDTQMRKKLPAWILEGLEKAEREKQKKIEKEEYEKKRKEMEEEKQKQREAKGIGKFVYFYLKDIPSGGIFLYPFMEY

SEQ ID NO: 136335 - protein, 382 aa, Heterodera glycines
  Coding regions on vcDNA: vcDNA=SeqID_62758; Strand=+; Position=1 -122,170-255,348-505,555-1134,1348-1548
LKLATVESVMAELPFSVLDRLFFVGVPIVDAEVRERFRRLWYDRPYWKSSGNFEGEEQNEEPKMPNEKNVVVDTLPMFLNVPQPVLHEPVGRASIRYQQHQMPMPSFTSADMPHFPPPSPVANFAQLTVPTSVTIDEHYNVAAPPAAQRSRGLCAECNGIPDAMASLSNIMGSHLAGPLMPKANAIENSADADQKNENDQRTEVAELAQHHQLKHGNAAERSPIFKMPTFGKGKRADQRNEQDGSGSEHMVHLQHQLNKHVDRVQHLGTTPFGGGENAADGGRRGTQIRVPSFVPESNGSVQQPAAPITGEETGNVILSVPSSSEAKPSHNKNDDVMVKSNGDEKLEQSEEEEEKRQQIGTKIGKRELLTIDGEQQRGQLST

SEQ ID NO: 136336 - protein, 18 aa, Heterodera glycines
  Coding regions on vcDNA: vcDNA=SeqID_62759; Strand=+; Position=1-56
YREAIPEGFGLPINLGAS

SEQ ID NO: 136337 - protein, 95 aa, Heterodera glycines
  Coding regions on vcDNA: vcDNA=SeqID_62760; Strand=-; Position=1-661
LFEYPKRTLEKIDFFVFGAVPPNRCAQIYGETESFGSSFPIACTLILRWIFAPHNCLSTPNGHLKKSIFLFSGQSPRTDAPRFMGRPNPSGVASL

SEQ ID NO: 136338 - protein, 95 aa, Heterodera glycines; identical to SEQ ID NO: 124813
  Coding regions on vcDNA: vcDNA=SeqID_62761; Strand=+; Position=1-444

SEQ ID NO: 136339 - protein, 49 aa, Heterodera glycines
  Coding regions on vcDNA: vcDNA=SeqID_62762; Strand=+; Position=1-407
LNLKKCQRLLFLKFFEILTFSLIIYYFAKLIHKYFFRTCSETHQMLFKS

SEQ ID NO: 136340 - protein, 225 aa, Heterodera glycines
  Coding regions on vcDNA: vcDNA=SeqID_62763; Strand=+; Position=1-678
MRHAMRMFLVPEDVFQSVFVQPQAATAAADGADGTPIGLLRSRIQQIERSRELNEEQKAAQYHQEFKRLNKLVREQEEQPINVRLQHEKEREKNAATPPPPQTIDHSTPKRLEKNIVPSAFGLRRQRHHYTQKAGALSNRRPAQKQQRKAAAAAETPNSSGNGETEKEEGDVDDGEQWDDAQSSSSTASTGGVAPKRMLRARDGEAGKGGGGETADRLQQNTTTR

SEQ ID NO: 136341 - protein, 41 aa, Heterodera glycines; identical to SEQ ID NO: 133620
  Coding regions on vcDNA: vcDNA=SeqID_62764; Strand=-; Position=1-336

SEQ ID NO: 136342 - protein, 199 aa, Heterodera glycines
  Coding regions on vcDNA: vcDNA=SeqID_62765; Strand=-; Position=1 -168,374-550,803-1054
MPNIRRHIYAHHPAAREALDKRSLVKMISRKKPKRNDITSGIAGVLESPSARHQTRIVFATPDDVFALLEHLSVRISSSSPSSSPPSPPALFDAVVLEDVAALKSAEDWRSFLPLSTVFILDQQYRSNMNAQIWSGRAFYAPLYKELDLARPVAHAQQELRLNHLMDRLVLDERTVNTDTLTLVDTGALEGHWTETMFK

SEQ ID NO: 136343 - protein, 131 aa, Heterodera glycines
  Coding regions on vcDNA: vcDNA=SeqID_62766; Strand=-; Position=1 -185,644-785,1134-1201
QQSAQATTPQVPCNPSLCSVEKFAVKVCPRTCGRCVDYLRSMEQTKYCDDTENVDNCMMLKESGLCASADAAEMCALTCNDPANNQLCEQYTRKVSAAVTAMTGQPGGAAARVNGDLSDDCPSNKNLCNNE

SEQ ID NO: 136344 - protein, 92 aa, Heterodera glycines
  Coding regions on vcDNA: vcDNA=SeqID_62767; Strand=+; Position=1 -180,316-414
MSAHQSLLDKLSDQQQNKKAAPSPSSPERKVSPNAFPKMEIEMAKTLCTLPTNVRDEMAEPNVKEEESKQTKSEGMEVVKLGECERDDGICR

SEQ ID NO: 136345 - protein, 430 aa, Heterodera glycines
  misc_feature (21)..(21): Xaa can be any naturally occurring amino acid
  Coding regions on vcDNA: vcDNA=SeqID_62768; Strand=-; Position=1-1309
  Homolog annotation: Hit_ID=NP_917837.1; Match level="QueryCoverage =96%, HitCoverage=20%, E-value=3e-77, Identity=39%"; Hit description =B1158C05.18 [Oryza sativa (japonica cultivar-group)]
KKELTALNKYLMNEEQKRNFXLRKNVDHPEKNKGNCYIDGPGGTGKSFVQIALFHLARGFGKKVTNMAFSGIAATLLNGRTVHNRFKLPLDLNSNSYSSIENGSNEAIEIRNTDVFIFDEAPMAPKYVIEIIDKKLRELHNNDIIFGGKILILSGDFRQCLPIKNKATKEEILDLCLQKSDLWIHFKVFHLNQNIRTNSEALNFSEQLLEIGNGKRNEQNYIFLPEVCDIKEKDLIEEIFGEIINTKEFSKLCSHCILAPYNREINIYNEQILEKFQGEEYVFKSIDEAESKEAPILPEILNKLQTNSLPDHELKLKINCVTKLIRNLNVNMGLCNGTRLQILDIEKNVLRVMILTGDRTGEIDFIPRITLEDKKLPYVLKRHQYPLKLAFCMTINGAQGQTFEKVGIDLTRDVFSHGQLYVALSRTRSW

SEQ ID NO: 136346 - protein, 26 aa, Heterodera glycines
  Coding regions on vcDNA: vcDNA=SeqID_62769; Strand=+; Position=1-80
MVTNIFNAIKNFFFVPHSLTNICLMH

SEQ ID NO: 136347 - protein, 1022 aa, Heterodera glycines
  Coding regions on vcDNA: vcDNA=SeqID_62770; Strand=-; Position=1-3067
  Homolog annotation: Hit_ID=NP_494149.1; Match level="QueryCoverage =94%, HitCoverage=64%, E-value=1e-159, Identity=34%"; Hit description= predicted CDS, putative protein of ancient origin (2C297) [Caenorhabditis elegans] gb|AAF39854.1| Hypoth
MVRTKQLFPSELQCSSSSLQNNSSEISENQTGSKLPSKKAVKPVQSSGKKRTRTMFDSFERMHMNEKKNIGNEMNLENVINLDMIDFEEVKESDEIERKRKKIGKDMNLESVINLDMIDLDGVNETTQTQKSQPNTKRIPTGFLFKSAAELNNVKKFSLQEFNIECIFCKAVHFIEEQSIKNSKVNEFHSCCNFGKSKNLLELFDEYPFELKQLFTEENETSKNFTNNIRKYNNSFACASLACNRFGFTTPGPSCFKISGQVYHKYNAVAQPTEQKFLPTNGQLYFLDNDDAQNIRLHSHNLNINILDKIELILRKIYPFAKAYEMMKNVIDEQNKSTVRNKNEKQEVKMLMSLRNGFDPNRYNVQQSNEVAAIIVANASDEIPAANIIVVEKGSKQMKNIYPLDPNVEPLIYPLLYPLGTKGWNFDIKDQKGKKISFCDFIKFKLFYRENFFLPHHFAKRLFQQWVVDQAARVEWDRLNFIKTHQKELRACSYKGLEDYLFNKSEQTGAVIGKQVILPSSFLGGPRNKDQNYIDSMAIVGENGKPDLFLTYTINPEDSDIKKCLLKNQKAEDRPDIVARIFKLKSDKLIEEVVKGEIFGKVVAYSWVIEFQKRGLPHLHFLITLHPKDKFKNTNDIDQFIRADLPNKEQEPILRSLVRKFMLHGPCGESNKNAPCMRNEKCRFKYPKKFREETQLGEDGYALYKRPNNGDFEFVKGQRLTNQNVAPYNPYLLLRFQSHINVEICSEINAVKYLYKYIYKGYDAATVECVKEEPNGEKTFLKYDEVGQYLEARYLSPVEACFRLLKFELQGKSHSIERLEVHLENEQTIYFDHDANNDNIEEAMEKDSKLTAYFIFLKKIQLLQNSNTLKCQHIALLTKKNRKWKWPRKGPHKVIGRIYTINPKNKELYYLRYLLIHKHATGFEDLKTEYTSYSDACLALGLTRDDLEWDKCLNEASQFKFPRGLRSLFANILINCEPKKPGLLWDKYKDALSYDLKKLHSENTAYQMALSLIDKNLLDHGK

SEQ ID NO: 136348 - protein, 138 aa, Heterodera glycines
  Coding regions on vcDNA: vcDNA=SeqID_62771; Strand=-; Position=1 -45,122-338,906-1060
LDELRPTEAYMSIKLKADDPLAGVWWNLYINEKNAKRISERFNKNILKKHPEIFRKFPMQVFYGRQFSHCYSKFMIAWAAGKLKECPGPHHCEIQPIAGLNCTISKRIFVPHKLSHGVTLYVAPNEGVFQLSTTGCTF

SEQ ID NO: 136349 - protein, 88 aa, Heterodera glycines
  misc_feature (4)..(4): Xaa can be any naturally occurring amino acid
  Coding regions on vcDNA: vcDNA=SeqID_62772; Strand=-; Position=1 -98,474-527,654-767
  Homolog annotation: Hit_ID=AAB95119.1; Match level="QueryCoverage =94%, HitCoverage=15%, E-value=2e-25, Identity=67%"; Hit description =voltage-dependent potassium channel alpha subunit [Caenorhabditis elegans]
SMEXCKFPRAKNSSPKQCHRRGGGKCRTSKIEMDERVVLNVGGIRHETYQATLKKIPATRLSRLTPAQSNYDPMLNEYFFDRHPAVFE

SEQ ID NO: 136350 - protein, 44 aa, Heterodera glycines
  Coding regions on vcDNA: vcDNA=SeqID_62773; Strand=-; Position=1-136
LVEVVSRRFGPARRASVPMACNLLAVCTKIVNTAVAANTAPNGG

SEQ ID NO: 136351 - protein, 53 aa, Heterodera glycines
  Coding regions on vcDNA: vcDNA=SeqID_62774; Strand=+; Position=1 -26,101-236
MLPPVVFYCTFVLGYCVPLVLIIYFNSRLIRKLYRHTKCDVEIIELFLFLKQI

SEQ ID NO: 136352 - protein, 230 aa, Heterodera glycines
  Coding regions on vcDNA: vcDNA=SeqID_62775; Strand=-; Position=1 -324,718-971,1250-1362
  Homolog annotation: Hit_ID=NP_510849.1; Match level="QueryCoverage =31%, HitCoverage=6%, E-value=1e-09, Identity=39%"; Hit description =predicted CDS, zn-finger, CCHC type and RNA-directed DNA polymerase and Integrase, catalytic domain contai
MVHSHNQKVGRGVKSDPNCQRQCFVTRFHEISNKCHPNSPSTVAINKTQDQIAVQQNYSAQQKPVTGWKANRGQPFQPCGSSGGTDHWRSDCRFRETTCHKCLKQGHICQRLPFGVKSAQICAGIPGAFAYLDDGIIASKTLEERFSAIHQFFTRFKAYGLRIQLEKCKFLQTELPLRSFLGALTYYSRSSKSHKLIIFPSLPPTQKDESLQKVIKFTKEGWSPNKQPLQ

SEQ ID NO: 136353 - protein, 23 aa, Heterodera glycines
  Coding regions on vcDNA: vcDNA=SeqID_62776; Strand=-; Position=1-108
PIMTSESKNFNAEMRFLSSFLQI

SEQ ID NO: 136354 - protein, 206 aa, Heterodera glycines
  Coding regions on vcDNA: vcDNA=SeqID_62777; Strand=-; Position=1 -103,454-680,999-1086,1150-1353
SDMEQPCAEGCCTSIFGFWHQMSLTSDTAKLAKEKRTPFSMADDDGLDSSGHSSSSASAGFIPKVQHGGGGGTVGTAAAAAQASASSTGVAPVHPLTVTYMKASWTIDNRDICLVIAEDVQKAHIFYKILNNEALKMFKFGDGGFSSSTQCSSRTGGSGGLSANSNSNNQQHRHAYASSTQRAAGKKHSTSAAAVRKMTANNNTEV

SEQ ID NO: 136355 - protein, 49 aa, Heterodera glycines
  Coding regions on vcDNA: vcDNA=SeqID_62778; Strand=-; Position=1-531
LNLKKCQRLLFLKFFEILTFSLLIYYFAKLIHKYFFRKCSETHQMLIKS

SEQ ID NO: 136356 - protein, 31 aa, Heterodera glycines
  Coding regions on vcDNA: vcDNA=SeqID_62779; Strand=-; Position=1-160
HKYFLERALKRTKCYLKVKQGSLMLFLSKGR

SEQ ID NO: 136357 - protein, 115 aa, Heterodera glycines
  Coding regions on vcDNA: vcDNA=SeqID_62780; Strand=-; Position=1 -158,593-779
  Homolog annotation: Hit_ID=NP_492127.1; Match level="QueryCoverage =99%, HitCoverage=2%, E-value=3e-50, Identity=79%"; Hit description =EGF motif related, Low-density lipoprotein Receptor Related (lrp-1) [Caenorhabditis elegans] emb|CAA98124.
MDYLLFSSNKVVRAIYPEIMQNALAEAILPISPSSQRRIGYFFAVECDVHGGSFFYADIMDNTLYRVKPDGEGAAPILVTHNDGLVSMAFDWMSKQLYYVDNVRNSLEVVKVEEQ

SEQ ID NO: 136358 - protein, 92 aa, Heterodera glycines; identical to SEQ ID NO: 125147
  Coding regions on vcDNA: vcDNA=SeqID_62781; Strand=+; Position=1-304

SEQ ID NO: 136359 - protein, 60 aa, Heterodera glycines
  Coding regions on vcDNA: vcDNA=SeqID_62782; Strand=+; Position=1-280
EIYTSQKRLRMRRRAVHNRHFISQRIFIFRGYPRKMDISFFDKFYTHTNALEHDREGGAQ

SEQ ID NO: 136360 - protein, 209 aa, Heterodera glycines
  Coding regions on vcDNA: vcDNA=SeqID_62783; Strand=-; Position=1-630
MRHQISWSDEAVLHVLFPVLLPLLLLTGVVRSGQPISGLPDDGGFDMPERSDGAKVGHLRHAFSILEPELAQSVWSREGLKNPIRRTTTIPMNDRLDIGNTGELQPKGRFSDQRLRAITFLITHSLSAGANKPMKRRPRKAETVSEYDTLNDDFLTEYDLLNLDFSLDEPQDGKKSAKEVEVPEKEFEWEEGEKRKGEENFPPKASNEF

SEQ ID NO: 136361 - protein, 108 aa, Heterodera glycines
  Coding regions on vcDNA: vcDNA=SeqID_62784; Strand=+; Position=1 -207,256-374
  Homolog annotation: Hit_ID=AAP30770.1; Match level="QueryCoverage =69%, HitCoverage=27%, E-value=1e-28, Identity=77%"; Hit description =putative gland protein G17G01 [Heterodera glycines]
MPLFANCVKASFCCSFSYKISQQTEEGVTRGDIMEKIVNFKLMQFVLTLAFIWQLISMRQFCGTFADPKAFIHENISVGHCKRFTLIGKDSKTGDFGAVFDQDKWHNQ

SEQ ID NO: 136362 - protein, 87 aa, Heterodera glycines; identical to SEQ ID NO: 129152
  Coding regions on vcDNA: vcDNA=SeqID_62785; Strand=+; Position=1-736

SEQ ID NO: 136363 - protein, 282 aa, Heterodera glycines
  Coding regions on vcDNA: vcDNA=SeqID_62786; Strand=+; Position=1-849
MEKWYNLQPKVTPNKYQEGERVMVKFPGTNQRSTHKKLRWNIFGPYEITEISNSSAKVVPIDKRTAEPLSVPLERLIHAPNGIPNICTAPRGRNAYKNVINVMAILEILECGNFENVEAENLVENSNSSETMKILVAGDRMEIDEAKISWTSTCEGGEHVLCKKLLAADLDPILDKSQGIGAMTIQTPLQGLLTLFILRANIAMSASKELLKVLLKWKRTDGISKLQAILNSDPDFELIKYVEERGDAIRSGSCPRNEEVKTIWQKWTNCCAMVHGNLKMSG

SEQ ID NO: 136364 - protein, 18 aa, Heterodera glycines
  Coding regions on vcDNA: vcDNA=SeqID_62787; Strand=+; Position=1-56
HNTSALLENLEEHNTSAL

SEQ ID NO: 136365 - protein, 212 aa, Heterodera glycines
  misc_feature (62)..(62): Xaa can be any naturally occurring amino acid
  Coding regions on vcDNA: vcDNA=SeqID_62788; Strand=-; Position=1 -20,5034-5666
  Homolog annotation: Hit_ID=NP_498959.1; Match level="QueryCoverage =99%, HitCoverage=9%, E-value=7e-33, Identity=37%"; Hit description =zn-finger, CCHC type and RNA-directed DNA polymerase  and Integrase, catalytic domain containing protein (
AIKDEFKIIKIGNECTIQKYSLLNGLLYFNEANSEKFSVVPQKYRQKFDRKGHEGKMAGPFXVTKSYWPSSPKNIFWPNMRADCVKAVLECRICAHTRNPRSNTPELRPIITTEPFELVCMDILSIGMSERGNKYVLVMVDHFTKYLITAAIPNKNVESVAKAFVEQLILVFGNPKKIHSDRGGEFVNKTVAEITKTLGIERSTTAGYDPNA

SEQ ID NO: 136366 - protein, 94 aa, Heterodera glycines
  Coding regions on vcDNA: vcDNA=SeqID_62789; Strand=-; Position=1-371
FEYPKRTLEKIDFFVFGAVPPNRCAQIYGETESFRNSFPIACTLILRWIFAPHNCLSTPNGHLKKSIFLFSGQSPRTDAPRFMGRPNPSGIASL

SEQ ID NO: 136367 - protein, 98 aa, Heterodera glycines
  Coding regions on vcDNA: vcDNA=SeqID_62790; Strand=-; Position=1 -128,219-387
MVEERIKEQMFKDEKIKNDNLLRHIFKKIQKQAKDMFGHLLFENQSNETDNEKKNNAHAEILFFFMHLYNKMVKLLKGEHYGNNKNAVNTHTFLNLNY

SEQ ID NO: 136368 - protein, 102 aa, Heterodera glycines
  Coding regions on vcDNA: vcDNA=SeqID_62791; Strand=-; Position=1-309
MGTYVQRAEERSGGGGGRRNGGGQSGRGGRRTADGGRDGAAGGGAELHHQSAQGGQQGQKHLQTNGKNDGPNRAKFAHIGKSGSHPKGKPDPGFPRENSLNL

SEQ ID NO: 136369 - protein, 77 aa, Heterodera glycines
  Coding regions on vcDNA: vcDNA=SeqID_62792; Strand=+; Position=1-233
FLPLRCPRQRQALTAPPAAQPPYPTPPPVAAAIAAITARDPAVLGAVPHRVPHPGRLPRRGRRRGRPFPPPWPHCAA

SEQ ID NO: 136370 - protein, 120 aa, Heterodera glycines
  Coding regions on vcDNA: vcDNA=SeqID_62793; Strand=+; Position=1 -129,290-523
MLDLDFLDKNPGKSRSRKNPGSSRPGSRPGPGFFETHLKNQKKVFRVLPGPGPGFFFHIGPGPGFPGQKSGKIQVQEKSRLPKNDLDLDPGKIQAWIQEKSRPGSRSRPSSMFTLKYDCN

SEQ ID NO: 136371 - protein, 83 aa, Heterodera glycines
  Coding regions on vcDNA: vcDNA=SeqID_62794; Strand=-; Position=1 -141,774-883
  Homolog annotation: Hit_ID=CAA08879.1; Match level="QueryCoverage =43%, HitCoverage=4%, E-value=8e-10, Identity=86%"; Hit description =kinesin like protein 3 [Xenopus laevis]
MTQLGNAAASVSRNRPNFSSAKTPTALSSNASMASSSSNTGECVKVAEEIRDLLNRSANKRLELKERPDIGVYVKDLSSFVTK

SEQ ID NO: 136372 - protein, 318 aa, Heterodera glycines
  Coding regions on vcDNA: vcDNA=SeqID_62795; Strand=+; Position=1 -167,953-1096,1232-1271,1324-1411,1481-1524,1600-1685,1930-2057,2178 -2335,2383-2484
  Homolog annotation: Hit_ID=CAE70599.1; Match level="QueryCoverage =99%, HitCoverage=99%, E-value=1e-88, Identity=50%"; Hit description =Hypothetical protein CBG17273 [Caenorhabditis briggsae]
MLVKDAQVKPDISKPRWDQSTFSGRARHFFTVVNPLNLLASNNQLENSRKIVTDYETGNYSEDLSVDELWRAKHLYDSAFHPDTGEKVLLLGRMSARVPVVTLMSAPAVFGWQFVNQTFNAITNYSNRSGDALNNSQLLQAYLMATGGATGVALGLNRAVTKLPAIWGRLVPFAAVAFANCVNIPMMRRKEFIDGVQVVDANGVPLGQSRKLAWIAVPQVVFCRIAMVTPGMVCTPILINRLDQKQWFRARPWLSPLIQAAVCGFLLTFTIPLGCAVFPQLSPMKVAKLEPELQEQIRQKFVAKNVPVPELVYYNKGL

SEQ ID NO: 136373 - protein, 27 aa, Heterodera glycines
  Coding regions on vcDNA: vcDNA=SeqID_62796; Strand=+; Position=1-83
MPPIWGSLMPFATVAFANCVNIPVMRR

SEQ ID NO: 136374 - protein, 29 aa, Heterodera glycines
  Coding regions on vcDNA: vcDNA=SeqID_62797; Strand=+; Position=1 -66,123-146
MAISFFEKFSMQQTLSNMKRSAKNGYLFF

SEQ ID NO: 136375 - protein, 29 aa, Heterodera glycines
  Coding regions on vcDNA: vcDNA=SeqID_62798; Strand=+; Position=1 -66,123-146
MAISFFEKFSMQQTLSNMKRSAKNGYLFF

SEQ ID NO: 136376 - protein, 29 aa, Heterodera glycines
  Coding regions on vcDNA: vcDNA=SeqID_62799; Strand=+; Position=1 -66,123-146
MAISFFEKFSMQQTLSNMKRSAKNGYLFF

SEQ ID NO: 136377 - protein, 29 aa, Heterodera glycines
  Coding regions on vcDNA: vcDNA=SeqID_62800; Strand=+; Position=1 -66,123-146
MAISFFEKFSMQQTLSNMKRSAKNGYLFF

SEQ ID NO: 136378 - protein, 185 aa, Heterodera glycines
  Coding regions on vcDNA: vcDNA=SeqID_62801; Strand=+; Position=1-558
MGRKEEEKRNEEKKREIISNFYKIKEKIKEKGRTYSKKEWNKINAKIAKKLGTNRQYIAEWIKEFGLQKQIHKNYKSKTDEEKLEIVQNFIEMINEYKQKRKYTRKEWHQNYAEICKKIGVGHGTIENWKRKFGIRSKLTKNEKMEKMKIYSQIKRKNPKMSERAIAKKMKIDRTNISKWKKLFG

SEQ ID NO: 136379 - protein, 60 aa, Heterodera glycines
  Coding regions on vcDNA: vcDNA=SeqID_62802; Strand=+; Position=1-180
MTKSKSSSGTTRTKKRTADQVVKTVFRRKICLFCFMASLIVFALVLGLAITLTVITVNNW

SEQ ID NO: 136380 - protein, 46 aa, Heterodera glycines
  Coding regions on vcDNA: vcDNA=SeqID_62803; Strand=+; Position=1-138
MSTQQQQRKTRSPIVLERGVSGRVKWFDFWKGITPSIANFQFCHYV

SEQ ID NO: 136381 - protein, 121 aa, Heterodera glycines
  Coding regions on vcDNA: vcDNA=SeqID_62804; Strand=+; Position=1 -97,147-415
MSAIGDGTHSDGTQMEKSKKCKKDHDDDSVIKAENCGWEEMRCDHEIEADLTLNNRPIEDENGRTESQGQRDKGENRDSSSPAADQLRHTHSFECQQCNSQLDSFEQFISECLQRMINAWK

SEQ ID NO: 136382 - protein, 104 aa, Heterodera glycines
  Coding regions on vcDNA: vcDNA=SeqID_62805; Strand=-; Position=1 -162,256-408
MPLTNLAKVLGPTVVGTNSRLLTVQDKHQQQGTAYMTEATNQIQIMQALLSLDHAYWTEMYDGPAARLDNNGAVPVVPKHQWQTTPTSTRGAERGGHLVQSIVR

SEQ ID NO: 136383 - protein, 40 aa, Heterodera glycines
  Coding regions on vcDNA: vcDNA=SeqID_62806; Strand=+; Position=1-182
IVRSENQTRKKTERKAIGKIMRKLNVYEFTANDRMDLKLG

SEQ ID NO: 136384 - protein, 343 aa, Heterodera glycines
  Coding regions on vcDNA: vcDNA=SeqID_62807; Strand=-; Position=1 -107,152-275,439-641,737-857,1045-1177,1317-1478,1573-1752
  Homolog annotation: Hit_ID=AAH67994.1; Match level="QueryCoverage =38%, HitCoverage=23%, E-value=3e-14, Identity=36%"; Hit description =Hypothetical protein MGC69444 [Xenopus tropicalis] ref|NP _001001236.1| hypothetical protein MGC69444 [Xeno
MSESNVYEPPTSENLQQQQQQHKAAMSAKQISTLNIHFGPPRPCVGRGWTKGKPINQCVHTYVPVSNLFSAAFSCCGVHEHCCQLAPPLCVPMVPTPQRCNNRHRPTLGDLAPVLPPRIPGQIIRCVYALEQGFLDTVGLYRVPGCDSEVKKLKDQFNSKFVPKLDQTDSETITGYIKKFLRDCRAAIEGDEAQLKTFIEELPMPHRDTVIGVEDGDKLDKKAFLIFDFNAADQFGQSARPNGGGHQLAAADRAGQTPATGHRVHDGGHQSDPNHAGAAQPGPCLLDGNVRWAGCSVGQQWGSAAGGAETPMADNADVHPRGREGRTLGAVDCQMNGARKRSK

SEQ ID NO: 136385 - protein, 64 aa, Heterodera glycines
  Coding regions on vcDNA: vcDNA=SeqID_62808; Strand=+; Position=1 -98,287-383
MPPPEQRKPRMPSPRAHTPQQENAALNRLLTGTFSLVGGSYTFDSDIDRFFVRRPGTAFDGRLR

SEQ ID NO: 136386 - protein, 142 aa, Heterodera glycines
  Coding regions on vcDNA: vcDNA=SeqID_62809; Strand=-; Position=1 -18,188-325,756-1028
  Homolog annotation: Hit_ID=EAA15432.1; Match level="QueryCoverage =80%, HitCoverage=12%, E-value=4e-13, Identity=32%"; Hit description =hypothetical protein [Plasmodium yoelii yoelii]
MSDDKKSPKFYATVLDDIGSYLVRAVPLYIKKIADEPSPPADNENDTITRKRELRTSLKMHGAIQQWGGDKKVAHKFVAELGQKLETNQEEEEETDDEDEEEEEGDVELGEESDDEMEDEEEEDDDEEEEEAMDDDGEEDDE

SEQ ID NO: 136387 - protein, 18 aa, Heterodera glycines
  Coding regions on vcDNA: vcDNA=SeqID_62810; Strand=+; Position=1-56
YTEAIPEGFGLPINLGAS

SEQ ID NO: 136388 - protein, 127 aa, Heterodera glycines
  Coding regions on vcDNA: vcDNA=SeqID_62811; Strand=-; Position=1 -250,303-412,458-481
  Homolog annotation: Hit_ID=BAA91345.1; Match level="QueryCoverage =62%, HitCoverage=16%, E-value=1e-10, Identity=44%"; Hit description =unnamed protein product [Homo sapiens]
MFRFDAQNENAGNSNKNTSKQLKLIIFNIYGNYPNYFQLVSDNCPVVVVPDVEPAAFKVMLSFIYAGDLSELNGDNAMAVLYAAKKYNIPALVAPCLQIPISELRNVFLAYAQARLFDLEPNLGATT

SEQ ID NO: 136389 - protein, 125 aa, Heterodera glycines
  Coding regions on vcDNA: vcDNA=SeqID_62812; Strand=-; Position=1 -7,761-965,1005-1167
  Homolog annotation: Hit_ID=NP_001005317.1; Match level="QueryCoverage= 76%, HitCoverage=32%, E-value=1e-12, Identity=37%"; Hit description =si:busm1-173m20.16 [Danio rerio] emb|CAD59047.1| SI:dZ173M20.16 (novel transposase) [Danio rerio]
MKYVWDYFESGLAGNSILLGDSGYPLKKWLVVPFRDPKSVAEKRFNTALCKGRSVIEHAFGIFKRRFSIAKTSCRLQLKRIATSILAAAVLHNIAIEMCLPEPPAVEESNENDDLNEINEDENRN

SEQ ID NO: 136390 - protein, 101 aa, Heterodera glycines
  Coding regions on vcDNA: vcDNA=SeqID_62813; Strand=+; Position=1 -111,560-754
MTGFVTCLGLLHLIFVLKYIKDEQIRTDLYWLVFMPSLNGSRKAMCRKLMAKGKRISIRVCPLGCCLFCFDKFEPTECVWRGGGNWQKGLIRECPNLDNVC

SEQ ID NO: 136391 - protein, 49 aa, Heterodera glycines
  Coding regions on vcDNA: vcDNA=SeqID_62814; Strand=+; Position=1-150
FFASVPSRRLLPIVLVRAEVHRRFHRPPQFDPEYGRRFHAVALLGGGTM

SEQ ID NO: 136392 - protein, 118 aa, Heterodera glycines
  Coding regions on vcDNA: vcDNA=SeqID_62815; Strand=+; Position=1 -326,627-657
MLFASLLATVCFRPSRCAFFDRHRSANAIANANSLEECAVDGGAHSVASLSACGGAEDGDESRNTSVESIHCRWRNFDGDENGDEAIRGGKGQRMANEWHGKTADREQKYFCTKICSN

SEQ ID NO: 136393 - protein, 172 aa, Heterodera glycines
  Coding regions on vcDNA: vcDNA=SeqID_62816; Strand=+; Position=1 -234,446-590,981-1117
MPSSSSTLLFLLLLQFAVILRCNFVARPSSAPPDFRDARSIVRSEGEWTRRMGEEFVRHNVLPFIRQFRRQLKPPRNLQWAPGAGNLLPFGPNQRNNRNSAKWGDDESVQFTHVDLDPAEQRKYRKNHSVASLFDLGGLVARELWKQTKHRCIHCENGACELADPQCGFPYQ

SEQ ID NO: 136394 - protein, 140 aa, Heterodera glycines
  Coding regions on vcDNA: vcDNA=SeqID_62817; Strand=+; Position=1-423
MSSNGMVGYGNGGNRNFNNVGGREWDDRGREWEDGRGGRECANGGVARWRDGQRVCEGAESGRERNGKRNDRNINGDRGNQNGMDNFAYDNPYYGGGGNGLFDEGGENQRNYYDGNANAVNNFNAKAKRYEAIGEDFKGN

SEQ ID NO: 136395 - protein, 16 aa, Heterodera glycines
  Coding regions on vcDNA: vcDNA=SeqID_62818; Strand=-; Position=1-49
EAIPEGFGLPINLGAS

SEQ ID NO: 136396 - protein, 47 aa, Heterodera glycines
  Coding regions on vcDNA: vcDNA=SeqID_62819; Strand=+; Position=1 -69,320-394
MHRRCPEGTFKIFKILCENQIQKDFKGRGSEHRSHCTEHGKNVNSDF

SEQ ID NO: 136397 - protein, 97 aa, Heterodera glycines
  Coding regions on vcDNA: vcDNA=SeqID_62820; Strand=-; Position=1 -243,978-1027
  Homolog annotation: Hit_ID=CAE71617.1; Match level="QueryCoverage =97%, HitCoverage=3%, E-value=4e-31, Identity=66%"; Hit description =Hypothetical protein CBG18580 [Caenorhabditis briggsae]
GSQGVQLYHSPFAYVPLDPDDVAVQRQSLSRLEFVDILYAGYDSTTKNVTPALYVEGVPPLMNGIRVERSAYDGIYFWEPEGPVLIANSTISHNRGH

SEQ ID NO: 136398 - protein, 21 aa, Heterodera glycines
  Coding regions on vcDNA: vcDNA=SeqID_62821; Strand=+; Position=1 -54,580-591
MRTRPIWPVKQRLLTSQKKGF

SEQ ID NO: 136399 - protein, 95 aa, Heterodera glycines; identical to SEQ ID NO: 124528
  Coding regions on vcDNA: vcDNA=SeqID_62822; Strand=-; Position=1-544

SEQ ID NO: 136400 - protein, 29 aa, Heterodera glycines
  Coding regions on vcDNA: vcDNA=SeqID_62823; Strand=+; Position=1 -66,123-146
MAISFFEKFSMQQTLSNMKRSAKNGYLYF

SEQ ID NO: 136401 - protein, 29 aa, Heterodera glycines
  Coding regions on vcDNA: vcDNA=SeqID_62824; Strand=+; Position=1 -66,123-146
MAISFFEKFSMQQTLSNMKRSAKNGYLFF

SEQ ID NO: 136402 - protein, 29 aa, Heterodera glycines
  Coding regions on vcDNA: vcDNA=SeqID_62825; Strand=+; Position=1 -66,123-146
MAISFFEKFSMQQTLSNMKRSAKNGYLFF

SEQ ID NO: 136403 - protein, 22 aa, Heterodera glycines
  Coding regions on vcDNA: vcDNA=SeqID_62826; Strand=+; Position=1-66
MAIYFFEKFSMQQTLSNMKRSA

SEQ ID NO: 136404 - protein, 106 aa, Heterodera glycines
  Coding regions on vcDNA: vcDNA=SeqID_62827; Strand=+; Position=1 -137,291-473
RCARLGVHPFVQARAGPTPSPGSAAATGRVGLVTGAAFDGQRRGQCEEQTTYGFGDTIYRPLIPRLENHRVLTSFIGEISGAGQYFRYDDDSGRFCVVSINTHEAN

SEQ ID NO: 136405 - protein, 151 aa, Heterodera glycines
  Coding regions on vcDNA: vcDNA=SeqID_62828; Strand=+; Position=1 -85,143-291,347-568
  Homolog annotation: Hit_ID=EAL28735.1; Match level="QueryCoverage =84%, HitCoverage=5%, E-value=8e-13, Identity=37%"; Hit description =GA15452-PA [Drosophila pseudoobscura]
MPSVEDVPLIRETCLAIEAILSCARDERERVFVSLIVRSLVQFLCADDDELFQQKGPLRELHEFAFGRLNAIFAQHPETFKALLQAAPDIRQKIETATIKQQQQKGRTQQKRVSRSGEGGAAQQQQPTIKLSTDFSAFAASGGGSGKLPEG

SEQ ID NO: 136406 - protein, 399 aa, Heterodera glycines
  Coding regions on vcDNA: vcDNA=SeqID_62829; Strand=+; Position=1 -121,240-436,867-1005,1066-1195,1434-1524,1587-1631,1695-1796,2039 -2277,4987-5019
  Homolog annotation: Hit_ID=XP_413706.1; Match level="QueryCoverage =98%, HitCoverage=57%, E-value=7e-57, Identity=34%"; Hit description =PREDICTED: similar to Bardet-Biedl syndrome 4 [Gallus gallus]
EFALVLRGQIAREEGELRESVAWHFNFQLLTPPFPPPLKELGKSHYLLAEHRKAIELFTKSLEQNEKKWQRKLGEQRKKFEFRGKKAARISTKRQLQLNHSLISLMFLARLLDEQNEIGAAVEAYKRSIEMEPENVDIIHNLGMLYLKVGDQPNAFTQPNAFTTFGKALSYDPNFVPSVLAIASIMQTNGDWDVALTKYKAATSEFDHSCALWNNIGMCFFGKGKLLAALVCLNKANYLCPLDVCLNKANYLCPLDWKVLLNLSLVYCTLHQFASVLLNLSLVYCTLHQFASAYHFVSAAFAITPQNPLVYKLFSVILTGLADFRNAKSAYKRALKLGPSLWAVRFNLAIFESRRANYAEATRRLTELESDGSLAMGSTHGTAYPEVCQVAQNTHGGMI

SEQ ID NO: 136407 - protein, 95 aa, Heterodera glycines
  Coding regions on vcDNA: vcDNA=SeqID_62830; Strand=-; Position=1 -121,875-1041
MLLQFEYEILMARDASKAQHSQQSVKNTDIKKSESQPHNKTVDGENCTKIVQVKNEANEFSPPDTFLATLLKKKRKKNNSKGDEWADWDAENGAL

SEQ ID NO: 136408 - protein, 329 aa, Heterodera glycines
  Coding regions on vcDNA: vcDNA=SeqID_62831; Strand=+; Position=1 -154,200-294,714-1199,1362-1444,1501-1672
  Homolog annotation: Hit_ID=NP_040250.1; Match level="QueryCoverage =68%, HitCoverage=49%, E-value=4e-23, Identity=41%"; Hit description =ORF 48~EDLF5~sim. to EBV BRRF2 [Saimiriine herpesvirus 2] emb|CAA45671.1| unnamed protein product [Saimir
MCRGSQSGGRRTRRSLSSSLAAEYAPAIEFDDELVGPELFSRMAREAAPINEFNETTAIPLKGISVVGGDINGEHDKNLFGGTSMEDSQQNITEQSVSAPTTDRDEYEDLCKLVNPISKDKRVEQEGAKKGSDEEDIGDEGAEKGSDEEDVGDEGAEKGSDEADVGDEGAEKEDDDGVEKEGGGDEEGVQGEGVEKDGDEVEKEGDDEEGVHGEGVEKDGDEVEKEGDDEEGVHGEGVEEEGVEGDKDKKAEFEDEDEPKLIRVEPAEEDVEQDSLGRTWDFDVMLAKKKQERRRRRRKDGSIDLMADADDQIRELVEAMNEAANVSKK

SEQ ID NO: 136409 - protein, 199 aa, Heterodera glycines
  Coding regions on vcDNA: vcDNA=SeqID_62832; Strand=-; Position=1 -172,736-1163
MNRQFKLDKTHRQDTVQLRIIVKKPLVKFIDPIQKDVFRRKNQHFVNIFGDACVRQNRRKKKEISHWMVRKMPNSQKGKTPLRERRNCTKGTDKLPRQAITLQRALKRGENLGTTANAKQSADRPGHVADGGGKQLHGQQVYDLPIRVDCRGDEKAEGGGEPMFGQIEEEPNNDQSPARQTWTGDGGIGKEKHLAMTFS

SEQ ID NO: 136410 - protein, 392 aa, Heterodera glycines
  Coding regions on vcDNA: vcDNA=SeqID_62833; Strand=+; Position=1 -32,2557-2757,2813-3012,3064-3274,3355-3499,3554-3801
  Homolog annotation: Hit_ID=CAE74536.1; Match level="QueryCoverage =97%, HitCoverage=26%, E-value=1e-103, Identity=50%"; Hit description= Hypothetical protein CBG22293 [Caenorhabditis briggsae]
VVLTNGCVATEVISGEGSQPALKAIILDPDSGNDSPDPVRVHPSLVRVLKKHQAEGIKFLYNCTIESLSRLNEPGGGAILGHCMGLGILGHCMGLGKTLQIIAFLHTILSHTRISENIHKVLVFAPKNVLLNWINEFDKWLFDNDPELDGVLTSEIDSLSEIDSLTDNSDRLLAIKRWAKSKKPSVLVIGYDMFRRLTGSDEDRNVPKRGGKVRSQKPKNKSKTEKELDTPHMIICDEPHMIICDEGHKLKNYESAISKTINRIVARRRVCLTGTPLQNNLSEYYCMVMVNFVKPNLLGNIKEFKNRFEHIINRGRTADASREDVVFMKRRCHVLHDRLRGILDRRDYTVLKESLPPKQEYVLMIRLTQATFSLKLSFTDIFLGFAERNNTL

SEQ ID NO: 136411 - protein, 1309 aa, Heterodera glycines
  Coding regions on vcDNA: vcDNA=SeqID_62834; Strand=+; Position=1-3928
  Homolog annotation: Hit_ID=CAD40308.1; Match level="QueryCoverage =52%, HitCoverage=28%, E-value=4e-40, Identity=25%"; Hit description =OSJNBb0013O03.3 [Oryza sativa (japonica cultivar-group)]
MPSKQQMLKKRKKEEHLRRAEQSVSPGRSPIPNCPPQGNQNCPLQDNPLSADGNGAASPRGFNTPNISALQLSTPASSIGSRRGIPPKAGTESITTSQNSVSSAGTQNTSATQNVESPPNSKKLKVEDVDRPLSVIEAITSTPVSTQKSRGGRPAKKRGGPGRGKTNDSMSESFSMDQGSEAGINAAVLPNVPEKINFSTVQINFATTRNLACKIWKWGATALYECDARRSGPRFIETCWNDLAQFLNDAFIVEYLAYLASISQRKVVIVDPAVWQMGIDRVIEYKNMTFGYDPNVPAEVILLPVHFPGHWTLIVHDVQYGTHFADSLPTPYGRLDPQLTDKIRKIISDILPSTVLTGIVNAVNLTVQHDGNSCGYFVCLYAESWLMNNRTFVLPDLSINYEKKRILWHINELYGSDNVPYHPREGVPTPCPIVYRHTDEAQSKSKAAEPMEIDEHDDIMIIEPQTSGQAANAILTQAQVDGENQVDTLGLVSESCVPQEPIAQADDAIFVRPKTPPRRSTRIGRRQSTSISRSPSPAPRRRSSTNPVEKVTAFTKRCYLVHKGWCCAAAAAKHFPEYSDSGKLGEKKCAHCGALLFPHEDSSHCCRQGRVVLPKLNPHPKELEELIVCDKQPRQGKEFVRNMSRYNNLLQFASVSAGNKPCPAGGPMAVILNGEFHRRISSMQAGTTQIPGFGQLYILDPVEAMEQRRKNPTFTGEKITNDKEFVQGHQLNDETLEILEQMIQENHPAASAYKQAREQLHELLRQQRTEELRFFRMTLLNERSAPGGMKDPKLHPHQIITPSTGEGMFAIHADPTGAPAPKGIWVENKQGQLNEIAPFSPWTDSLTYPLIKPKGDDGYHIGIPYAKPAQKKRRSDQCVDQMFDTDAMSDDGSCETESIAASDAESVASTESLIDRIDKTRKFISLRDYCKYHLAIRDENLEWQYHHILSCGGGLGQRWVLDQAAKIDWQIASFLRRPDMDLRISTPKNLLHYLVNQYNKQQARQNPNARQKTVDDIGSVVRLSEKNINSLQYWKKRYEDCNTIFARCHDAKKARLFITFTNNREWPEFKQNIYKNGQMFTDRFDMWMRVWCGKIAVFHQELYEKGFFGTILGSGESMEFQGRGGPHAHIVAQTDLDAVPEVIQEYIWAHIPSLPCKDDDSPIAQMHREVRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMKKG

SEQ ID NO: 136412 - protein, 870 aa, Heterodera glycines
  Coding regions on vcDNA: vcDNA=SeqID_62835; Strand=+; Position=1-2611
  Homolog annotation: Hit_ID=NP_920205.1; Match level="QueryCoverage =98%, HitCoverage=55%, E-value=7e-75, Identity=28%"; Hit description =putative DNA helicase homolog [Oryza sativa (japonica cultivar -group)] gb|AAP52492.1| putative DNA helica
MFETDAMSDDDSCETESIAASDDESVASTESLIDRIDKTRKFISLRDYCKYHLAIRDENLELQYHHILSCGGGLGQRWVLDQASKIDWQIATFLRRPDMDLRVSTPKNLLQYLVNHYNKQQARQNPNARQMTVDDIGSVVRLSEKNVNSLQYWKKMYEDCNTIFARCHDAKKARLFITFTNNREWPEFKENIYKNGQMFTDRFDMWMRVWSSKIAVFHQELYEKSFFGTILGSGESMEFQGRGGPHAHIVAQTDLDAVPEVIQEYIWAHIPPLPDKGDDSPIAQMHREIRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMNFRGATEAFAVVHSMPFAKLSHHVVHLSIHLPNQQPVVYRAFQLVSKAEEIQRGELPETPCSAYWKQWQNEWQHVPSLKDMLFEKVPEQFRWAKDRWVPYKKKPTKRPPIGRVVPVPPTDRERFALYVLMTHFPGDPYHLKLVNGQQCNTFTEAALQHGLLEDDQIWHKTLSEASLHRWPDQMRFLFVSILVFGQPSNALELWNKYKDQMYNPQGITSAAIRQAREQQALADIDWRLHYFNLSCVHCGLPDPPNSIAKNTNLAVEEFFFGDDDLNTPPGQPNQRPQQYPPPPLNSDQQKVFNAVVRAIKSDPKDQTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIEVIDRVCKEMAVRQHKDLLFGGKTVIFS

SEQ ID NO: 136413 - protein, 47 aa, Heterodera glycines
  Coding regions on vcDNA: vcDNA=SeqID_62836; Strand=-; Position=1-141
MAPKCLPLELLFEIVPFIPAEKAVPNALSSCRLLHKLLLPRVIKWKE

SEQ ID NO: 136414 - protein, 127 aa, Heterodera glycines
  Coding regions on vcDNA: vcDNA=SeqID_62837; Strand=+; Position=1-384
MALACPGAAAELLYHAGVDATVPASIRVCEEAVGGAALQQETVGRGKSRAAFATGVVPFCRRLIPVLLITLITVPGLIKIQLIMMLIARVVGVGVAAVPSWLRAAANPNGTASVAASARCSVVMVNC

SEQ ID NO: 136415 - protein, 30 aa, Heterodera glycines
  Coding regions on vcDNA: vcDNA=SeqID_62838; Strand=-; Position=1 -3,610-699
MMDFSIGSNQIKERRSKEWKERIITKLFVN

SEQ ID NO: 136416 - protein, 246 aa, Heterodera glycines
  Coding regions on vcDNA: vcDNA=SeqID_62839; Strand=+; Position=1-741
MKEARGHLKTDIAKRLELPVLEREKCYLTSFGERNPRHYSSNVVKIGFLGMNGDAYVCSLNEMEFMVKAMPIVALNSVDEEQLRERKLRFPTKLQQPDIMLGMDIRHDLNIRDEVEKLPSGFTLSNSRLGRMISGIGQWEKTISPWAQVTFIGSLASAVLDQREEVHEPENVLEDQMKSFFGLNIIGMDDDNTQLDRDEVMKTFRKNLTLKKTAVMNADSHGMRESMSSRPTTSKHEQGCAARYES

SEQ ID NO: 136417 - protein, 147 aa, Heterodera glycines
  Coding regions on vcDNA: vcDNA=SeqID_62840; Strand=-; Position=1 -52,100-153,259-596
MKKPGWINFEFVISNDRCLEEPRFFLDLDFCPGNPAKSFITATLMGTNRRRKKRMDNDQNIRVNEIYRQSRRIHKQRRVAIVKCIWIAIFFVFWVFVMHLILVREQLWVKWVIVSTVGLCYVRFFVFECRYTIYNYEPILPTVITGP

SEQ ID NO: 136418 - protein, 174 aa, Heterodera glycines
  Coding regions on vcDNA: vcDNA=SeqID_62841; Strand=-; Position=1 -115,163-572
MVSFNLPPKLLFFFAMAMLLARKSTQKVPNSTKTHAKIDYFKLAHELVDKASKIENTESEIAWWKKHTFGLLCDANFAKFELEMDGNFGKLRKNFCELMRKDFSNENLLKMFVNDKEALGDLMGFVSNDKQIIDTKTILQKIKNSSILSNKNEQNLATMFEYLNAGIAIITTNN

SEQ ID NO: 136419 - protein, 199 aa, Heterodera glycines
  Coding regions on vcDNA: vcDNA=SeqID_62842; Strand=+; Position=1 -358,1155-1395
  Homolog annotation: Hit_ID=EAA15432.1; Match level="QueryCoverage =52%, HitCoverage=11%, E-value=2e-09, Identity=33%"; Hit description =hypothetical protein [Plasmodium yoelii yoelii]
TPIKCILNRFPASLDPQQFHHPRSTVKRPPPIAPALAKSGPLPANKLPFSTGRSISDRLPDSPSSSRPPHLSITDCGKDKVVHDDPGRRPVHNDDPAFDNKSSNPSNSENSSSRSQSSKTIKETDEILDTLKDINLEVKRRLKVIKAKPSSDTDQEDESNDDEEENEDEEIEEEDEEEKEYDSDQEDDSPELTSNDQTN

SEQ ID NO: 136420 - protein, 891 aa, Heterodera glycines
  Coding regions on vcDNA: vcDNA=SeqID_62843; Strand=+; Position=1-2673
  Homolog annotation: Hit_ID=NP_508324.1; Match level="QueryCoverage =43%, HitCoverage=16%, E-value=2e-48, Identity=32%"; Hit description =predicted CDS, peptidase family A16 and RNA-directed DNA polymerase and Integrase, catalytic domain and Z
MSGFIRSKIPLLNRVLRKEIQSTKTKIEENKFEFDQNKLDECTRVFNKTKEIIQKIEPNFEKLKTLHKKWQNLMRRMDKEEWNTEWKIQKIFRKKHDYLKTIKETDEILDTLKDINLGVKRRLKTIRAKSLSDTDQESDSNADEQEEEDEEMEEEDEEEKEYDSDQEDDSPELTSNDQINRKQTPFVNYRSRIKLPPQTLTHFSGKFSQWPSFWDDFKSSVHNDQNLENIQKLKYLRGLLHDEPYRIVSPIRLKLREKFKLYSTKELMNFLNSHTQAREDIERMEDSNRQIRNFPPHRPPQNRPQRQSYPNYSQPQLKANHRNHQNLPLSPYPITSALTTKSKPVRLAEFKPKPSQPKPQTKIIFCRFCERDNHLSKECKIYSTTEKRSNRARELKLCLNCLKKGHHLKECKSPFSCFNCKSKHNTLLCTRKTNQFNQREQFTNVNVTQNPEEFEETQNFMSLDCDQNDEILQNSEEELLMTTEAPVLNPDQNKTQKEMIFFDNGSQKSYITDECADSLQLPTIDEKLLAISTFNQNKPKIISSRLVKIGIKTLNGEIEYVTLQTVEKITDVTKMVNRETVDIRKRKIPINHACPQILIGIDHYWHFMLPNSQIQILPSGFYSIDTKLGKILSGKGTIEDTNINLVKEKRKKDETNEILQKFWELENIGITDSPHLTDEDTALIHFDKNVIFEENRYYIRWPYKRETPNLPTNFGLCLGRLRNVVKQLIKNKQLENYNKILQEQMDTNVNEIAEFKSKNLIHYLPHHPVIKESSNTTKIRPVFDASAKLRGSNFLNDEIHQGPKLLPDLCGMILRFRLKNFVLIGDFEKAFLRVGLNEIDRDTTRFLWVKQSYLDEIKQNYREIEMRDVELRRFTRIPFGVNAYRFLLTSV

SEQ ID NO: 136421 - protein, 27 aa, Heterodera glycines
  Coding regions on vcDNA: vcDNA=SeqID_62844; Strand=-; Position=1-82
PQNPQSHRDSDVFTMSKVKSDHVFVIS

SEQ ID NO: 136422 - protein, 95 aa, Heterodera glycines; identical to SEQ ID NO: 124528
  Coding regions on vcDNA: vcDNA=SeqID_62845; Strand=-; Position=1-828

SEQ ID NO: 136423 - protein, 195 aa, Heterodera glycines
  Coding regions on vcDNA: vcDNA=SeqID_62846; Strand=-; Position=1 -539,599-647
MVLLTEKIAKILNCRISELRDRLNHPSDCETVVKALKGHRVKTTYKDRNGYTKSFAFGGITAQGAAITMAYGRLGRPFNVNVAAHFYVRHHIKLRHPFLHCAVESFPEGQEDRFYPLELCEMEDGPNEPDWLGRIFTEIRNDNYTDSMSPANREVLTPEDTSMSREGRDECSQNISYTLCQKVLFPILNFFENVF

SEQ ID NO: 136424 - protein, 117 aa, Heterodera glycines
  Coding regions on vcDNA: vcDNA=SeqID_62847; Strand=+; Position=1 -58,106-251,298-447
MSTSSNKNYLPKNQCPNCDDEEVDNDPSPEEVEKWTPEEVIEWDRRCEGQMPAEEELWQEFLDKGEANVLREFFGGKGALEVEKSLREYAKKKERRDAILIEKRNEYKKMMEKKDKN

SEQ ID NO: 136425 - protein, 36 aa, Heterodera glycines
  Coding regions on vcDNA: vcDNA=SeqID_62848; Strand=+; Position=1-311
NLFKYSIFLAFFRKIFCLFSAGTASDNVFYLFRKIN

SEQ ID NO: 136426 - protein, 46 aa, Heterodera glycines
  Coding regions on vcDNA: vcDNA=SeqID_62849; Strand=+; Position=1-356
INKKHCQRQCLPKKRQKIFRKKAKKIENLNKFTSEKRKKSLQHLRF

SEQ ID NO: 136427 - protein, 46 aa, Heterodera glycines
  Coding regions on vcDNA: vcDNA=SeqID_62850; Strand=+; Position=1-320
INKKHCQRQCLPKKRQKIFRKKAKKIENLNKFTSEKGKKLTTPSIP

SEQ ID NO: 136428 - protein, 48 aa, Heterodera glycines
  Coding regions on vcDNA: vcDNA=SeqID_62851; Strand=+; Position=1 -61,121-206
MLTALTPELRGTLSKDLIFSGLEQLLRDPDEDVRVQTVSAIALLYAFA

SEQ ID NO: 136429 - protein, 182 aa, Heterodera glycines
  Coding regions on vcDNA: vcDNA=SeqID_62852; Strand=-; Position=1 -322,676-902
MSERGRGGGFVPKRRNVVKEIVIDESQENLVMIVQKKVEESEKTKDHQSEEEKKKESEKGDGAEKEGQTVGTGTMAQQQPKKEPYHAQHHHFTRKPSWTKDPKGMPTLPRVVNYTFRHTKSDQRHQQKAKEEEEEHVELETYKVKMGEEFSNFKGGQNKQVGFGIEIRIWVGIEVEIGFSFH

SEQ ID NO: 136430 - protein, 57 aa, Heterodera glycines
  Coding regions on vcDNA: vcDNA=SeqID_62853; Strand=+; Position=1-173
MIYPIVQSGPSTALENVCGIANPPDMPRCSRATSLMSRSARGDAVGVPPVIGPKIAE

SEQ ID NO: 136431 - protein, 89 aa, Heterodera glycines
  Coding regions on vcDNA: vcDNA=SeqID_62854; Strand=+; Position=1 -198,250-321
MPKRHYYFDAIRHCSRFINNYPNGIFTIPSPCLSYKLCDLPKAKVECTVTKSKYYRSTIMPIQVYRVHVLKRTLFVKRKGGCFARKLRF

SEQ ID NO: 136432 - protein, 132 aa, Heterodera glycines
  misc_feature (99)..(99): Xaa can be any naturally occurring amino acid
  misc_feature (107)..(107): Xaa can be any naturally occurring amino acid
  Coding regions on vcDNA: vcDNA=SeqID_62855; Strand=+; Position=1 -22,144-253,450-506,558-758
  Homolog annotation: Hit_ID=NP_503111.1; Match level="QueryCoverage =68%, HitCoverage=19%, E-value=2e-28, Identity=59%"; Hit description =met onco (49.0 kD) (4S388) [Caenorhabditis elegans] emb|CAB02923.1| Hypothetical protein F11E6.8 [Caenorh
WLREIDRCAYSTMSDVWSYGIVLWELLTRAASPYSDVPSTEIRHFLETGKRLAQPLHCPDILFDLMFDLMLSCWRSRPSERPDFVTIEHQLRGILQAKXKAWKCSRXFVRIKNLLAPKFPKKSRNFPENPHN

SEQ ID NO: 136433 - protein, 77 aa, Heterodera glycines
  Coding regions on vcDNA: vcDNA=SeqID_62856; Strand=+; Position=1 -84,632-781
MASLGTTTTEQIAKRQPETVALRAAFAEPRYGTLAFWSTVWACDRRQLVSNCTKNRERRKSDGSDCKKIKTWIREIP

SEQ ID NO: 136434 - protein, 149 aa, Heterodera glycines
  misc_feature (138)..(138): Xaa can be any naturally occurring amino acid
  Coding regions on vcDNA: vcDNA=SeqID_62857; Strand=+; Position=1-454
  Homolog annotation: Hit_ID=AAP92584.1; Match level="QueryCoverage =80%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg
GAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 136435 - protein, 37 aa, Heterodera glycines
  Coding regions on vcDNA: vcDNA=SeqID_62858; Strand=-; Position=1-111
  Homolog annotation: Hit_ID=P23731; Match level="QueryCoverage=100%, HitCoverage=6%, E-value=2e-11, Identity=91%"; Hit description =Intermediate filament protein B (IF-B) pir||S06954 intermediate filament protein B - common roundworm
MVTEMGSTSVGGISPSLSANAAKSFLEATDKEKKEMQ

SEQ ID NO: 136436 - protein, 669 aa, Heterodera glycines
  Coding regions on vcDNA: vcDNA=SeqID_62859; Strand=-; Position=1-2009
  Homolog annotation: Hit_ID=NP_507780.1; Match level="QueryCoverage =69%, HitCoverage=32%, E-value=1e-39, Identity=28%"; Hit description =predicted CDS, DNA polymerase type B, organellar and viral family member (5T899) [Caenorhabditis elegans]
MSTALDESQQNGITPDQLGATISSDLLNPSIWIPIRRISDNTADSIMNRFLEVAQSKSREGSLWGSPFTVTITTLDVAQLPQRQQVRGSGKRTTNSVQHIVKESALLRINNSDDAYCLFYALEASRKYHIKEMSRRNFCYYINHQNGRRLEDVFGLMSSANIRTDLREYDAVVYVPIVVDYWNRKYATANQRFKVFIFGATGTYRPKFQYGPDNYNVEIPLYHHNGHFDGIRCGVGKAVFGRDYYCFSCECPYDNANDHSLQCKAKCINCGRIGAGRPCRADDNNDNYYRECTACGKDFMSQDCFSHHLSSNVCRQFKKCKQCGVVWNVKQNRRKGRSGHVCGEKFCYTCKCYHKPERGCFIQQLKARRPKKYRLIAFDCETTQNTRIEGDRRVHSVNFISCYVVCTKCINENLWRNSLQAPCGICGRQRTVTFSHRVYERTQTDAQFITPCPMAAFAQWLLSEFDPRYPTMLFAHFGGRFDNIMLFRQFFLNGFCPQMIRRGNKLYEMKISRGEKNPEIIVRDSWNLMPVPLGALPGAFGLNVQDKEFFPHLANVEANYGHILPSLPSKADYLYGGMTPDRQRRFDQWYAEHRHQQFDLCEQLAAYCTNDTRILIEALVAFRTEFLTISDPLERHGCLDDDNDDEDEEEEEQQDDDNAFEVIGGGIDI

SEQ ID NO: 136437 - protein, 35 aa, Heterodera glycines
  Coding regions on vcDNA: vcDNA=SeqID_62860; Strand=+; Position=1 -78,857-886
MALNGTYLFNLSLYCSNSLHEVRAVQMFAFYGHFS

SEQ ID NO: 136438 - protein, 146 aa, Heterodera glycines
  Coding regions on vcDNA: vcDNA=SeqID_62861; Strand=+; Position=1 -73,257-624
MVYIERFEANSYEELNTVLERLARDSIANLRLALSTQQSTTLIVWPKPFAGARHCVHSLLRWSLERVSSKCQNKPMPFQIVRVWAVPNSPYKIDKTLGLRQLPTLIEYSLTDRRRIEGRMVYLDEQFLSVDYITRFFLKQPLNVFQ

SEQ ID NO: 136439 - protein, 74 aa, Heterodera glycines
  Coding regions on vcDNA: vcDNA=SeqID_62862; Strand=-; Position=1 -73,255-406
MVYIERFEANSYEELNTVLERLARDSIANLRLALSTQQFDEGGDFHMEWQRIRRDLAVFGLGNRIKMPKIHKKL

SEQ ID NO: 136440 - protein, 255 aa, Heterodera glycines
  Coding regions on vcDNA: vcDNA=SeqID_62863; Strand=-; Position=1 -180,331-721,779-974
  Homolog annotation: Hit_ID=XP_326403.1; Match level="QueryCoverage =73%, HitCoverage=13%, E-value=1e-24, Identity=36%"; Hit description =predicted protein [Neurospora crassa] gb|EAA33019.1| predicted protein [Neurospora crassa]
IENIRRTEVGAVPEADPKDIHACILSCPFCEGYGGECPNTLHFWVCDDCCQTLTFVKIEKQFGSKASLDKELDRLNNKGMLNILLLGETGIGKSMLINALIAYLKHGTLQKALEVTEFIEYCIYNWHYLNPKQAKEIDWVIPARFCTGRYDSKKIRHRIEVQLGEESKEERLEAGESQTKWPNAYVIPSKDGHKVRIIDAPGIGDTKGVNEDKINFDKTLNFISTLPELHAVCILLRPNTTRATPAITYCIKGLL

SEQ ID NO: 136441 - protein, 18 aa, Heterodera glycines
  Coding regions on vcDNA: vcDNA=SeqID_62864; Strand=+; Position=1-54
DGKPSIACRFSAQQSNNR

SEQ ID NO: 136442 - protein, 124 aa, Heterodera glycines
  Coding regions on vcDNA: vcDNA=SeqID_62865; Strand=-; Position=1 -152,204-287,410-594
  Homolog annotation: Hit_ID=NP_507920.1; Match level="QueryCoverage =29%, HitCoverage=17%, E-value=3e-11, Identity=69%"; Hit description =predicted CDS, putative mitochondrial protein (5U798) [Caenorhabditis elegans] emb|CAA21554.1| Hypothetic
LRIALGLLVLILLIGFFPSTDAIQCYSGNQFSIVECPSLYCIKQTLGLDTVRYCDGTGFSSICSTYRIIDSCQTVPSLGYVCCCPDQLCNSAQKVPMNALFGITLLGIALASLNVAMRTTERMF

SEQ ID NO: 136443 - protein, 44 aa, Heterodera glycines
  Coding regions on vcDNA: vcDNA=SeqID_62866; Strand=+; Position=1 -50,142-226
MEKILAKAPPRGREAAENCSETHQILFASYFRHSDAFTIKKGDE

SEQ ID NO: 136444 - protein, 50 aa, Heterodera glycines; identical to SEQ ID NO: 125301
  Coding regions on vcDNA: vcDNA=SeqID_62867; Strand=-; Position=1-460

SEQ ID NO: 136445 - protein, 256 aa, Heterodera glycines
  misc_feature (34)..(34): Xaa can be any naturally occurring amino acid
  misc_feature (65)..(65): Xaa can be any naturally occurring amino acid
  misc_feature (124)..(124): Xaa can be any naturally occurring amino acid
  misc_feature (160)..(160): Xaa can be any naturally occurring amino acid
  misc_feature (228)..(228): Xaa can be any naturally occurring amino acid
  misc_feature (242)..(242): Xaa can be any naturally occurring amino acid
  Coding regions on vcDNA: vcDNA=SeqID_62868; Strand=+; Position=1-779
  Homolog annotation: Hit_ID=EAA16792.1; Match level="QueryCoverage =100%, HitCoverage=18%, E-value=2e-37, Identity=39%"; Hit description= ookinete protein-related [Plasmodium yoelii yoelii]
GDKWGTTNGEWHGSRGGLNGGQPMGNGTGAEEGXMGTTNGEWHGSRGGLNGGQPMGNGTGTEEGXMGDKGNGTGAGVKWGTTNGEWHGSRGGLNGGQPMGNGTGAGGLNGGQPMGNGTGTEEGXMGDKGNGTGAEGVKWGTRGLNGGQPMGNGTGAEEGXMGDKGVKWGTTNGEWHGSRGGLNGGQPMGNGTGAGVKWGTTNGEWHGNRGGLNGGQPMGNGTGTEEGXMWDKGNGTGAEEGXWGTTMGNGTGAEEG

SEQ ID NO: 136446 - protein, 129 aa, Heterodera glycines
  Coding regions on vcDNA: vcDNA=SeqID_62869; Strand=+; Position=1 -19,776-890,940-1130,1185-1249
MPRSLTGVLAYNALNHFDCYDLNEVMFRMNQWIARRLTQIMSRPNDNVKPSRRKKDIFRIVVANSAEEPPPASLFNKEIHSQMPLNSNKERFSTQQDIDYSVGVVLHKKFFRVEVISVRLFKSSSHRRR

SEQ ID NO: 136447 - protein, 108 aa, Heterodera glycines
  Coding regions on vcDNA: vcDNA=SeqID_62870; Strand=+; Position=1-449
LSVCSFGPKSERLREESTLSKCTMILKQIQFILSSSHFSSLALFCCRSPPSAAFVFLVVVKKCHRFGSHFLHRFARRMRRGTKRAKGTVHIAIPCRTDGTARVVRRRQ

SEQ ID NO: 136448 - protein, 247 aa, Heterodera glycines
  Coding regions on vcDNA: vcDNA=SeqID_62871; Strand=+; Position=1 -118,324-505,2649-2747,3178-3522
MFAAEPISDRLLKSSDQQTNELTQNGGDGNKGEVQVIVKGFPTTFNKFQIASLFPDFRPLHVEYLSGGEAVVQFANKYHAAQVVRNYNGLSFENENFILETGALNFRPPLSRSRSVPRLCSIDEEEARAEEQEDECDETVKDEDEELQLSSSDLDSLNTADHYQPVPIPTATTTMANAMASFACVAADQQTITDSSCRSSACGDELEDEDDDAEDEERRHFWAEHHHQFHRNDDHHHANTAPGRGPH

SEQ ID NO: 136449 - protein, 30 aa, Heterodera glycines
  Coding regions on vcDNA: vcDNA=SeqID_62872; Strand=+; Position=1 -44,81-129
MQIFGNSNSLQGWTINSGNLRFFRKIQNAF

SEQ ID NO: 136450 - protein, 87 aa, Heterodera glycines
  Coding regions on vcDNA: vcDNA=SeqID_62873; Strand=-; Position=1 -149,599-711
IALCSNIAMPLYSLFKNFYSVQQNCDIVCNPSGVLTINIFANTYYNEDPVAMGMGDTLLCKAIEPFRRLKLSTEEFVLIRAIIYSHM

SEQ ID NO: 136451 - protein, 176 aa, Heterodera glycines
  Coding regions on vcDNA: vcDNA=SeqID_62874; Strand=-; Position=1 -57,114-170,229-287,435-533,894-1067
  Homolog annotation: Hit_ID=CAE70564.1; Match level="QueryCoverage =93%, HitCoverage=48%, E-value=4e-45, Identity=54%"; Hit description =Hypothetical protein CBG17211 [Caenorhabditis briggsae]
VLSEGPHGPPVYYATVGQMIYHKWTCEANGPNIYHKWTCEANGPNQFCMTVHSCFADDGNGDKVQLHSCFADDGNGDKVQLIDEKGCARDKYLLQNLEYVSDLMVGKEAHVYKYADRQNIYFDCKISLSVKEPFCEFCPVPNCADPPRRKHYNFIAENESYQRDIWRKKKRVIKTK

SEQ ID NO: 136452 - protein, 132 aa, Heterodera glycines
  Coding regions on vcDNA: vcDNA=SeqID_62875; Strand=+; Position=1 -102,145-441
MSLQFSLSLSDVAVSNLNEFHRRHEKRQFAPVGKVIDGVKVLILDGQTMKRVPIGVPGEVNGGNCKESKELTDLRRGSDFGKGLYQPPRAEQRPFCGSAGRTAQRSGRRANVPDGRLGLFDAELSAGNMRTL

SEQ ID NO: 136453 - protein, 29 aa, Heterodera glycines
  Coding regions on vcDNA: vcDNA=SeqID_62876; Strand=-; Position=1-109
IAKLHHFLETRRSRVPEREALSPQQQNSI

SEQ ID NO: 136454 - protein, 67 aa, Heterodera glycines
  Coding regions on vcDNA: vcDNA=SeqID_62877; Strand=+; Position=1 -53,273-314,385-493
MALPFKKRFYINSAAWISQIEPVQDHVMKSSIQSEPEEDSVNYFMFVFCYFFFPFIQRTLSFSHIIR

SEQ ID NO: 136455 - protein, 100 aa, Heterodera glycines
  Coding regions on vcDNA: vcDNA=SeqID_62878; Strand=+; Position=1 -86,499-590,897-1021
MNFSEVKALNLFNNYLFWCKTSVPNSAYFENLFKKVQHFQFFPRRRLSAPPEPRPMFPKELLKITFACFLQNISNSCNMPYTNFIFHGKVLLMKLLITSP

SEQ ID NO: 136456 - protein, 16 aa, Heterodera glycines
  Coding regions on vcDNA: vcDNA=SeqID_62879; Strand=+; Position=1-48
MTLSKKFLPRPYVSAS

SEQ ID NO: 136457 - protein, 15 aa, Heterodera glycines
  Coding regions on vcDNA: vcDNA=SeqID_62880; Strand=-; Position=1-137
YRQWLISSVIDFVSE

SEQ ID NO: 136458 - protein, 136 aa, Heterodera glycines
  Coding regions on vcDNA: vcDNA=SeqID_62881; Strand=+; Position=1 -114,1526-1681,1724-1862
  Homolog annotation: Hit_ID=AAH55704.1; Match level="QueryCoverage =66%, HitCoverage=22%, E-value=7e-12, Identity=38%"; Hit description =Btbd2 protein [Mus musculus]
MEQLQSSHQLEYPPLLVSQYFDLWENLIVLHCEAVHWLDFSCRCLDYIDQNAESLIQSDAFLEMEQNLLYEIIERDQLKIISGELIIWNAALRWADAQCLQNGTECSAENRRVVLGLALSKIRFPLISLSGLADYV

SEQ ID NO: 136459 - protein, 129 aa, Heterodera glycines
  Coding regions on vcDNA: vcDNA=SeqID_62882; Strand=-; Position=1-389
MNLDRVFQSDFSNGVENDELLGNENVFVIEDENEILEQEIDCHVLSEHNYAKRARVLNVASQASLNSDIGVAGPSRVSDSQFEEMRRDEYLKRKRERERLRRENEAQSQRALRLERNRNRMSSQRSEEN

SEQ ID NO: 136460 - protein, 34 aa, Heterodera glycines
  Coding regions on vcDNA: vcDNA=SeqID_62883; Strand=-; Position=1-102
MSLFLFLLNLLFRHFRLGVLSLPYINYSELFSFL

SEQ ID NO: 136461 - protein, 79 aa, Heterodera glycines
  Coding regions on vcDNA: vcDNA=SeqID_62884; Strand=-; Position=1 -165,503-577
MTNFFCPPVLICVLSLLTAVVSSLKVLQIAPNFLDTNFELSVRFANLLGENGHHVHFLVPLSKPNNLPALEQFNSNVHV

SEQ ID NO: 136462 - protein, 54 aa, Heterodera glycines
  Coding regions on vcDNA: vcDNA=SeqID_62885; Strand=+; Position=1 -75,341-430
MKQHIASSSNSVDKCDEENIKNYIKNCTYFAMNALRATQKRHSKRNHSRAVGWD

SEQ ID NO: 136463 - protein, 122 aa, Heterodera glycines
  Coding regions on vcDNA: vcDNA=SeqID_62886; Strand=-; Position=1 -70,162-261,548-661,717-798
  Homolog annotation: Hit_ID=BAA91422.1; Match level="QueryCoverage =95%, HitCoverage=33%, E-value=4e-11, Identity=29%"; Hit description =unnamed protein product [Homo sapiens]
MPLAKGGLGLRCMAADCNNPITLQELQAFVPSSTVTKLEERCAELSVVQANLKFMERCPDCRLKFCRLCDEPWQDEHKGVSCEQFAKKQNRERLLEKRLSEAVVHCCAKCKMSFVKHDGCNK

SEQ ID NO: 136464 - protein, 504 aa, Heterodera glycines
  Coding regions on vcDNA: vcDNA=SeqID_62887; Strand=+; Position=1-1515
  Homolog annotation: Hit_ID=NP_491240.1; Match level="QueryCoverage =98%, HitCoverage=37%, E-value=1e-109, Identity=41%"; Hit description= zn-finger, CCHC type and RNA-directed DNA polymerase  and Integrase, catalytic domain containing protein
MNAPILMNDKSIDFVLDSGTEIIVVTNQTYKDIGRPPIQACQEEGKFFDGTRCKFLGRGVANFQFNGIRTELPYYVAKSGTINLLGLTALDRLGFLEEMKRLIGTKNINQIWSTDSTKIRDTIANFENKYEQIFSEGLGLCTKMKGQLMLKSGANPIFKRARPVPYATLPTINAEMDRLEKLKVITPVDHTDWSAPILVVKKANGTARLCADFSTGLKDSLQLNQHPLPLPSDIFATLNGGKYFSKIDLSDAYLQIELEENSKKLCTIATHRGHYQYERLPFGIKSAPGIFQSIMDNMLSDLSFALAYLDDLIIVSPTLEKHNEHLDQIFSKIQEWGFKIRIEKCSFFQPKIKYLGVIIDQNGRRPDPSKISAIAEMRMPSNISELRSYLGMVNYYQEFVRNFRTIRQPLDELLKKDSKWDWSPKCQNAFSKIIAMLQSDLAFTHFDPSLPIVVAADASQYGIDGVISHKFSDGTIKAVSHFSRSLTPAEQNNGQIEKEALALV

SEQ ID NO: 136465 - protein, 57 aa, Heterodera glycines
  Coding regions on vcDNA: vcDNA=SeqID_62888; Strand=-; Position=1 -55,490-608
MQCLCKVLPPLILGHLQGVTQPIKTTTETEPIISPTENYTEEPKTAVTLLASKLFFC

SEQ ID NO: 136466 - protein, 109 aa, Heterodera glycines
  Coding regions on vcDNA: vcDNA=SeqID_62889; Strand=+; Position=1 -113,241-457
MKWGLAIDAKRRPAMSPHVHGSHVVPIISSSHAARQSRRGLSALPDSHVLFPKCSWKRIAKSGKKVVAIWLKIPKTGLYRKIPKKYLGLIGIRSGSRVSVPVAFQKSTG

SEQ ID NO: 136467 - protein, 34 aa, Heterodera glycines
  Coding regions on vcDNA: vcDNA=SeqID_62890; Strand=+; Position=1 -64,368-408
MQEMVQLLGHALLENQKFTYFLQFIGHFLIILVD

SEQ ID NO: 136468 - protein, 104 aa, Heterodera glycines
  Coding regions on vcDNA: vcDNA=SeqID_62891; Strand=+; Position=1 -93,349-465,518-622
MLRRSAVLCLKSGTYLAKGKRVQKGQINKIKDPYASADEETCAEFFAGPTIEDRKSKFQAYVAKVESKDQVDFLLTKIKGVGKIARATHNPYAWAFSDHSSIEK

SEQ ID NO: 136469 - protein, 90 aa, Heterodera glycines
  Coding regions on vcDNA: vcDNA=SeqID_62892; Strand=+; Position=1-273
MALPELVLKRLSSLRKKDGNKIMPASPSSKDGKSLVGSAELPKIALLRSLSKQRSNSVRRESEKSPFDSPKPQKTKLARSLSRTMLSLIR

SEQ ID NO: 136470 - protein, 49 aa, Heterodera glycines
  Coding regions on vcDNA: vcDNA=SeqID_62893; Strand=-; Position=1-150
NIFREYTFFIFTIFLCLFIIFGLKYMPETKNKTLAEVEEAIGQKKQNEN

SEQ ID NO: 136471 - protein, 47 aa, Heterodera glycines
  Coding regions on vcDNA: vcDNA=SeqID_62894; Strand=-; Position=1-141
MLSRSDEHIAHAKKLREIYLDRPIPPMDEGVFAVEHHIFGQKHGNGW

SEQ ID NO: 136472 - protein, 184 aa, Heterodera glycines
  Coding regions on vcDNA: vcDNA=SeqID_62895; Strand=-; Position=1 -126,192-296,695-839,883-981,1065-1146
  Homolog annotation: Hit_ID=CAE64076.1; Match level="QueryCoverage =92%, HitCoverage=33%, E-value=2e-30, Identity=38%"; Hit description =Hypothetical protein CBG08680 [Caenorhabditis briggsae]
ERFLMPNIAKFGVPNFNWFEFLWHSEMFFFENIDRMGMPLAVGAEMIATGAHCEMKKNLQKLPGELSTFMEKPNSKGVLYVAFGTHVDWKYAPEHLLNAFFDAFNQLIDYQIIFACKGCEEKPKNLNQNVMIVKWAPQNEILAHPNTNAFITHGGFKSVREGICAAVPLIIMPVLAEQVENRWT

SEQ ID NO: 136473 - protein, 87 aa, Heterodera glycines
  Coding regions on vcDNA: vcDNA=SeqID_62896; Strand=-; Position=1 -48,757-972
MSNKDFGLLLSNHSEQVTEIVSTDWDLIVVDDIFWSFGFALTTMRQRLWESSGGGQGQRKRPHYLVYATSGTSVTVHNSIRATGGKN

SEQ ID NO: 136474 - protein, 111 aa, Heterodera glycines
  Coding regions on vcDNA: vcDNA=SeqID_62897; Strand=-; Position=1 -146,1340-1529
MNQLKLFCSYLLITTVLLLQNVVNAEKILFTFFHDSGSHFQSMLPMIEKFASRGHSVAILDTILPVEKQKPFIHHIRAPLPIVPSNDEAKLNNNYYKTIRYIQYSRTAVSS

SEQ ID NO: 136475 - protein, 321 aa, Heterodera glycines
  Coding regions on vcDNA: vcDNA=SeqID_62898; Strand=-; Position=1 -162,210-290,345-397,449-616,665-943
  Homolog annotation: Hit_ID=CAE65943.1; Match level="QueryCoverage =98%, HitCoverage=39%, E-value=3e-74, Identity=47%"; Hit description =Hypothetical protein CBG11120 [Caenorhabditis briggsae]
SILVSSLRYYTSNLYHNRSWREGFFKYGKFVRHLPEGVKPTHIVVGAGSAGCVLANRLTENPDNRVLLVEAGPQDNCVLANRLTENPDNRVLLVEAGPQDNWWNWKIHMPAALMYNLCNDKYNIHMPAALMYNLCNDKYNWMYFTMPQENMNGRVLYWPRGRVWMYFTMPQENMNGRVLYWPRGRVWGGSSSLNAMVYIRGHPKDYDRWEREGAKGWAHKNCLPFKKAQNCLPFKKAQAHELAIGPDDPYRGHDGPLFVTQGKCEHPLHQAFLESGRQHWIGVTEDMNGYRQEGLGEMDMTIKDGRRWSASSAYLTNVRFF

SEQ ID NO: 136476 - protein, 31 aa, Heterodera glycines
  Coding regions on vcDNA: vcDNA=SeqID_62899; Strand=-; Position=1-140
LLLKTESHDISNLIISSHDDQSDRKWEHHEP

SEQ ID NO: 136477 - protein, 76 aa, Heterodera glycines
  Coding regions on vcDNA: vcDNA=SeqID_62900; Strand=-; Position=1 -157,823-896
MAEDRKGKQKANIASAVVWPATIVPRNLWVSRVLTEKKIQLLLGQNRTAAQHERVLKRTKFYLHVSLGTLMLSSFK

SEQ ID NO: 136478 - protein, 37 aa, Heterodera glycines
  Coding regions on vcDNA: vcDNA=SeqID_62901; Strand=+; Position=1 -23,148-238
MIALLLRRPYFFLLKIMEYNIKIEKSYAIELDKKLWR

SEQ ID NO: 136479 - protein, 38 aa, Heterodera glycines
  Coding regions on vcDNA: vcDNA=SeqID_62902; Strand=-; Position=1-175
FYKKCLDFFLAYQNFIEPGSFYSHSNRPNFFYSLTRPY

SEQ ID NO: 136480 - protein, 41 aa, Heterodera glycines; identical to SEQ ID NO: 130306
  Coding regions on vcDNA: vcDNA=SeqID_62903; Strand=-; Position=1-525

SEQ ID NO: 136481 - protein, 27 aa, Heterodera glycines
  Coding regions on vcDNA: vcDNA=SeqID_62904; Strand=-; Position=1 -7,441-517
MSAIWESKSNKLAQSIIEWISMAVDVF

SEQ ID NO: 136482 - protein, 148 aa, Heterodera glycines
  Coding regions on vcDNA: vcDNA=SeqID_62905; Strand=+; Position=1 -150,553-849
MPDLYFFRDPQEQEKEGTEGEAEADITVKEGGWGATGGMDTMGGDFPGVQAEPIKLDFEVPHITDWAAASSDWNAPPAEQQPPQAQQMVVPSQPAAQAPSAVPPSAIAPPQAAAVAPPPPQPIQQHQPMPTQVKCLVNCSENCSTCIC

SEQ ID NO: 136483 - protein, 376 aa, Heterodera glycines
  misc_feature (228)..(228): Xaa can be any naturally occurring amino acid
  Coding regions on vcDNA: vcDNA=SeqID_62906; Strand=+; Position=1 -857,888-1079
  Homolog annotation: Hit_ID=NP_495557.1; Match level="QueryCoverage =99%, HitCoverage=28%, E-value=2e-68, Identity=39%"; Hit description =zn-finger, CCHC type and RNA-directed DNA polymerase  and Integrase, catalytic domain containing protein
ALQQIRQFVKNTLPEPKNFQQIEGLDSDKFTQFYRRRDDISIVKDCLMFGDRTIIPKSVQKQILKMLHQGHPGVKRMKSLARMHVYWPLMDAEIEAFVQKCTSCAAIAKNPIKTTLQSWPKSDGPWKRIHIDYAGPFHGKMYLIVVGSFSKYPEIFEMNSTNASATISKMRSLITHYGIPETIVSDNGTQFSHQFQNFVKSNGIEHIFTAPYMPQSNGQAERMVDTFXRTFAKIKGEGVDGNVLDTFLLTYRTTPSELLGKCPAELFLGRKPRIGLDLLRPPPSDQFNRKHGAKFRSFDIGQLVFTRLRPPPSDQFNRKHGAKFRSFDIGQLVFTRRHNTADWRPGKIIDKKGVIYTVELPNSSRRFHANQIRTRQ

SEQ ID NO: 136484 - protein, 43 aa, Heterodera glycines
  Coding regions on vcDNA: vcDNA=SeqID_62907; Strand=-; Position=1-280
CFAVPRTGRQWMALNLQEIKLAISGCKKLLGKELFFEVSQTPY

SEQ ID NO: 136485 - protein, 360 aa, Heterodera glycines
  Coding regions on vcDNA: vcDNA=SeqID_62908; Strand=+; Position=1 -231,289-386,447-588,649-734,987-1147,1211-1386,1436-1624
  Homolog annotation: Hit_ID=CAC20783.1; Match level="QueryCoverage =94%, HitCoverage=35%, E-value=1e-109, Identity=52%"; Hit description= kinesin-like boursin [Paracentrotus lividus]
MITNFGSCSSVKHKVGPTTKRKNVQVVVRTRPLSEMERNERCKNIVSCDSVSKVVSLKTNTCDKYSTGQRQFGVFDKVYGHESTQIQVYGDVVAPLMKEVLNGYNCTVFAYGQTGSGKTYTMEGRHDESGAFSWDSDPTSGIIPRALHQIFTELSNEDIDFTVRVSYVELYNEQIYDLLSLSETSHRSHSVFTVSVMVRESGLVNGEEMLRQGKLNLVDLAGSENIGRSGATDKRAREAGNINTSLLALGRVINALTTNAPHIPYRESKLTRILQDSLGGKTITTIIATLSPASSNFEESVNTLEYAQRAKNIKNNPEVNQKITRRGLLKEYNEEIERLRRDLLAAREKHGIFLDKENYE

SEQ ID NO: 136486 - protein, 108 aa, Heterodera glycines
  Coding regions on vcDNA: vcDNA=SeqID_62909; Strand=-; Position=1 -110,193-294,605-721
  Homolog annotation: Hit_ID=NP_509581.2; Match level="QueryCoverage =74%, HitCoverage=2%, E-value=1e-10, Identity=40%"; Hit description =Filamin/ABP280 repeat family member (XK45) [Caenorhabditis elegans] gb|AAN60532.1| Hypothetical protein C2
PVGQLTEFIVDVLPSDEGDDTASAPVIEQLPKVQITDPRGDLLPVDVAAYEEEPSRSVVRYTPQTVGNHQISVQFDGQSVPGSPFTVKAFDAECVKLTLDQPAKAISH

SEQ ID NO: 136487 - protein, 53 aa, Heterodera glycines
  Coding regions on vcDNA: vcDNA=SeqID_62910; Strand=-; Position=1-398
FLKRHYFIFLAKLIHKYFFRNCSETHQILYTSYLGTQMLSLSKREMNKKSKNF

SEQ ID NO: 136488 - protein, 181 aa, Heterodera glycines
  Coding regions on vcDNA: vcDNA=SeqID_62911; Strand=-; Position=1 -180,224-363,568-793
MFRMIIDAWPAFSPASITMDFEQAAMDAAAAVFPGAQLRGCLFHLVHNMHKRLISEGLQNRYRSDPIFAETARMITALAFVPIQHLTGAITALNDVVGQELDQILGCCRYPSIWRFIDVLRMDQRARDADYVSCVNGEEPPMKKKKFRNADKRILNIIENFDAQNIVEFLRGISNNCVMDP

SEQ ID NO: 136489 - protein, 129 aa, Heterodera glycines
  Coding regions on vcDNA: vcDNA=SeqID_62912; Strand=-; Position=1 -204,251-436
MNNNFVKMVTEHTHEANIANVKAKKIVTGIKRRAAECMELPSQLRANAMVNVSTPVLAQLPSANGIKKIVKRVRHEIVAAPAAPNSIHDLQIGQAYQVYKRSEGVEEEQYLLSDSGVFSLNADNSQHRY

SEQ ID NO: 136490 - protein, 26 aa, Heterodera glycines
  Coding regions on vcDNA: vcDNA=SeqID_62913; Strand=-; Position=134-213
MTRCSVFVLTLLGVGMAHSLLMSGGS

SEQ ID NO: 136491 - protein, 27 aa, Heterodera glycines
  Coding regions on vcDNA: vcDNA=SeqID_62914; Strand=-; Position=1-143
TKIISVIIYKFLMFYCVFLTILPFSIP

SEQ ID NO: 136492 - protein, 89 aa, Heterodera glycines
  Coding regions on vcDNA: vcDNA=SeqID_62915; Strand=-; Position=1 -103,168-276,772-829
MGLAKQLKQELKYYHNLALIRNWNFWSSSATITLGVTPTKINSVRAEKGFNNKINPVDIANAQIFHVHMLLFFAYFAIFRQIFSDLNIP

SEQ ID NO: 136493 - protein, 83 aa, Heterodera glycines
  Coding regions on vcDNA: vcDNA=SeqID_62916; Strand=-; Position=1 -40,258-469
MIEDLALEVREMKGLPADHWKASDWRRRTLDRHHDAMKIGEAQAGDNSRGRHSHAADEEEALQSATIVDERDTWHVMPRKTAR

SEQ ID NO: 136494 - protein, 57 aa, Heterodera glycines
  Coding regions on vcDNA: vcDNA=SeqID_62917; Strand=+; Position=1-259
SHLSQCVHQRRDGIPGLDHPMGPFLREFMSSFPMFPICPPKLPSPNASTSTAHGRAT

SEQ ID NO: 136495 - protein, 18 aa, Heterodera glycines
  Coding regions on vcDNA: vcDNA=SeqID_62918; Strand=-; Position=1-54
STTRVLYWRILKSTTRVL

SEQ ID NO: 136496 - protein, 102 aa, Heterodera glycines
  Coding regions on vcDNA: vcDNA=SeqID_62919; Strand=+; Position=1-311
VLFALLKFPTPPFCCCCNAAASRARCLVNGGERLIIFTTRVLLENLEEHNTSALLENLEEHNTSALLENLEEHNTSALLENLEEHNTSALLENLEEHNTSAL

SEQ ID NO: 136497 - protein, 319 aa, Heterodera glycines
  Coding regions on vcDNA: vcDNA=SeqID_62920; Strand=-; Position=1-960
  Homolog annotation: Hit_ID=NP_504186.1; Match level="QueryCoverage =80%, HitCoverage=31%, E-value=1e-14, Identity=24%"; Hit description =vglm uuk m polyprotein like family member (5E780) [Caenorhabditis elegans] gb|AAB63927.1| Hypothetical pr
MCNSIRSETAIPELAELNNRPGHSFCMRSTSFWQNACGLPTASCLFYRWAAVPTTTTVFEEFTCLEWDMQISAWVELETNSGQVDTHRLTLHPGVSEQWGNMTIAVVPTSLPPMPALSAHFITDGRAVAMGKSLPSDLHCLDEEMARSFDKCQLSIGACQKCAPDHDNGTIHCHCRDLDVGRVMNNPEQRLPLDVARLHLHNNGPNVRGEFQYSPVQVHVQLNGLELISEYSNTKCWVTSPKLSGCYRCVSGATFNATCRTDYGTALAKIKCADGTLFAFHCGGNESTTTEAIPFDRAEVFAECKSEVPRRGTDTHIRT

SEQ ID NO: 136498 - protein, 281 aa, Heterodera glycines
  Coding regions on vcDNA: vcDNA=SeqID_62921; Strand=+; Position=1 -106,181-295,366-467,599-693,736-791,963-1121,1205-1414
  Homolog annotation: Hit_ID=NP_491292.1; Match level="QueryCoverage =96%, HitCoverage=17%, E-value=3e-56, Identity=45%"; Hit description =UNCoordinated locomotion UNC-89, PHarynx Muscle abnormal PHM-1, uncoordinated protein 89 (unc-89) [Caenor
MTIVRPMVGVDTGEYSCVAQNEFGRDRCACKSICGDAPERPSRPDVELSSDTEVYVCWEAPERLPVTLEGVMYRLECRPAGEKDAFSAWTVVSNCVEDEAAVVKHLIPMGVYQFRVTAHNEFGWGTPSITSRIIRTHPRGIPKLNLDVLRREGRQFTVEQREEEGREEEEENDEQMGDERAEEKNGNENNGNGKQRTVPLNTTEDPLKRFQLESELFRGQFSVIRYAVDSKTGAHCTVKIRAAPSHGSLMFAAPAERMRAARAEYETLAECQSANVARLIA

SEQ ID NO: 136499 - protein, 153 aa, Heterodera glycines
  Coding regions on vcDNA: vcDNA=SeqID_62922; Strand=+; Position=1 -27,847-887,946-1101,1174-1347
  Homolog annotation: Hit_ID=NP_491292.1; Match level="QueryCoverage =100%, HitCoverage=9%, E-value=1e-31, Identity=47%"; Hit description =UNCoordinated locomotion UNC-89, PHarynx Muscle abnormal PHM-1, uncoordinated protein 89 (unc-89) [Caenor
LEQTKGTLQTDMWGLGLCTFCLLAGFHPFADDDDTEQDIRRLAGFHPFADDDDTEQDIRRQVLEHRCDPNLIPVQASEEALRFVTWALKKDPRRRMRRMRPDEALDHRFLASDAAMVRRRENIRYASHRLMRTVQRRVRQQTIREERRSGTGR

SEQ ID NO: 136500 - protein, 118 aa, Heterodera glycines
  Coding regions on vcDNA: vcDNA=SeqID_62923; Strand=+; Position=1 -93,1390-1653
MDIPTFAANTTAEPAEPNEMSTVVEGGAEKTLGLPKGIQKAMPKYFAFTRPKSKQCHSSDDRFCVATEAKPTKTATECVCQQKMINGGKEAVAKTDQRMDQQLRAKSDQKFIESIWDK

SEQ ID NO: 136501 - protein, 177 aa, Heterodera glycines
  Coding regions on vcDNA: vcDNA=SeqID_62924; Strand=-; Position=1 -49,396-706,791-964
MDFVALRLSRLSESLHIFNHKLGVAIFRDEIPPKFESVENLSGGIFQLYFHGTSGRQSAVTVQKLDALFIQTVRSLFGMPSPIACHVHGLFYRCEINPGNRRDPISYGNLLDLPFMAKFEIWIDDVVNRRLIEQSFIAEFKNQIKAEEIPIRLPFRFNPNNLRAKKIVKSVESLSKK

SEQ ID NO: 136502 - protein, 66 aa, Heterodera glycines
  Coding regions on vcDNA: vcDNA=SeqID_62925; Strand=-; Position=1 -66,205-339
MYIQKTFEASNLNELEKRNNAIQDTHVDLNRAIGQPLASVLRSLAQIAYSKMQKNIVDKLNKQIKL

SEQ ID NO: 136503 - protein, 95 aa, Heterodera glycines; identical to SEQ ID NO: 125597
  Coding regions on vcDNA: vcDNA=SeqID_62926; Strand=+; Position=1-661

SEQ ID NO: 136504 - protein, 219 aa, Heterodera glycines
  Coding regions on vcDNA: vcDNA=SeqID_62927; Strand=+; Position=1-662
  Homolog annotation: Hit_ID=XP_146481.3; Match level="QueryCoverage =84%, HitCoverage=16%, E-value=8e-22, Identity=35%"; Hit description =PREDICTED: similar to carboxylesterase 2; carboxylesterase ML3; acylcarnitine hydrolase M1 [Mus musculus]
DSDSGRPRTELESEPIVGQDEEEEGEEENHLFVEDDEKEEEDYPEEPEELRALRREAEEEEEEREQEREEEEARAEEGGESSQKKEEGKDEEEERKRGKGEEEQNGEATEEEKGDQNEMEGRTELDEAAADQDGTNMEIDAKKEALVEHEQHGKEKKTERVADEHGKLGHEKSAHQQQQQKPFMLGVYSDELEQILYGEAAVKIQSAWRGYAVLDFRHD

SEQ ID NO: 136505 - protein, 231 aa, Heterodera glycines
  Coding regions on vcDNA: vcDNA=SeqID_62928; Strand=+; Position=1 -50,419-504,837-965,1206-1314,1364-1685
  Homolog annotation: Hit_ID=NP_500734.1; Match level="QueryCoverage =38%, HitCoverage=5%, E-value=2e-18, Identity=50%"; Hit description =LAMinin related (lam-1) [Caenorhabditis elegans] pir||T15099 hypothetical protein W03F8.5 - Caenorhabditis
MTQMVANIVTVILAALKVASRPTLRERKKVGKRGGKFSQKFVGDGCRIHPVNTKQCRKCGARIFAGSASDMDGRRFCSSAREHPPNICDPIGWEDLKITIVRPGEPSPDSICANALPSDDFISARLPPRSRFYEIHPAICLESDTRYEIRLYFGEKRRNAPDIRAHVNFITSTIYPPTCPGSIIFIQKFFWIRILITDCEELFDIFFDHSSTFRHWIVPKRFLATSFLWIG

SEQ ID NO: 136506 - protein, 204 aa, Heterodera glycines
  misc_feature (10)..(10): Xaa can be any naturally occurring amino acid
  misc_feature (142)..(142): Xaa can be any naturally occurring amino acid
  Coding regions on vcDNA: vcDNA=SeqID_62929; Strand=-; Position=1 -48,261-832
  Homolog annotation: Hit_ID=XP_318550.1; Match level="QueryCoverage =97%, HitCoverage=20%, E-value=4e-43, Identity=47%"; Hit description =ENSANGP00000020240 [Anopheles gambiae]
IEVLGKFQVXRSVQRTDSQSGIGATISHVFPNGVECVIEHASRTLTPAERNYAQIEREALSLIFAVQKHRMIYGRNFTLLTDHKPLLAIFGNKNGIPIYTASRLQRWALILSNYDFTIKFKSANFGHADVLSRLISEHRTDXEVIVAHTSDNDVDSTEEVEYALLVNLERLPVDAKEVSELTISDDLLQEMAQFVRSGWPNKCP

SEQ ID NO: 136507 - protein, 63 aa, Heterodera glycines
  Coding regions on vcDNA: vcDNA=SeqID_62930; Strand=+; Position=1 -155,756-792
MLLSPTVRRDSSKICTTFYCGKSKYLNWTITCQRTQSPLASYGTEKGGYQMGIFWGVQIVMKD

SEQ ID NO: 136508 - protein, 46 aa, Heterodera glycines
  Coding regions on vcDNA: vcDNA=SeqID_62931; Strand=-; Position=1-757
CQKLIENIDLYSGYSSVKNDATLAIRPRKKSSFEWYLQIKKRLSGS

SEQ ID NO: 136509 - protein, 63 aa, Heterodera glycines
  Coding regions on vcDNA: vcDNA=SeqID_62932; Strand=-; Position=1 -24,403-570
MANVKKWLDVFGSTAFYASNRLLRVQSQFARPIDFYASNQKFTRPIDFYASNQNFPKSNILLT

SEQ ID NO: 136510 - protein, 68 aa, Heterodera glycines
  Coding regions on vcDNA: vcDNA=SeqID_62933; Strand=-; Position=1-7,99- 298
MIKNGRGTESGRESRRVTESGKGTENGRGTENGIESGRGTESGIGKENGRGTENGRESGRRTEGVVLV

SEQ ID NO: 136511 - protein, 19 aa, Heterodera glycines
  Coding regions on vcDNA: vcDNA=SeqID_62934; Strand=-; Position=1-58
GPGSRSRILKSSGPGPGRA

SEQ ID NO: 136512 - protein, 50 aa, Heterodera glycines
  Coding regions on vcDNA: vcDNA=SeqID_62935; Strand=+; Position=1 -62,757-847
MDLTRPATVLGTIATMRMFFRIFSSVQMVQWLIFLLVFYFFPLVQSLFCN

SEQ ID NO: 136513 - protein, 88 aa, Heterodera glycines
  Coding regions on vcDNA: vcDNA=SeqID_62936; Strand=-; Position=1 -96,1394-1564
MPRGDAATFAERRAQLAHVKDKRTDRENCWKRVIIIVFFKFVRRAWYALWAFVFAIALLIWLLIVCAVCHWSRRHNGRSAYDNIVVNR

SEQ ID NO: 136514 - protein, 202 aa, Heterodera glycines
  Coding regions on vcDNA: vcDNA=SeqID_62937; Strand=-; Position=1 -241,1102-1328,1852-1992
MAFSDFALETWPICQTEFIPVAQQQRTRFQVDAYVASGVPAFVYSFDFVPRGDVVEEDRRFYPMFGERPVGVRRRDRKRKGFLSNISMPIYSTDQLMDIFFVIVQINTDLIIKICLQFDSDDHKFCGHRRSVDEEFQLATMRQRHNATRFTEHAAKPANYRMNRGPIHFPTPTFWNDEVRMLSKYQMADPSGRANEQAVNEL

SEQ ID NO: 136515 - protein, 318 aa, Heterodera glycines
  Coding regions on vcDNA: vcDNA=SeqID_62938; Strand=+; Position=1-955
  Homolog annotation: Hit_ID=NP_913627.1; Match level="QueryCoverage =94%, HitCoverage=20%, E-value=1e-26, Identity=32%"; Hit description =putative helicase [Oryza sativa (japonica cultivar-group)]
MRQLLANILIFGATENCLIDGALLWDKFLHHMCDLRCTDAERPARIDRALVLLEKLLVRLGKQCKDYGLPTPTISIMNNPQLGLDEFFFPQHANDDDADDIDTSSYERGKLNIEQQKFFDLVKTAFIDSRCSRLFYLYGDGGTGKTYLLNYILYHLRRIGAKIIPTASTGMAATRFYAGGTTVHSAFKFGINVEPGKLPSIPFDSFFGRRIIECDIIIIDEMTMLERTVLENIDALCRLMCLQKQHLPFGGKCVIISGDWKQSLPVVTDSYGSPAQVSACIQSSPLYSLFTKFKLTQSMRVNPKEIEFLKWLDDVGKR

SEQ ID NO: 136516 - protein, 74 aa, Heterodera glycines
  Coding regions on vcDNA: vcDNA=SeqID_62939; Strand=-; Position=1 -52,407-512,552-618
MLILSFFILFAFFGFADGNNSFCTDNFESNCLEFAKLVAKRADGFDECLLAAGATNCAGRLACCEKYGQQSCIC

SEQ ID NO: 136517 - protein, 87 aa, Heterodera glycines; identical to SEQ ID NO: 135209
  Coding regions on vcDNA: vcDNA=SeqID_62940; Strand=-; Position=1 -269,436-490

SEQ ID NO: 136518 - protein, 103 aa, Heterodera glycines
  Coding regions on vcDNA: vcDNA=SeqID_62941; Strand=-; Position=1-604
IIFIQKKFFFGFRGSTMNRCAQIYGETESFGNSFPIACTLILRWIFAPHNCLSTPNGHLKKSIFLFSGQSPRTDAPRFMGRPNPSGIASIYLYFIFTLDFCSP

SEQ ID NO: 136519 - protein, 153 aa, Heterodera glycines
  Coding regions on vcDNA: vcDNA=SeqID_62942; Strand=-; Position=1 -75,130-516
MKKELITVAENKDIFDKIKFRTKFEVSHAVWNPKISLIALGSLDGEVVVKRYLWKTGWKVLLLNSISLNFSLFNFREIFLVMILPNTLIFLAMFRPFRRPPSRRISCCFCVGPPMAKCFSLFSKVAYSIIWTLKLATLFSLKNCHIRLFALNG

SEQ ID NO: 136520 - protein, 384 aa, Heterodera glycines
  misc_feature (2)..(2): Xaa can be any naturally occurring amino acid
  misc_feature (7)..(7): Xaa can be any naturally occurring amino acid
  misc_feature (111)..(111): Xaa can be any naturally occurring amino acid
  misc_feature (141)..(141): Xaa can be any naturally occurring amino acid
  Coding regions on vcDNA: vcDNA=SeqID_62943; Strand=-; Position=1 -357,386-514,594-668,747-958,1011-1085,1167-1333
  Homolog annotation: Hit_ID=NP_502180.1; Match level="QueryCoverage =97%, HitCoverage=86%, E-value=3e-84, Identity=43%"; Hit description =mammalian RIB-affecting EXT family related (44.9 kD) (rib-1) [Caenorhabditis elegans] emb|CAB61014.1| Hyp
IXSDLQXYIVIAFNPNYTNLENPKDGIESCSMSNCFNFSKCSKSMKIYVYSDGSPVRRSPLFTKMLKVIKESHFYTERAEEACLFVLSADTTDRDRSKQTANDNAKSHFKXVLPALWDDGRNHLVFNLYFGTFPDYANTDXVLPALWDDGRNHLVFNLYFGTFPDYANTDLGFDFGKAMVAWASSNLQNFRPNFDLSFPLFNNEHPFKDDKPWHFQHFQPHFPNHDKYLASFKGKRYVYGVGSKTRNILHHLNDNRSIVIATTCKHNTDWKKFEDERCEVDNANYGRWDYEQLMANSTFCLIWDYEQLMANSTFCLIPRGRRLGSFRFLEFLEALRSVCIPVILSDEWVLPFSEVINWSEAVILGKKRTALIVSRLLKPLKRIL

SEQ ID NO: 136521 - protein, 32 aa, Heterodera glycines; identical to SEQ ID NO: 127531
  Coding regions on vcDNA: vcDNA=SeqID_62944; Strand=-; Position=1-248

SEQ ID NO: 136522 - protein, 225 aa, Heterodera glycines
  Coding regions on vcDNA: vcDNA=SeqID_62945; Strand=-; Position=1 -218,246-345,413-519,578-713,759-875
  Homolog annotation: Hit_ID=NP_740984.1; Match level="QueryCoverage =30%, HitCoverage=21%, E-value=2e-10, Identity=49%"; Hit description =SH2 motif (2F277) [Caenorhabditis elegans] gb|AAM15611.1| Hypothetical protein T27F7.2c [Caenorhabditis e
MDVGPMIEELEKLAYFCRSQEKWAFGNGLGWKKSKIQRLCDEPFAGNARWPFRAATVRHEAKVNGIRSLPFKKFLALSIRVERDEKNQKGIAHYLVLRNEHGFRIKGSKRYFQSLPMLITHHSVITDQLPCRLLLSDWRWTRGDANQRRRQSSGGSTLAVLRATEENKAGNPSGGGGQRQNAADGTTIRWRKDALYSMARRQNGGHRRTNSSTLISSQSSTFLSA

SEQ ID NO: 136523 - protein, 154 aa, Heterodera glycines
  Coding regions on vcDNA: vcDNA=SeqID_62946; Strand=-; Position=1-462
MQISLGKCFSHLQAPPPLLSHSLRKVCCAVCRVRTAQLAYITREQHSHHGHHVPGRKLCHVFRVSTPLNAQHIQTALADAFRQQKQWEEAAGEADEMANCHMENGKNDDGTTTMLMAWHPPDNAMAICRGKANFGSDGGTAAAGEHLLNTPTKR

SEQ ID NO: 136524 - protein, 33 aa, Heterodera glycines
  misc_feature (8)..(8): Xaa can be any naturally occurring amino acid
  misc_feature (22)..(22): Xaa can be any naturally occurring amino acid
  Coding regions on vcDNA: vcDNA=SeqID_62947; Strand=-; Position=1-99
VAISTNFXAAVPQRQRSNLLMXERHAVQQRNDD

SEQ ID NO: 136525 - protein, 26 aa, Heterodera glycines
  Coding regions on vcDNA: vcDNA=SeqID_62948; Strand=-; Position=1-78
WQHGKSYSELIAFSKPLNSFALLICT

SEQ ID NO: 136526 - protein, 56 aa, Heterodera glycines
  Coding regions on vcDNA: vcDNA=SeqID_62949; Strand=-; Position=1 -111,344-403
MPRISAFNSWRSERMSFSRLRTSEQRSWLALSKKPPKRLSIQTKVSQIPKPKPEFE

SEQ ID NO: 136527 - protein, 1224 aa, Heterodera glycines
  Coding regions on vcDNA: vcDNA=SeqID_62950; Strand=+; Position=1-3673
  Homolog annotation: Hit_ID=NP_499726.1; Match level="QueryCoverage =73%, HitCoverage=40%, E-value=1e-107, Identity=29%"; Hit description= predicted CDS, RNase H integrase-like protein family member (3O318) [Caenorhabditis elegans] pir||T26836
MYVDNLLIECETEEEAIDKSSNAKQILKDADMNLREFLSHSPNVMGRLPEDDRLDKTPAKVLGLTWDTPRDCITFSLPKDTDITATRRSVLSIIASTFDPLGLVGPCLLPAKRLFQRLWGEGTAWDTPLPETEAETWIQTLSLWQNQTIVVPRHSILGKQSRLQLHVFCDASEHTFAAAVYIRSETADNSQANLIFAKNRLRPRTANQRFTIPRLELLAILVGIRAMRFAEKELRRPIEERHLWSDSQIALSWVKSEEPKAQFEQRRLVEIRQGPTTTFHFVRTDQNPADIATRGCTPAELCTRQMWWKGPEWLTNLETEWPDELTFATPASHPSPDFPCEDSEPKTLLVKQSQVPPPLVDPARFSTMLTLLGTTILILQFIGRCRPKWLTIGASTIPKSGPPTGDAFRAARTFLIRQDQHRLLNGYDKHPTVVNEDGLLCLKTRLIYATGPPTLASPVLLDRHSPLTRLIVQEVHADLKHAGVDWTLTEFLGRYWMPQARRTIRGILQGCPSCRRITAPPFARPTMPPLPPMRVKPANPFEFVGLDFAGPTSSRLSDGSLTKTYLVIITCFVTRAVYLEATTDLSAPSFINVLRRFISRRGRPKRILSDNAPTFVQTSKALDILTGPSAKTDPVTFAARRGIQWDFIPAYSPWMGACYERLIGLVKSCIKRTIGRRILDYDDLSAFLAEIEASVNSRPITWVSDQPDSSKALTPKDLVQPGLLNDLDIADSDLDYDGGISGPERLAALWKAYREAADHFWLKWSHEYLIAIRERAGWTHKGPRLRAPTAPRVGQVVIIEEDFRPRNLWPMGVVAALNGSPPNVRSVQLRLPNGQTITRPISRLCPLETENEAPEPALDATKSTPTNQRSRDFKTAEVSVPEMPTVPAPSGEPMVHPHHHGMLTRRKARLLGIAPNTTMAFAFLVTFLWAQVSPTQGLWPFPDHPKPSPGSDCVGNHLNCTLRGVKISSNSAVQKVTICCFDSCFDRLAAATIDYELSSDLLVNEYSCSTTYSLSSTRNCIDEITCPALDECELIDCALCVEQLVNWRCNPRLALALFLLTGSLISCLIGWVVCFCSSVRLGIKLGYRIIALLLSWPLRVAFFIAGHPWTREDRERVAERLETGVQRVRRQTRQRIQNARQHGKRAQRAAIRLIGILLATPALLCNTETISVITQTESCLKGPSGLTCRINTATTLTLLPAGQTSALLLRNSRETPSGPSNYAY

SEQ ID NO: 136528 - protein, 61 aa, Heterodera glycines
  Coding regions on vcDNA: vcDNA=SeqID_62951; Strand=-; Position=1 -120,452-515
PNVKLFNATAVEDLIIKRQQQSETGEGPGKSVQQQQHVVGDSGGTESSQSKLYGPKHSDGQ

SEQ ID NO: 136529 - protein, 109 aa, Heterodera glycines
  Coding regions on vcDNA: vcDNA=SeqID_62952; Strand=+; Position=1-329
PGLKCPAEAKNFFYFLKKIENFPKKLPIDRARKTMFWKWSSFFWENSLKNPKIQKPENRFLGLARKILKIFEILKFGKIGLLNSTISLLATLRSGQTLMSYSAGTEVGK

SEQ ID NO: 136530 - protein, 54 aa, Heterodera glycines
  Coding regions on vcDNA: vcDNA=SeqID_62953; Strand=+; Position=1-162
MDSFDHKTALPTNGPSAADQQHQPPAEEVKPSAEEAAANASPPSPSSSADSAKG

SEQ ID NO: 136531 - protein, 74 aa, Heterodera glycines
  Coding regions on vcDNA: vcDNA=SeqID_62954; Strand=+; Position=1-224
MPANDGVLAESNVTKTDDDCGGSDEDIQIVETDEQRKTHDELRQKAAEALIREAKRSAKGEKSNIRKNSALVKR

SEQ ID NO: 136532 - protein, 85 aa, Heterodera glycines
  Coding regions on vcDNA: vcDNA=SeqID_62955; Strand=+; Position=1 -81,992-1168
MCGFSAAVPDKGDQRLFISGPGVWYWQHGFRDPVHILGHDQWGRFGHAVAAAGDLNGDGFQGKKSLSFTTQTFISLFGSVGGCTI

SEQ ID NO: 136533 - protein, 173 aa, Heterodera glycines
  Coding regions on vcDNA: vcDNA=SeqID_62956; Strand=+; Position=1 -75,144-174,251-399,454-507,710-869
  Homolog annotation: Hit_ID=CAE71248.1; Match level="QueryCoverage =93%, HitCoverage=67%, E-value=4e-47, Identity=59%"; Hit description =Hypothetical protein CBG18124 [Caenorhabditis briggsae]
ASAKCAREDCGKTVYPLEELKCLDKVWHKTCFKCTDCGCGMILSMKSYKGYDKKPYCQAHYPKTVPSAVAATPEMEQAKRNTAYQSQVKYHEAYEKQMKGTKVKYHEAYEKQMKGTKMEVADDPETMRHKANMVNQSLAHYHGELQKKEKQDSQRDTTAGSPRLVSQSFAVLT

SEQ ID NO: 136534 - protein, 88 aa, Heterodera glycines
  Coding regions on vcDNA: vcDNA=SeqID_62957; Strand=-; Position=1-267
MINDENANNNANNSAEQSGENAAASELRRRRNATRSEESAEEQRETANTARDAANGARDGHGEVADADQLSEPEQEEEHQQQQQSMNK

SEQ ID NO: 136535 - protein, 69 aa, Heterodera glycines
  Coding regions on vcDNA: vcDNA=SeqID_62958; Strand=-; Position=1-208
MVGAEHENSAPPIDDEQHKLVEEEEEEDNNDEDEDDNNQQPNGSDQALNRPSPTDRRHPTAQSPQKDSA

SEQ ID NO: 136536 - protein, 87 aa, Heterodera glycines
  Coding regions on vcDNA: vcDNA=SeqID_62959; Strand=+; Position=1 -58,111-277
  Homolog annotation: Hit_ID=NP_741400.1; Match level="QueryCoverage =93%, HitCoverage=6%, E-value=2e-24, Identity=70%"; Hit description =metabotropic glutamate receptor mGluR7 (4G215) [Caenorhabditis elegans] gb|AAM97973.1| Hypothetical protei
IFICSFFGPIYFATQNNFKIQLTSLCMAIALIQLTSLCMAIALSGTVALACFFCPKVYICLFQPYKNVRTRSSAVGKLVNQQMRFIS

SEQ ID NO: 136537 - protein, 206 aa, Heterodera glycines
  Coding regions on vcDNA: vcDNA=SeqID_62960; Strand=-; Position=1 -70,138-223,275-337,442-513,572-662,719-788,965-1005
  Homolog annotation: Hit_ID=NP_872183.1; Match level="QueryCoverage =98%, HitCoverage=28%, E-value=2e-60, Identity=63%"; Hit description =calcium-activated SK potassium channel and Calmodulin binding domain containing protein family member (5U
LGYGDVVPTSYCGRFLSITTGIVGAGVSSALIAVIGAGVSSALIAVISRKLELSRAEKHVNNFMADSKLTADSKLTNACKNAAASVLQHTWFIHKYQQRKQKGDELRLRQHQRKFLNAINEFLNAINEFRRIKWDQRKLQDKGNLLLDVGKLHAEMHETLWEMHRTQETLHAEMHETLWEMHRTQETFAGMIEVLTKRIVELQNIV

SEQ ID NO: 136538 - protein, 131 aa, Heterodera glycines
  Coding regions on vcDNA: vcDNA=SeqID_62961; Strand=-; Position=1 -55,399-664,1214-1285
  Homolog annotation: Hit_ID=NP_872183.1; Match level="QueryCoverage =68%, HitCoverage=11%, E-value=2e-18, Identity=55%"; Hit description =calcium-activated SK potassium channel and Calmodulin binding domain containing protein family member (5U
MPFVSFIEIAVCAVCPFPALNRISMDFRFVIKTMMADHPMTVLVSLHLKTYIRRPFAIHSIVPSFSIIFTASYWVCMSWMFTQCERYNEGYTGSTEMVYSNSFWFIMVHPQIPAEKWTKGRRTQTETAPEK

SEQ ID NO: 136539 - protein, 82 aa, Heterodera glycines
  Coding regions on vcDNA: vcDNA=SeqID_62962; Strand=-; Position=1-246
  Homolog annotation: Hit_ID=NP_012721.1; Match level="QueryCoverage =98%, HitCoverage=12%, E-value=4e-17, Identity=56%"; Hit description =Mnn4p [Saccharomyces cerevisiae] sp|P36044|MNN4_YEAST MNN4 protein pir||S78475 mannosylphosphorylation pr
MEEKKIEGCSIKRKWNEVKKITEEKEEKRKKEEEKKKTEDEKKKAEEKEEKRKKEEEKKKEEPKKKKKAEEEKKKTEEEKKK

SEQ ID NO: 136540 - protein, 49 aa, Heterodera glycines
  Coding regions on vcDNA: vcDNA=SeqID_62963; Strand=+; Position=1 -59,129-219
MLHRRSSDSRLNAFLRGELAPSIVPDFCDTSVFKTIVERARKVCEIYLS

SEQ ID NO: 136541 - protein, 45 aa, Heterodera glycines
  Coding regions on vcDNA: vcDNA=SeqID_62964; Strand=+; Position=1-135
MIYKACAMFKAPKKPHNDRFSNLRTLQQLKGIMSKKKQLSNKPSS

SEQ ID NO: 136542 - protein, 63 aa, Heterodera glycines
  Coding regions on vcDNA: vcDNA=SeqID_62965; Strand=-; Position=1 -61,197-327
  Homolog annotation: Hit_ID=AAP30760.1; Match level="QueryCoverage =96%, HitCoverage=33%, E-value=8e-16, Identity=58%"; Hit description =putative gland protein G10A07 [Heterodera glycines]
MRTILFMAMVCLVMAVLMEMAAVAASPAKGKASPKGFETAKKAKPAKKVKAAKAIKGEPKTGN

SEQ ID NO: 136543 - protein, 102 aa, Heterodera glycines
  Coding regions on vcDNA: vcDNA=SeqID_62966; Strand=+; Position=1 -147,206-367
MANAYIWMIFCVIYGITSSSLPSRSFSPGCTAWFFNPHFGYINDPKREIYRNKLLTIYDYTMATVLTSYICPFCLFSSSKLALNTAKLAYRIQPMAYKRRKW

SEQ ID NO: 136544 - protein, 43 aa, Heterodera glycines
  Coding regions on vcDNA: vcDNA=SeqID_62967; Strand=-; Position=1 -45,222-308
MQRNENPIQQLIKCMGPAKLVTQIYEHIWGSRPLGTQQPGSRW

SEQ ID NO: 136545 - protein, 45 aa, Heterodera glycines
  Coding regions on vcDNA: vcDNA=SeqID_62968; Strand=+; Position=1 -123,492-506
MVYCEPGDMVQGEVFLVASLIVVIFTLPTIVIYIIMGIMLKQRIS

SEQ ID NO: 136546 - protein, 153 aa, Heterodera glycines
  Coding regions on vcDNA: vcDNA=SeqID_62969; Strand=-; Position=1 -138,187-507
  Homolog annotation: Hit_ID=NP_054733.2; Match level="QueryCoverage =100%, HitCoverage=7%, E-value=4e-54, Identity=65%"; Hit description =activating signal cointegrator 1 complex subunit 3-like 1 [Homo sapiens] sp|O75643|U520_HUMAN U5 small nu
MAFAQGSHTMSNKKCVLPDGSQRTQKKSYESIYVPPLKPKPFGENEKLIEIEDLPKWARPAFQGYRTLNRIQSVISQKALHTDGNLLICAPTGAGKTNVALMCILREMSKHMNEDGTVRKDEFKCIYVAPMRSLVQEMVGSFKQRLEEAYGIT

SEQ ID NO: 136547 - protein, 108 aa, Heterodera glycines
  Coding regions on vcDNA: vcDNA=SeqID_62970; Strand=+; Position=1-327
  Homolog annotation: Hit_ID=XP_419676.1; Match level="QueryCoverage =97%, HitCoverage=35%, E-value=1e-12, Identity=34%"; Hit description =PREDICTED: similar to chromosome 6 open reading frame 211 [Gallus gallus]
MRYRMMTDKSLEPISSEFPDAALWNNEIDQLNKVREEGENCIFMIKKGRKETQSKANESDGSANWYGSPWMFVECYMYRRIRQFFQQSQFLREFDPFNEDKEKSYKDR

SEQ ID NO: 136548 - protein, 50 aa, Heterodera glycines
  Coding regions on vcDNA: vcDNA=SeqID_62971; Strand=-; Position=1-152
MANKVAADGIEMKRTPPDLSPQSLRVLSAARGTRPGQAGTTRDGKHLARR

SEQ ID NO: 136549 - protein, 73 aa, Heterodera glycines
  Coding regions on vcDNA: vcDNA=SeqID_62972; Strand=+; Position=1 -71,194-344
MALDPGKNPGLDPGLGRSLILMLLECQQFRRVQKFVPIFWLSFACSPVPFGHFAKCCKLKWTKCPCQFHWIVC

SEQ ID NO: 136550 - protein, 29 aa, Heterodera glycines
  Coding regions on vcDNA: vcDNA=SeqID_62973; Strand=-; Position=1 -20,392-461
MTVFDHVPILCSLFCSFSTLGIIIMHLMH

SEQ ID NO: 136551 - protein, 149 aa, Heterodera glycines
  Coding regions on vcDNA: vcDNA=SeqID_62974; Strand=+; Position=1 -102,183-444,852-937
  Homolog annotation: Hit_ID=NP_510539.1; Match level="QueryCoverage =76%, HitCoverage=24%, E-value=4e-18, Identity=39%"; Hit description =general substrate transporter family member (52.2 kD) (XP951) [Caenorhabditis elegans] emb|CAB60332.1| Hy
MKFKIIFIFMFNKKFNSEFASLKLFLALNVTQNLNISSPADFTVLNESFVIPHTVPYSSVEKSRLLYAVGLASMVSTFPFSALYTRYGARYVFFAAGVISTLATALLPLAAAHGMAAFMVIRLAYGANFAAIGFVCHRWATLRQHGFFL

SEQ ID NO: 136552 - protein, 68 aa, Heterodera glycines
  Coding regions on vcDNA: vcDNA=SeqID_62975; Strand=+; Position=1 -21,441-626
MSVVLLVANIFFWFFADDQPAKFTKEKMKIRKQNHQNNLEAPAKLASAEKAKDGGEPIGRKRIAQHWI

SEQ ID NO: 136553 - protein, 69 aa, Heterodera glycines
  Coding regions on vcDNA: vcDNA=SeqID_62976; Strand=+; Position=1-6,70- 273
MLANIFFWFFADDQPAKFTKEKMKIRKQNHHNNLEAPPKLASAEKAKDGGEQMGENELHNIGFRTNKIN

SEQ ID NO: 136554 - protein, 84 aa, Heterodera glycines
  Coding regions on vcDNA: vcDNA=SeqID_62977; Strand=+; Position=1 -148,224-330
MFRFDEQNETRPPAKKVAKIANSDTDATPRGPILIEFFKIFTNYLEFPKLNNKLSTVTFRCLATPHKNVMIPIKENSFLGSFRR

SEQ ID NO: 136555 - protein, 92 aa, Heterodera glycines
  Coding regions on vcDNA: vcDNA=SeqID_62978; Strand=+; Position=1 -20,609-865
  Homolog annotation: Hit_ID=NP_492273.1; Match level="QueryCoverage =97%, HitCoverage=17%, E-value=5e-34, Identity=73%"; Hit description =adrenergic receptor (1I963) [Caenorhabditis elegans] emb|CAB01500.1| Hypothetical protein F16D3.7 [Caenor
LSRLKTSEQLPFPIVLILSVPAMLIILLTIFGNLLVLFFKARVGRTNTTLLVWNLGLTDFMVGILVLPMGAYYLLNRRWIFGPMLCRIWVRA

SEQ ID NO: 136556 - protein, 168 aa, Heterodera glycines
  Coding regions on vcDNA: vcDNA=SeqID_62979; Strand=-; Position=1 -212,502-796
LISHYGISSTPVIALWQDGFPRYRLYDDYARLDTLLRVLRTHTDLTPAAAVGDSNSSSPSPYHGTVGQQQRKMLPREHQQQQINEKEAEEKSAVIVDGSGGDDSVQNEPPQQQQNDGGGEDGGGGATTTAPSEEAKGAGSSSNGQQQPPPQQQKQQQKHQWQQHSPLP

SEQ ID NO: 136557 - protein, 39 aa, Heterodera glycines
  Coding regions on vcDNA: vcDNA=SeqID_62980; Strand=+; Position=1-119
CVWGTLTIMGSENPPQNYSTGYMEDIPEGFCLPKIWAHL

SEQ ID NO: 136558 - protein, 101 aa, Heterodera glycines
  Coding regions on vcDNA: vcDNA=SeqID_62981; Strand=+; Position=1 -205,465-565
MHPIKKFLFLYLILYQSVKVEQKPVHRRAILTVLAIGGIAALVLIPIVVGSAVVGYLISYSIHGVNGKYHEGNRQRHARSAQIEMFLYFAVKKDNLKISMC

SEQ ID NO: 136559 - protein, 52 aa, Heterodera glycines
  Coding regions on vcDNA: vcDNA=SeqID_62982; Strand=+; Position=1 -115,1130-1173
MNIMKALFFIRQFVKICCRLATVGALDSARGAAARPGKIIYYIYIFYKQTHN

SEQ ID NO: 136560 - protein, 31 aa, Heterodera glycines
  Coding regions on vcDNA: vcDNA=SeqID_62983; Strand=-; Position=1-93
FVAFQNFAQHFLVNLQKSLRFDQSVGILVNV

SEQ ID NO: 136561 - protein, 31 aa, Heterodera glycines; identical to SEQ ID NO: 126976
  Coding regions on vcDNA: vcDNA=SeqID_62984; Strand=-; Position=1-93

SEQ ID NO: 136562 - protein, 93 aa, Heterodera glycines
  Coding regions on vcDNA: vcDNA=SeqID_62985; Strand=-; Position=1 -130,239-357,595-627
MHYFDIACLLGYIMDKIHTWLVNRRLDPTSLAKNAWSKFKQYKVTKAISRITEHTVENDDDGGCAICLGAYEIGDKVRTLPCEPKISHGMHKP

SEQ ID NO: 136563 - protein, 51 aa, Heterodera glycines
  Coding regions on vcDNA: vcDNA=SeqID_62986; Strand=+; Position=1 -71,248-332
MVVGQQNLLLFCIYYAVFLITKKSTTEWALFCQSTYIQVQKGSVQRLAICS

SEQ ID NO: 136564 - protein, 146 aa, Heterodera glycines
  Coding regions on vcDNA: vcDNA=SeqID_62987; Strand=+; Position=1 -163,529-715,1326-1416
MHPGIQFPEPLQNFSPEPLDLMYGLVMLKDLSLEQLLLYVQPGSYFYPDSPTDEINEMVQQSKWEEKEGRRYNWTDSNSMPFADWEVGAKVPKTTKTPPPAQPPPLPIFAESQKDKLRHLMPSPVPHFTISKFDPKYKMAFNYKNW

SEQ ID NO: 136565 - protein, 154 aa, Heterodera glycines
  Coding regions on vcDNA: vcDNA=SeqID_62988; Strand=-; Position=1 -138,485-549,600-860
  Homolog annotation: Hit_ID=NP_492343.2; Match level="QueryCoverage =100%, HitCoverage=36%, E-value=1e-59, Identity=68%"; Hit description= CYcloPhilin (cyp-14) [Caenorhabditis elegans] emb|CAB10726.2| Hypothetical protein F39H2.2a [Caenorhabdi
MAVLIETTLGDLVIDLFVDERPNACKNFLKLCKTKYYNLCQFFTIEPNYIAQTGDPTNSGRGGESIYGTLFGEQARFIEMENVPKLRHSQRGIVSMVNNGDGMVGSQFFVTLGDELDYLDGKHCIFGQVGEGMDTVTKLNEELVDRNNRPYRDI

SEQ ID NO: 136566 - protein, 119 aa, Heterodera glycines
  Coding regions on vcDNA: vcDNA=SeqID_62989; Strand=+; Position=1 -140,287-386,496-615
  Homolog annotation: Hit_ID=CAE66560.1; Match level="QueryCoverage =63%, HitCoverage=25%, E-value=3e-12, Identity=42%"; Hit description =Hypothetical protein CBG11872 [Caenorhabditis briggsae]
MPCQLPNEIATVTDDVFSYMCNLAMEKCSKKADKKKASCGGAAMRKRLLIKNFVAQMLAQDRHSRELSSPTSDCSSHLNQTFDESFDFPSCQSGANAVDQFGDDMEMDAIGEEVSERFL

SEQ ID NO: 136567 - protein, 174 aa, Heterodera glycines
  Coding regions on vcDNA: vcDNA=SeqID_62990; Strand=+; Position=1-525
VPSNATNDAFLCLDQPSSLLTDLDDVSCDPQQQCHSSRNRKRPWSLVFSADATATADSMPMPSLCSMGVVVDQYNHHHLSNTNNSVVDMFTAATSAQHHHFINSTANNINNNGVLHSSAPPLLSPLCCGMLQMSPFGSATAAGEAMLFNGAGGGAGGVGTGGRVEQPMLKRVKL

SEQ ID NO: 136568 - protein, 185 aa, Heterodera glycines
  Coding regions on vcDNA: vcDNA=SeqID_62991; Strand=+; Position=1 -87,279-352,546-942
MPQFTKRPFRVPSAHSVDKFVDEFLKSDGLFILRLVATNAGELVVVDIVKCLWREFSSRQFHIRPLVYENELSEERRREDEDSHHSLLLNVYSSRGNGPTHQQQQRKQSQQLRLVVQNIWKTKFELLSDIPLMATASAFHSRQCLGRLLWSHWTILSAHRRPSDEEEKEANGRRHSQRMDAMPSD

SEQ ID NO: 136569 - protein, 169 aa, Heterodera glycines
  Coding regions on vcDNA: vcDNA=SeqID_62992; Strand=-; Position=1 -45,202-292,556-929
  Homolog annotation: Hit_ID=EAA16160.1; Match level="QueryCoverage =65%, HitCoverage=9%, E-value=9e-12, Identity=33%"; Hit description =rhoptry protein, putative [Plasmodium yoelii yoelii]
MKKGIALPPENLSEVKARVDLAKAKELLGNLAAHMLPVHLGQLRNFLFALYETFATFNQLAIDRTDSQNQNVAVRGENAGLRALNVGLRDENVSLLAEHVSLRAENVSLRAENVSLLAENAGLRDEKISLRDQNVAVRAENAGLRDENVSLRAESDVLRAKIETLQSMI

SEQ ID NO: 136570 - protein, 28 aa, Heterodera glycines
  Coding regions on vcDNA: vcDNA=SeqID_62993; Strand=+; Position=1 -82,723-727
MAKKGIDRACRKVAFKTIGIFKNDFDSV

SEQ ID NO: 136571 - protein, 40 aa, Heterodera glycines
  Coding regions on vcDNA: vcDNA=SeqID_62994; Strand=+; Position=1-125
TISRGGKTGEEIEKALVEMWKRLESDIPRADRQCSNSVID

SEQ ID NO: 136572 - protein, 349 aa, Heterodera glycines
  Coding regions on vcDNA: vcDNA=SeqID_62995; Strand=-; Position=1 -184,228-331,447-650,842-1186,1221-1433
  Homolog annotation: Hit_ID=NP_509255.1; Match level="QueryCoverage =87%, HitCoverage=53%, E-value=1e-11, Identity=24%"; Hit description =predicted CDS, ac-like transposable element family member (XI27) [Caenorhabditis elegans] gb|AAC46515.1|
MGKRWRKNFNHKHQNNGNDRSGPAATCWSSKDAAHSLLSVTCHFIYEGQLKFVVLAAKPIKGRHNATVLKDLLMKVFVEFSLEKSKNFVVLRDAAEAIWDGVRKLNDDESTKSLLERIKKFVRKLKKSPVQKEQFENLQKLLELPKLSLTKDTEVLNELYISKIILSQIHSATNDLQKRGTPISAMIPLFRVICFALEEEGDLKHVKKAITDGLKHRMDAKIDASGNVKRFSWDESRELVLSTILDPRFKLSFLNAEKHDRYKIWLTNEAEMSKTLRCFDLIITEVCETDQIQSQGSSEFHDLFSRCEQNIATECGLDITAQPLPSPETLNNRQKAEVIIIKFSKSICF

SEQ ID NO: 136573 - protein, 103 aa, Heterodera glycines
  Coding regions on vcDNA: vcDNA=SeqID_62996; Strand=+; Position=1 -126,258-443
MLFLLLLFSSAPFALLFLPLDIFFTQIVPAKGGNGGGKGGCYGYCEKFNALEDDLEKMKQIKANAECFVDDMGKVIKGFEKKLNKLRTSVTKLEEENESLTGD

SEQ ID NO: 136574 - protein, 64 aa, Heterodera glycines
  Coding regions on vcDNA: vcDNA=SeqID_62997; Strand=-; Position=1-192
MELCHLLRSFANVRPDGLRPTDRMHDAIQCPRGQPTEFGDRGESVAGEERNEGMGVGTEHGRSE

SEQ ID NO: 136575 - protein, 23 aa, Heterodera glycines
  Coding regions on vcDNA: vcDNA=SeqID_62998; Strand=-; Position=1 -55,557-573
MEPISGKSAFQANGRAFGESLCR

SEQ ID NO: 136576 - protein, 85 aa, Heterodera glycines
  Coding regions on vcDNA: vcDNA=SeqID_62999; Strand=-; Position=1 -55,945-1147
MFVIQIIFIATIFTLWVKKFTKILSNKELVAMNSASNTTTLAPSLIVSTKMGCTSASVTAVTNQPYNEHTVQADYISLVTKVTTK

SEQ ID NO: 136577 - protein, 124 aa, Heterodera glycines
  Coding regions on vcDNA: vcDNA=SeqID_63000; Strand=-; Position=1 -164,219-269,1308-1412,1472-1524
  Homolog annotation: Hit_ID=CAE64619.1; Match level="QueryCoverage =100%, HitCoverage=18%, E-value=3e-42, Identity=51%"; Hit description= Hypothetical protein CBG09377 [Caenorhabditis briggsae]
EYLSQKGFVHRDVAARNILVQDKTYAKIGDFGLCRFIYADSSNYKSRGGRLPIKWMAPEAIRHYEFTTSSDVYRVMCSCWTGDPRMRQDFAQIRQQLALQLENVSDEYAYLKLDAKKDYYNVSY

SEQ ID NO: 136578 - protein, 35 aa, Heterodera glycines
  Coding regions on vcDNA: vcDNA=SeqID_63001; Strand=-; Position=1 -43,118-182
MSEVGTRNSVPSLIAFFSFLPSMMQGLSPIKDASN

SEQ ID NO: 136579 - protein, 281 aa, Heterodera glycines
  misc_feature (7)..(7): Xaa can be any naturally occurring amino acid
  Coding regions on vcDNA: vcDNA=SeqID_63002; Strand=-; Position=1 -130,174-242,302-397,444-547,593-615,662-719,788-854,921-963
  Homolog annotation: Hit_ID=NP_509753.1; Match level="QueryCoverage =96%, HitCoverage=42%, E-value=8e-51, Identity=44%"; Hit description =neurotransmitter-gated ion-channel subunit family member (XL75) [Caenorhabditis elegans] pir||T19840 hypo
FYKSLNXFCEIGFSFSITLSVACNLELSLYPMDSQKCRIEMLSYAYVERQLLIRWFDHAYVERQLLIRWFDHVDPTRHNPNIQLPEFRISNIIQLPEFRISNITSGYCSGNYQYAIMEHTYRRDNFSCLVAIIHLNRQIGYHVVQTYLDNFSCLVAIIHLNRQIGYHVVQTYLPTGLIVMISWVSFWIDRRVSFWIDRRAVPARVTLSFTTAVPARVTLSFTTMLSLSTLGNGLRFGLPQGNGLRFGLPQVAYAKAIDFWFGACMFFVCMFFVFLSLLEFA

SEQ ID NO: 136580 - protein, 17 aa, Heterodera glycines
  Coding regions on vcDNA: vcDNA=SeqID_63003; Strand=+; Position=1-52
MALSGFWTELSTKNADT

SEQ ID NO: 136581 - protein, 90 aa, Heterodera glycines
  Coding regions on vcDNA: vcDNA=SeqID_63004; Strand=+; Position=1-271
  Homolog annotation: Hit_ID=NP_417955.1; Match level="QueryCoverage =100%, HitCoverage=13%, E-value=3e-49, Identity=100%"; Hit description=oligopeptidase A [Escherichia coli K12] gb|AAC76523.1| oligopeptidase A [Escherichia coli K12] gb|AAB18
MRKADGSLQKPVAYLTCNFNRPVNGKPALFTHDEVITLFHEFGHGLHHMLTRIETAGVSGISGVPWDAVELPSQFMENWCWEPEALAFIS

SEQ ID NO: 136582 - protein, 43 aa, Heterodera glycines
  Coding regions on vcDNA: vcDNA=SeqID_63005; Strand=-; Position=1 -124,319-326
MPQDEFTVKLPNFTATLTDWYKLYLRIRKNAYFHLFLSGRGKK

SEQ ID NO: 136583 - protein, 74 aa, Heterodera glycines
  Coding regions on vcDNA: vcDNA=SeqID_63006; Strand=-; Position=1 -158,242-310
  Homolog annotation: Hit_ID=XP_321532.1; Match level="QueryCoverage =86%, HitCoverage=8%, E-value=2e-09, Identity=42%"; Hit description =ENSANGP00000025219 [Anopheles gambiae]
KPIGNLEEQCAQLSTDLYRLVHKYQALRSAVRELARAYQHTRFYPLVPRYNLLKAMIKRLLRTPAVVELDSNFE

SEQ ID NO: 136584 - protein, 38 aa, Heterodera glycines
  Coding regions on vcDNA: vcDNA=SeqID_63007; Strand=-; Position=1 -35,158-239
MYNSLKLMWFTIKTGTLGVISEVGHEKCRGTARKSIFV

SEQ ID NO: 136585 - protein, 583 aa, Heterodera glycines
  Coding regions on vcDNA: vcDNA=SeqID_63008; Strand=-; Position=1 -105,148-339,381-786,829-970,1019-1121,1169-1331,1379-1593,1637 -1785,1831-2107
  Homolog annotation: Hit_ID=NP_507780.1; Match level="QueryCoverage =96%, HitCoverage=35%, E-value=2e-37, Identity=26%"; Hit description =predicted CDS, DNA polymerase type B, organellar and viral family member (5T899) [Caenorhabditis elegans]
MQCTVKRGNENTTIEKSVCKSSKKCVDCGVLYRVADQDKKNGHICGQKFCKVCLGFHAPRDCYIPYRPKVKKVKRFVFFDFECTTNFKPDPQLMRFKHQVNFCFAHVTCTRCIEKGIWDQELEMACALCGRFRTYAWSPFEFWHTDVECRKVVEDPLAAFTKWLLNFETEVLGMEPGAKKRRKRKNAENTDGEAMECEEEEDAVDEDAENNWMLGYEEAGEKPESVTTYAYAHAGSRYDHVLIYGEMLRMGVRPELIRQGNHLLEMKARKTGVYTTTVFRDSYKLIPIKLANFVKTFGLEIEGVENKKYFPHKFNKAENYGTVLDTLPPMEDYYPGGLFPAERAKFEQWYDENRETGFELSEVIADYCKTDVQILAHGMVKMRQLFLSETRHDITDSVTIPSGCMKYWVQLAHHDKERVAIIPHLGYEKRGKQSSIARKYLKWRAEEELRENGRVLRHVESPGGEFKFGNYSLDGMMERPDEDKNLAIEVNGCYWHGCPSCFPDDAAIVGGGETAGALRARDAKRTRDIAREFEVEIIWECHLNAMLEDNPAMKAYFDNCPDSGPIDFHDAFFGGIFGFKFAK

SEQ ID NO: 136586 - protein, 223 aa, Heterodera glycines
  Coding regions on vcDNA: vcDNA=SeqID_63009; Strand=-; Position=1 -132,192-327,453-855
MSQYSDNSLPPTLDGPYSPVGDDGTELMDEAPPLDEVMKRLPISVVPSDNNERKAQKEPSITRELEAELFNGDGFTCLSAEQAEAGRFKAFRFIGQFLMSLTFGAVFPEDILRNLFTMCLSYASEGAKSMKISADHFIFLLTSKHLDYEVAVHFKKLDNSATEKILTRFEMVDQSNKAKERPSLLEEPFIIDITAIESKCAKPKMAGKGRNDFNIDYRIADGA

SEQ ID NO: 136587 - protein, 42 aa, Heterodera glycines
  Coding regions on vcDNA: vcDNA=SeqID_63010; Strand=+; Position=1 -120,458-466
MAGAQLARAHLAALKWLALSWPCTPPTPMGGYRNPVKSTRHH

SEQ ID NO: 136588 - protein, 57 aa, Heterodera glycines
  Coding regions on vcDNA: vcDNA=SeqID_63011; Strand=+; Position=1 -89,140-223
MSTECSEGKENENRRKSAQTAEAVAEKIGGEPDNGILSIEVVPSLAGNPLHGYRFVD

SEQ ID NO: 136589 - protein, 84 aa, Heterodera glycines
  Coding regions on vcDNA: vcDNA=SeqID_63012; Strand=-; Position=1-255
MESDFVRKFLDFFVMTPIPKVTPTPSRRTSAFLHLQRRRQCRRLGVQMDSTDFYRAPEYRRGTELTRTGLAQMANETFENAKQS

SEQ ID NO: 136590 - protein, 22 aa, Heterodera glycines
  Coding regions on vcDNA: vcDNA=SeqID_63013; Strand=+; Position=1-71
SVWGTQTFMEEQKSNAELKYRL

SEQ ID NO: 136591 - protein, 16 aa, Heterodera glycines
  Coding regions on vcDNA: vcDNA=SeqID_63014; Strand=-; Position=1-49
EAIPEGFGLPINLGAS

SEQ ID NO: 136592 - protein, 31 aa, Heterodera glycines
  Coding regions on vcDNA: vcDNA=SeqID_63015; Strand=+; Position=1-98
EPISEDKIVDTNGAGDAFCGGIVKVNALSCG

SEQ ID NO: 136593 - protein, 56 aa, Heterodera glycines
  Coding regions on vcDNA: vcDNA=SeqID_63016; Strand=-; Position=1-169
MKKSFYEQKKVKFIERFGEFKELYGQGKQKEFVKELGICKETFIKWKKELLPNYHK

SEQ ID NO: 136594 - protein, 36 aa, Heterodera glycines
  Coding regions on vcDNA: vcDNA=SeqID_63017; Strand=-; Position=1-331
FDFTNRLIICKNQHFEKQSFYHDIKRNEKKVRVSTK

SEQ ID NO: 136595 - protein, 246 aa, Heterodera glycines
  Coding regions on vcDNA: vcDNA=SeqID_63018; Strand=+; Position=1 -577,622-785
MNLWPLIFIIFCIAYKIESGKIRPNFDEIFGDEWEINESVENGEENVIKSIGQMQNDQIFKNDQNTKEEPNDEQKRQIIRKYEAIKEKLKQRGKFQRKNQSKIETKIGKLLGESRYKIYKWKKDLNLNKKKNNKMKKSFYEHKKREFIQRFEEFKSLYAHGKQKEFAKELGICERTFWKWKKELAPKYHKSQKHHTNEDKLMKMKHYLQIKEANPKMSDELIAKKLGIGSATLKRLKKECSHPIDQ

SEQ ID NO: 136596 - protein, 60 aa, Heterodera glycines
  Coding regions on vcDNA: vcDNA=SeqID_63019; Strand=-; Position=1 -93,163-252
MPDADQILQQLEHHFVNNWLLDTGKIDEMKQRQSDRREEHDEFDQSEEETDEISLINVIY

SEQ ID NO: 136597 - protein, 105 aa, Heterodera glycines
  Coding regions on vcDNA: vcDNA=SeqID_63020; Strand=+; Position=1 -43,176-450
MECHAVAGQPVPQRGKGGAIFGALWEHQRRMDTANGRGETSQNAQQTENPANCIWRSGEETCQCWQFLTCPSDGGGRTEEFGAQKPMGLNNPSIQFPCHFNKSLF

SEQ ID NO: 136598 - protein, 252 aa, Heterodera glycines
  Coding regions on vcDNA: vcDNA=SeqID_63021; Strand=-; Position=1 -619,767-906
  Homolog annotation: Hit_ID=AAM91820.1; Match level="QueryCoverage =88%, HitCoverage=39%, E-value=6e-30, Identity=44%"; Hit description =choriogenin H [Oryzias latipes]
VWGGGGNPWNVHVPQFPSNGPPQSPWNVHVPQFPSNGPPQSPWNVHVPQLPSNGPPQSPWNVHVPQFPSTGPPQSPRNVHVPQLPSNGPPQNPWNVHVPQFPSNGPPQSPRNVHVPQLPSNGPPQSPWNVHVPQLPSNGPPQSPWNVHVPQFPSNGPPQSPRNVHVPRRSSTGPPQSPWTVSRPDHLIEHAHQLNVVPSASLPSDQGGSKQKLRLAGPVQAPGTRSACAGAHFCISEKRRLRCCDHICDVFL

SEQ ID NO: 136599 - protein, 90 aa, Heterodera glycines
  Coding regions on vcDNA: vcDNA=SeqID_63022; Strand=-; Position=1-272
VPNYVQGSQTIEETVPNIVETTPERKRPLMTIQCQMAPKLRTLKMPLMSIQYQMSSKLWTLKMPIISIQCKMLAKTMDNENAIIYNKNEN

SEQ ID NO: 136600 - protein, 119 aa, Heterodera glycines
  Coding regions on vcDNA: vcDNA=SeqID_63023; Strand=+; Position=1 -91,185-450
MHWFIVLVLILNSIYNSNAFFHSLDSATPGACPLLVPAPWVCVCGCQKSDIKKISSSYGGADHSSSDGDGGYGGNESGGGGEENLKLKIGKVKEYCGCQTVNVTCKSCESEQENPIHIE

SEQ ID NO: 136601 - protein, 86 aa, Heterodera glycines
  Coding regions on vcDNA: vcDNA=SeqID_63024; Strand=-; Position=1-258
MIAQSVPNIGHYYEEEEEVMEDEEEYSYEEIDEEEEEEEEEVEKEEKRTVAARALPAAQLAEDGGQNGTAQGNDQLANLADECRRK

SEQ ID NO: 136602 - protein, 19 aa, Heterodera glycines
  Coding regions on vcDNA: vcDNA=SeqID_63025; Strand=+; Position=1-60
EPVNSCIGCKCRRCCTPNS

SEQ ID NO: 136603 - protein, 97 aa, Heterodera glycines
  Coding regions on vcDNA: vcDNA=SeqID_63026; Strand=-; Position=1-291
MAINISDKKSLMENILAAVEISQTANGITVSSERIAMPRTIQFDILGKCRECKGTECEAEWCVTKEGVTIWCTRFKISPRFVPFDVIYDLPGYTFFK

SEQ ID NO: 136604 - protein, 467 aa, Heterodera glycines
  Coding regions on vcDNA: vcDNA=SeqID_63027; Strand=+; Position=1 -87,187-493,1174-1296,1363-1501,1604-1824,1983-2077,2135-2355,2690 -2900
  Homolog annotation: Hit_ID=NP_505683.1; Match level="QueryCoverage =83%, HitCoverage=49%, E-value=1e-34, Identity=29%"; Hit description =poly polymerase (73.6 kD) (5K925) [Caenorhabditis elegans] emb|CAA16309.3| Hypothetical protein Y32F6A.3
MYFCVLPGPGFFFTFDLDLDFMTKTQEIQLQNVNVSTIRSIEDALVPLIKFTFQFDQNTPIDFDIGLVTFDPNEQIFKSKMPLKYEQSNALSAKIAKEIGELSEQRKHFGGGEVGEKNIDEKLKKKLRSLSSFEVSSIILKRILATENTENGNGNILQIYRTFLLMIKFWAREHHIYDNKLGFFNGISLSLLVAKVMLLYPMASLPFLIEKFFFTFSTWPWPTPVKLTDLPSLSILRWNASDESDKRGVIYSRRGLMPGLTMPIVTPGHIEQNATFNVNRSTATIIQRELQNAIKIIRNWPMDLQNLQEEKWENLLKDKKFEEKFSHFIRINCKAFALADFYDFCGYVETRIRLQLLIDVERFDRIRLAHAKQIVEKGQILGENEKGDENEAFPVSKSEHYQKIWLIGLELDDKIAAVGDEWIQRLNSMLFHQFDATIEKAYRIKKNLANELIQIELKSKYEKDENY

SEQ ID NO: 136605 - protein, 71 aa, Heterodera glycines
  Coding regions on vcDNA: vcDNA=SeqID_63028; Strand=-; Position=1-215
ILSQNLSLFNDLLRMGQSNAIKSFDIDQQLETNSRLHVAAKVVKVGQSEGFAINANEMGKLREKIFGILIC

SEQ ID NO: 136606 - protein, 53 aa, Heterodera glycines
  Coding regions on vcDNA: vcDNA=SeqID_63029; Strand=+; Position=1-159
CSPICLCRRWHCLWRWRNWRRRHRFFSHHFAVVEEVQRRAVEETQAQRRRRRL

SEQ ID NO: 136607 - protein, 178 aa, Heterodera glycines
  Coding regions on vcDNA: vcDNA=SeqID_63030; Strand=-; Position=1 -181,231-586
MVKRRKRKNRKEQAEPNHEKEEQKERDEEDEDDNLPTATFQPRNSVRPGPNGRVHPPTEGVCVQRGNPSARHARPPAVAFLNGRRTSPPYQCAQSDTFLNFFLTFVLNRHKPTTEPTIVSNFHQRVEAADWQFNNSKNGGRKGRKAAAEANSSTREHEEEQRDRNGRADTDNSQKGAY

SEQ ID NO: 136608 - protein, 76 aa, Heterodera glycines
  Coding regions on vcDNA: vcDNA=SeqID_63031; Strand=-; Position=1 -87,156-299
MEQKAGWNATVVIPESPRIFGIPFVDLFAGEFNFEFLLETEGKEIAHLEVPTNLAFVPIGMQNEEDEDEDDGKGQC

SEQ ID NO: 136609 - protein, 96 aa, Heterodera glycines
  Coding regions on vcDNA: vcDNA=SeqID_63032; Strand=+; Position=1 -144,480-626
MRRLLEADQLALGCLDTWLMMKLSGCDDQSFVTEPSSASSTGMFDPFTLGDSQAAAFGAGCIRRGDLKISLGTGTLFDYVSGPEIHSQCMVGREWY

SEQ ID NO: 136610 - protein, 89 aa, Heterodera glycines
  Coding regions on vcDNA: vcDNA=SeqID_63033; Strand=+; Position=1 -147,407-529
MLYLPIIKNMIKKFFGPLFFDLAASMLFTGLIVLVLIKTNFEWLLFYDVSPIAIPHPTFICAFALTICVTIGYCYIFVIFFRYSNINCL

SEQ ID NO: 136611 - protein, 137 aa, Heterodera glycines
  Coding regions on vcDNA: vcDNA=SeqID_63034; Strand=+; Position=1 -126,358-419,817-954,1029-1116
  Homolog annotation: Hit_ID=NP_501209.2; Match level="QueryCoverage =43%, HitCoverage=11%, E-value=1e-10, Identity=49%"; Hit description =putative protein, with at least 6 transmembrane domains (4I264) [Caenorhabditis elegans]
MALYGCDKAVEAQHWHNYDLGLRVTLNNFCVRFGFVHLHNPTQFCRDNTEMDSVIKNLCPPYIKNGFHCNNASLNKQQQIWYRLHYGLLKSAIVTCAAELVPVLLVGHWIACGHAKKIAQQNLTHRAISKFKVKGEQ

SEQ ID NO: 136612 - protein, 197 aa, Heterodera glycines
  Coding regions on vcDNA: vcDNA=SeqID_63035; Strand=+; Position=1 -198,382-507,595-681,733-915
MLTLIVSKCYKNVMKWQSVLICVLSIFLWLLCFHNYIKDDEQSVAVLSQDIAEVFTGLVQLCFFINLFILTREIPKEGLDTARAAQSRADHVLLLGSTILLTVECVCECIEILHFSHKKQMRFLTKCLDIFYSIFTELANWFEIYCLKKISALNDDLVRRLRDTLPFVAICGITLNLSVFVMTYFYIEAEKHHLQVN

SEQ ID NO: 136613 - protein, 70 aa, Heterodera glycines
  Coding regions on vcDNA: vcDNA=SeqID_63036; Strand=+; Position=1 -122,176-266
MITSLPNDYFVLVGVVARILDTANYVYTFTSALCWLEVLLRYKKNNNFFMVGNNFVKEGNANHAFEETAF

SEQ ID NO: 136614 - protein, 67 aa, Heterodera glycines
  Coding regions on vcDNA: vcDNA=SeqID_63037; Strand=+; Position=1 -43,233-375,443-460
MAQKPIFNKTKNILGLKIFSLLVRLIEHVKSFRVIPTMLYLDVKEKSYRGKRAGAETRAPKRKIFVF

SEQ ID NO: 136615 - protein, 85 aa, Heterodera glycines
  Coding regions on vcDNA: vcDNA=SeqID_63038; Strand=+; Position=1 -44,378-591
MNNFLSKIFNLILFDSVQFGFAEKPLPIRRRNGTYAYDSDGQFLIDGSPQGPKANSYNAGDVVGIGINLATQQIFFVKNGLRLGW

SEQ ID NO: 136616 - protein, 184 aa, Heterodera glycines
  misc_feature (135)..(135): Xaa can be any naturally occurring amino acid
  misc_feature (150)..(150): Xaa can be any naturally occurring amino acid
  Coding regions on vcDNA: vcDNA=SeqID_63039; Strand=-; Position=1 -25,67-157,215-431,491-569
  Homolog annotation: Hit_ID=NP_505977.1; Match level="QueryCoverage =84%, HitCoverage=11%, E-value=1e-40, Identity=55%"; Hit description =pyruvate carboxylase, Biotin-requiring, cadmium-responsive gene (129.3 kD) (pyc-1) [Caenorhabditis elegan
EWGAGLCNYHSFSQIEDAFSRAFSEALTAFGDGSNYHSFSQIEDAFSRAFSEALTAFGDGSLLVEKFVERPWHIEVQIIGEHFVERPWHIEVQIIGEHYGNLVHLYERACSVQRRHQKIVDLAPAPVLDPAIRQXMLDDPLKLTRHVGYXNVGHVEFLVEFLLDYKGNHFFMEVNARLQVEHNV

SEQ ID NO: 136617 - protein, 16 aa, Heterodera glycines
  Coding regions on vcDNA: vcDNA=SeqID_63040; Strand=-; Position=1-49
EAIPEGFGLPIILGAS

SEQ ID NO: 136618 - protein, 116 aa, Heterodera glycines
  Coding regions on vcDNA: vcDNA=SeqID_63041; Strand=-; Position=1 -273,327-404
MDLSLVLRNARKMQPNVTTNSTVHFSTEAGLASQSLPPQFLVADDGTVLNGGGATVLPPSPSFVPDDIGTAASTYAAGVSAPLQLGHIMDVAALTAPPYPILPLFFGNLTPFRHKL

SEQ ID NO: 136619 - protein, 358 aa, Heterodera glycines
  Coding regions on vcDNA: vcDNA=SeqID_63042; Strand=-; Position=1 -185,1053-1197,1465-1568,1900-2161,2468-2620,2676-2760,3018-3072,3337- 3424
  Homolog annotation: Hit_ID=BAD17922.1; Match level="QueryCoverage =82%, HitCoverage=83%, E-value=1e-110, Identity=63%"; Hit description= phosphoglycerate kinase [Acipenser baerii]
MPNSSIARYESSPWHLMPRPRPHNQKYHGQDHISRKCHDTAMTRSVMDELGVTHQNSWNMPKTVVFLTDCVGTEIENATADPKPDTIILLENLRFHVEEEGKGKNSAGETVKASKEAVNAFRASLSKHGDLYVNDAFGTAHRAHSSMVGCAMEKRASGFLMKKELEYFAKALESPTRPFLAILGGAKVADKIQLINNLLDKVDEMVICGGMAFTFYKVLTGKSIGKSLFDEEGSKIINDLMAKAKDKNVKIHQPVDFVVGDEFKEGTPFANVDAKDGIPDGKMGLDIGQETLKQFAEVIGRAKTVVWNGPAGGGDTATAAEKWGAEDKVSHVSTGGGASLELLEGKVLPGVAALSDAP

SEQ ID NO: 136620 - protein, 101 aa, Heterodera glycines
  Coding regions on vcDNA: vcDNA=SeqID_63043; Strand=-; Position=1 -245,1050-1110
  Homolog annotation: Hit_ID=NP_507845.1; Match level="QueryCoverage =80%, HitCoverage=11%, E-value=5e-12, Identity=45%"; Hit description =transposase family member (5U321) [Caenorhabditis elegans] emb|CAB81975.1| Hypothetical protein Y116F11B.
MRVTVCITAQNNGQKLKPYVLVNRKRSVPQIVNQFAGKLVINFAGSVWMNDETTEDYLYKIIGAKLFVGEHLLVWDAFDSHNQGAKCVSPDYIPTMPIVNA

SEQ ID NO: 136621 - protein, 206 aa, Heterodera glycines
  Coding regions on vcDNA: vcDNA=SeqID_63044; Strand=+; Position=1-621
  Homolog annotation: Hit_ID=CAE64507.1; Match level="QueryCoverage =81%, HitCoverage=95%, E-value=7e-19, Identity=33%"; Hit description =Hypothetical protein CBG09235 [Caenorhabditis briggsae]
MCAALFCCAFALFILCSHLRKCSSPFVCVCPFWRQFGAGGQLIGLICGQLISLIYGQLIGLICGQLIGLIYGQLIGLIYGQLIGLICGQLISLIYGQLIGLICGQLISLIYGQLIGLICGQLIGLICGQLISLIYGQLIGLICGQLIGLIYGQLISLIYGQLIGLIYGQLIGLIYGQLISLIYGQLIGLIYGQLIGLIYGQLIGLI

SEQ ID NO: 136622 - protein, 28 aa, Heterodera glycines
  Coding regions on vcDNA: vcDNA=SeqID_63045; Strand=+; Position=1-88
KVKPKLFGLFKKELKIFKNFIHLPIDRK

SEQ ID NO: 136623 - protein, 92 aa, Heterodera glycines; identical to SEQ ID NO: 131693
  Coding regions on vcDNA: vcDNA=SeqID_63046; Strand=+; Position=1-359

SEQ ID NO: 136624 - protein, 86 aa, Heterodera glycines
  Coding regions on vcDNA: vcDNA=SeqID_63047; Strand=-; Position=1-289
LLCGSLAFNRTFSTMTDSVLGQKECLLYSVISEGRVSGRIGCLSLLDQADVAVLLQPIQQLFLHMIILNDTSSAQRSVQFLTSDHF

SEQ ID NO: 136625 - protein, 110 aa, Heterodera glycines
  Coding regions on vcDNA: vcDNA=SeqID_63048; Strand=+; Position=1-330
MPPNFFYKLLLERLSRSKKWEQVQLNLGMNPNNSFAIDGPGGGGGGGGAAWDKQTEAKTGAGGQQISGGFQSITGGSNYSTLSVAIESRQYDQSGVSGLNGGGGGSEMVV

SEQ ID NO: 136626 - protein, 97 aa, Heterodera glycines
  Coding regions on vcDNA: vcDNA=SeqID_63049; Strand=+; Position=1 -52,419-657
MALGISDIGLQFNRKGLALIHLSFSTTQEFLGISLIAPIPVLFPLINLLCLKEFRNITSQIVLCKIWMRKKRQERAAAERKAQENIDEDLVSASKNK

SEQ ID NO: 136627 - protein, 17 aa, Heterodera glycines
  Coding regions on vcDNA: vcDNA=SeqID_63050; Strand=+; Position=1 -39,310-324
MCTSYPYNTVAFGANRG

SEQ ID NO: 136628 - protein, 211 aa, Heterodera glycines
  misc_feature (201)..(201): Xaa can be any naturally occurring amino acid
  Coding regions on vcDNA: vcDNA=SeqID_63051; Strand=-; Position=1 -60,123-164,224-318,367-438,684-967
  Homolog annotation: Hit_ID=AAN32888.1; Match level="QueryCoverage =89%, HitCoverage=47%, E-value=5e-65, Identity=78%"; Hit description =annexin 4C10 [Heterodera glycines]
HFKTVTAHHHDAMRKKHEAEVTQVIAPAEVTQVIAPISNEQRQALALEFKKQFGTDRQALALEFKKQFGTDLIAMLKKEFKSDFEELIISLMQTPISLMQTPAVYDANQMRAALSGSNEAVLIEILATRTNRQITALKQAYEQLDRRHQHNQLEENIKAKTKTLPKSVGVFAQLLSRRKAPASIVLAHDVIKWQIGKNIKXSINTYINNII

SEQ ID NO: 136629 - protein, 62 aa, Heterodera glycines
  Coding regions on vcDNA: vcDNA=SeqID_63052; Strand=-; Position=1 -51,95-229
MPIEEKEDKDVYRIVVWDSETSQDSIYKGDQKEHVINYISVRVTCTECCDDKNRTNCKICGE

SEQ ID NO: 136630 - protein, 47 aa, Heterodera glycines
  Coding regions on vcDNA: vcDNA=SeqID_63053; Strand=+; Position=1 -30,456-569
MPLHLRYAYEIFREKTVITFFDTTKIKKQLPENGIKLISFGCVYEKL

SEQ ID NO: 136631 - protein, 79 aa, Heterodera glycines
  Coding regions on vcDNA: vcDNA=SeqID_63054; Strand=-; Position=1 -54,284-469
MLRTDKDELKEEKQRLKEVFLCANQQGWASPNAVAHVNRCNVSLGMDIWLHCWLGQMLNQFVLKFIIFFITIFKKKIKN

SEQ ID NO: 136632 - protein, 174 aa, Heterodera glycines
  Coding regions on vcDNA: vcDNA=SeqID_63055; Strand=-; Position=1-525
  Homolog annotation: Hit_ID=XP_319741.1; Match level="QueryCoverage =78%, HitCoverage=32%, E-value=1e-21, Identity=36%"; Hit description =ENSANGP00000006515 [Anopheles gambiae]
MNAEQIQQLLTALLQGNAASSISQANLASSIDSRISKFVYDPENGQTFEQWHKRFGILIEEDGKDLTEQAKVRLLLGKLGDEEYTKYRDTISPELPDKALWAESINRLKELFAETRSLFVRRYECFRIRQHPNQDISSLVAQINAACEYANLSLTKEQLKCMILVILLRDEHHD

SEQ ID NO: 136633 - protein, 385 aa, Heterodera glycines
  Coding regions on vcDNA: vcDNA=SeqID_63056; Strand=+; Position=1 -154,1499-2502
  Homolog annotation: Hit_ID=AAP30765.1; Match level="QueryCoverage =62%, HitCoverage=48%, E-value=1e-102, Identity=78%"; Hit description= putative gland protein G15A10 [Heterodera glycines]
MQSIPVLNPRKQFASSYFSPSEKKQNCTRQSGKTVRTAATIACSKSNDMVSDLASSLRQQRTEDNHISINGQNYAVDGPNVNVGVEGHDLSVNGRVYQNRATEQYLEIIQDKNIRNVIVSVPLSLFSRENIIDGQINAKCNGNLYIDQSSDGCSRIICVDDKKNGVENNFGQTRDIFLTGDVNIFESANGIIYNSMMGGTLHMHNSSLECANIECDASLNVTHSPIERNAQMKCGGSLSIDESPMGNIRLNCDGSLRIEKSKMESSQIDVGGSIGIVKSPMANIRLNCGGSLRIEKSKMEIGNLDSGGSSTIVESPAQSLKLNCGGSLNMNECSMKNVGINCGGSATIKKSKMESGRINCGGNFSIDSSPTGSVRIDYGGRRINL

SEQ ID NO: 136634 - protein, 162 aa, Heterodera glycines
  Coding regions on vcDNA: vcDNA=SeqID_63057; Strand=+; Position=1 -277,515-726
MKARRIPFIQLQILLLKLIGDIVTTDQQREEATDANGTTEGEAAEEAKDMALALAMSSRQFWHQMTDEWNYKNGKFQKPKEEMFSKVSYHDFEGLSRINNSLEGWHYIWGSVLEPKPLFSKFARWQHIVDDYENAPANGIRGKGIRRNPSLLIRTTICVRFC

SEQ ID NO: 136635 - protein, 25 aa, Heterodera glycines
  Coding regions on vcDNA: vcDNA=SeqID_63058; Strand=-; Position=1 -36,859-900
MCAKTGRISKFPYIFGCPDHYEGVI

SEQ ID NO: 136636 - protein, 63 aa, Heterodera glycines
  Coding regions on vcDNA: vcDNA=SeqID_63059; Strand=+; Position=1 -98,518-612
RNAKRQCLRHKRWPINRLTFAAAGGENLAVEEYEPLTPTLEGIVILRELAKKSGGASIGPTTE

SEQ ID NO: 136637 - protein, 71 aa, Heterodera glycines
  Coding regions on vcDNA: vcDNA=SeqID_63060; Strand=+; Position=1 -118,829-926
MVCLRRKFPGGHRLDRHLDVAQAACPAVASADHLQLQLGDEPLTPTLEGIVILRELAKKSGGGASVGPSTD

SEQ ID NO: 136638 - protein, 122 aa, Heterodera glycines
  Coding regions on vcDNA: vcDNA=SeqID_63061; Strand=-; Position=1 -101,143-219,284-472
MITSLAFLPVHHLPAGLNALEAQLPQQLIGVFDWFTDNYTGRPRFNGGLTAPRFAPDEWSIARCIAGELPPQKAPKYRAADARILRLLQSYNAINNNQAHQNDHNYHALINVNPYNIINFLL

SEQ ID NO: 136639 - protein, 82 aa, Heterodera glycines
  Coding regions on vcDNA: vcDNA=SeqID_63062; Strand=+; Position=1 -63,110-185,708-806,930-940
MALLFTRLIRNVILVIVFFNVVSYYLRWKSYNIAARDFKTASVNSATQNFRHGQFESYVYEFKEGTHVVCYWRGFIPASGDL

SEQ ID NO: 136640 - protein, 100 aa, Heterodera glycines
  Coding regions on vcDNA: vcDNA=SeqID_63063; Strand=+; Position=1 -90,374-475,606-695,1623-1643
  Homolog annotation: Hit_ID=NP_496376.1; Match level="QueryCoverage =99%, HitCoverage=27%, E-value=5e-44, Identity=70%"; Hit description =NADH ubiquinone oxidoreductase (52.5 kD) (nuo-1) [Caenorhabditis elegans] emb|CAA90435.1| Hypothetical pr
MGARAAYIYIRGEFYNEACILQESIHEAYKALIESLEGKQGKPRLKPPFPADIGLFGCPTTVTNVETVAVAPAICRRGGAWFASFGRERNRGTKNYCITI

SEQ ID NO: 136641 - protein, 143 aa, Heterodera glycines
  Coding regions on vcDNA: vcDNA=SeqID_63064; Strand=-; Position=1 -75,126-283,1745-1943
  Homolog annotation: Hit_ID=CAE70530.1; Match level="QueryCoverage =37%, HitCoverage=28%, E-value=7e-09, Identity=47%"; Hit description =Hypothetical protein CBG17161 [Caenorhabditis briggsae]
MENEREFGREFTKEFVERHNELRKLHGCPELTLCEELSEMAKEWADRIAWQGHVSFAEMSGNKWAVGKEWHCQTTIKEAIVGMPNKHLFGNNGTDEPPGMMAKRLSQPPITPPLCLSIKSRNGMDISSSTVVGSLTWPEMQYN

SEQ ID NO: 136642 - protein, 355 aa, Heterodera glycines
  Coding regions on vcDNA: vcDNA=SeqID_63065; Strand=-; Position=1 -39,85-134,193-285,325-383,429-509,565-636,788-877,970-1177,1534 -1619,2289-2353
  Homolog annotation: Hit_ID=NP_493547.1; Match level="QueryCoverage =100%, HitCoverage=54%, E-value=7e-85, Identity=49%"; Hit description= endoplasmic Reticulum Oxidase (59.3 kD) (ero-1) [Caenorhabditis elegans]
KVWECIYNENCFKPDPKFDKKFLLQPPDPKFDKKFLLQPTPTGMCLEKRVFYRLISGLHSMCLEKRVFYRLISGLHSAITVSIAAHNYRPVIFLLAPGGFGTGTIFLLAPGGFGTGTWYRNVEFFENRFGTKWGKEGPERLRFFENRFGTKWGKEGPERLRNLYFTYMLELRALVKATPYIRNELRALVKATPYIRNQLFYTGNEQEDRETQQSLEHFLAVLKEFPNQFDETQLFSFQESHARLLKEEFRQHFWNISRIMDCVGCDKCRLWGKLQTHGMGTALKVLFSDLPRNGRRESERKERAKNDLVALFQSFGRYSSSIWEIDGFRKEFRPAEKRQGNAQFGAPSAKYPIAL

SEQ ID NO: 136643 - protein, 89 aa, Heterodera glycines
  Coding regions on vcDNA: vcDNA=SeqID_63066; Strand=-; Position=1 -126,336-477
  Homolog annotation: Hit_ID=CAC70110.4; Match level="QueryCoverage =100%, HitCoverage=20%, E-value=4e-10, Identity=35%"; Hit description= Hypothetical protein Y105E8B.8a [Caenorhabditis elegans] sp|Q7YTU4|ERO1_CAEEL Endoplasmic oxidoreductin 1
MAKPCPFWEDEAGQCSSKECSIGYCDDEVPPALKEPIAPLSASNSNDSCGGSESNKFDPLDDSLSEFDRAQLRELDMFEDNSNKFCEVE

SEQ ID NO: 136644 - protein, 46 aa, Heterodera glycines
  Coding regions on vcDNA: vcDNA=SeqID_63067; Strand=+; Position=1 -59,333-414
MAANFPKLVFGVMLPYPMVDATILPMLDLEGLNWKCDRQWRSGFFG

SEQ ID NO: 136645 - protein, 181 aa, Heterodera glycines
  Coding regions on vcDNA: vcDNA=SeqID_63068; Strand=-; Position=1 -37,137-255,313-369,426-465,516-532,765-888,1987-2138
MLIRKKEMVDREEIQILAEVLLVEQRIREMTGHYNLANSQNRDRLETFASISTLKKEMRKYKQFAMNRIRKTIYWYVLLVYFLTDQQTYKLAERCWELGVELNSTDHKKTKLTKSIREFNEFVGLRHTLAPRIIRGTFADDDGRICGGRRTNGGRNNRNDEAEDEHGRPVESLAAEKATKE

SEQ ID NO: 136646 - protein, 326 aa, Heterodera glycines
  Coding regions on vcDNA: vcDNA=SeqID_63069; Strand=-; Position=1 -224,591-786,968-1255,1614-1883
  Homolog annotation: Hit_ID=CAE61287.1; Match level="QueryCoverage =98%, HitCoverage=44%, E-value=1e-126, Identity=67%"; Hit description= Hypothetical protein CBG05109 [Caenorhabditis briggsae]
MQTDVYCEGGSVGFFRGDIRLLADDIKTLRPTVLPVVPRVLNRIYDKVLGEANKSVFTRLLFDAAVGLKTRELNNWIVRNNSLLDQIVFKKVREGLGGRVKLMITGSAPLSETVLTFMRCATGALVCEGYGQTECVAAATITIEGDPVPGHVGVPVPCCAVKLIDVPELNYFATHGAGEVCIKGPNVFRGYYKMAEQTAETLDTDGWLHTGDIGRWTEQGTLKIVDRKKHIFKLAQGEYVAPEKIELIYMRSKYVAQCFVHGESLKTCLVAVVVPDFDVLPEAAKKQLGIEGKTMEELCRNQQVKAMVMEDIHEVGKKAGLFTFEQ

SEQ ID NO: 136647 - protein, 107 aa, Heterodera glycines
  Coding regions on vcDNA: vcDNA=SeqID_63070; Strand=-; Position=1 -48,381-569,892-976
  Homolog annotation: Hit_ID=CAE61287.1; Match level="QueryCoverage =99%, HitCoverage=13%, E-value=9e-17, Identity=45%"; Hit description =Hypothetical protein CBG05109 [Caenorhabditis briggsae]
MDASVSFDIQNNFVLVFCDTVAKVNGLLERKSACPSLKYIVLMAPAYDELTESARDIAAQNGVKLFSFDNFERMGLHEEVASLSDVPPSPDDLATICYTSGTTSVSK

SEQ ID NO: 136648 - protein, 137 aa, Heterodera glycines
  Coding regions on vcDNA: vcDNA=SeqID_63071; Strand=-; Position=1 -178,476-711
  Homolog annotation: Hit_ID=NP_490744.1; Match level="QueryCoverage =97%, HitCoverage=20%, E-value=7e-22, Identity=44%"; Hit description =long chain fatty acid Coenzyme A ligase and a putative endoplasmic reticulum membrane protein, the two ge
IADISDWNEQNNGNTSLLYSIGAAATIGAMGLWWVWSSRPSAKKMVPLVDPESQTRELPDGSRVCKYLKTDALMRFTHANAKTIYEGVRRGAHVSKNGPMLGFRNRQCDGEPYEWLSYGDALHRSALLARAIRSLGL

SEQ ID NO: 136649 - protein, 32 aa, Heterodera glycines
  Coding regions on vcDNA: vcDNA=SeqID_63072; Strand=-; Position=1-248
ADPQNVQPTKCPSLEFEFFYYSDGPKVRQRVI

SEQ ID NO: 136650 - protein, 47 aa, Heterodera glycines
  Coding regions on vcDNA: vcDNA=SeqID_63073; Strand=+; Position=1 -65,629-707
MSSPRNVQVSNLSFFIIQMGLRELGVLIEATGIAQILYFYLFRWPLH

SEQ ID NO: 136651 - protein, 108 aa, Heterodera glycines
  Coding regions on vcDNA: vcDNA=SeqID_63074; Strand=-; Position=1-326
  Homolog annotation: Hit_ID=ZP_00145678.1; Match level="QueryCoverage =100%, HitCoverage=20%, E-value=9e-46, Identity=87%"; Hit description= COG0606: Predicted ATPase with chaperone activity [Psychrobacter sp. 273-4]
HLSQGLPAVTIVGLPEAAVRESKDRVRSAIINAGFSFPNRRLTINLAPADLPKDGARLDLPIAIGILAASGQLDDSQLAGYELIGELALNGELRPVTGALAVARAIKS

SEQ ID NO: 136652 - protein, 118 aa, Heterodera glycines
  misc_feature (114)..(114): Xaa can be any naturally occurring amino acid
  Coding regions on vcDNA: vcDNA=SeqID_63075; Strand=+; Position=1 -92,181-276,318-458
  Homolog annotation: Hit_ID=NP_501783.1; Match level="QueryCoverage =94%, HitCoverage=20%, E-value=2e-39, Identity=69%"; Hit description =tbc1 domain family protein (56.5 kD) (4K665) [Caenorhabditis elegans] emb|CAB03042.1| Hypothetical protei
FLQFSFRWMNNLLMREIPLRATIRLWDTYLSEHDGFSQFHTYICGAFLRLWSKQLLNEKDFQGIMLLLQNLGIMLLLQNLPTKGWNDQQICELTADAYSLMQFFHHAKSHLQTXCLIM

SEQ ID NO: 136653 - protein, 113 aa, Heterodera glycines
  Coding regions on vcDNA: vcDNA=SeqID_63076; Strand=-; Position=1 -157,611-795
  Homolog annotation: Hit_ID=A41101; Match level="QueryCoverage=100%, HitCoverage=5%, E-value=2e-37, Identity=73%"; Hit description =phorbol ester-binding protein unc-13 - Caenorhabditis elegans
ICAKGLSAKDKTGTGVPYVTAQVGKALKRTRTIHQQQQELNHLPVWNEQFTFECDNITDRIKVRVWDEDNDLLLKSSSKLRRKLSRESSDDFLGQTIIEMRTLCGETDVWYNL

SEQ ID NO: 136654 - protein, 242 aa, Heterodera glycines
  Coding regions on vcDNA: vcDNA=SeqID_63077; Strand=-; Position=1-729
  Homolog annotation: Hit_ID=NP_702063.1; Match level="QueryCoverage =97%, HitCoverage=4%, E-value=4e-11, Identity=22%"; Hit description =hypothetical protein PF14_0175 [Plasmodium falciparum 3D7] gb|AAN36787.1| hypothetical protein [Plasmodium
MTFQSLGLNPPAFQSLRLNSQAFQSLGLNPPAFQSLGLKSPAFQTLGLNPPTFNGIPISGTQPTSISISGTQPTSISISGTQPTSISISGTQISGIPDTGTQPTSILISFQSLGLNPPAFQSLRLNSQAFQSLGLNPPTFQSLGLKSPAFQTLGLNPPTFNGLPISGTQPTSFHGLPISGTQPTSISISGTQPTSISITVTQISGIPDIPLNENQATSIPILGLNSPAFQSLGLKSPAFQTM

SEQ ID NO: 136655 - protein, 250 aa, Heterodera glycines
  Coding regions on vcDNA: vcDNA=SeqID_63078; Strand=-; Position=1 -270,488-793,1391-1567
MSEQQHAGSSNTAKCGRKRDLAAVRHAFEMNKIKVEKRKLRMRRMEEVVQRERALIKIRHEYRKAKSAVLSGQFRFSCSASSMVITIPQMAKVDGQAAESFTIVIAYGPAEQGGPNVASSHAQPAAQKTVTQDSRPTDPRIARGVCKSTVHVENVFFFDNNNNVIIACANSAAGCGPVTGNGRDGEATHHISLPAPPKAPVLRSGGPTRPSKKQKIYSSDDSSSSDNGDRSASKCPLRILVSDDDEKVEQ

SEQ ID NO: 136656 - protein, 206 aa, Heterodera glycines
  Coding regions on vcDNA: vcDNA=SeqID_63079; Strand=+; Position=1 -165,215-534,566-701
MSGLKRFQIVPSSQKRVTEDFPTNPKDLRAIIQFNSPGLFYVRARIADLQFSLYKACPLKNFGTFCKKKLDEELYCASCAHHANKAIRSIYLRLELRDCEDPEICQTVTVFSTVAEHYLGLKVERFAKMVEEQPEQLEALLKSKIERTVTAKLSIKVHKFTTQRVSSRRWTGLFCPYSMRTGKTMEMMRRLLMNKRKLTMITKMEK

SEQ ID NO: 136657 - protein, 185 aa, Heterodera glycines
  Coding regions on vcDNA: vcDNA=SeqID_63080; Strand=-; Position=1 -199,241-395,438-638
  Homolog annotation: Hit_ID=NP_492694.1; Match level="QueryCoverage =75%, HitCoverage=33%, E-value=8e-64, Identity=82%"; Hit description =casein kinase gamma (46.4 kD) (1K804) [Caenorhabditis elegans] emb|CAB60309.2| Hypothetical protein Y106G
MSINTHLGKEQSRRDDLEALGHMFMYFLRGSLPWQGLKADTLKERYQKIGDTKRATPIEVLCEGFPDEFAQYLRYARRLDFFETPDYEYCYGLFKTVLERTGHTYDYEFDWTHKLNQATTPSGSIHTAVGVEGGELRKTRTDYAKRASVPKPRNSDGLLRSGQQVNSTTTGGAIGHHGPGFGSTQ

SEQ ID NO: 136658 - protein, 94 aa, Heterodera glycines
  misc_feature (92)..(92): Xaa can be any naturally occurring amino acid
  Coding regions on vcDNA: vcDNA=SeqID_63081; Strand=+; Position=1 -135,300-446
  Homolog annotation: Hit_ID=CAE65045.1; Match level="QueryCoverage =94%, HitCoverage=19%, E-value=1e-27, Identity=61%"; Hit description =Hypothetical protein CBG09886 [Caenorhabditis briggsae]
VMCEQSLCLSLSNENACETLILADLHSAEHLKTQAVEFINLHANEVMESDGWKILVKEHPPLLEQVFKALATQQTPPIILNQPPRKRPRQFXDV

SEQ ID NO: 136659 - protein, 255 aa, Heterodera glycines
  misc_feature (17)..(17): Xaa can be any naturally occurring amino acid
  misc_feature (205)..(205): Xaa can be any naturally occurring amino acid
  Coding regions on vcDNA: vcDNA=SeqID_63082; Strand=-; Position=1 -60,149-248,368-420,463-510,551-698,739-850,905-957
  Homolog annotation: Hit_ID=NP_493502.1; Match level="QueryCoverage =81%, HitCoverage=32%, E-value=1e-57, Identity=60%"; Hit description =src family, fyn and suppressor of pole hole related, with N myristoylation domain, SRC oncogene related (
KRCQRQSNANALPLPFXAEAQLMKRLRAQLMKRLRHPKLLQLYAVCTREEPFLIATELMQENLLHFLQGHGRVCNVAQLVDVAVQIASGMRYLEVAQLVDVAVQIASGMRYLEEKNFIHRDLAVRNIEKNFIHRDLAVRNILISHPSMVKIADFGLARLIRENEYEARVGARFPIKWTTPEAANYNWTTPEAANYNKFTVRSDVXSFGILLTELVTFGRIPYPGMTNAEVLHKVRMDPMTNAEVLHKVRMDPNPS

SEQ ID NO: 136660 - protein, 45 aa, Heterodera glycines
  Coding regions on vcDNA: vcDNA=SeqID_63083; Strand=+; Position=1 -104,544-577
MHSNNVKYEEIKQLMTFPLTVAEHFMKRLSKFVQSNWPITFSRYR

SEQ ID NO: 136661 - protein, 58 aa, Heterodera glycines
  Coding regions on vcDNA: vcDNA=SeqID_63084; Strand=+; Position=1-175
EACEFDDQPLQLATVAVVVTAQFMLKRLQKQRTHATGECQRIVAMARLHKVKLDKTVA

SEQ ID NO: 136662 - protein, 165 aa, Heterodera glycines
  Coding regions on vcDNA: vcDNA=SeqID_63085; Strand=+; Position=1-498
MVRERGTERERRDRERVTKIFLTLLTQYPKTNRPTQEHGVRCVHRRWNAAPALRLRCADRRWPWHFGRCGGRRRSKQLELLGRNGGRMLIIIQFKKDAELDEQLDRRKAEEEEQQRAKGREYFCDICGRTLWFADNVQAIKHKKGHQQKEEEKPKQDEDGERTDG

SEQ ID NO: 136663 - protein, 267 aa, Heterodera glycines
  Coding regions on vcDNA: vcDNA=SeqID_63086; Strand=+; Position=1 -253,304-357,399-813
  Homolog annotation: Hit_ID=AAA93487.1; Match level="QueryCoverage =88%, HitCoverage=44%, E-value=2e-29, Identity=37%"; Hit description =Hypothetical protein F36D4.4 [Caenorhabditis elegans] ref|NP _505436.1| somatostatin receptor 5 like (5J882
NWLCGANVVAQFSMSANSAAAAFAPKWRHLMSRHKYLIVIGTVLFVDILFLFPYSGIQMVALLHLNNLLATSQMTTLIRWCLQILIGVHSVCQPLCYFRMTLQILIGVHSVCQPLCYFRMTEFRRLACCLGEFRRLACCLGQKRRWGQRKQRGRIRFWWGDGRHNQSNDKREQKRRHRRAPADHEEKHRIEDSVLPGNGPDRRNSDDGRTNRAKGRERRLGKRERERNAKPNDGKGKEELQTIPTGAANVADHPKTEMDAQSELIVQ

SEQ ID NO: 136664 - protein, 123 aa, Heterodera glycines
  Coding regions on vcDNA: vcDNA=SeqID_63087; Strand=+; Position=1-372
VKLDYKFEKILKEPNYDLKLLNEHEFEQLGKIGQNLVKKFKEIKFFGSQNQTKHLTAEKGNKKELTVALLTTGEEKSVINTNEEAISTLNEEFDAMMKEKAEKVDSDEEYGKMNKEALKWLVQ

SEQ ID NO: 136665 - protein, 31 aa, Heterodera glycines
  Coding regions on vcDNA: vcDNA=SeqID_63088; Strand=-; Position=1-94
KKQIYKSKIIQLRNQLKANCDEETKVLQDFL

SEQ ID NO: 136666 - protein, 276 aa, Heterodera glycines
  Coding regions on vcDNA: vcDNA=SeqID_63089; Strand=+; Position=1-831
  Homolog annotation: Hit_ID=AAP92574.1; Match level="QueryCoverage =82%, HitCoverage=33%, E-value=2e-12, Identity=26%"; Hit description =Aa2-050 [Rattus norvegicus]
MDNSENHDNSFDQSNCPSQKNQTNYSADTSTDLLMLPNTVNHYIHSNPMMTLSQQNYYNQENPSTSTNQSTYPDHANTMALNNQSIYADQANTYALNNHSTFSDQTNSLALNNQSNYPDQANSLALNNQSNYPDQANSLTLNNQSNYPDQANSLALNNQSNYPDQANPLALGNQSTYPDRSLFMANQNNEVNGLIPTIDSDQADQTILQSNKGSTGQQLQQNVQVQQGNLPTMLSMTTPVPEQPFDGTHSMVSQYRIFLYPFFLRVFVFYLIITKT

SEQ ID NO: 136667 - protein, 126 aa, Heterodera glycines
  Coding regions on vcDNA: vcDNA=SeqID_63090; Strand=+; Position=1 -176,298-501
MGSLKKYSMVLNHAGLRRELEQKKTHPRAQSRGAANPKQQQQEEGRIRVQLKGDDGENRGRRGGTAKVHDPTTNDGIRCGNGAQTEDTAAANPSRTERRDGEAEEAEVNERTDIQPMTSNVQLIQL

SEQ ID NO: 136668 - protein, 73 aa, Heterodera glycines
  Coding regions on vcDNA: vcDNA=SeqID_63091; Strand=+; Position=1-240
MIGRAVRNRPFIFEGIFKFILYPRKMAISFFEKFYTSQKRLRMRRRAVHNRHFISQRIFIFRGYPKKNGYLFF

SEQ ID NO: 136669 - protein, 92 aa, Heterodera glycines; identical to SEQ ID NO: 129648
  Coding regions on vcDNA: vcDNA=SeqID_63092; Strand=+; Position=1-304

SEQ ID NO: 136670 - protein, 110 aa, Heterodera glycines
  Coding regions on vcDNA: vcDNA=SeqID_63093; Strand=-; Position=1 -103,162-391
  Homolog annotation: Hit_ID=P09670; Match level="QueryCoverage=86%, HitCoverage=62%, E-value=5e-33, Identity=66%"; Hit description =Superoxide dismutase [Cu-Zn] pir||A24475 superoxide dismutase (EC 1.15.1.1) (Cu-Zn) - sheep
CKAAGAHFNPHGKRHGSKESEERHVGDLGNVKAAENGVAVVDIKDYLVALNGVNSVVGRALVVHEKADDMGKGGNEESGKTGNAGKRIACGVVGVIREEPMKVTTDQTNG

SEQ ID NO: 136671 - protein, 82 aa, Heterodera glycines
  Coding regions on vcDNA: vcDNA=SeqID_63094; Strand=-; Position=1 -67,173-354
MRRFGAAGPRNRFEADAVLLMIVMTRVRHFEKDCDMDSMLDLDKNPGPGKIQVPRDLDFLKLILDLVPGKIQAWIQQVQVEL

SEQ ID NO: 136672 - protein, 118 aa, Heterodera glycines
  Coding regions on vcDNA: vcDNA=SeqID_63095; Strand=-; Position=1 -104,170-269,798-950
  Homolog annotation: Hit_ID=CAE70223.1; Match level="QueryCoverage =91%, HitCoverage=7%, E-value=4e-51, Identity=83%"; Hit description =Hypothetical protein CBG16703 [Caenorhabditis briggsae]
MDGFRFWRSGYWAQHLAGRKYHISALYVVDLVKFRQIAAGDRLRGQYQGLSSDPNSLSNLDQDLPNNMIHQVRIHSLPQEWLWCETWCDDVSKDSAKTIDLVNTIISKITQILEYSII

SEQ ID NO: 136673 - protein, 167 aa, Heterodera glycines
  Coding regions on vcDNA: vcDNA=SeqID_63096; Strand=+; Position=1 -24,85-174,1224-1447,1654-1819
MAYFEFPEADFDSLEALVEFAYTARLRIGSRRVKELYRHSALRAAGERVDAHIESLAEKTHLLVTNSEEQHKPLANNNGGASSAAPTMANNGNGQQHNNGRLQDANELDEKVLIINTEFGFFLFVRLLSSKTDQQSSLHVMGATPIKLNGADMGRLSTKDAIKFASW

SEQ ID NO: 136674 - protein, 251 aa, Heterodera glycines
  misc_feature (223)..(223): Xaa can be any naturally occurring amino acid
  misc_feature (230)..(230): Xaa can be any naturally occurring amino acid
  Coding regions on vcDNA: vcDNA=SeqID_63097; Strand=+; Position=1 -118,178-314,421-912
  Homolog annotation: Hit_ID=NP_510109.1; Match level="QueryCoverage =86%, HitCoverage=38%, E-value=6e-57, Identity=36%"; Hit description =influenza virus NS1A binding protein like (90.9 kD) (XN244) [Caenorhabditis elegans] emb|CAA92005.1| Hypo
GVFAVCGSNGNNDLSSCECFDPTTGRWNEVCPLEPARSHNGCACASLSGLLYCIGGSTDHATLGDCRCYDPATNEWREIAPLKAQRSQAGCTAWRGLVVCVGGCDKWNCLDSVEAYDPQMDQWHHLARLRTPRRGCAVAVLGNSLFAIGGHDGHNVLATVEVLDSPNAQWRPGPSMQQSARVHHHAISASGIGIFVVGGFDGTHFLASMEVMESEESGETDVXMKQILIXNFKGWHFSLDDRKVEVDPTLT

SEQ ID NO: 136675 - protein, 302 aa, Heterodera glycines
  Coding regions on vcDNA: vcDNA=SeqID_63098; Strand=-; Position=1 -262,351-431,514-881,1023-1106,1156-1267
QISPTLPTDHRKEAAAESVLQREAEAKQKGEDQRIIVVHAEREGTETAERTTVHFKRNWTSHASALTTSAPIWDGRIEIDDMSSTDDEAEIDAVLADAQRLRKIALERELPPTAAMSRPLLYNPLDFSLSSESGLISPSDAALLPAVTYKQLMLLTGGGSGPSEKQQQSNSVSGTGTSLGSPTVIGDDGVNTVSGTCTSSSASAEGAQPPLQQRPHATVAPTTTIQAAPATMYKMNGQQYQYHHQNPQLRPRSHPYSQGYVPPPVGHAYRYQVSRGSVSKVYTGGNKMQFAIQQQNVPLGDR

SEQ ID NO: 136676 - protein, 43 aa, Heterodera glycines
  Coding regions on vcDNA: vcDNA=SeqID_63099; Strand=-; Position=1-132
MLLSLDYVVLKLCDFGTIAKHRTDMASTCGTAAWMAPEVFRGE

SEQ ID NO: 136677 - protein, 54 aa, Heterodera glycines
  Coding regions on vcDNA: vcDNA=SeqID_63100; Strand=+; Position=1 -46,554-672
MTTESLVIPKDIANKRLCLQMKSFPCSNKREKLLVQTVLYLRLVCLFRTQNAAM

SEQ ID NO: 136678 - protein, 438 aa, Heterodera glycines
  Coding regions on vcDNA: vcDNA=SeqID_63101; Strand=+; Position=1 -195,278-421,527-670,725-883,967-1104,1226-1573,1812-1904,1975-2070
MRFKGRHSQIRRLEARSLEFNPYAMPRDNKKRSADGKWMTQNERIKLPPFGHFTSEQQMHFREIQKSSAINWVFDELLNLTEAGDGRFVTLEGDAELVLSAKKRLAKLITEIEDSHLHSSSVRLANSPTTGRTLYRTVVKVPSPAWRLVIGGGGKTIKGLKERFGVSMRFLGDNFVAYPHFRSLSIFGHDQMNVHSAREHIEREFVAKNDEYLGQNTSQAKAKGRRKFLSTTDDPNNNIDLIDANAYGHKTEIGGWESDEESWAVDEPHVCSDFTMNEQKTDETVSNSEEELLKWDDEDKEEDKEEEQKDEKKTKSNIFGGERGQNGGDGNTVKELGKEAESAKNEDSGIVGDGEEDELFLLIEGKGTQKDGDDDEPLDRNALACQLERAKATLLGDEHLSRELARTQALLRARERECEQLRLENQRLKLQLSSSTVA

SEQ ID NO: 136679 - protein, 71 aa, Heterodera glycines
  Coding regions on vcDNA: vcDNA=SeqID_63102; Strand=+; Position=1 -37,87-211,354-407
MAKATKARWAKKTAPQLNPNAEIPPQDEAGPRIGARREQFRKRDLTGNSIRKILAQILSPNDPRPIFYSST

SEQ ID NO: 136680 - protein, 75 aa, Heterodera glycines
  Coding regions on vcDNA: vcDNA=SeqID_63103; Strand=+; Position=1 -181,262-306
LRMCHCGSNSFPLGVRLRDCTHLSCVQCFVAYAEELLSRMSLKWHPQVGYTVGCPFYGCTAVVTDVHTLYLLDKH

SEQ ID NO: 136681 - protein, 25 aa, Heterodera glycines
  Coding regions on vcDNA: vcDNA=SeqID_63104; Strand=-; Position=1-76
REKKIMFFSGTLYLLVHISFFETVC

SEQ ID NO: 136682 - protein, 44 aa, Heterodera glycines
  Coding regions on vcDNA: vcDNA=SeqID_63105; Strand=-; Position=1-209
WYRSVHFLWDSVVPVLRWHWFEFIPCFLDLAHQALSNDTKFVRI

SEQ ID NO: 136683 - protein, 126 aa, Heterodera glycines
  Coding regions on vcDNA: vcDNA=SeqID_63106; Strand=+; Position=1 -140,536-600,659-832
  Homolog annotation: Hit_ID=CAE66729.1; Match level="QueryCoverage =94%, HitCoverage=12%, E-value=8e-23, Identity=50%"; Hit description =Hypothetical protein CBG12078 [Caenorhabditis briggsae]
MAIELNNNNACASTEEDTSSSPNAANLTGTPSGEAMSGEESARLKRSYVLQELVESERTYVQDLASISDGYIASLREMELSDEDREKVKIIFANIEQILDFHKTFFLKEIEKSLNDYEAAGIPSLI

SEQ ID NO: 136684 - protein, 58 aa, Heterodera glycines
  Coding regions on vcDNA: vcDNA=SeqID_63107; Strand=-; Position=1-234
VISLCFWWGAWNSGIMRTRPIWQVKQRLLTSQKVRCRDETNQHCLPRGTRHGPPKEWI

SEQ ID NO: 136685 - protein, 48 aa, Heterodera glycines
  Coding regions on vcDNA: vcDNA=SeqID_63108; Strand=-; Position=1-145
KNLKLDALFKVLALPDEEFEEWLRELKLLHTTRFCDCGKEMRYKWIKG

SEQ ID NO: 136686 - protein, 183 aa, Heterodera glycines
  misc_feature (2)..(2): Xaa can be any naturally occurring amino acid
  misc_feature (18)..(18): Xaa can be any naturally occurring amino acid
  Coding regions on vcDNA: vcDNA=SeqID_63109; Strand=+; Position=1 -113,680-769,814-894,943-1113,2604-2648
  Homolog annotation: Hit_ID=NP_498930.1; Match level="QueryCoverage =94%, HitCoverage=43%, E-value=4e-32, Identity=46%"; Hit description =solute carrier family 35 member A1 (39.9 kD) (3J836) [Caenorhabditis elegans] gb|AAK82925.2| Hypothetical
AXNSKIVWQIYSWASCQXGYYWYRKPINSLSMYISCSVVFFAECLKLLITLFFIFRDCDFSTEKCKKLLDREYFSKPLLDREYFSKPMELLKMSVPSIAYAIQNNLDFVSLNLDFVSLSNLDASVYQVMTQLKIPSTAIFMMLFLGRRFSTKRWIAIFLLCAGVASVESSGATDREGGPRRRT

SEQ ID NO: 136687 - protein, 44 aa, Heterodera glycines
  Coding regions on vcDNA: vcDNA=SeqID_63110; Strand=+; Position=1-132
KASQPILAHPIPSTIAFIHPIMNAKIIRVPKIACDLRLAKNGVS

SEQ ID NO: 136688 - protein, 50 aa, Heterodera glycines
  Coding regions on vcDNA: vcDNA=SeqID_63111; Strand=-; Position=1-152
YQLRNTGRKVIALTGFSPVQLNLQIEGLQMALELHQSLCTILPLNISGCY

SEQ ID NO: 136689 - protein, 59 aa, Heterodera glycines
  Coding regions on vcDNA: vcDNA=SeqID_63112; Strand=-; Position=1-180
DPIYQQLAEQKYAIDNFPGLDDIFRKTRFFLVNSQPEVDFDNYRSVKGMDKSNSSEDLI

SEQ ID NO: 136690 - protein, 103 aa, Heterodera glycines
  Coding regions on vcDNA: vcDNA=SeqID_63113; Strand=-; Position=1 -42,300-333,423-658
MVEKHKKLVQQTRPLGVEIIDTAKKVASGCVTCIVRLLNERGEECAGRPKPDHGTFPTLLQQIPPNYTLVKNDQLFILDQYIKEAQHRENVRVTTKKKVEKFS

SEQ ID NO: 136691 - protein, 90 aa, Heterodera glycines
  Coding regions on vcDNA: vcDNA=SeqID_63114; Strand=+; Position=1 -232,1959-1999
MGARALLRPLLTLHPVKQAEAMRRVHLHSEALRLAEKRRIRADLVATMEEMRARRKADATRDGEAKSEAFGTNYQQESICACPCPKSDQT

SEQ ID NO: 136692 - protein, 80 aa, Heterodera glycines
  Coding regions on vcDNA: vcDNA=SeqID_63115; Strand=-; Position=1 -130,914-961,1006-1070
MSSASSARFVPSLLFAPRHALRHRCALLVAALLLLFGLVTVCADQPTQIGKQPMACGENGPSSLRCNKWAKRTENESDDD

SEQ ID NO: 136693 - protein, 56 aa, Heterodera glycines
  Coding regions on vcDNA: vcDNA=SeqID_63116; Strand=-; Position=1 -40,101-231
MCPFVFLVAPIALGHCLRHRKKKNKKRDKAAKKGRRLLTISDGQKNKNSDQPQKKK

SEQ ID NO: 136694 - protein, 125 aa, Heterodera glycines
  Coding regions on vcDNA: vcDNA=SeqID_63117; Strand=-; Position=1 -185,383-434,739-879
MAQHGAFSTAARTEDQCEVGTSKIATEIWGEQLSYCFCAVGDVGAHNSNVKVAFPEELSYGCESRHSLSLGPFFGADDAEKDFRDYWTWEPGSRSRTGRTLMLMMHFGPLRHGYFVDKLFITFIT

SEQ ID NO: 136695 - protein, 54 aa, Heterodera glycines
  Coding regions on vcDNA: vcDNA=SeqID_63118; Strand=-; Position=1-164
MRTLLRGDPSDLEALTDFLRANGVVENAAAMAASPLLTAEISLGEGTDSAKSTA

SEQ ID NO: 136696 - protein, 170 aa, Heterodera glycines
  misc_feature (3)..(3): Xaa can be any naturally occurring amino acid
  Coding regions on vcDNA: vcDNA=SeqID_63119; Strand=-; Position=1 -117,227-281,337-415,611-747,788-827
  Homolog annotation: Hit_ID=CAE71449.1; Match level="QueryCoverage =80%, HitCoverage=29%, E-value=4e-34, Identity=52%"; Hit description =Hypothetical protein CBG18361 [Caenorhabditis briggsae]
TDXLCRVAEGIVPSLIIAMAFAAHWYCVNFGFIPFAYRGLETGSRKTVAYAVKQDKIVFVFESALLPNNGEMSAHLIVFVFESALLPNNGEMSAHLAKHGDGTKDVAFEVDNLDWVLDTARRAGAVVAEETAEERDQNGHIRRASIRTYGDTIHSLIYGDTIHSLIERHH

SEQ ID NO: 136697 - protein, 152 aa, Heterodera glycines
  Coding regions on vcDNA: vcDNA=SeqID_63120; Strand=-; Position=1 -103,194-234,279-453,504-643
MPSTTEEAEDLEEDEEERHNATEAGNSVVNTHYCYLESPFNDDLFAIMQNRWNLSCACASADGSIDNSKVHLGRDRFIVRNLFQIYRFDVLQCVDLDECLYEECPKGQQCLNMNKGKICACPVGSYKSKDGRNCIKVPVSGNLKELLEAPFY

SEQ ID NO: 136698 - protein, 47 aa, Heterodera glycines
  Coding regions on vcDNA: vcDNA=SeqID_63121; Strand=+; Position=1-142
MSTKPPADNESNNEGQQKSSNSLARDGNYEDGNMKNRDKQKEFGGPA

SEQ ID NO: 136699 - protein, 37 aa, Heterodera glycines
  misc_feature (36)..(36): Xaa can be any naturally occurring amino acid
  Coding regions on vcDNA: vcDNA=SeqID_63122; Strand=-; Position=1-136
SKKNIKLKIFKKKRKKEFNLSSLFFYHSVDSANNLXL

SEQ ID NO: 136700 - protein, 719 aa, Heterodera glycines
  Coding regions on vcDNA: vcDNA=SeqID_63123; Strand=-; Position=1 -1848,2321-2632
MESVPLRYFVGITHSGHSVTPFRGDDCWAKHHQQEEHVEQHQLNPEDYHLAAATVCFEPLQRVERANELETYPRRAYCRDVKMPKSADERGEPLPFATRIGAILHLKSTNRTTNQWQPPPISVYNGPHKLLAPAEQLTQTDIEASICQNLPPNSVMPIKSVKKEEEEATDNVAINAANANIVRHGSKKMAKIFVTLKSVTTMREDQAATASAGNVNALQIIITPTAQIVHELCPTSELLSVPIGSCIDKQQKDDDDAKSADNNQINGGGGKKFVAKITVTTSAITKGTVGPTSSRHNANEEARDGQLQQLHLLNRKDEFMGQPIEQIVAMANKRSTQVGQDDDQQQKVKTTSRKKYAAKIVLKTTQTNGATTSKEAEKMTNKQFEAPAAEWHVLNRESELKCHPIGEFVALTKAAEQKRTDVENDEPKPANCKKYNVKIVMKSPSDDHVVCPPTTDEECHLLSRHSELKCRPMGEFVAPIKNKLMEEGRSDVQKAAPTNGKKLTAKIVTTKTIAAVEQTQQQLLENEPKNLQQQQQMHSLHRNEELKCHPIAEFVTCTASTSATVVDDDEASKKEELEQQGQQNGGFPAVDEEGKRLSRKRKRPSAKMALLGGFWQQIGTSKDKQKKKGKKKKTDHEKKAKKQNGQKATATAATTTSASSSSSSPSSSDAEEIHVLVQDEEGKQQQQMPAINVSIEKASLKIALIDESFSTEQHKRFFL

SEQ ID NO: 136701 - protein, 51 aa, Heterodera glycines
  Coding regions on vcDNA: vcDNA=SeqID_63124; Strand=-; Position=1 -87,160-202,445-470
MRVHRFAWPGIIKFSHRRHYFSIKLKAGEVDPKKETSLTYTLVEPIYSNVV

SEQ ID NO: 136702 - protein, 51 aa, Heterodera glycines
  Coding regions on vcDNA: vcDNA=SeqID_63125; Strand=+; Position=1 -65,157-245
  Homolog annotation: Hit_ID=CAE57287.1; Match level="QueryCoverage =98%, HitCoverage=7%, E-value=2e-12, Identity=63%"; Hit description =Hypothetical protein CBG00196 [Caenorhabditis briggsae]
SVPPQSRSPALGLQGLLVSGIGTLPSPVIWGWLVDSACLVWDNECELGSCQ

SEQ ID NO: 136703 - protein, 210 aa, Heterodera glycines
  Coding regions on vcDNA: vcDNA=SeqID_63126; Strand=-; Position=1 -51,112-373,416-734
  Homolog annotation: Hit_ID=NP_507780.1; Match level="QueryCoverage =98%, HitCoverage=16%, E-value=7e-15, Identity=27%"; Hit description =predicted CDS, DNA polymerase type B, organellar and viral family member (5T899) [Caenorhabditis elegans]
MPIEEKEEKDVSRIVVWDSETSQDSIYKGDQKEHIINYISVRVTCTECCDDKNRTNCKICGEERTKDWSEAEGHEPTKDFVEWILMAFTNYDTYIFAHNAGRFDGHFVFNYLCRTGKNPLPLINGLKIYEFKVRNSKKHSMLIWRDSCLLMPVKLESMKATFNLGCEDKAFFPYYYNKKENYGIRLEHLPPMEDYAPGSMNKEKYAKFEK

SEQ ID NO: 136704 - protein, 209 aa, Heterodera glycines
  Coding regions on vcDNA: vcDNA=SeqID_63127; Strand=+; Position=1 -183,2231-2676
  Homolog annotation: Hit_ID=AAG27458.1; Match level="QueryCoverage =92%, HitCoverage=18%, E-value=3e-10, Identity=22%"; Hit description =latent nuclear antigen [Human herpesvirus 8]
MDRFNRANHQSQNAEQRRLKKEKAERAMRDIELYEELQKLKNETTAISETVKKRKSHSMFLDAQTVELEAQNAEHIKTINRQKLQMKEKDEDIAKVRKQNEEQTKMVGTLQTEIKELKAKVELRDTNLEIKEEIIKIHEQKIGGMEKANVQLAETNKNLHEEIAVLTETNQNQEELIAGQGETIKNQQEKISKLEGMLITTGHVEQSIG

SEQ ID NO: 136705 - protein, 287 aa, Heterodera glycines
  Coding regions on vcDNA: vcDNA=SeqID_63128; Strand=+; Position=1 -446,692-826,1298-1393,1589-1660,1744-1858
  Homolog annotation: Hit_ID=AAK50002.1; Match level="QueryCoverage =100%, HitCoverage=27%, E-value=4e-13, Identity=23%"; Hit description= ORF73 [Human herpesvirus 8]
DAQTVELEAQNAEHIKMINRQKLQMKEKDEDIAKVRKQNEEQAKMVGTLQMEIKELKSKVELRDTNLEIKEEIIKMHEQKIGGMEEANVQLAETNKNLHEEIAVLTETNQNQEELIAGQGETIKNQQEKISKLEGMLITTGHVEQSIGMNLSQIQSGHKVLTLADELADCEPKAELDKAAKDDKQEELELEKNCKLPAPTESVEGNQLESIQRQQEKDEGGKQEKGTTDECGQENQQQEKGEKDTEESNKNLATSEDSGNPLKSSEENQKQQQMDEGEEKEEEECKE

SEQ ID NO: 136706 - protein, 34 aa, Heterodera glycines
  Coding regions on vcDNA: vcDNA=SeqID_63129; Strand=+; Position=1 -66,123-161
MAISIFEKFSMQQTLSNMKRSAKNVFQKNGYLFF

SEQ ID NO: 136707 - protein, 29 aa, Heterodera glycines
  Coding regions on vcDNA: vcDNA=SeqID_63130; Strand=+; Position=1 -66,123-146
MAISFFEKFSMQQTLSNMKRSAKNGYLFF

SEQ ID NO: 136708 - protein, 34 aa, Heterodera glycines
  Coding regions on vcDNA: vcDNA=SeqID_63131; Strand=+; Position=1 -66,123-161
MAISIFEKFSMQQTLSNMKRSAKNVFQKNGYLYF

SEQ ID NO: 136709 - protein, 82 aa, Heterodera glycines
  Coding regions on vcDNA: vcDNA=SeqID_63132; Strand=-; Position=1 -79,142-311
MLFGTDHEIQFVFVSTDFAGIMYRNKFVSFFLFFNLCGNLFIVKLAIVVLYIRVGSVRDITGILPGFRSRLISKKVRVRDLG

SEQ ID NO: 136710 - protein, 18 aa, Heterodera glycines
  Coding regions on vcDNA: vcDNA=SeqID_63133; Strand=+; Position=1-56
YREAIPEGFGLPINLGAS

SEQ ID NO: 136711 - protein, 23 aa, Heterodera glycines
  Coding regions on vcDNA: vcDNA=SeqID_63134; Strand=+; Position=1-71
VIIGTQMLSLSKREMNKNLKIFN

SEQ ID NO: 136712 - protein, 150 aa, Heterodera glycines
  Coding regions on vcDNA: vcDNA=SeqID_63135; Strand=+; Position=1 -111,470-811
MKIWAEWSDENMPSSIVQCLISFSLEVKTRSSNEFPLVNLFISDPISSQFSLSVSINCCRKLWTSSGGSQHPHKLSILFHPSVVFRRIVNTDDDVPPAGPWSAIHGPEHSAERLELRTAADFFCHATKASFWKARDDKRTFSGRGLFWAG

SEQ ID NO: 136713 - protein, 84 aa, Heterodera glycines
  Coding regions on vcDNA: vcDNA=SeqID_63136; Strand=-; Position=1 -52,176-378
MYTAVDNLNIAANIKNEPDKKNKRNRRKKRFVDLASLGFLAFLIVFSLIIWYISGKIGTWLANQDFVPNWLVVSICRFLGPEMQ

SEQ ID NO: 136714 - protein, 68 aa, Heterodera glycines
  Coding regions on vcDNA: vcDNA=SeqID_63137; Strand=-; Position=1-207
MKSILFCRFSLIAFAFPLFLFPKECFSMDGQKMMAQMAEDMKNEVKMGEWGNNIIGNLIHKHSLIIYI

SEQ ID NO: 136715 - protein, 165 aa, Heterodera glycines
  Coding regions on vcDNA: vcDNA=SeqID_63138; Strand=+; Position=1 -54,1493-1738,2001-2063,2192-2326
  Homolog annotation: Hit_ID=NP_388707.1; Match level="QueryCoverage =89%, HitCoverage=35%, E-value=4e-39, Identity=52%"; Hit description =hypothetical protein BSU08260 [Bacillus subtilis subsp. subtilis str. 168] emb|CAB12655.1| yfiG [Bacillus
MGVFYFMLFSLVLLNGIQNPSYRCFLQKVTWICTLGGLLFGYDTGVINGALPFMRDELELTDLTIGLVTSSLLIGAAVGAFVCGKLSDRLGRKRTLIILSSILPFRFLLGFAVGGASAIVPVYLAEVSPAKRRGQLVTRNELMIVTGQLLAYVINAILGNIWSDQ

SEQ ID NO: 136716 - protein, 121 aa, Heterodera glycines
  Coding regions on vcDNA: vcDNA=SeqID_63139; Strand=+; Position=1-364
VSRGLASITFCEREIGIEESAVIDCAHYMREVCASFILLQQQHQIGGNNMTVEIDEALFTNKNNVGRVLPEQWVFGAGLGEARLSTRSRSRRRSPIFIRSRSPKLEAQKPEVFEGFEAEAE

SEQ ID NO: 136717 - protein, 33 aa, Heterodera glycines
  Coding regions on vcDNA: vcDNA=SeqID_63140; Strand=-; Position=1-104
QSNPGTICEGFANPFEPMRTWAPTFRDSHMACV

SEQ ID NO: 136718 - protein, 120 aa, Heterodera glycines
  Coding regions on vcDNA: vcDNA=SeqID_63141; Strand=-; Position=1-363
  Homolog annotation: Hit_ID=NP_615913.1; Match level="QueryCoverage =95%, HitCoverage=31%, E-value=3e-09, Identity=29%"; Hit description =hypothetical protein MA0960 [Methanosarcina acetivorans C2A] gb|AAM04393.1| hypothetical protein (multi-d
MEPNDGITDQPTDQDGSDTEATDSTTVGSDPGPNDNDQNATGPTDEDETGTEATDSTTTTTESNAIDEEGTDQNATNSSDQGESDAEAEATDSTTNGSDLEPNDQDENGADADSTTTNGI

SEQ ID NO: 136719 - protein, 144 aa, Heterodera glycines
  Coding regions on vcDNA: vcDNA=SeqID_63142; Strand=-; Position=1 -47,306-471,521-742
MATVPREKKSRIAEAVSPSLANISTNIELHPHNNALGGSSSHKFIKRPLNAYMIWTRQERKRILTDDPKMKMNEVSKAVSFFICFSIYQFVFVMCCADILTITLLDSDGRKMEENVGQGKGDLSQISQKRLFSETLLRNGKKIL

SEQ ID NO: 136720 - protein, 98 aa, Heterodera glycines
  Coding regions on vcDNA: vcDNA=SeqID_63143; Strand=+; Position=1 -40,355-411,459-513,621-762
MVLQPIEAVPIYRVRSLWSDVGITAETVVEYFAVNVPLMQSLFLSLVMTEGFEFAIYAMKIGCDNTIPSPAIKNMVRFGEDGETANALADNGPTTAGP

SEQ ID NO: 136721 - protein, 93 aa, Heterodera glycines
  Coding regions on vcDNA: vcDNA=SeqID_63144; Strand=+; Position=1 -55,131-354
MKIKEAMETIGTDVKVENAHEEASSARGKDMQNIYEAEKKQKREEEPSEGGREEGAPARPPNSGEGGRTTKKGGRKGKRLTDLDIGNASESDT

SEQ ID NO: 136722 - protein, 84 aa, Heterodera glycines
  misc_feature (19)..(20): Xaa can be any naturally occurring amino acid
  Coding regions on vcDNA: vcDNA=SeqID_63145; Strand=-; Position=1-252
KCFGTFLWLFAKSPRRSPXXGKILVLRWFWVLFIFICTARLPFVLIFYVSGMAFLTNRVRLGRIANVQVGQSFALSSAFLRRSA

SEQ ID NO: 136723 - protein, 231 aa, Heterodera glycines
  Coding regions on vcDNA: vcDNA=SeqID_63146; Strand=+; Position=1-696
MASLIQKGITFTLKALDSARTTTALSLHPDADLSNWEYAVKLETQCTRVNREVQTMEAQLDNLRNLSNNWIDLLNRLEGAEKDKGEKEYVKFDTHEKIAERHDAATTKLRDLGDLEAMLSADAKLYRGRAEREARADQQANPPPQAATPPMAAPTFTAPLYQFQPIQLDKFFGQKRKWPEFYESFKSAIGSQTISKAQKLNLLRNLLGGEARELIAGFRLEDQTTRRSSSC

SEQ ID NO: 136724 - protein, 1938 aa, Heterodera glycines
  Coding regions on vcDNA: vcDNA=SeqID_63147; Strand=+; Position=1-5816
  Homolog annotation: Hit_ID=NP_508324.1; Match level="QueryCoverage =73%, HitCoverage=53%, E-value=1e-126, Identity=26%"; Hit description= predicted CDS, peptidase family A16 and RNA-directed DNA polymerase and Integrase, catalytic domain and
MLEKKLTPAFLRNILNKKGEDPANWTTTKFRDVLNEAVRKEVQIQEVMGEYGHHHQPLNRPARPQAQAHQVQRARMPTANFRNRNASPANRERTFMSSTIEEVQQRMNHRPQLRKSQQRGSRPTQAPYNVPIRNGTAQAGSRNPPSPCIFCNGTHWNEKCQKLSTVQQRSAFVREKGLCFKCMKTNHRANECPRPAKCYKCKRSHPPALCPEGNNSMTQHAAAVVTERPQGESESTNQTAQLCNAIQSKDTRALLMTAKATIYNPAQPCLSMMATVFIDPGSHRSFVSCNTAKQLELTNLGTEECFLTSFGEREPKRYVSDRVAIGFLCPDGDRFIFNLNALKFLLNNLPVLQLNEMDNMQLQQKKLYIPHESRQPDVMLGMDVWHELQVQPVERLPSGFTICQSKIGKIISGSGRIELSQPSNVTFVVTVTDENVFTTEEDLKADDELNKFYGLNIIGMDDSSPPIDHDEVMKNFKRNLSFVNDRYQIALPWNDKVTQLPTNYHQAKARLISLVRKLRTINLVDEYQVILDEQLQNGIIERANPDHSCGPVHYLPHRAVIRTDRATTKIRIVMDASAKPKSTPSAPSLNECLHTGPLLLKDLTGILLRFRQMEKVVLADIEKAFLQVGVREQDRDATRFLWLANPKEANLDQLRKEDIHILRFCRVSFGLTVSPFLLNATIREHMALYDTDVAQRISNNLYVDNIMMEVKPGENIREIATEAKNIFESAGMRIREFYGSHIEELKELDSSDLANELEDTKVLGIKWKPKYDQLVFSMPHFDSPITKRNILSHIAKVYDPLGLISPALLPAKHFLQIVQNANYKWDDPLAEDLKLMWLKLMRAWDGFGFNSLVEFPRHIIAGISEEFHCFCDASKSGLGIALYQVAETHYNKRESNLIFGKSHVKPLKVADHDSTIPKLELQALTLGVKATKFVQTQLNFADSQVILWTDSQCSIERLKENRTHDRFVVNRLKKIREANFKVRHIRTAENPADIASRGTDPQSLQASLLWRYGPAWLTKTHKWPETNVTYTPGEETREETEPPIVEWSATLQEEQKFSPSIQFERFSNWNRLKAAAAYAIRFALALLQKRNVVPAIDSLLYQQERQAGLLTAKELENAETWILLETQRLHSPTETATNNLKLSSSSSIEPLRCQGRLENADLPYESKHPTFLPTEAWTTKLIVIHYDRALKHCGPRTLLSKLREKYWIPKGRQTVQHILNSNKFGCLKCRRERLKPYAYPDAPDLPKERVTETRPFNHTGVDYFGPLKVKQGNTTVKVYVALFTCLVIRAIHLEVAEDYSAEAFLRAFRRFAARRGIPSLMMSDQGTNFTAGAKTIQENWTTQLFPNEIRGQLAHQGVTWLFNTAHAPWRGGAWERLVGITKNALRRSIGRNLLTWEEFCTLTVEIETIVNYRPLTFESDREPSPVIRPIDFLIPYWSAETNFPVIDVDPEDPEYTPTPNKLTEMLHKTDKRLTRFWDLWRSEYLLSLRERPSLNQNHGAHMPQEGDVVLVEEDGTPRSVWTMARILKLQRGRDGETRSALILLNGKEKWRATNQLFPMEVQSEIPETQLIAFIMDVDMDSVSLPGSEDEASERSAPNFKIPKKRRAFLRPIGQQHSPLQGPRRKKMELGDSGLRKLFAAISEEQGGSKATTNAITESRQMEKAPERVRKEHDKEMARRQREKVQRIPTEEIRQKLAALPHITVSSENAETQRKERKENEVRRKNNQQSTSEGWKQLAKQLDYDLKDQPDEPALERRKATEEQSVKGREVERRQIARKKGIVQMKKRAKPLKFPTEDETLLSYVKRFYDKDNWVLSWKSRRILDELHDLENEGRWFLYHAANGAQLTISRTFDGTRPFAEFRYVEEGHLVDLTPNQVIFRQTVPDEPEESPASNNKKLEEKAEKPARNDKRTTLATRKVEEYCTAEMKQNSYCYDIFE

SEQ ID NO: 136725 - protein, 1091 aa, Heterodera glycines
  Coding regions on vcDNA: vcDNA=SeqID_63148; Strand=+; Position=1-3276
  Homolog annotation: Hit_ID=CAE63953.1; Match level="QueryCoverage =14%, HitCoverage=28%, E-value=2e-10, Identity=32%"; Hit description =Hypothetical protein CBG08535 [Caenorhabditis briggsae]
MSPGQECRPRQSQQHAPGRSNRQNETSGSTEMAMTFSGVRIAEARPGNEVSRMHEELIKPTTELEEVAKLFHDEQIVKNKRGLGKDQQVMKVIEIWRNSCDRFGELFTKPAMQQIKFRPILIEHNGQYNQWINRQNTRMAELFSKMRTKAQHPTYLSYNCTTVIVGDNVAELFTPLFDDAKWFTHFPADTCRLIPGPNVKHIIMGYQATDENMAAQLAPMIHKLARTEIQTTLIIGKEDNAKWIMNKKHLFDVCRQLKAGFIVFNREMGEARKISDRIRQRMEEPMEIDNEIVPSTSSVVSSSQASRATMASSSVITLMLLSLLGLLLVPSVSAAPLRIHRASLSLTAQNYLKAMHNYYNTLTTTNSTDTTTATSLPWTSTTSNWPISTLPTLTTTMVTRTAPPGTTTTTQRTTLATRARTRIQYVTRARMQTTTEPTTRTRPVKSSKRDLGINRDGHDIFWCSDRGSTIWELKGTENSPFCRPPPSLTAQWHNLAIELFVKVIKPEQITFAWHCSVKRTTERYYTNLLADKFVTIEKEFPPVNKRICKQMAIHQEYPFAKSEMTNHEGQLWSTNDEMEVNFPGPIAGLFKGEQISTATNCFTQPATLFVKRHNLQMFSPVHHVQNCQYATEFCQLPDNTTLIWKSTCNGNECQTCDYEKAEIINGKFTAAYGESMATWISEDHQKALTFVKNAPEFIACDGTRIVMSEQNFGIAKDQYEDIVSTTTRWKRGIRPEQLASQLSASQVATSVALNQLYTRECQRNTRAANPTLQARRLLRQPNVQARWIGEMTMEVFPCVNVSLQDISYRPMNDCRVYIPVTVHFPDRAIAAFLDPELRIISLTAQFASCNNHRFHHLQLRSNPNIWLLIDSRTGIARQMPKDYTHELYETTLNQSNSNIELHPLIFHAWQLDNESDATRFPHINEFINLEQFKEKLEQHITARTEALGALKGGIEGLTMRWLKSMIDEVITWWIRIACVYSTFLFLRDIVLPCTLAYLFNPVRVTFFSLMGVRRQPLQPMLGKTLRQEEVPLREVLRSPQPRTSPHRSLSPVHLDVIARSARYQQTRAQSDANLAEVDTPFGRRTRRREEH

SEQ ID NO: 136726 - protein, 121 aa, Heterodera glycines
  Coding regions on vcDNA: vcDNA=SeqID_63149; Strand=-; Position=1 -168,334-399,538-669
MNMVAHQQQQQQQFVQQQSKQQQQQQQQVAVRVWVIQTYKSIIGLCYQIYNPIIPHELMEIDSFQHQAGGYLVDPLFQELSTGDLNPHEFDKYLIINDTARAAAQQQQHHQQQQHQQNMAQ

SEQ ID NO: 136727 - protein, 74 aa, Heterodera glycines
  Coding regions on vcDNA: vcDNA=SeqID_63150; Strand=+; Position=1-225
MCQELAEEAKQSIEIAKNYRQEIGHIYRTAYSQPDLGIGDLANKLKETMRENQIRFEKQRPQEEFRDEFIAYKI

SEQ ID NO: 136728 - protein, 58 aa, Heterodera glycines
  Coding regions on vcDNA: vcDNA=SeqID_63151; Strand=-; Position=1 -167,329-338
  Homolog annotation: Hit_ID=CAE73973.1; Match level="QueryCoverage =93%, HitCoverage=22%, E-value=4e-10, Identity=60%"; Hit description =Hypothetical protein CBG21601 [Caenorhabditis briggsae]
MSAPQVLAPQMSAPHMSAPPMSAPQMSAPHMSAPQMSAPRMSAPQMSAPQMSAPQIIT

SEQ ID NO: 136729 - protein, 105 aa, Heterodera glycines
  Coding regions on vcDNA: vcDNA=SeqID_63152; Strand=+; Position=1-328
PGLKCPAQAKIFFYFREKIEIFPKKIPVDRARKTMFWKWSSFFWENSLKNPKIQKPENRFLGLARKILKIFEILKSGKIELTELYNKSAGHPALRSKPNELFNGD

SEQ ID NO: 136730 - protein, 68 aa, Heterodera glycines
  Coding regions on vcDNA: vcDNA=SeqID_63153; Strand=+; Position=1 -94,185-297
MHAFCARAIYHRACQSKAKQQRCCFERIKGIESVNRLLEKYICNLSTILRSELEMINFTIQISFRCSN

SEQ ID NO: 136731 - protein, 32 aa, Heterodera glycines
  Coding regions on vcDNA: vcDNA=SeqID_63154; Strand=+; Position=1-96
MGEAKIQRRHSSTGYREAIPEGFGLPINLGAS

SEQ ID NO: 136732 - protein, 73 aa, Heterodera glycines
  Coding regions on vcDNA: vcDNA=SeqID_63155; Strand=-; Position=1 -72,216-365
MSVRQRNCPFYSRPILALTVALRRGGFVSYQHGDPRTPMGQGQARNVNQNGSPSDVGEEDDEDSPLMNRGLFA

SEQ ID NO: 136733 - protein, 193 aa, Heterodera glycines
  Coding regions on vcDNA: vcDNA=SeqID_63156; Strand=+; Position=1 -135,1516-1594,1667-1812,1874-1939,1991-2146
  Homolog annotation: Hit_ID=NP_500326.2; Match level="QueryCoverage =72%, HitCoverage=40%, E-value=2e-41, Identity=57%"; Hit description =heterogeneous nuclear RibonucleoProtein A1, RNA binding protein (36.3 kD) (hrp-1) [Caenorhabditis elegans
MPNLVAVLASDDMERRFAVKSNFGLTNPAHNHWTCEMRLMIGDFGEHVKLESNGGSKAELVDGEQYRKLFIGGLSLNTTNETLSDFYSQFGSLVDCVVMRDPQTKRSRGFGFVSFSSLEEVDRAMTARPHTIDNRVVDPKRAVPREMAGKGESNVSTKRLYVSGVRDEHDEDSFNRYFSEYGPVIKVYFKFIL

SEQ ID NO: 136734 - protein, 197 aa, Heterodera glycines
  Coding regions on vcDNA: vcDNA=SeqID_63157; Strand=+; Position=1 -142,227-520,577-660
  Homolog annotation: Hit_ID=CAE73870.1; Match level="QueryCoverage =85%, HitCoverage=28%, E-value=2e-47, Identity=60%"; Hit description =Hypothetical protein CBG21460 [Caenorhabditis briggsae]
VVLRGPSKDIINEVERNIQDALHCVRNVLTNPRVVPGAGALEMALSHALLEKAKSIPALLEKAKSIPGVRAGPYKAVAHALEIVPRTLIQNCGGSSTIRQLTALRAKHAQQPDTNWTWGINGRDAGGELVDMAQPEGVWDSLTVRLQAIKTAIETAIMILRIDDIVSGTAIMILRIDDIVSGTKKRDKDENGGGGGG

SEQ ID NO: 136735 - protein, 122 aa, Heterodera glycines
  Coding regions on vcDNA: vcDNA=SeqID_63158; Strand=-; Position=1-369
MEISAQGVDVLALTAADFAAMDEAHRQWETERRQRKEQRQREQQNRPKWKRSGEWMVLQREWEEEKEEEEKDPKNGKWKRTSKLKNGGGETMNFGRNRQVRVAAAATTKNRTLPNTFGIGPN

SEQ ID NO: 136736 - protein, 84 aa, Heterodera glycines
  Coding regions on vcDNA: vcDNA=SeqID_63159; Strand=-; Position=1-255
MREMNQKSTSFSIPIRLWQKSGARPTRPAIQAEAMTGGAEKAEETPEKERKAELEKEGKSDAGSRKGREGAESGKGGDGGKSGE

SEQ ID NO: 136737 - protein, 224 aa, Heterodera glycines
  Coding regions on vcDNA: vcDNA=SeqID_63160; Strand=+; Position=1 -150,568-825,871-954,1162-1342
MEVELLSATNTSGGHERYAVCNALLTNSELARVLVVAWRNRAQPAEQVFLAQSGNHQQQQQHQPNVQLGQIPTTIGLVVNHQQQQSLVGAEIQQGQSEEPPPGPMTNRHQSQRREPIHGSTIAAAAVAASVEEANTNQPVFRRRRNNNNNSGRGTTNRENPVELIGGGLTAQQCDSILPNLEVNQQMLQNDERCVVCQIGFTLGSLNATELPCQHFYHLTCARE

SEQ ID NO: 136738 - protein, 92 aa, Heterodera glycines
  Coding regions on vcDNA: vcDNA=SeqID_63161; Strand=+; Position=1-279
MTSYKKWTRTKECEQTAYEQFQTTEKLNTKMEAANTKLTELKDLEMQVEAGAKLQRSKADRDARVEQREHAKAMSKSNAEADKGNSVREAMK

SEQ ID NO: 136739 - protein, 62 aa, Heterodera glycines
  Coding regions on vcDNA: vcDNA=SeqID_63162; Strand=+; Position=1-189
  Homolog annotation: Hit_ID=ZP_00362852.1; Match level="QueryCoverage =100%, HitCoverage=9%, E-value=3e-27, Identity=95%"; Hit description =COG0488: ATPase components of ABC transporters with duplicated ATPase domains [Polaromonas sp. JS666]
LLLLDEPTNHLDLATREALSMALNEFEGTVMLVSHDRALLRAVCDEFWMVGRGAVGPFDGDL

SEQ ID NO: 136740 - protein, 179 aa, Heterodera glycines
  Coding regions on vcDNA: vcDNA=SeqID_63163; Strand=-; Position=1 -163,310-684
MAAAAVTPWAPSAWQWSAAATETAALLNGTYGGGGGAAGTTTATSSAQSNGGWNGLVSNQLGANIGNACFFSNSQPQFTPTTTHADSGLKNKSSTTVTAAQRNAKKGSNRTPEKAKNGTMKQQMPLETNNGSVSTNSHREAFKSNAKGQKQRVKAGGKTKSKSGGGKTGRNCECPNCKA

SEQ ID NO: 136741 - protein, 235 aa, Heterodera glycines
  Coding regions on vcDNA: vcDNA=SeqID_63164; Strand=-; Position=1 -412,551-712,765-895
MKLWRFPPLLLPPPLSMFRKRLIPPRRRLCLSRWPQLPPLHHHQHRNNSRTLRLSPLPRPTTPNNSWAQRPKSVVAGSYAAIAAAARGNGPNNVDNIVTVHVPAAVAATNGPTAPTPSKEIPQHNNNIAKHNPEHQIAVKQQQQTPPSLPPVLNIAPRREWTHRIYFSQLTKPGRFVDFKLGQQELMREIQAITDGVEFVGIKPNSLRREYRTAFGFIDFTTAADMQAVYDACKQ

SEQ ID NO: 136742 - protein, 326 aa, Heterodera glycines
  Coding regions on vcDNA: vcDNA=SeqID_63165; Strand=+; Position=1 -168,501-833,1356-1463,1570-1605,1875-2067,2629-2771
  Homolog annotation: Hit_ID=CAE68383.1; Match level="QueryCoverage =90%, HitCoverage=82%, E-value=1e-110, Identity=30%"; Hit description= Hypothetical protein CBG14139 [Caenorhabditis briggsae]
EANQEQLYNRNIEDVELWLSELEGQLASEDFGKDLISVQNLQKKLGLVESDYNAHQERIDAIGHQTREFHDTGHFNAPLIGKKFEALRARFEALREPLQRRKQKLAESLLGHQLFRDIDDELAWIREKEQIAASTNRGRDLVGVQNLIKKQNALHTEIANHEPQMEQPNCATNWRALKTKADKRKQDLQDSLQAHQYLADANEAESWMRDKEPLVGSTDYGKDEDSAESLLKKHRAMMSDLEAFNTTIDELRREAGQCKYQEQLDGQLGKECVVALYEAIHRKVAARSVYEKGRRADAAERVQQGLVEGGGQRPPGLRPGRLCEAD

SEQ ID NO: 136743 - protein, 115 aa, Heterodera glycines
  Coding regions on vcDNA: vcDNA=SeqID_63166; Strand=+; Position=1 -107,182-322,637-737
  Homolog annotation: Hit_ID=NP_508537.1; Match level="QueryCoverage =100%, HitCoverage=42%, E-value=2e-46, Identity=49%"; Hit description= spectrin (spc-1) [Caenorhabditis elegans] gb|AAB53876.1| Spectrin protein 1 [Caenorhabditis elegans] pir
YQRFLSDYRDLMQWVDGMVQLVSSDELANDVTGAEALLERHQDYRTEIDARASTFHAFEQFGNQLIRSEHYAAEDVRQRMDEVNDARRRLEEAWVERRKVLDQCLELQLFHRDCE

SEQ ID NO: 136744 - protein, 137 aa, Heterodera glycines
  Coding regions on vcDNA: vcDNA=SeqID_63167; Strand=+; Position=1 -163,418-632,885-918
  Homolog annotation: Hit_ID=CAE68383.1; Match level="QueryCoverage =100%, HitCoverage=80%, E-value=3e-55, Identity=36%"; Hit description= Hypothetical protein CBG14139 [Caenorhabditis briggsae]
AFLSQEDTTGDNVESLIKKHEDFDKAIASQQEKLNNLDMLARQLVQAGHYAAPAITAKRDQIFERWDQLKAALIEKRSKLGESQTLQQFSRDADEVENWIAEKFQVAQEETYRDPTNIQQKHQKQQAFEAELSANAD

SEQ ID NO: 136745 - protein, 44 aa, Heterodera glycines
  Coding regions on vcDNA: vcDNA=SeqID_63168; Strand=-; Position=1-203
SVHFHWDSVVPVLRWHWFEFIPCFLDLAHQELSNDTKFVRIWAF

SEQ ID NO: 136746 - protein, 44 aa, Heterodera glycines
  Coding regions on vcDNA: vcDNA=SeqID_63169; Strand=-; Position=1-203
HLKKKTMENAMRKMSEGIPNCQHQYGECLSQQIRSLCHFKYLSP

SEQ ID NO: 136747 - protein, 76 aa, Heterodera glycines
  Coding regions on vcDNA: vcDNA=SeqID_63170; Strand=+; Position=1-228
MELEVSAALAELDGLIELVHQVDEQIEAQENRLFSIKKQLAKMDEQAKLVGERMRTLEKRAERMGGKGTADPTPII

SEQ ID NO: 136748 - protein, 83 aa, Heterodera glycines
  Coding regions on vcDNA: vcDNA=SeqID_63171; Strand=+; Position=1 -76,156-329
MFLIFLLIILLTILLSVFGQNISGQGKSEEKLDSINAMGKFDKVRLNEKNYGLVRNLHTNWYAGGIKAIMGKMGRDLFRKLLP

SEQ ID NO: 136749 - protein, 68 aa, Heterodera glycines
  Coding regions on vcDNA: vcDNA=SeqID_63172; Strand=-; Position=1 -84,490-613
PKASRIEQRERSSSSASNERLENALGDEYFDSSFYAPASSSYRQSFVVVVNALFNLALLALFLAMIQH

SEQ ID NO: 136750 - protein, 154 aa, Heterodera glycines
  Coding regions on vcDNA: vcDNA=SeqID_63173; Strand=-; Position=1 -65,732-957,1046-1219
MTMALKKSAQPQQKEQQASVILKNRKILPFFPTPSIKSPATAVRPTTPSKSAPSLAPSAASSAAMPKPSNSSSKLLPLQNSTVQSEYDRHNRVHVIHICGIGTQSFCGAGARGINPANPAISKKGVIADWDSVKSHAGIGIQIFAGRDHAGLIP

SEQ ID NO: 136751 - protein, 41 aa, Heterodera glycines
  Coding regions on vcDNA: vcDNA=SeqID_63174; Strand=-; Position=1 -45,611-691
MPSLSTIIWTVTNLSATFAAGVLAVPIATRPKIRSCFMRRL

SEQ ID NO: 136752 - protein, 174 aa, Heterodera glycines
  Coding regions on vcDNA: vcDNA=SeqID_63175; Strand=-; Position=1 -87,143-291,410-492,550-755
MATGVLDNDHSVDTVDLSNEMFNIDNMDNNPIAEECQNRAKKHGNSMAKLTWHGISIKLNRQSAGINTAILDTSFCEKSYIVPDVFRQFNIHFGNKSHFAAYITIDEEGIDIEDGKVAQYKKMALSGAKIKDFVGFWVLGLDMIPWDEQTMRLFVIRHCNCSLEAFVKNAKIKN

SEQ ID NO: 136753 - protein, 50 aa, Heterodera glycines
  Coding regions on vcDNA: vcDNA=SeqID_63176; Strand=+; Position=1-150
MGFVEPYFHCSTRGIAGIQKGSRTFGQWTLRQWTFGSWTEADNWTVDTST

SEQ ID NO: 136754 - protein, 78 aa, Heterodera glycines
  Coding regions on vcDNA: vcDNA=SeqID_63177; Strand=-; Position=1 -161,1481-1556
MRTDQTDQNCICHNRVLLSDYYSDHFRHFPNNSEHDQGGVAQGGLRNVAADTRRFAPLALLWSGLANSQTISYIIRID

SEQ ID NO: 136755 - protein, 61 aa, Heterodera glycines
  Coding regions on vcDNA: vcDNA=SeqID_63178; Strand=+; Position=1-185
FKQIYFYATVRHSAAAKETKKNSKNNKSAKFHVKKDKVNQIFLGADFSPRFSASLFYCRVQ

SEQ ID NO: 136756 - protein, 417 aa, Heterodera glycines
  Coding regions on vcDNA: vcDNA=SeqID_63179; Strand=+; Position=1 -67,360-510,557-661,715-875,1435-1537,1599-1699,1747-1935,2016 -2142,2190-2309,2353-2482
  Homolog annotation: Hit_ID=XP_392786.1; Match level="QueryCoverage =94%, HitCoverage=57%, E-value=1e-102, Identity=49%"; Hit description= similar to CG1518-PA [Apis mellifera]
MSELANKEKKSLTAAVSASSIGERAWYPLGRIVGGTVYPGLMLTSGFIHYLLSCLHIPVHIRDICVFLAPTFSGLTAIATYLLTKELWSTGAGLFAACFIAISPGYTSRSVAGSYDNEGIAIFALQFTYFLWVRSVKTGSVFWAALTALSYFYMVSAWGGYGYIAPWTGRFYSLWDTGYAKVHIPIIASVSEHQPTTWVSFFFDLHITAAVFPAGLWFCVKNVNNERIFVILYAVTAVYFAGVMVRLMLTLTPVVCILAGIAFSNIFEKYMLDDGDARRGGEWREPKDVKEGDRRLYDKATTKGGKPPKVPQATTASFSPSAQQETVDHIGMNTRSIVLVALLFILLMYVAHCTYVTSNAYSHPSVVLQSHTNDGGRIIMDDFREAYYWLRKNTPEDARVMSWWDYGYQIAGMANRT

SEQ ID NO: 136757 - protein, 72 aa, Heterodera glycines
  Coding regions on vcDNA: vcDNA=SeqID_63180; Strand=-; Position=1-633
  Homolog annotation: Hit_ID=NP_498362.1; Match level="QueryCoverage =72%, HitCoverage=6%, E-value=2e-15, Identity=80%"; Hit description =membrane protein 1 (85.1 kD) (3H339) [Caenorhabditis elegans] gb|AAC24442.1| Hypothetical protein T12A2.2
MSELANKEKKSLTAAVSASSIGGYSTLLVFVVLGLAWFVGFASRLFAIVRFESIIHEFDPWFLLFVIECSPI

SEQ ID NO: 136758 - protein, 180 aa, Heterodera glycines
  Coding regions on vcDNA: vcDNA=SeqID_63181; Strand=-; Position=1 -190,237-389,433-597,643-675
AKMAKITQIKNGEERRIESITRRKNELDERRRLINKSLTGELKINKQTRFADSDEEESTQNSKPFSFLASIGRIYPEQNEKSKNTNVVDDSPEQFLKKTRLTNETEKSAPKLKNISLYKPPNGDGDMWQCFFVNEHTPEIRSSFSSFRRHQKEETLRKEWDKKRAPIVKFYKKERKSALR

SEQ ID NO: 136759 - protein, 86 aa, Heterodera glycines
  Coding regions on vcDNA: vcDNA=SeqID_63182; Strand=-; Position=1 -85,133-198,271-379
MGPQAKYAGQTNEYKEDWGKQFSKTNGRRYYGPLKAIDRENEQTNGREDTDINPPPEGTRIKMDGRNDGKANERERQWHRKDGTIS

SEQ ID NO: 136760 - protein, 69 aa, Heterodera glycines
  Coding regions on vcDNA: vcDNA=SeqID_63183; Strand=-; Position=1 -72,410-547
MEISSSWSFLKMTLQLVLYLIYIKKSVFCHPRFFETRNFGPKDVEVEFHDLLVQSTFMGFQKNFKALNR

SEQ ID NO: 136761 - protein, 42 aa, Heterodera glycines
  Coding regions on vcDNA: vcDNA=SeqID_63184; Strand=-; Position=1 -48,106-186
MATFNVAHLITLIGVGSIASVKTVEIPLMEIEASILGIKAKI

SEQ ID NO: 136762 - protein, 174 aa, Heterodera glycines
  Coding regions on vcDNA: vcDNA=SeqID_63185; Strand=-; Position=1-525
VKRKNWSKKHLKKYLEKNGKKKKSEQQKREIVEKFIKIKAKIKQKGRKYSTKEWNTIEQKIAKKLGTNRKKIYKWIKELGLYKYQCKLKTDAQKIEIVQKFMAMKNEYKQKGRKYSTKEWDKNYAEIVKKIGVNYGTIQKWKKQFGMGERMSEKEKMAKVNIYLLNERTKPKNK

SEQ ID NO: 136763 - protein, 95 aa, Heterodera glycines
  Coding regions on vcDNA: vcDNA=SeqID_63186; Strand=-; Position=1-730
FFEYPKRTLEKIDFFVFGAVPPNRCAQIYGETESFGSSFPIACTLILRWIFAPHNCLSTPNGHLKKSIFLFSGQSPRTDAPRFMGRPNPSGVAFL

SEQ ID NO: 136764 - protein, 406 aa, Heterodera glycines
  misc_feature (376)..(376): Xaa can be any naturally occurring amino acid
  Coding regions on vcDNA: vcDNA=SeqID_63187; Strand=+; Position=1 -61,172-317,671-794,1104-1177,1226-1355,1450-1521,1726-2278
  Homolog annotation: Hit_ID=NP_500952.2; Match level="QueryCoverage =99%, HitCoverage=69%, E-value=3e-63, Identity=34%"; Hit description =solute carrier family 7 member 6, possibly N-myristoylated (4H38) [Caenorhabditis elegans] gb|AAB38125.2|
AKIAACAIIVVIGFSFGSLKAHSNNFAQPFANSNFEPGKVVLALFSGLFSYGGWDILNTGIEDIAHPHRTMPFAIIAGMAIVILLYMTMNVSYFAVLTVTEMRTSNAIAMTFSERVFHGFQYLMPFLVCIVLIGSLNATLFGGSRMLWAIARDGYFIGSLNATLFGGSRMLWAIARDGYFPSFISCINRQHGSPRAALFIFVVLAMLFTVVLAMLFTFLGDLDVRLSLSFILFVVRCCTMVALFCIRYRADRIHPEALRVPLVLPIVYFFVCLSLVVVTVVRNFTFDLTIFPNLRKYGNWGAFFGNFLHRSAMIGLSFQAFGLFVYLVFIWPPAISRFSNYRNDSMQRETLKIEFLLKKAKCPPSLKLFLTVPSKXKIGDKMRTDCSVSDGDNDYLASTHKENSIS

SEQ ID NO: 136765 - protein, 231 aa, Heterodera glycines
  Coding regions on vcDNA: vcDNA=SeqID_63188; Strand=+; Position=151 -227,317-935
  Homolog annotation: Hit_ID=NP_506146.1; Match level="QueryCoverage =93%, HitCoverage=50%, E-value=2e-51, Identity=49%"; Hit description =putative protein, with 2 coiled coil-4 domains (5N52) [Caenorhabditis elegans] emb|CAB02877.1| Hypothetic
MIATTRCVVLLLVGATMADAFLSAFDNISFSVAPGALRDRRQCGCGCGGGGGGGGCGGGCSSGGGGGGAVQLAVSCGAAQQAAPASSGCGCSSGCGGGCGGGCSSSCGGGCGGGGGGGGGGSVQLTISCGAAQQAAPASSGCGGGCGGGCGGGCGGGCGGGCGGGCGGGGGCGGGGSSGGGSVQLAVSCGAAQQAASSGCGGGGGGGCGCGCGRRKRMAMRRRCVRALGRF

SEQ ID NO: 136766 - protein, 26 aa, Heterodera glycines
  Coding regions on vcDNA: vcDNA=SeqID_63189; Strand=+; Position=1-79
GLHFCRRHSPKNSFIFCENKGSNCST

SEQ ID NO: 136767 - protein, 15 aa, Heterodera glycines
  Coding regions on vcDNA: vcDNA=SeqID_63190; Strand=+; Position=1-47
TWLRPQNHCVIGDSE

SEQ ID NO: 136768 - protein, 95 aa, Heterodera glycines
  Coding regions on vcDNA: vcDNA=SeqID_63191; Strand=+; Position=1-830
LFEYPKRTLEKIDFFVFGAVPPNRCAQIYGETESFRNSFPIACTLILRWIFAPHNCLSTPNGHLKKSIFLFSGQSPRTDAPRFMGRPNPSGVASL

SEQ ID NO: 136769 - protein, 46 aa, Heterodera glycines
  Coding regions on vcDNA: vcDNA=SeqID_63192; Strand=+; Position=1-138
LFTLPGVVERFFPRPEEAHMVKAVREVLTKSWSIGEGDEEAEEIIK

SEQ ID NO: 136770 - protein, 19 aa, Heterodera glycines
  Coding regions on vcDNA: vcDNA=SeqID_63193; Strand=-; Position=1-60
EPVNSCIGCKCRRCCTPNS

SEQ ID NO: 136771 - protein, 105 aa, Heterodera glycines
  Coding regions on vcDNA: vcDNA=SeqID_63194; Strand=-; Position=1 -18,116-413
MDLGTIEQNIKDHRYTTIAAFRRDIDQVKRANQKKEGGMIHFSDLHQILINSRIFNGPQSAYSLKAEEIVELTNQLLNNSQRHLAELETNIQKALTVSTNEEEKI

SEQ ID NO: 136772 - protein, 50 aa, Heterodera glycines
  Coding regions on vcDNA: vcDNA=SeqID_63195; Strand=+; Position=1-150
  Homolog annotation: Hit_ID=CAE72630.1; Match level="QueryCoverage =100%, HitCoverage=10%, E-value=2e-09, Identity=60%"; Hit description= Hypothetical protein CBG19828 [Caenorhabditis briggsae]
MKIVAIGCAPTSIGFAYRLQQLKADGIEEAADIELLVLEQNPTPGGLSCT

SEQ ID NO: 136773 - protein, 47 aa, Heterodera glycines
  Coding regions on vcDNA: vcDNA=SeqID_63196; Strand=-; Position=1 -126,1095-1112
MGDGFSSSKMGQNAWPFVRLKMIIFEKLFFHPFGFSFLGLPLVTMKD

SEQ ID NO: 136774 - protein, 83 aa, Heterodera glycines
  Coding regions on vcDNA: vcDNA=SeqID_63197; Strand=+; Position=1 -235,574-590
MRAGAELQLGKPHNHAPSPTRCEAAQINRSVRNTALSSRGNMPRTVVNGEPCRLYPAPFGIRGGPFADGRTVDGERIRVQFHP

SEQ ID NO: 136775 - protein, 59 aa, Heterodera glycines
  Coding regions on vcDNA: vcDNA=SeqID_63198; Strand=-; Position=1-179
APIRAAPLAYNHSLHGHTPTQRQPLARPFILPLNDLDVATRCPMTNDDVVDRNGTRRFE

SEQ ID NO: 136776 - protein, 115 aa, Heterodera glycines
  Coding regions on vcDNA: vcDNA=SeqID_63199; Strand=+; Position=1 -48,111-147,502-590,761-793,878-996
  Homolog annotation: Hit_ID=CAE69532.1; Match level="QueryCoverage =63%, HitCoverage=13%, E-value=1e-26, Identity=72%"; Hit description =Hypothetical protein CBG15741 [Caenorhabditis briggsae]
LPYDSPWTWILCFLTQDLADLAYYFGHRAIHEIGFFWGVHTIHHSSEYFNYSTSFRQAAIQDAGLAAHDILQALSPSGLALSPSGLITNLGHFRSAFPMNENEIKNVEKKGMKLK

SEQ ID NO: 136777 - protein, 18 aa, Heterodera glycines
  Coding regions on vcDNA: vcDNA=SeqID_63200; Strand=+; Position=1-56
YREAIPEGFGLPINLGAS

SEQ ID NO: 136778 - protein, 85 aa, Heterodera glycines
  Coding regions on vcDNA: vcDNA=SeqID_63201; Strand=-; Position=1-258
MVAKTRGWPRWKFYDYLHSRRGQHGQFRHDTIRLMQQIEAPMNLEGYDADTFFLEFWIFGTTANNIIVLLCLFLVRLVNTNQGWT

SEQ ID NO: 136779 - protein, 264 aa, Heterodera glycines
  Coding regions on vcDNA: vcDNA=SeqID_63202; Strand=-; Position=1 -459,896-1233
AEDLFGTLRSHLNNLPQITFDKSSNNSAFEWMQKDGIAILCNEKMGEISEKIQENKLNEQLFFVVKSAEKNRKHFCSMFKDGKSIKLIAHNNLVNKAKKFVQILENIPPQLMEKFGKIAENDALFNEGNKQEIAKIIGTFSNGLNFFRKFVAGNSDRCLTDQLQTSNTASIITLLKKPHGMARRKRRFSTMNFLKCVVSIVIGSLTGVFAVIFGFYLFQHVFLVFLCNIHFNFGRGLVMFLWIFCILSFVVCFFLFYSNCFSFA

SEQ ID NO: 136780 - protein, 118 aa, Heterodera glycines
  Coding regions on vcDNA: vcDNA=SeqID_63203; Strand=-; Position=1 -85,153-424
MILRSGIAKGVRVVRNDDRTPKAAVVLDTKVAAFFESKNLVDTVMEILPQRRKGGRPSMRDFTPKDWSEVETVIKDVRVEVSSVLGYGDSYNGITKGLKKLTTQKRPRDLGLSKNFIF

SEQ ID NO: 136781 - protein, 59 aa, Heterodera glycines
  Coding regions on vcDNA: vcDNA=SeqID_63204; Strand=-; Position=1-178
FGPRGRLGPNPKIEKCAFLKNKILKTKPEGSLATWHKLGLINIRSFLQFYLFQILLFFN

SEQ ID NO: 136782 - protein, 272 aa, Heterodera glycines
  misc_feature (266)..(266): Xaa can be any naturally occurring amino acid
  Coding regions on vcDNA: vcDNA=SeqID_63205; Strand=+; Position=1 -80,136-165,223-426,879-905,954-1027,1156-1228,1279-1367,1771-1848
  Homolog annotation: Hit_ID=CAE62344.1; Match level="QueryCoverage =89%, HitCoverage=62%, E-value=2e-63, Identity=48%"; Hit description =Hypothetical protein CBG06419 [Caenorhabditis briggsae]
LIKPIFNYLIRSDECPSSGQLCTQSDGSHCCQDAMQSHCCQDAMQGIPVSHIKAKSGHCPPPIGISGIPVSHIKAKSGHCPPPIGISTLQDGNVGCWLDTNCPGIQKCCLEPNPGSHVAARRICRDPEGVSSQLSESICTLPLVVGTCTAFVTRYYFDASVGTCTAFVTRYYFDASSGKCKPFQYSGCGGNENNFQSIQSCHSTCGLLGIKGTPSCPIKGTPSCPGEANAELNCLLPHADACHTDSDCMGRDGGQQPVSLKSQIDXLLKNLK

SEQ ID NO: 136783 - protein, 77 aa, Heterodera glycines
  Coding regions on vcDNA: vcDNA=SeqID_63206; Strand=+; Position=1-233
MLVDSLRPATLSSSKKRSAHSMDDTDQFIDHSPPHKKQLMDEENDQILTQNTPNDSLDRRRPIAFATKAIHAGNRPE

SEQ ID NO: 136784 - protein, 178 aa, Heterodera glycines
  Coding regions on vcDNA: vcDNA=SeqID_63207; Strand=+; Position=1 -314,368-525,569-630
  Homolog annotation: Hit_ID=NP_872145.1; Match level="QueryCoverage =69%, HitCoverage=20%, E-value=3e-14, Identity=36%"; Hit description =phospholipase D/Transphosphatidylase (5T54) [Caenorhabditis elegans] emb|CAD56614.1| Hypothetical protein
MENAATGGKRVPRFSHSAGTEGAEGEKEPQAEEPPSAGTAGADRPAEDHSLLLAQLLAAFALFGLVTALLFQLPAFRVRSRIGTDGPVPIHQLDPQMAECAKTCRIELVESIPQNVSFHLSLGNSPALAIPTFSAWMQLISEAKHSLAIAAYKTSLRGKHVLGEDQGNYSTQGETVFD

SEQ ID NO: 136785 - protein, 15 aa, Heterodera glycines
  Coding regions on vcDNA: vcDNA=SeqID_63208; Strand=+; Position=1 -18,101-130
MYCFSKNFMIIILKN

SEQ ID NO: 136786 - protein, 83 aa, Heterodera glycines
  Coding regions on vcDNA: vcDNA=SeqID_63209; Strand=-; Position=1 -75,151-327
MKHFSRAFLLFCLIFVVALNSFNEASLIIDECKSVCPKTNNKCATDCVKCASGKCKKECKKPAAPKCAECGKKAVNECKAMGK

SEQ ID NO: 136787 - protein, 29 aa, Heterodera glycines
  Coding regions on vcDNA: vcDNA=SeqID_63210; Strand=-; Position=1-87
TRVQRYREIWARPGPGLFGWDNREKSREF

SEQ ID NO: 136788 - protein, 20 aa, Heterodera glycines
  Coding regions on vcDNA: vcDNA=SeqID_63211; Strand=-; Position=1-59
SKIIWQHIILVPSVTARTLR

SEQ ID NO: 136789 - protein, 84 aa, Heterodera glycines
  Coding regions on vcDNA: vcDNA=SeqID_63212; Strand=-; Position=1 -69,641-826
MDWLNVWEKCVRTAHSPINQWQANKRLNVIRRDRHFEKCLDLDLDLDSMLDLDLDFLDKNPGKSRSRKNPGSSRPGSRPGPGFF

SEQ ID NO: 136790 - protein, 73 aa, Heterodera glycines
  Coding regions on vcDNA: vcDNA=SeqID_63213; Strand=+; Position=1-230
CFYVIKCKYTNVIESVRTQICEYAKLTLKNMSFYVMLSDLKFLSPFILCLLRINKRQWQLNQGQCAPREVGPS

SEQ ID NO: 136791 - protein, 132 aa, Heterodera glycines
  Coding regions on vcDNA: vcDNA=SeqID_63214; Strand=-; Position=1 -158,482-722
MNGFVWHHFVLGAVLLISNCADCLRNVDWTTGKQLNSEELKKAPIVISDGGEIITFCFLGQMDPANARLNSQYHMENYEEDNKIATKCKMAQQTKWAKHFEQDKVLHGFQIVMSETDEEKVMDLYTSTHQEK

SEQ ID NO: 136792 - protein, 252 aa, Heterodera glycines
  Coding regions on vcDNA: vcDNA=SeqID_63215; Strand=+; Position=1 -124,354-659,1497-1823
MKCKKGTVLDTLDLGMNPKMNISVEECKAGYEYCAAFTCTKAGRAGFSRIQWYCARIKSPPYECAERFTKLVEEYITHSNGHWCECHFGEMGKEMDNEQFVLPPIPDGMMCKVGQFDENEIGQVSEGKCLHDDHYCYIAKCTKDNEYFKTVWDCTDRPKRDHITDQIGQKASVTLYCDAMFGKKNMAMSNEHFTIEKLEEHVEMMNMMTTKRRRRRKKSTTITTPSTDLATTTMPTVTEQTVPATVEEATVT

SEQ ID NO: 136793 - protein, 186 aa, Heterodera glycines
  Coding regions on vcDNA: vcDNA=SeqID_63216; Strand=-; Position=1 -203,509-748,1163-1280
MDPTVATKGGRFSLENYKQKNSIATSCEQQLQQSGGSETLAIGKVLHGFNIAFAEDKLLLTSSTSQKSPSYAIRNAQQCFDIHLGSEKNLDGFLKDYTDNKKLEKDNDFFTELSYDILSGIPQKGGKIGIIAAGGACNIKIILVPWAKKAMDWANVLTINVPKAMCKQAIKRRKNERIKKKFIFLK

SEQ ID NO: 136794 - protein, 97 aa, Heterodera glycines
  Coding regions on vcDNA: vcDNA=SeqID_63217; Strand=-; Position=1 -112,729-910
MSIYNFFLLFSSLLVVVLQQCSAANATDKNNEENVTKAISSGKIVPKSDAIVHSGPVIESVFAAEPVKKWTNWQNGKQLEVKEAMEMPLVINPDGRV

SEQ ID NO: 136795 - protein, 29 aa, Heterodera glycines
  Coding regions on vcDNA: vcDNA=SeqID_63218; Strand=+; Position=1 -19,367-437
MIPFCLELGLEVMRPTPLMCRLALLFQFF

SEQ ID NO: 136796 - protein, 384 aa, Heterodera glycines
  Coding regions on vcDNA: vcDNA=SeqID_63219; Strand=-; Position=1-1153
  Homolog annotation: Hit_ID=NP_608540.1; Match level="QueryCoverage =89%, HitCoverage=65%, E-value=2e-35, Identity=29%"; Hit description =CG2839-PA [Drosophila melanogaster] gb|AAF51469.2| CG2839-PA [Drosophila melanogaster]
LKQLTSLIQRKAEEQKNSLEEGGNERREEKRTNEEKEKEEDKRRKEEREQQKEEQQQHQQRKITEEEREREKKEEEEKGGEERKRGTTRSKTNSEVSSGAKRREEAVGRVEEGEEAGEGKEGKTWDGRGGDDEAERKARDLEQLAIYRSRVRQQLNRKLTALLERVIRRMDKCHLNLSPIGGTAEFSQKGWPWKKMNWEEIHRRAEARGEEWMMPTMAKGRGRKRKSGREEDEGKEEEVSVGRRAGEKKRVNGERSVRDTKRERKVKKRNSEEKHGEEDQTKKRVTRKRRGREEDGETEKQTKRMHDERGGQEEKREEPKKEEKQEKNIQEERRERNEKREEAGEREEKQNTPPIILRIRPPTAKPTALTTIKRMTAPRAATGK

SEQ ID NO: 136797 - protein, 49 aa, Heterodera glycines
  Coding regions on vcDNA: vcDNA=SeqID_63220; Strand=-; Position=1 -35,121-235
MVFHQVRKSLKIGAGGGVESSRGLNFCWAGFIGNTGCNAAIGFDVDIAC

SEQ ID NO: 136798 - protein, 80 aa, Heterodera glycines
  Coding regions on vcDNA: vcDNA=SeqID_63221; Strand=+; Position=1 -155,424-480,848-878
  Homolog annotation: Hit_ID=NP_497425.1; Match level="QueryCoverage =87%, HitCoverage=20%, E-value=6e-13, Identity=51%"; Hit description =MOB protein family member (3C674) [Caenorhabditis elegans] gb|AAK84597.1| Sphingomyelin synthase protein
MLCAVLLFSGHTLIMMVATLTVDRYIPSAFRLLRLLPRLFALIGVPCMVISRTHYTCDVVIAYLSTIAIFSRELRNPMTN

SEQ ID NO: 136799 - protein, 180 aa, Heterodera glycines
  Coding regions on vcDNA: vcDNA=SeqID_63222; Strand=+; Position=1 -57,306-791
  Homolog annotation: Hit_ID=NP_502797.1; Match level="QueryCoverage =85%, HitCoverage=43%, E-value=2e-26, Identity=39%"; Hit description =HASI (4P602) [Caenorhabditis elegans] emb|CAB16520.1| Hypothetical protein Y57G11C.19 [Caenorhabditis ele
MAQVGVCVGVSGAVAIVVLAKKIDPEIKTDDVNNFLEKQKTYTIHRPIRKRFPRLKTIPSGFHTDWQCDLCIFDQLKKHNDGYKYLLVCIDVLSRMIFSAPAKSKKSEDMIEAFDRVFDKSKIIPLKIYSDSGLEFQAGKMKKYFEEKFIIKNVMYSPDLHAGVVERANRTIKERLYRYF

SEQ ID NO: 136800 - protein, 237 aa, Heterodera glycines
  Coding regions on vcDNA: vcDNA=SeqID_63223; Strand=+; Position=1-712
MTEEELRRRLLVVSIERSQPPANGNAGNGENAEGLRNAIRENDGRPNFGVNGQTFAHQRRPHDTFLSNLMNNGIGNFPQNLVHVPRTSTPTRNVEFEQQIGPFPFVVDRNNRAPTPPLNIRQQIFHPIPLNTHRINQMSVNAQRNIDVQYVPNNCVNAPPNVQRHCDIQYTAPNPVAAPSNAQQIQAGSRLIQNIPMQAQLWQGPDGKMTLVYPQDQQQQVLIEQPNLAQIIKNHSP

SEQ ID NO: 136801 - protein, 1153 aa, Heterodera glycines
  Coding regions on vcDNA: vcDNA=SeqID_63224; Strand=+; Position=1 -99,489-3851
  Homolog annotation: Hit_ID=AAM11674.1; Match level="QueryCoverage =40%, HitCoverage=53%, E-value=8e-82, Identity=38%"; Hit description =pol protein [Drosophila melanogaster]
MTEEAMRRRCWWSALNVASRQPTEMPEMEKTPKRHCDIQYTAPNPVAAPSNAQQIQAGSRLIQNIPMQAQLWQGPDGKMTLVYPQDQQQQVLIEQPNLAQNQQKFTRQAFQIPETNQEPRHFPTYPQPNVAPSNLEFNLILERIPDLNGNEGTDSVRRFFKKFDAYTDGWPNAKRISALESKVYNKAERAFEAAKSTQPYRYEHIRKDMIQQLEETDSKQLNAFDDLMLGVRRRQNESIDELAGRISRLVKSAYPGLTNNLCDEYSIKFLIRSMGNPDLALNLELIRTPGMTLDHFVSLAARAESTQRAAKRFSTHPNDGFQQREQQPKWRQNFGGNSSQNMAKGQNFAGNINQHPQPKEDTRNQWKCYNCDEYGHLSRNCSRPRTFMQNQPINQQKNFVATGANRTQIQPPNQNRNFQTPKPNSANFLKQNCLVVQREEVLAEARVNKIELAPEVSEFYEKLERITESKNEIFLPTIGKVMSLKLEVFGTETDAMLDGGAQISLISSDFLHKLLIEKAITLETLEIFKTKTQIFDVNGKLVKCLGTIKLPVNRHGFYEPVTIPLHITNAPIGFGLLIGTNALQDLGFKLYDERNKALVEFEKVEPEKKDFLTVIYRTIIEAGTVKNLEFSVNTEFEGQEIVVTSDETSAIRVEPTIGIPEKGKIVVPVTNSSFLPITLFEKSSIGKVERVYSIGETENLLSSPIICSTKYEQNAAPECYEKFFESLQVRIGELNEANDKEVRKMICTFPEIFALSDDDLKQTNLVEHQINTAENSPVKMKMRLVPYAYREKIAEMLQNYLARGIIRPSMSPWASPIVIVPKRDGTLRFCVDYRGLNSITRKDSFPLPNIDNTLLMLGGRKYFSTLDFMSGYWQIRMDENSIEKTAFSTEYGLYEFTVMPFGLTNAVATFQRFMSRLFEGMINGFLFVYIDDILIASKSFDEHLKHLEAVFSRVKAAELKLKFEKCHFCTTELPFLGHILTREGIKMDADKLKPVMDLPMPTTKKQLHSLLGFLTYYRKFIHSFGTIAAPLFKLISEKAEFKIGEQEKQAIEELKSKIIRDVVLHFPDFDAAQNDLTRQFIIMTDACKTGIAAILCQPDPEKQIRPIYFASRQCNVHESRLQCYRIRSFSRQIWCKKVRTIHHYDSDSGHYGP

SEQ ID NO: 136802 - protein, 138 aa, Heterodera glycines
  Coding regions on vcDNA: vcDNA=SeqID_63225; Strand=+; Position=1 -126,243-322,394-475,689-792
  Homolog annotation: Hit_ID=CAE63692.1; Match level="QueryCoverage =97%, HitCoverage=59%, E-value=3e-32, Identity=50%"; Hit description =Hypothetical protein CBG08205 [Caenorhabditis briggsae]
LPSPLLKAFVGVSLCLTFIFLIVHFFTLHQTLLYFWPWAESDFLFSAVSAFVFLVCSFIESFYSTGAWSNNCNDIGGDSNNCNDIGGDGVIHNGCRLIWEWAFAAFLLFTLCVLFFTSAFFAKQNGRTTHLFAREKCW

SEQ ID NO: 136803 - protein, 23 aa, Heterodera glycines
  Coding regions on vcDNA: vcDNA=SeqID_63226; Strand=-; Position=1-70
KEFERTIRTYKSPYISFTYFHSQ

SEQ ID NO: 136804 - protein, 43 aa, Heterodera glycines
  Coding regions on vcDNA: vcDNA=SeqID_63227; Strand=-; Position=1-130
MSPLRFLLALFLITLAVMAGTNGFFENSVDGGPNVASPLIRER

SEQ ID NO: 136805 - protein, 23 aa, Heterodera glycines
  Coding regions on vcDNA: vcDNA=SeqID_63228; Strand=+; Position=1-72
CPFGGTQTIMGEQKSNAELKYRL

SEQ ID NO: 136806 - protein, 258 aa, Heterodera glycines
  Coding regions on vcDNA: vcDNA=SeqID_63229; Strand=-; Position=1 -240,329-531,594-855,943-1015
  Homolog annotation: Hit_ID=CAE58429.1; Match level="QueryCoverage =64%, HitCoverage=18%, E-value=8e-14, Identity=34%"; Hit description =Hypothetical protein CBG01563 [Caenorhabditis briggsae]
INGHQSQVKNSRGKPPPPPTPPTVINQQKEVFYNWVDGRFEFSHNQQSPPAPPQQFPPVPTAASSVASPQQRQSVLTAAMPSTTESKASFVDPTNNKRSDLLQQIQQGTKLKKVGPPSTERTPVPTNAPTLRDNMMEQIKQGTTFKHVDQSDVENSRCSAGGSAQEIGVLTGALAKALEEQSRHAMYSIENSALASPTPSTSMSSTTFSTSALSPVKLQFKSLDKALPTNPWESELDAFLELCGQSAVFSWNEFEDST

SEQ ID NO: 136807 - protein, 327 aa, Heterodera glycines
  Coding regions on vcDNA: vcDNA=SeqID_63230; Strand=+; Position=1 -188,235-429,478-721,763-863,906-1057,1102-1203
  Homolog annotation: Hit_ID=XP_393330.1; Match level="QueryCoverage =98%, HitCoverage=29%, E-value=1e-97, Identity=55%"; Hit description =similar to ENSANGP00000004153 [Apis mellifera]
SGIVTQQHSSQTDYGQFYLSTQGEQSQGVPSTVDASQSQTEPDLNFQDEEEPLVDNLPTHACKYCGIHDPSSVGQCTVCGKWFCNGKGNTAGSHLINHLVRAQHKEVSLHKDCPLGETQLECYHCGSRNIFILGFIPSKTDSVVVILCRQPCATQNSLKNANWSAEDWKPLIQERQVLSWLIKIPSQQEQLRARQITASIINRLEELWKDNPEATIEDLECPGKYTTDPDHVLLRYEDASIYKRIFNPLISLEAEYDKKMKESISCPVGQVKWDVKSANKVHATFQLPGFRDGNMKLMIGDDLRLKHYQTVDGSEWSCMGRLIKIPD

SEQ ID NO: 136808 - protein, 94 aa, Heterodera glycines
  Coding regions on vcDNA: vcDNA=SeqID_63231; Strand=+; Position=1 -105,545-722
  Homolog annotation: Hit_ID=NP_496144.1; Match level="QueryCoverage =92%, HitCoverage=16%, E-value=3e-32, Identity=73%"; Hit description =CoA transferase (56.1 kD) (2K226) [Caenorhabditis elegans] emb|CAA88202.1| Hypothetical protein C05C10.3
KFQIRKLVSSYVGENEEFARQYLGGELELEFSPQGTLAERIRAGGAGIPAFYTPTGYATMVQEGGTPAKYSVAENGKIEISSDPKEVKKIFLMN

SEQ ID NO: 136809 - protein, 87 aa, Heterodera glycines
  Coding regions on vcDNA: vcDNA=SeqID_63232; Strand=+; Position=1 -61,206-408
MPYRLVYNKKITYAYCIFVSKREHVARIFADCDQPFAHGTAEEGGAHPRHGGVHGQTDHQGGHGIQMGASFASVTRGGFASEKAETI

SEQ ID NO: 136810 - protein, 82 aa, Heterodera glycines
  Coding regions on vcDNA: vcDNA=SeqID_63233; Strand=-; Position=1 -39,264-473
MPKPTSTEWRQSEFIIHSLSCLSLIFTLAFCRPLALIFRCFSPLLSVKMDGIFHSVKRVFAFFSAFCAIMTLAIYEKSQPNL

SEQ ID NO: 136811 - protein, 146 aa, Heterodera glycines
  Coding regions on vcDNA: vcDNA=SeqID_63234; Strand=+; Position=1 -277,320-483
MPPKRKHVYLESYEKEFRHIKKSRKGEEFALCVVCNDDINLLSIGKTAISLHQKTGKHQKAAKAANRSIPLQEFLPNTSAPSTEDRKVLAAEGTIAYHTAQHCQSFRSVDCLSSDGMLRTIFPDSTIAKKISCGKTKTAKILTGIA

SEQ ID NO: 136812 - protein, 28 aa, Heterodera glycines
  Coding regions on vcDNA: vcDNA=SeqID_63235; Strand=-; Position=1-85
KINKNIHVAQRTRTTTLCPFTILQKPLR

SEQ ID NO: 136813 - protein, 244 aa, Heterodera glycines
  Coding regions on vcDNA: vcDNA=SeqID_63236; Strand=+; Position=1 -69,390-542,586-1098
MPGHFKNSTKRMRELKGFCEELEKEKAILPELLLEMDKFRAKIERRKQERFYGADLAMEKVGKCTREALEEQFQSFYTSVLAYLNKWHRIDRFPEKLQWVALASRKIPHDDALALARQIAPELTNDLFDDVSEANQILNSFPNDEFQKLTPEQKWKKLFEANLPHLLKLVSIVLSIPVSNAFVERVFSLCGSQWTDTRNLLQVETVKALVQTKANFDLSCPQMYQMLISNHKLLEKIGGWEKYF

SEQ ID NO: 136814 - protein, 57 aa, Heterodera glycines
  Coding regions on vcDNA: vcDNA=SeqID_63237; Strand=-; Position=1 -61,120-232
MTEAELREIFMAGTTANERNTTNRPLGGAVTTTTNANNRTTGGNATSSSSSSISDSD

SEQ ID NO: 136815 - protein, 197 aa, Heterodera glycines
  misc_feature (1)..(1): Xaa can be any naturally occurring amino acid
  Coding regions on vcDNA: vcDNA=SeqID_63238; Strand=-; Position=1 -167,229-327,378-479,663-848
  Homolog annotation: Hit_ID=NP_498209.1; Match level="QueryCoverage =90%, HitCoverage=31%, E-value=3e-40, Identity=51%"; Hit description =biogenic Amine Synthesis related (58.3 kD) (bas-1) [Caenorhabditis elegans] gb|AAV58886.1| Biogenic amine
XLNLFIYFINHEFFFWIDLAPHWFKTETKNRIFNVDAVYLKHEHQSDAYDFRHLQHLQVGLSRRFRALKIWFVFRAIGIQRIQQFLRMQNELAKMFADLLLQNELAKMFADLLLRDDRFELFVPQRLGLVCFRMKETSNELNESLYLAINDDRRVHLVASFTHCTFFLRFVVCSSKTRETNIEKAVEVIREMADKVT

SEQ ID NO: 136816 - protein, 33 aa, Heterodera glycines
  Coding regions on vcDNA: vcDNA=SeqID_63239; Strand=+; Position=1-100
LCSSELAPAAHLQTLHYWHTHRSANGDSETIAL

SEQ ID NO: 136817 - protein, 65 aa, Heterodera glycines
  Coding regions on vcDNA: vcDNA=SeqID_63240; Strand=-; Position=1 -129,172-240
MSQKSISDFISNVTFQQSPSTQISSAEEAISDLAVSISSDEFGVTSPKRKKYSHKKPGGGLSKKG

SEQ ID NO: 136818 - protein, 32 aa, Heterodera glycines
  Coding regions on vcDNA: vcDNA=SeqID_63241; Strand=+; Position=1 -14,999-1083
MDKKFKICPLFWFHELKCNIWYSAEVDEPLLM

SEQ ID NO: 136819 - protein, 28 aa, Heterodera glycines
  Coding regions on vcDNA: vcDNA=SeqID_63242; Strand=+; Position=1-84
GTASVGASAQNEEVGLGQIGKAQAPNHT

SEQ ID NO: 136820 - protein, 34 aa, Heterodera glycines; identical to SEQ ID NO: 127275
  Coding regions on vcDNA: vcDNA=SeqID_63243; Strand=+; Position=1-105

SEQ ID NO: 136821 - protein, 67 aa, Heterodera glycines
  Coding regions on vcDNA: vcDNA=SeqID_63244; Strand=+; Position=1 -153,611-661
MGCDALVLVTEESAGPSNGTKENAEMDETSDGKEKEPMASANSKVMQRNPKPFRLRHRSHPRGSVFH

SEQ ID NO: 136822 - protein, 377 aa, Heterodera glycines
  Coding regions on vcDNA: vcDNA=SeqID_63245; Strand=+; Position=1-1134
MNTRVNYAMYRLDEARKQQYDQIYIQACESTKFQMQLARAILQINPNEGVRRIFDRDDLVAHWEGDNLEVGFCAPLTPEKIFWDKKIGNECYEWTPVFAENTIFFVKPGTRELSILGKKSECVENGSVKEMHNETQRGIIQKMGENIEKIRPKYRNIQNPLILKAGALFESDNVRIEETIREYRSKMNNLPTPTLRLVEKPNITEIIKLVKSEANETLGVIIGRSGDWLEIVKKIPEKTKEALNYLKGLSYVLIAIPLLILLALIGYIGIKYRLIIFAGVRAGSVLARVLRAIMGMKKRSTRVLAVPTAPELDPIDEEAYVLDYLPPRRVAAITNDPRRLPSIRVRLNDLLTAALVDSCASVSYCRERTARKQDLNF

SEQ ID NO: 136823 - protein, 407 aa, Heterodera glycines
  Coding regions on vcDNA: vcDNA=SeqID_63246; Strand=-; Position=1 -66,115-352,402-1321
  Homolog annotation: Hit_ID=AAS38911.1; Match level="QueryCoverage =83%, HitCoverage=89%, E-value=3e-29, Identity=27%"; Hit description =similar to Leishmania major. Ppg3 [Dictyostelium discoideum]
MRLQNILSILIILHICEVKSFPILSSLFPSKNDSGDTVTIFDNIKEQEVQIRKKRQAITLLNDGKSITLTITGQSVTVTEETLSDGTIVLRITGQNPTVLTGTDNLSSDDQASTTEESSASANEEVSTSDDPASTTEESSASANEEASTSDDPASTTEVLSASANEEVSISDDPASTTEESSASANEEVSISDDPASTTEESSASANEEVSISDDPASTTEESSASANEEVSISDDPASTTEESSASANEEVSISDDPASTTEESSASANEEVSISDDPASTTEESSASANEEVSISDDPASTTEESSAYADTVTSSSSSLITSSISSKSSTTTTILRPPSQQKPRSSSSSSCESEENKFGKRRPSHHKNKKSKQTKNKQEGKDKNEKENFAKRVYEWFHNLPRHFG

SEQ ID NO: 136824 - protein, 89 aa, Heterodera glycines
  Coding regions on vcDNA: vcDNA=SeqID_63247; Strand=-; Position=1 -111,161-262,843-897
MINFIESKCIKSYQDGSLKIKNDYSAEEEEIETKVLKTPRRIFTLNKRSKTNANPVPNYEVDAEVEITGRKRVKTTAHKKAQRVKTTAK

SEQ ID NO: 136825 - protein, 303 aa, Heterodera glycines
  Coding regions on vcDNA: vcDNA=SeqID_63248; Strand=-; Position=1 -721,1134-1324
  Homolog annotation: Hit_ID=NP_701342.1; Match level="QueryCoverage =98%, HitCoverage=29%, E-value=8e-20, Identity=26%"; Hit description =MAEBL, putative [Plasmodium falciparum 3D7] gb|AAL10509.1| erythrocyte binding protein 1 [Plasmodium falc
MSQRERDNLRITDQKVIQKIRLQNLVKDNKLSSTPKRLKTFGIFKENNSYKIHENELENNNVLWTSRKITANAANGQSKIEQKYLKKKQNAKNYKEKSQRLEKELRERDVEISNLKRNEVHYKIKSEQLEKELAKKEKQIDEIKKNMQKELDNKESVKIFKEKSQKLEKELGQRETEIYELKRNEVRHIVKSEHLEKELEKKEKQMEQLKKELEKKEKEIAKLKKEVRRGGGGENKTNDRGEGNRAKTIDSKLTVKERELYNLDRNISMKVRQLQNFESLIDQQNKSTNSAIRNSEKFEALFI

SEQ ID NO: 136826 - protein, 50 aa, Heterodera glycines
  Coding regions on vcDNA: vcDNA=SeqID_63249; Strand=-; Position=1 -11,113-254
MSVCATKYYLDADSLDAVFKQLESDGVALRTRLYEEIKRAGLLEDKGGQG

SEQ ID NO: 136827 - protein, 174 aa, Heterodera glycines
  Coding regions on vcDNA: vcDNA=SeqID_63250; Strand=-; Position=1 -154,212-582
MLLRRHELRKPRFSSSEAAPVNMHKKNIGKSQLSKMSKNNGETVEGDKMPKIGTAASLAAAKHQLAPSAFPSSAFSYALPNFSKSKQQISPIRRQRPIGKSASYDSLIGQSSGQLSSFHQGPTKHGKSSELDGVSKGMRKVPSWDGGLASRLMDEMPKINFSKLKGKNKPLFDS

SEQ ID NO: 136828 - protein, 25 aa, Heterodera glycines
  Coding regions on vcDNA: vcDNA=SeqID_63251; Strand=+; Position=1-75
MVQKAFRRRFGRRRFGVHRPQTPAA

SEQ ID NO: 136829 - protein, 77 aa, Heterodera glycines
  Coding regions on vcDNA: vcDNA=SeqID_63252; Strand=-; Position=1 -93,152-292
MPNNEAEMFSENWAISAGKSIWTQFVPKCFTEIITTVEVSTMIPASGYPTVSRPGYPASRLGRSESNWVQKYTLVIM

SEQ ID NO: 136830 - protein, 548 aa, Heterodera glycines
  misc_feature (1)..(1): Xaa can be any naturally occurring amino acid
  Coding regions on vcDNA: vcDNA=SeqID_63253; Strand=+; Position=1 -171,407-492,620-702,781-813,878-961,1206-1427,1588-1728,1819 -1856,1916-1981,2058-2126,2273-2360,2625-2824,2896-2954,3280 -3397,3473-3559
  Homolog annotation: Hit_ID=NP_112341.1; Match level="QueryCoverage =98%, HitCoverage=54%, E-value=1e-130, Identity=45%"; Hit description= phosphodiesterase 2A, cGMP-stimulated [Rattus norvegicus] sp|Q01062|CN2A_RAT cGMP-dependent 3',5'-cyclic
XLINYLICKCFLKVAEVFEKNGTSDEYLTEIRMPLNQGIVGHVATTGQMMNVRDVYSHPNFYPKVDERTGFITRNILCFPIKDSSGTLVGVAELCNKIGRDAFTRHDEQIAATFAVYCAFAVYCAISISHCLLYRKLQEAHRRCLLYRKLQEAHRRSHITAELLVQSSTLSPEDILRLTVRDIPSPDSFHSESTFHFVPRSIGGADIYVEASLSMFKSLGFIDRYRIRRRTLARFLLMVQKGYRDVPYHNWSHAFAVAHFCFLLLRMPSVKSSLQELERFALLVACLCHDIDHRGTTNAFQLQSKTPLAQLKTPLAQLYSSEGSVLERHHFAQTVSILGMDECNIFDQLNQKQYQQIMDCIREVILATDIAAHLRKVERIAEMAKVGFDSRSDEHRYLFTCLLMTASDLSDQSKDFRHSKAIAENIYKEFFSQGDLEKEMGNRPIEMMDRERACVPKIQIEFMDTVALPVFSILSDYLITFPLPLRALLHNRRCWMKLDHILQEQGLPLTSGEDNVSKNGEDNVSKNGQTDDDDTLGIPINVWRRLSN

SEQ ID NO: 136831 - protein, 88 aa, Heterodera glycines
  Coding regions on vcDNA: vcDNA=SeqID_63254; Strand=-; Position=1-309
SNDLQIHKMGPTDHSDQFFVLINTRLSNRLSIALHTFIIASFPAFLTFLPSTKKDRPPFSVRRRWEGIGADVPDQRPFPGDKRSKKSL

SEQ ID NO: 136832 - protein, 37 aa, Heterodera glycines
  Coding regions on vcDNA: vcDNA=SeqID_63255; Strand=+; Position=1 -16,276-373
MPFPFDDVLLAFEDSTVCVFNLATKSVVDAVRIHLFK

SEQ ID NO: 136833 - protein, 50 aa, Heterodera glycines
  Coding regions on vcDNA: vcDNA=SeqID_63256; Strand=+; Position=1-150
MSDSADESADPLDALVFMEQAEENGSDFSDTKEGKGMAEENSSDESEYNE

SEQ ID NO: 136834 - protein, 30 aa, Heterodera glycines
  Coding regions on vcDNA: vcDNA=SeqID_63257; Strand=+; Position=1-219
ARGNIKGIFVFSDPENPKNPKLDSFCFYKF

SEQ ID NO: 136835 - protein, 53 aa, Heterodera glycines
  Coding regions on vcDNA: vcDNA=SeqID_63258; Strand=+; Position=1 -8,369-522
MKRHIRALPIVCLMGPGKMLMSNFFLAMLSDAALIWPPNKFSSPKMAIDCVRK

SEQ ID NO: 136836 - protein, 36 aa, Heterodera glycines
  Coding regions on vcDNA: vcDNA=SeqID_63259; Strand=-; Position=1 -77,334-367
MLIGIAAIKAQKKALTGEAIEGISRSMELRNNLTIL

SEQ ID NO: 136837 - protein, 96 aa, Heterodera glycines
  Coding regions on vcDNA: vcDNA=SeqID_63260; Strand=+; Position=1 -183,255-359
MAVSFLHFSSIILCSVLALLLLAMFCEVRAAPAVYQMDRNAFRMSFGKRSQPMETESSELNGANIAIPLLYDMAEAETAAQKQRHRVSAPWATRWK

SEQ ID NO: 136838 - protein, 29 aa, Heterodera glycines
  Coding regions on vcDNA: vcDNA=SeqID_63261; Strand=-; Position=1 -14,155-230
MGSRSKPANTTRVRVSCCSTGSSRSPVPQ

SEQ ID NO: 136839 - protein, 43 aa, Heterodera glycines
  Coding regions on vcDNA: vcDNA=SeqID_63262; Strand=+; Position=1 -86,343-388
MSDRMQMFLQFITKKIQGKATVPKKINNCWAIFCSISSYLTWK

SEQ ID NO: 136840 - protein, 234 aa, Heterodera glycines
  Coding regions on vcDNA: vcDNA=SeqID_63263; Strand=-; Position=1 -380,560-884
  Homolog annotation: Hit_ID=AAS66293.1; Match level="QueryCoverage =43%, HitCoverage=44%, E-value=3e-09, Identity=33%"; Hit description =LRRGT00202 [Rattus norvegicus]
MLKTDNGNGLGETEQKQQQMNREGKGQTEEEEEEDGQREEQKKGGKKAKGNWENEKEGKKEEENNKSSNSRRRNSSKRTRKRSKTTPTAEGGGGGKAAQNERDKRRLLGPSLSWDPQQCEQQQRKLSRPRFPLFTTNGTCGTQCATAADLRGRIHSDGSAERLAHTNKKLSIFLTAKIMPTKGGHSEKKPKGKRRKKSGGLTKGANGTAEKIGLELNWSVLLENWHFYLSSAGA

SEQ ID NO: 136841 - protein, 63 aa, Heterodera glycines
  Coding regions on vcDNA: vcDNA=SeqID_63264; Strand=+; Position=1-508
SVSFSFLFFKFIRPLNFQNNFCPFLFFKLFIFYFFLLDFGISFGIIFLRDRTAECAVLSPNGA

SEQ ID NO: 136842 - protein, 71 aa, Heterodera glycines
  Coding regions on vcDNA: vcDNA=SeqID_63265; Strand=-; Position=1-477
IIFIQKKFFFGFSGRPPYRCAQIYGETESFGNSFPIACTLILRWIFAPHNCLSTPNGHLKNRFFCFRGSPP

SEQ ID NO: 136843 - protein, 57 aa, Heterodera glycines
  Coding regions on vcDNA: vcDNA=SeqID_63266; Strand=+; Position=1-206
HTSIIFFNYFFHFITQRSRLIRSSPNFAGKLLRTLQMLINFLRIFCLEEHSSSHLPH

SEQ ID NO: 136844 - protein, 214 aa, Heterodera glycines
  Coding regions on vcDNA: vcDNA=SeqID_63267; Strand=-; Position=1 -227,274-424,478-593,1031-1060
  Homolog annotation: Hit_ID=NP_499453.1; Match level="QueryCoverage =94%, HitCoverage=12%, E-value=8e-27, Identity=36%"; Hit description =chondroitin sulfate proteoglycan 6 (3M395) [Caenorhabditis elegans]
FLFQGCVIDLFRIRKSAHQAVEVTAESRLFYHVVSDDRVAMKLLERINQRGLPGEVNFYPLNRVLVKDRRPVSDADASPILDHLQYDPNFEPVFRSIFGNDASPILDHLQYDPNFEPVFRSIFGNCVFVRDLAAGSRVAKQERFDCVTLDGDQVSRRGPMTGGYIDRDQVSRRGPMTGGYIDRKRSKIDLAKKLRNFERERINLEIFLSCSANI

SEQ ID NO: 136845 - protein, 58 aa, Heterodera glycines
  Coding regions on vcDNA: vcDNA=SeqID_63268; Strand=+; Position=1 -113,398-461
MTLKTNAKVFYNNAKNKTEEFVICADEAESEECAGKYWALFDLSGPFSAEHLPNDPKK

SEQ ID NO: 136846 - protein, 38 aa, Heterodera glycines
  Coding regions on vcDNA: vcDNA=SeqID_63269; Strand=-; Position=1-114
MTTTQNATALSLLTISVGIGWGANYECRRVTDLPCRYE

SEQ ID NO: 136847 - protein, 113 aa, Heterodera glycines
  Coding regions on vcDNA: vcDNA=SeqID_63270; Strand=-; Position=1 -117,357-464,523-636
MSDRLLNRTVSDSTRHSNKPLVPSSTKGIDLCLLFYVYVIVQAGSRRRSAERPVTSLHEAAHAIAIREGDLVAPAVLQMRGLEVNDAQVANLVEQAAMAALELLQQNELALMR

SEQ ID NO: 136848 - protein, 75 aa, Heterodera glycines; identical to SEQ ID NO: 135273
  Coding regions on vcDNA: vcDNA=SeqID_63271; Strand=-; Position=1-225

SEQ ID NO: 136849 - protein, 231 aa, Heterodera glycines
  Coding regions on vcDNA: vcDNA=SeqID_63272; Strand=+; Position=1 -348,423-694,755-830
MDGQPIWDVLAREIWPIFASNIRHLRFNGDDHLDNLRRRTSPTILTDLNQLDSIDSFDLLPAAFGDDFDGPNSTISAGQILSKWLHSPRKDGQPKRLSCYNYNEQGNTNWVNNFKEHFLRANAISSVSYQIHFSVHRSIPMMPFELVNESTKEKLTLAKAKELGNNWIMKQCKIIGEKEEKQQKNENLDNSCNNVVFWLYICNNCIGPLSPPPAEEAGQNIKKVAFSADNE

SEQ ID NO: 136850 - protein, 68 aa, Heterodera glycines
  Coding regions on vcDNA: vcDNA=SeqID_63273; Strand=+; Position=1 -74,188-320
MCPLMKLRTVPTVHHFRYGQYNTFRLVMIMHPFIRLLSPVTRQNDVLSQHPIIPICLWNFPRRKETIE

SEQ ID NO: 136851 - protein, 116 aa, Heterodera glycines
  Coding regions on vcDNA: vcDNA=SeqID_63274; Strand=+; Position=1-349
  Homolog annotation: Hit_ID=AAH43989.1; Match level="QueryCoverage =93%, HitCoverage=28%, E-value=3e-21, Identity=51%"; Hit description =PSMD4 protein [Xenopus laevis]
FMKFAKKLKKEKVSVDFVLFGEATAENNKIIADFVDILNGTEEGGASHLLVVPVGDTKLYDALLRSPICAGAGAAVGAVGEFGINDEDDPELAMALRISLEEQRLRQQQQQGGEGR

SEQ ID NO: 136852 - protein, 475 aa, Heterodera glycines
  Coding regions on vcDNA: vcDNA=SeqID_63275; Strand=-; Position=1 -181,386-1631
  Homolog annotation: Hit_ID=AAL40415.1; Match level="QueryCoverage =87%, HitCoverage=41%, E-value=1e-30, Identity=25%"; Hit description =endonuclease/reverse transcriptase [Branchiostoma floridae]
MNKIDEISLTLTNKNTDLLLITESWTNENEEIPLSPWTRENYNCIFASRKSKSCSRGGGCGDFNFSKRDLVWKEGHPFSKSKFGEIFCHFFSKLSLFNATNGPTRENSWLDLVLSANDQIVKQCNIEGGVFSSDHLAQFFTMSIPKTTQKPKFINIRRFTPSNVSLLNTVISSRISTLSQGHFSVNEKYNAFNKTLLETLNECIPIKRLTKNELAPKYPTHLLASIKEKAKLYKLCKIDPTKRALYDSISLHIKIQTKKFHSQLEQKAISKGKNSIFKYIQKYDVNPFEISNLVSENKCYHNDQEKCELFANLFVNSFNNSEVDPGFLSLDNTFVNQSFISDIEFNIIETQKLLRKLPNKNGTSPDNISYKTLKNCHPSLATVITDLFRISLDSGSLPDIWKESIVFPLFKKGDKFNPENYRPISLTCSLCRVMERILSKNIYNFLLKNNKISEYQFGFVRNRSTTSQLITVVED

SEQ ID NO: 136853 - protein, 199 aa, Heterodera glycines
  Coding regions on vcDNA: vcDNA=SeqID_63276; Strand=-; Position=1-598
MDNTAPKKFLTSLDQLQIPPEIDNDSAIPDYAKLLIKQLHSLLATASSLVQSQVTANDAIEEDRRQRTVVITNVPEFQSGKASERGEADRALVNLILDTVDLDQTPVVFRVGMRTPNRARPLKMEFPTRHAARHVLRMKGKALALNALHGARIRESMTKEQLAERRKLIEQCAKKRKEDAGDWIIYANQVILRSDIDTI

SEQ ID NO: 136854 - protein, 338 aa, Heterodera glycines
  Coding regions on vcDNA: vcDNA=SeqID_63277; Strand=+; Position=1 -215,270-708,766-1046,1107-1188
MALLSPRFDALVDKHFDGKSELTIWRTIEIRRKDKGPEPKLSVRMDRKFMEFPLPDDRPLPSKSRFKSLEIVYIDHSVIAFLRSNHQIFDKRGTNLHLWIPYSNTTDGPRIWDIFGREIWPFFSTNIRHLRFSHRDHLDNLLRRTSSTILTDLNQLTSIYSCGLFPAAFGDDFDGPISAGQALSKWLHTPRKDGQPKRLRCEDYSEQGNTDWVNNFKEHFLRANAISSVSYQIHFSVHVPSMPMVPFELLNEWTKEKLTLAKANELDNRWIMKRFKIIGESAAVQQQKKDDNWDNNCNNVFFGLVAGTNSIGPLSPPPPAEEDEAGQSITKGPSSADK

SEQ ID NO: 136855 - protein, 44 aa, Heterodera glycines
  Coding regions on vcDNA: vcDNA=SeqID_63278; Strand=+; Position=1-135
ITIITSQPATEIQSIGRCHPSEHFAVHARGTAKSAAPATGARTA

SEQ ID NO: 136856 - protein, 97 aa, Heterodera glycines
  Coding regions on vcDNA: vcDNA=SeqID_63279; Strand=-; Position=1 -212,273-354
MPMVPFELLNEWTKEKLTLAKANENEWDNSWIMKRCKIIGEKEEKQKKDKNWDNNCNNVFFGLFAGTNSIGPLSPPLEEVEEQTGQSITKGTSSADK

SEQ ID NO: 136857 - protein, 105 aa, Heterodera glycines
  Coding regions on vcDNA: vcDNA=SeqID_63280; Strand=+; Position=1 -213,283-387
  Homolog annotation: Hit_ID=NP_728531.1; Match level="QueryCoverage =85%, HitCoverage=6%, E-value=6e-27, Identity=55%"; Hit description =CG17090-PB, isoform B [Drosophila melanogaster] ref|NP_612038.2| CG17090-PA, isoform A [Drosophila melanog
MASYWRLKSIEEYELEMSTKSKETRRYVFNCLDDIGQVHLPSDLDDIDRMCERNDRLEFVDILKQMLSMDQDRRLTPTRGLQHKFVKMTHMIEMGRTKYCQVINS

SEQ ID NO: 136858 - protein, 97 aa, Heterodera glycines
  Coding regions on vcDNA: vcDNA=SeqID_63281; Strand=-; Position=1 -11,80-362
MNRRWICNDVWMDIFPCFDRPQLGLKMALLSPRFDALVDKHFDGKSELTIWRTIEIRRKDKGPEPKLSVRMDRKFMEFPLPDRPLPSKIRFKDLRIE

SEQ ID NO: 136859 - protein, 33 aa, Heterodera glycines
  Coding regions on vcDNA: vcDNA=SeqID_63282; Strand=+; Position=1 -27,432-506
MLTIMYAFESCRDAANHHVRDFGLSLMALRRNR

SEQ ID NO: 136860 - protein, 577 aa, Heterodera glycines
  misc_feature (61)..(61): Xaa can be any naturally occurring amino acid
  misc_feature (506)..(506): Xaa can be any naturally occurring amino acid
  misc_feature (543)..(543): Xaa can be any naturally occurring amino acid
  misc_feature (547)..(547): Xaa can be any naturally occurring amino acid
  Coding regions on vcDNA: vcDNA=SeqID_63283; Strand=-; Position=1 -1407,2247-2587
  Homolog annotation: Hit_ID=NP_510849.1; Match level="QueryCoverage =84%, HitCoverage=40%, E-value=1e-104, Identity=40%"; Hit description= predicted CDS, zn-finger, CCHC type and RNA-directed DNA polymerase and Integrase, catalytic domain cont
PFAFAYLDDMIVVSRSHEEHRKHLNEVFKRIGNFRIKPYKCSFNQKQIKYLGFVIDKNARXPDPSKTKAISEMPVPTNVSELRSFLGMINQYQQFVKNMRFLRQPLDELLKQDAAWVWSTDCQNAFDKVIEVLKSDQLLTHYDPEKDIIVSADASDYRIGAVISHRFPDGSLKAIAHASCSLSPAEMNYSQIEKEGLALVFAVQKFHKYLSGRHFVLQTDHKPLLTIFGNKKGIKACTANRLQRWALILLAYDFEIEYQNTADFGQADALSRLIAKAPVPEDEFIVATITESPNLATVNAFTHFPVVHEDIVKATEADKLLQEVKGFVLPMAKQMKSLARQHYWPGIDQVRKCEPCATEAKAPKKTELHSWPKAEGPWKRVHMDYAGSFFGKMYLIIVDAHSKWPEVFEMRSTGSAATIEQLRSLCARFRLPETLVTDNGTQFSSNEFKEFVKENGINHLFSAPFVPRNGESFEVFVNRLKAALRKFRFSELTKRNSNAWFSSRRXSHQATPNYASTSSHVSQRRTQRRRKRPNYSTKSLRTXIHSXKRRRKQKFWRRQSPKSMQFNTAKHRQISTK

SEQ ID NO: 136861 - protein, 50 aa, Heterodera glycines
  Coding regions on vcDNA: vcDNA=SeqID_63284; Strand=-; Position=1 -46,1124-1230
MGRDYFLKKYLNKTNRVHKPHQASSFFNTKNIKNREVRASPLYNALMKAA

SEQ ID NO: 136862 - protein, 200 aa, Heterodera glycines
  Coding regions on vcDNA: vcDNA=SeqID_63285; Strand=+; Position=1 -37,126-220,475-508,566-827,879-988
  Homolog annotation: Hit_ID=NP_741741.1; Match level="QueryCoverage =99%, HitCoverage=35%, E-value=8e-57, Identity=58%"; Hit description =receptor (XD585) [Caenorhabditis elegans] gb|AAL32243.1| Hypothetical protein Y41G9A.4a [Caenorhabditis e
EFRVKRHSFYGDPTDALKAIRRQDARIIVGLFYVTEVRPDICSAYLHGLYGRRYVWFMIGWYSDAWFIWFMIGWYSDAWFIPPEEEALNCSRAQMERAAQFHFTTESVMLSRDLQPAISGMTGEQFQTRLRRRISTDPHETGGWPEAPLAYDAVWALALTLNCTALALTLNCTMGSLPFGVNSLEQFTYNSTGIARKMFK

SEQ ID NO: 136863 - protein, 116 aa, Heterodera glycines
  Coding regions on vcDNA: vcDNA=SeqID_63286; Strand=+; Position=1 -58,281-409,500-551,766-839,923-946
  Homolog annotation: Hit_ID=CAE70374.1; Match level="QueryCoverage =93%, HitCoverage=7%, E-value=5e-38, Identity=73%"; Hit description =Hypothetical protein CBG16933 [Caenorhabditis briggsae]
EVYAEKLQKDNHAFVGTYRINADDCSHDGSLSVENVLWANTVLASGTAIGLVVYTGRETRSVMTTLPDSKVGLLDREANNFTKIFFLFVLTLSTVMVLMKGHDDAKYLYDDAKYLY

SEQ ID NO: 136864 - protein, 136 aa, Heterodera glycines
  Coding regions on vcDNA: vcDNA=SeqID_63287; Strand=-; Position=1 -175,470-702
MSGKRALATIIKIYIDEKRDKKQKSDQQWSKSKWQRFLQLFLKVVEDENGTNGNLALEFDNKKMKKKRRGKRFADIVFSAVLLILLAFAFSAIFHKLKRQIGKCFGSQQPNANGQNIWAQNGEGWTSGEEQIIRGK

SEQ ID NO: 136865 - protein, 101 aa, Heterodera glycines
  Coding regions on vcDNA: vcDNA=SeqID_63288; Strand=+; Position=1 -256,880-932
  Homolog annotation: Hit_ID=XP_372979.2; Match level="QueryCoverage =96%, HitCoverage=46%, E-value=2e-27, Identity=58%"; Hit description =PREDICTED: similar to Involucrin [Homo sapiens]
QLIHGQLIHGQLIHGQLIHGQLIHGQLIHGQLIYGQLIHGQLIHGQLIHGQLIYGQLIHGQLIHELIYWQLIHGQLIHGNSSTGERTHRKIFRNIIIATNF

SEQ ID NO: 136866 - protein, 19 aa, Heterodera glycines
  Coding regions on vcDNA: vcDNA=SeqID_63289; Strand=+; Position=1-58
MDLKLKMQILYCRPLKTPP

SEQ ID NO: 136867 - protein, 262 aa, Heterodera glycines
  Coding regions on vcDNA: vcDNA=SeqID_63290; Strand=+; Position=1-789
MCNAVNGSDTRALLMTATSTAFNPAQPHLSMTAAIFIDPGSHRSFISLKAAQLLDLPLVHTEECHLTSFGEREPKRYISDLVKLGFLCTSGEKLIFNLNAMKFLVNDMPMIQLSELDKTELRQQKLNPPHEQRQPDIMLGIDVWHELQVQPIEKLPSGFTLCRSKIGKIFSGSGRIEMHQTPNVTFVMSVHGTEQEEANQSVTFESTKEETEVFTTEDDFKKDEQLNNFFGLNLIGMDDTSTPIDQDYVMIHFKKNLTFINN

SEQ ID NO: 136868 - protein, 112 aa, Heterodera glycines
  Coding regions on vcDNA: vcDNA=SeqID_63291; Strand=-; Position=1 -22,153-469
MEGTALTQFRTVRRGGGTRRQSAEYEDGKETKQKEEGDEHRHQSSSSSANFGRSSDSEQILREFNKEFSGFMRQFVMSRDKKPGEFDERMKAFIRDFNKKMPPEFEVERSAF

SEQ ID NO: 136869 - protein, 58 aa, Heterodera glycines
  Coding regions on vcDNA: vcDNA=SeqID_63292; Strand=-; Position=1-178
YWSDIQIPDDHGQFHYICPFCKETLVEAKKFIKLFITTDEQEEAETSAAGKGKSVVHY

SEQ ID NO: 136870 - protein, 41 aa, Heterodera glycines
  Coding regions on vcDNA: vcDNA=SeqID_63293; Strand=-; Position=1 -64,252-313
MSIINVPNVQIRQCLGNCTGYKNSSFEKSGKRILNNAGPSI

SEQ ID NO: 136871 - protein, 90 aa, Heterodera glycines
  Coding regions on vcDNA: vcDNA=SeqID_63294; Strand=-; Position=1 -125,192-337
STSLKEADGSDGAVENVQTKENMRPILEAERHQQNDDGTGEIRSPPSSSPTPWHPSHALAEPTWQKLLRKEFQMKYMTNICCFLEEQAKQ

SEQ ID NO: 136872 - protein, 91 aa, Heterodera glycines
  Coding regions on vcDNA: vcDNA=SeqID_63295; Strand=-; Position=1 -394,684-751
LFEYPKRTLEKIDFFCIRAVPPNRCAQIYGETESFGNSFPIACTLILRWIFAPHNCLSTPNGYLKKSIFLFSGSPPEPMRPDLWGDRILRE

SEQ ID NO: 136873 - protein, 208 aa, Heterodera glycines
  Coding regions on vcDNA: vcDNA=SeqID_63296; Strand=-; Position=1 -156,524-635,766-908,1277-1340,1390-1443,1493-1589
  Homolog annotation: Hit_ID=NP_497914.1; Match level="QueryCoverage =45%, HitCoverage=20%, E-value=5e-13, Identity=48%"; Hit description =putative nuclear protein, with a coiled coil-4 domain (47.3 kD) (3F582) [Caenorhabditis elegans]
GCCSQSLGPDQLHPQLQIGIGPRRPLLLHAGRGSRQNDVLSRPAPPGKHFLGLSAPSKISPMLNGKSGDDQWKAGEGIKQSVCPPQISISQQSPYAKGPDSVTSKASSDMSKDSFHNAAPTGGKEKTRKYTKFYGGREEHDDMITRVTSMEQEKNALETQNSVLRRELERLNFLLQERESRCVCKANQLQVGVSVLDESRSPSVGFMN

SEQ ID NO: 136874 - protein, 44 aa, Heterodera glycines
  Coding regions on vcDNA: vcDNA=SeqID_63297; Strand=-; Position=1-133
SVIFSRLIEPVKSFRMISRLFDSVNNFKSYIDSKLAQTELARSV

SEQ ID NO: 136875 - protein, 39 aa, Heterodera glycines
  Coding regions on vcDNA: vcDNA=SeqID_63298; Strand=-; Position=1-117
MFKNAEERAKENEAWRANSINDDKHNIIVYSKFDDYLNW

SEQ ID NO: 136876 - protein, 19 aa, Heterodera glycines
  Coding regions on vcDNA: vcDNA=SeqID_63299; Strand=+; Position=1-60
EPVNSCIGCKCRRCCTPNS

SEQ ID NO: 136877 - protein, 198 aa, Heterodera glycines
  Coding regions on vcDNA: vcDNA=SeqID_63300; Strand=+; Position=1 -315,625-906
MAKFSQFKLENEALQLDFKSGKSAKQKNKRLKTDGKANGIEFEQKMEKMFRKIIIENAKLANGSSSSAFSSSTFPSSAFPLPISMCTVPIYDAALRVPIYDMSDAIEEELFPKFVNGSADFSTHFAAVPSNKIKKYETHLGLLYAMKTNWRCANAKNKIDNSCTKYRRYIDILYEYLFMMRYGIKSVKADVETLVGPR

SEQ ID NO: 136878 - protein, 134 aa, Heterodera glycines
  Coding regions on vcDNA: vcDNA=SeqID_63301; Strand=+; Position=1-403
  Homolog annotation: Hit_ID=AAD29853.1; Match level="QueryCoverage =100%, HitCoverage=75%, E-value=6e-24, Identity=52%"; Hit description= pugilistDominant [Drosophila melanogaster]
SEFAALPSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLSSEFAVLFS

SEQ ID NO: 136879 - protein, 49 aa, Heterodera glycines
  Coding regions on vcDNA: vcDNA=SeqID_63302; Strand=-; Position=1-368
PITDSDHTARSLIASMLRLNAALRPTSSMFVHVHLFCVVSIFGMHISAW

SEQ ID NO: 136880 - protein, 438 aa, Heterodera glycines
  Coding regions on vcDNA: vcDNA=SeqID_63303; Strand=+; Position=1 -46,525-672,1179-1337,1596-1619,1679-1804,2063-2104,2148-2298,2755 -2830,2887-2941,3410-3530,3599-3678,3749-3829,4332-4385,5146-5189
  Homolog annotation: Hit_ID=AAC25991.1; Match level="QueryCoverage =99%, HitCoverage=40%, E-value=4e-96, Identity=46%"; Hit description =protein kinase/endoribonulcease [Homo sapiens] sp|O75460|ERN1_HUMAN Serine/threonine protein kinase/endori
RAVLGRGCDGTFVYRGQFDGRDVAVKRVQALLSADNNWHRIIDREVTHLRESDSHPNVIRYFCSESDSYFSYIALELCDHTLEDFINHQRGKMERRLKLELLRQATDGIAHLHSIKIVHRDVKPKNILINGVNILINGVAKGPPRVKISDFGLCKTVKLGHNSISKVSGVVGTEGWMAPELWDSTASVTKTYAIDVFTKTYAIDVFSLGCVFYYVLTEGEHPFGDSNVRLYNISMNKFNLSKLDGERHSDHTARSLIASMLRLNAALRPTSSILVTLVTHPIFWEPGKQLQFLLEVSDRIEKLESHDLIMRRLEWRRAVVVGTWLNRIDEPLKIDLLKQLLKQRSYQNNVRDLLRAIRNKKHHYQELSLELRTLLGRLPELSLELRTLLGRLPDEYIAYFTSRFPELLMHAFMALTLWAHENVFLPAFNPFMPPPLPP

SEQ ID NO: 136881 - protein, 24 aa, Heterodera glycines
  Coding regions on vcDNA: vcDNA=SeqID_63304; Strand=+; Position=1 -52,295-317
MEKACKIWRDYIDFSALELLELAS

SEQ ID NO: 136882 - protein, 47 aa, Heterodera glycines
  Coding regions on vcDNA: vcDNA=SeqID_63305; Strand=+; Position=1 -90,312-365
MSAGSVLRTSVLYKIGVDHFLLRLTVFRVQEKRRPLPKHSFSSSIDW

SEQ ID NO: 136883 - protein, 52 aa, Heterodera glycines
  Coding regions on vcDNA: vcDNA=SeqID_63306; Strand=-; Position=1-158
QSPFYFTEGFLYLEVIAEKRLSLFLINFIHIQMLSSTIGRAVRNRPFIFEGI

SEQ ID NO: 136884 - protein, 92 aa, Heterodera glycines; identical to SEQ ID NO: 125147
  Coding regions on vcDNA: vcDNA=SeqID_63307; Strand=-; Position=1-304

SEQ ID NO: 136885 - protein, 36 aa, Heterodera glycines; identical to SEQ ID NO: 135037
  Coding regions on vcDNA: vcDNA=SeqID_63308; Strand=-; Position=1-108

SEQ ID NO: 136886 - protein, 237 aa, Heterodera glycines
  Coding regions on vcDNA: vcDNA=SeqID_63309; Strand=+; Position=1 -136,188-331,516-732,1117-1333
MISSTAVPRPLRSSNQQKQQPNALTKQNGAHQQKTPIKAREDSRNRSDALGAQKPNGHSPRTPSVPPVNKRYAHVKRQLITFISIDSLVILQQTGGNVTIENKKLNFREAAKPRVEDKSEVPIPKSEKKVRKWGMASPTKGKECFDRLRLKSWNGKPSPKSVRWTIPQRSPRPVEMILTPKEIPPTDDDEQNDANRGHIGQAEEGGGEKRNGERATEEETPQGTKEAETGQLINFGD

SEQ ID NO: 136887 - protein, 253 aa, Heterodera glycines
  Coding regions on vcDNA: vcDNA=SeqID_63310; Strand=-; Position=1-761
  Homolog annotation: Hit_ID=XP_345024.1; Match level="QueryCoverage =100%, HitCoverage=87%, E-value=8e-33, Identity=28%"; Hit description= similar to SPAC23A1.17 [Rattus norvegicus]
MSLNTPTFQSLALNPPTFQSLGLNPTALQSLALNPPTFQSLALNPPTFQSLGLNPPTFQSLGLNPPTFQSLVLNPRALQSLALNPPTFQSLVLNPRALQSLGLNPPTFQSLGLNPPTFQSLALNPPTFQSLALNPPTFQSLVLNPRALQSLALNPPTFQSLGLNPPAFQSLGLNPPAFQSLALNPPTFQSLALNPPTFQSLALNPPTFQSLALNPPAFQSLGLNPPTFQSLALNSPAFQSLGLNPPTFQSLGL

SEQ ID NO: 136888 - protein, 184 aa, Heterodera glycines
  misc_feature (8)..(8): Xaa can be any naturally occurring amino acid
  misc_feature (170)..(170): Xaa can be any naturally occurring amino acid
  Coding regions on vcDNA: vcDNA=SeqID_63311; Strand=+; Position=1 -156,232-310,370-462,515-641
  Homolog annotation: Hit_ID=NP_510116.2; Match level="QueryCoverage =88%, HitCoverage=8%, E-value=6e-43, Identity=53%"; Hit description =ADAMTS family member (162.6 kD) (adt-1) [Caenorhabditis elegans] emb|CAA90302.2| Hypothetical protein C02B
ASIRSKQXMSTFPIRRINLSFSESGRGNCLRDPAESIASHDHLKDGRLPGQRFTADFTADQQCSYFWGRDFQVEIPNGRSFEDICRILWCGNSGSTISTAHDICRILWCGNSGSTISTAHPALEGSWCGPQRWCHRGQCEEWWCHRGQCEEWHPQMGDFPTEVDGICSDXTSAEKQCPITQRQI

SEQ ID NO: 136889 - protein, 136 aa, Heterodera glycines
  Coding regions on vcDNA: vcDNA=SeqID_63312; Strand=+; Position=1 -330,555-635
MIFENERAWDVVDRWLNAHYFSLEYGNTRGELEKIEQMLLIAKGAIVEDAYFDIHKILSVPQFFDAPQRVESDEDILKSKYLLNSFNPFKRGVYSREGSIRGWGSIPGSAAKSQNMDFCGVISHRNRTAEEINTNT

SEQ ID NO: 136890 - protein, 27 aa, Heterodera glycines
  Coding regions on vcDNA: vcDNA=SeqID_63313; Strand=-; Position=1 -72,306-317
MHATQLTNLVGSYYHYYFNSLFVNEDC

SEQ ID NO: 136891 - protein, 129 aa, Heterodera glycines
  Coding regions on vcDNA: vcDNA=SeqID_63314; Strand=-; Position=1-388
MVLPLTAALSKLLNCKPENLAEYLNNPEAVNKANAYLAGKKLKTTYQGRDSKTKEVKFGTFSVKAAAETYAFEGFLGKFPKILFRSNTMRSDVKVQQYFYMKHRIRLLYPQLKCIVEYHNKGHCKYYPL

SEQ ID NO: 136892 - protein, 634 aa, Heterodera glycines
  misc_feature (86)..(86): Xaa can be any naturally occurring amino acid
  Coding regions on vcDNA: vcDNA=SeqID_63315; Strand=+; Position=1 -105,153-283,1081-1226,1270-1342,1381-1505,1554-1659,1712-1782,1918 -2022,2074-2145,2189-2270,2325-2429,2529-2648,2700-2780,2839-2994
  Homolog annotation: Hit_ID=CAE58627.1; Match level="QueryCoverage =97%, HitCoverage=89%, E-value=1e-115, Identity=39%"; Hit description= Hypothetical protein CBG01795 [Caenorhabditis briggsae]
ENLEDWSITGKRRTQKALFHYTDRRAGKGYSDFATTLYYGRPYIWPPTTLYYGRPYIWPPVREINRWHFFICVTFALVILVDCKWXAELVVFRTSPFKPKMRQKEAAVTRRPIAVPLGKHKKKRKVGFREQRVVQYENRIRAYSSPDKIFRYFATIKAVVQYENRIRAYSSPDKIFRYFATIKALPTNYEDGSFDIFMTPEDFVRSLTPGVLPTNYEDGSFDIFMTPEDFVRSLTPGVIQPRKYGLDKYKVYNVEEVKEHLPVKEHLPSGDGVFNWMSDSGGLINFGDYLFLMTLLSTSPSEFKLAFHVFDSPSEFKLAFHVFDQNGDGVLDQQEFARVQELVLSQSNIGQRHRDHKTGAGAFVKTKNSMLSKHFFGENGQNMLSKHFFGENGQNKLDIGTFLQFQQNFHGDILKIEFERRQNFHGDILKIEFERRDPETGPEGIISELSFAELLMILSFAELLMIHSDLPEKRQKRMLKRVRRRQKELADKGGVSFEEVDSFFAFIYHIDKVDLALHFYKLAGKPLSKQLLQRVARRVARKVTGVDLSETVVDVVVTLFDENADGELSQGEFVAIMKKRMQDGELSQGEFVAIMKKRMQRGLERPKDTGLFRLMDAYWQCATRFARDDGQSWG

SEQ ID NO: 136893 - protein, 203 aa, Heterodera glycines
  misc_feature (18)..(18): Xaa can be any naturally occurring amino acid
  Coding regions on vcDNA: vcDNA=SeqID_63316; Strand=-; Position=1 -96,163-252,303-383,524-642,689-800
  Homolog annotation: Hit_ID=CAE59900.1; Match level="QueryCoverage =97%, HitCoverage=26%, E-value=5e-31, Identity=41%"; Hit description =Hypothetical protein CBG03384 [Caenorhabditis briggsae]
VQVEIQFSAKKAPIMVLXGGRARFRLHGKMDFVRPENATQRRELFVRPENATQRRELVLRSETTMTSNVNLWIERSQILGNRSQILGNATVENLDFKLVSTNVRDVDQSSFADLGLFGAEFLEKLLTEILQIGLLLPSMRGVVLRSPKLTVHDRYIRVQTYFKLDELTVHDRYIRVQTYFKLDEQYAEKLVQGAVRQTLLNIG

SEQ ID NO: 136894 - protein, 461 aa, Heterodera glycines
  Coding regions on vcDNA: vcDNA=SeqID_63317; Strand=-; Position=1 -71,116-152,198-307,359-423,474-531,634-740,791-825,880-966,1029 -1104,1161-1276,1525-1621,1665-1765,1849-1994
  Homolog annotation: Hit_ID=NP_501879.1; Match level="QueryCoverage =97%, HitCoverage=73%, E-value=1e-105, Identity=48%"; Hit description= lipopolysaccharide-binding protein like family member (4L13) [Caenorhabditis elegans] pir||T20482 hypoth
MPTGLAYLREIGMKVVNDEILKISLPTITESIDAGQLPTITESIDAGQVSIFNAYVSKYWPPVEYTVSIFNAYVSKYWPPVEYTLDLLTPDTFTWRMSKMHLRSNGNSNGNFDARLNGALLLPTVPIQGEFEALEFEALLGHLGLTISVRMLRSAIGAPQVQMIFCRAAVGYVDLSVRNSGVITDFFINVFKAFLIAHFKVFKAFLIAHFKPTVEQRICQMIPTVEQRICQMIEGVINGDMNAVLATMPLKVVRINEDNLDLIGRNFGISPDQSKNSGSKKLQAPRNFTLLNFVSKKLQAPRNFTLLNFVSQLRDRNLVLDFSLIDDPFVSQGTVLMKSHGEISYDGLGETPFAPPNVIIPQAQGVFMAEFFGVFMAEFFGTDFVANSMLYHAFKQKYMDVVVGPESSPQLKDVSSPQLKDVLLTTCSSGFCIGEYLGSLGQQFPGRQEAVCSLELFLNLR

SEQ ID NO: 136895 - protein, 39 aa, Heterodera glycines
  Coding regions on vcDNA: vcDNA=SeqID_63318; Strand=-; Position=1-118
MAENIFDQFIVIDEKAFTDFISEMDEMDCYRHYNNSCAD

SEQ ID NO: 136896 - protein, 126 aa, Heterodera glycines
  Coding regions on vcDNA: vcDNA=SeqID_63319; Strand=-; Position=1-701
KNRFIFVFGAVPPNRCAQIYGETESFGSSFPIACTLILRWIFAPHNCLSTPNGHLKKSIFFVFGAVPPNRCAQIYGETESFGSSFPIAWTLILRWIFAPHNCLSTPNGHLKKSIFLFHKYFFQKVL

SEQ ID NO: 136897 - protein, 62 aa, Heterodera glycines
  Coding regions on vcDNA: vcDNA=SeqID_63320; Strand=+; Position=1 -153,291-323
MFLCLFLLIAISIIPTTNGYKMLVYSPSVSNSHLISNARVADVLANDGHDVTLLESRMMAPL

SEQ ID NO: 136898 - protein, 50 aa, Heterodera glycines
  Coding regions on vcDNA: vcDNA=SeqID_63321; Strand=+; Position=1-150
  Homolog annotation: Hit_ID=AAR05667.1; Match level="QueryCoverage =100%, HitCoverage=55%, E-value=3e-25, Identity=98%"; Hit description= conserved hypothetical protein [Salmonella typhimurium] gb|AAC70138.1| hypothetical protein [Escherichia
VRLYACCGLLLCPAYPQHFAHGYVDKIPGYPGRAGTLTGLHPMQVCRCRR

SEQ ID NO: 136899 - protein, 240 aa, Heterodera glycines
  Coding regions on vcDNA: vcDNA=SeqID_63322; Strand=+; Position=1-722
  Homolog annotation: Hit_ID=ZP_00331685.1; Match level="QueryCoverage =98%, HitCoverage=30%, E-value=6e-09, Identity=26%"; Hit description =COG0532: Translation initiation factor 2 (IF-2; GTPase) [Streptococcus suis 89/1591]
MGETSAGQEEKPSSELDDMQKYLEQLPRTIEQVPETPREMDGMPKDPKQMPRELNEKVAQTPRDAYDIQQYLDQLPRTIEDVPETPREMDGMPETLKETGETPKDPKQMPIDLDNAQQELNQLAIENAPETRRELDGMTRAETMGMLGIMPKELPKKPKKTRKMSLPEQLAIPPKDLEGMQSEHVDTPRPDQKYIPDMEFMKYRIPYGTETPKVDDNKQEEKAEKVEEKEEMEEMAEKHK

SEQ ID NO: 136900 - protein, 379 aa, Heterodera glycines
  Coding regions on vcDNA: vcDNA=SeqID_63323; Strand=-; Position=1 -452,528-735,777-1253
MENYKLIDEWSTICEKFGFTKNITEFRINSDVRRPDEAMRDAIDTMIKAAFKTTEERMKRKVRMFGVAITGAGLASPVWVPYRAYPQNNADVIMQEINKLGQSGDGDENKKTLLLSEPIMMKITCVTLPSGDGPRNVHKFDFGFKEHQRIRISNVDKFCLFYALASSMNYLIMDRFAFNRFMNNIMRQRDAATELLRNCGIDINEYSYGVEHLSRVQNYLDEIYPGKYRVVAFEKSADPRKSIRVLWKGPMGRENVVPIFLENGHWDGLKKYVCFFNRGRKFCVECECFYDQDVYHTMDCRARCYYCNRAGGMPCQKESGVKIECPKCRRYFYNWECYTYHQGHQTCKLWRRCVICDKTYRFNPKKDHECGETYCQLCS

SEQ ID NO: 136901 - protein, 124 aa, Heterodera glycines
  Coding regions on vcDNA: vcDNA=SeqID_63324; Strand=+; Position=1-373
MHTFTGCTRRFALVSSAGCGGKLSSEQFNMTRYPASAHQSATGGAEPVEAVPLPTPAVVATIRGRQHVHGPGGWASLTSRPFGTCHWQPQQLFGAIARRQPDGGCTVGERRVQLPAARPGPDGP

SEQ ID NO: 136902 - protein, 70 aa, Heterodera glycines
  Coding regions on vcDNA: vcDNA=SeqID_63325; Strand=+; Position=1 -12,72-144,370-497
MFARTYHEELTNRFGGDYSHSVLLNKTGVCSFAIRLLQFRKQMDKLKTVQAKDLIFSVGYFFGNSNIFFL

SEQ ID NO: 136903 - protein, 78 aa, Heterodera glycines
  Coding regions on vcDNA: vcDNA=SeqID_63326; Strand=+; Position=1-234
MLLYHWQLQQVEAVRRLLLSAGWCLRSSSVAVGGGQCVRPFATRGGGQKRVSDDEWKTEREQYQKYEQHNQQQQQQPR

SEQ ID NO: 136904 - protein, 66 aa, Heterodera glycines
  Coding regions on vcDNA: vcDNA=SeqID_63327; Strand=+; Position=1-198
ILLYQLQCSETIGNYNKLKQFGDSFLVEASVLLPGHGLEHLQQAAKSVKEFADQLHPLCKLSYVDY

SEQ ID NO: 136905 - protein, 50 aa, Heterodera glycines
  Coding regions on vcDNA: vcDNA=SeqID_63328; Strand=-; Position=1 -132,314-334
MGKRKANQTKRTQFLGFTYLSFYGYMEIATIFPFWLFGPILCFEAFPQKS

SEQ ID NO: 136906 - protein, 32 aa, Heterodera glycines
  Coding regions on vcDNA: vcDNA=SeqID_63329; Strand=+; Position=1 -38,94-154
MARLFHAHRLYEWRLSQRGTAHALFSERKGIA

SEQ ID NO: 136907 - protein, 19 aa, Heterodera glycines
  Coding regions on vcDNA: vcDNA=SeqID_63330; Strand=+; Position=1-58
EDQVGSAGQNFRDRNLFDL

SEQ ID NO: 136908 - protein, 155 aa, Heterodera glycines
  Coding regions on vcDNA: vcDNA=SeqID_63331; Strand=+; Position=1 -125,356-698
  Homolog annotation: Hit_ID=NP_490685.1; Match level="QueryCoverage =58%, HitCoverage=91%, E-value=2e-11, Identity=37%"; Hit description =transposase (1A616) [Caenorhabditis elegans] gb|AAB54166.1| Hypothetical protein F53G12.11 [Caenorhabditi
MDHPFVVQLPNCFFEGRVPTRAARNCGLRIADYGNCGLFGPPVKAKQLLNVTPSPSALETRQKAEVEVNEYLLDPKIKSRADPSLYWEVNSQKWPMIGDVVRKFLSPPATSSESERLFSTAGLISDDLRKSLLPENLAKLLFLHHNLLLTGFSIE

SEQ ID NO: 136909 - protein, 148 aa, Heterodera glycines
  Coding regions on vcDNA: vcDNA=SeqID_63332; Strand=+; Position=1 -188,253-358,623-730,801-845
  Homolog annotation: Hit_ID=AAK08974.1; Match level="QueryCoverage =66%, HitCoverage=37%, E-value=3e-53, Identity=100%"; Hit description= pectinase precursor [Heterodera glycines]
STDYKNTLFVGGSGILNGACDVNNDKLKYLMTLKNGVTIKNAILDTPGLGIYCEGNCVLENIYYKRLCYHATGFGYKSTSTSYTYQVIGGAGQGSPDKANTANCGVHAGIVRSKRLVPYKFPTPSLRGPDFRLSRLIPTTVTKCHFRD

SEQ ID NO: 136910 - protein, 42 aa, Heterodera glycines
  Coding regions on vcDNA: vcDNA=SeqID_63333; Strand=-; Position=1-129
AISLFTPLNTPSKWAPGHPRHVAVCQRQLRFGPGRHKVAGSP

SEQ ID NO: 136911 - protein, 44 aa, Heterodera glycines
  Coding regions on vcDNA: vcDNA=SeqID_63334; Strand=+; Position=1 -107,293-320
MGLDVEHWAQCELLKKAEKVCRRVPNSIHFRGLLMKKYGFTKKI

SEQ ID NO: 136912 - protein, 152 aa, Heterodera glycines
  Coding regions on vcDNA: vcDNA=SeqID_63335; Strand=+; Position=1-9,67- 271,318-419,473-615
MIKKTKEDDNCKKLLCALHCRYNCFGYLKKIVVLFERVCLKYEQRKLEPSFLFELCVESVLPTKNQQQILSSLSLRQLCLLNCLVKLESSGYKQRIDFTYQEIAKGYIKFTNDYEKSMRVCSFVLYRDLDELAASGALSLAKGSDFGQIQFK

SEQ ID NO: 136913 - protein, 18 aa, Heterodera glycines
  Coding regions on vcDNA: vcDNA=SeqID_63336; Strand=+; Position=1-56
YREAILEGFGLPINLGAS

SEQ ID NO: 136914 - protein, 19 aa, Heterodera glycines
  Coding regions on vcDNA: vcDNA=SeqID_63337; Strand=-; Position=1-57
MGDRIPPANGADKEPVTSR

SEQ ID NO: 136915 - protein, 60 aa, Heterodera glycines
  Coding regions on vcDNA: vcDNA=SeqID_63338; Strand=+; Position=1-183
REGFLRALNESGLLLEEPEAIPHTHLNDPNLVWETFPIQHNRADKLDELDLSLEPGKGVC

SEQ ID NO: 136916 - protein, 88 aa, Heterodera glycines; identical to SEQ ID NO: 133373
  Coding regions on vcDNA: vcDNA=SeqID_63339; Strand=+; Position=1 -96,135-305

SEQ ID NO: 136917 - protein, 88 aa, Heterodera glycines; identical to SEQ ID NO: 133373
  Coding regions on vcDNA: vcDNA=SeqID_63340; Strand=+; Position=1 -96,135-305

SEQ ID NO: 136918 - protein, 114 aa, Heterodera glycines
  Coding regions on vcDNA: vcDNA=SeqID_63341; Strand=+; Position=1 -90,524-778
MPFRGPLATNGTELTQQRNHHQQQHQMFMQAIRCPQHQQQHNQQCPPIYSPVQMNEANNENGRETNGNEMRNADGMDRATQRQSDDELLELLRLRRQPTDGDGERRGGGTDGGP

SEQ ID NO: 136919 - protein, 207 aa, Heterodera glycines
  Coding regions on vcDNA: vcDNA=SeqID_63342; Strand=+; Position=1 -85,142-354,406-483,927-1021,1134-1286
MSKEFRRFDDVQLRLRSFDERMSKVGTLDVPPAQIVSSTVRPISAKSTNGDSAVLVPSTTMAPPFVSSTAATSVERHSAESSEEEETDKRHRKGKTPLRGNGGLSISAVWEGVKRMMGFTADCHNVDVFSLSLPGGRLLNDGTCHCVDGWYTGQFCQFYTSSWLIAFGIPLLVIAAIVFCCVICRLDLCALRRPSPPPSSRHNRSSS

SEQ ID NO: 136920 - protein, 156 aa, Heterodera glycines
  Coding regions on vcDNA: vcDNA=SeqID_63343; Strand=+; Position=1 -81,249-638
MKRQKSLAHRRRSQKVSVSTVLQKPLKLPVKQVVIPSSVKKETKIQSLPKETTKSQKPKKESQTQPKSQKKSQKEHQQPQKKSQSPQKESQTPHPPPMEGPSVSALVPNTADCKRRVNFGNVEVFRFEFAQGHDTVPAKGGVSLGIFTFYWILLNN

SEQ ID NO: 136921 - protein, 289 aa, Heterodera glycines
  Coding regions on vcDNA: vcDNA=SeqID_63344; Strand=+; Position=1-868
  Homolog annotation: Hit_ID=AAD25621.1; Match level="QueryCoverage =100%, HitCoverage=24%, E-value=4e-28, Identity=29%"; Hit description= Hypothetical   protein [Arabidopsis thaliana] pir||A96586 hypothetical protein F20D21.24 [imported] - Ara
MLHNTVIEVIYRVCKEMAIRQHKDLLFGGKTVIFSGDFKQSLPVVPHEGLTAQVTACFQTSPLFGQFTTMKLTINQRLGKGQQAYLQMCRQIGLGETGEHFWIPRQFLVKSKEELIDYVYPNFQQLLGNDKELLNRLILAPHIDTCDEVNDIMMANVPGHMREYLSTDKPLDDRPLDIDEIESEVAALNRRTDSGMPPHSLRLKVGCVVVLLINKSDKEGLINGTRIVLEELGDDRLIGRVINSNAIGGQVKFFLERTRNVYEDKSPGGIKYERLQFPIKPAFAMTIQK

SEQ ID NO: 136922 - protein, 266 aa, Heterodera glycines
  Coding regions on vcDNA: vcDNA=SeqID_63345; Strand=-; Position=1-802
  Homolog annotation: Hit_ID=XP_345024.1; Match level="QueryCoverage =96%, HitCoverage=88%, E-value=4e-32, Identity=28%"; Hit description =similar to SPAC23A1.17 [Rattus norvegicus]
HQHFNHWGLNPPAFQSLGLNPPAFQSLGLNPPAFQSLGLNPPAFQSLGTQPTSISITGELNSPAFQSLGLNPPAFQSLGLKPPAFQSLGLNPPAFQSLGLNPPAFQSLGLNPTAFQSLGLNPPAFQSLGLNPPAFQSLGLKPPAFQSLGLNPPAFQSLGLNPPAFQSLGLNPTAFQSLGLNPPAFQSLGLNPPAFQSLGLNPPAFQSLGLNPPAFQSLGLNPPAFQSLGLKPPAFQSLGLNPPAFQSLGLNPPAFQSLGLNPPAFQ

SEQ ID NO: 136923 - protein, 112 aa, Heterodera glycines
  Coding regions on vcDNA: vcDNA=SeqID_63346; Strand=-; Position=1-336
  Homolog annotation: Hit_ID=EAL47341.1; Match level="QueryCoverage =97%, HitCoverage=24%, E-value=3e-11, Identity=40%"; Hit description =actin, putative [Entamoeba histolytica HM-1:IMSS]
MYKKEYRLAEIDRQIQLIIDAKAKIQEEEEEEQIKERRAYSEKIKRERKRKEKEQMEAKSEAKRKEAEEKAKENAKAEKEEWKRALRRPAATPEEKARKEAENEARKEAEEA

SEQ ID NO: 136924 - protein, 171 aa, Heterodera glycines
  misc_feature (15)..(15): Xaa can be any naturally occurring amino acid
  misc_feature (162)..(162): Xaa can be any naturally occurring amino acid
  misc_feature (165)..(165): Xaa can be any naturally occurring amino acid
  Coding regions on vcDNA: vcDNA=SeqID_63347; Strand=+; Position=1 -206,290-543,899-940
  Homolog annotation: Hit_ID=CAE73114.1; Match level="QueryCoverage =87%, HitCoverage=15%, E-value=4e-32, Identity=53%"; Hit description =Hypothetical protein CBG20495 [Caenorhabditis briggsae]
VFLTNILFLKSHYSXLSLQAISSLVKAAYQVAVDSGVASVDEKGTPQTFILSTVYPNMVQELIKTSDRTDSNATDSNANNLRISAYEALMELIKNSPADCYPVVQQTTMVILGKLESLLSIEDALVSSNERSQLRDLQSQLCATLQSVLHKIKAEVMPPIVXHLXIGLESL

SEQ ID NO: 136925 - protein, 16 aa, Heterodera glycines
  Coding regions on vcDNA: vcDNA=SeqID_63348; Strand=-; Position=1-49
EAIPEGFGLPINLGAS

SEQ ID NO: 136926 - protein, 54 aa, Heterodera glycines
  Coding regions on vcDNA: vcDNA=SeqID_63349; Strand=+; Position=1-163
LSHQNADDDEQQQKVTLGVERFALPELLIRPGDVEVQQMGIPEALCAAIERLPK

SEQ ID NO: 136927 - protein, 636 aa, Heterodera glycines
  Coding regions on vcDNA: vcDNA=SeqID_63350; Strand=-; Position=1 -136,266-585,637-837,1201-1330,1382-1471,1756-1807,1976-2195,2290-3050
  Homolog annotation: Hit_ID=A89221; Match level="QueryCoverage=61%, HitCoverage=52%, E-value=1e-102, Identity=45%"; Hit description =protein T27F2.2 [imported] - Caenorhabditis elegans
ILDFLGTRVRLKGFESYKGGLDTRGDTTGLYSIYTEHHSAQIMFHVTIIFQEPDALPFSPITVRSHFQHVFIVIRACNPLTEGVTYRVAVSRAKDVPTFGPPIPASATFQVVPTNKTNKVSHSYAFKFSQKSAEFHDFLITKIINAENAVHRSRKFASMAARTRREALKDLVENYAGTAHSNEGASRIASRLLGGSVKRKERVVPRPVLDAAVRAALSCVKIFFDHGDLLLLWCASPDGSERELGLLLKRLASVTNGEEAKEVILHKNKALGESFGFHVQEEGIVTDVDMNKLTMIAPASDGNPRRGCEDPNCPAVRGLECQQLLSPDSFARQPLAYQQMFALRDQQRRVGSKLSSNLSGDSWGNSTPSPTSLTAVTERKKYSAMRPLTPSKHGAAPIGHSTRHSRGRVNNSHRWDCLNQLAIPFYSSPQNQSACSSASTFSRARSDDVATKPPAPSASAKVSVSNLAMSLEESLLSSNSAPFVQSTSFCDGIALPSTTKTAATLFAETNSGREQQQRRRVSTDGELSRYQWCLQKVVAEKRELEAELEHCRNQLVAVSPPKTVDDHQITLPNSGTACPREHEAATPHAHGVLRTLLNCPTSVRGGGRGIVIKKKACPSPGPSNLLTFVLPCTIFY

SEQ ID NO: 136928 - protein, 46 aa, Heterodera glycines
  Coding regions on vcDNA: vcDNA=SeqID_63351; Strand=+; Position=1-138
MGGRGEHGQPGGYGEEDERVGGQTEHGRCTLAGGMVKHVDLPKGGR

SEQ ID NO: 136929 - protein, 302 aa, Heterodera glycines
  Coding regions on vcDNA: vcDNA=SeqID_63352; Strand=-; Position=1 -45,94-280,632-1009,1070-1369
  Homolog annotation: Hit_ID=CAE75323.1; Match level="QueryCoverage =61%, HitCoverage=15%, E-value=1e-29, Identity=44%"; Hit description =Hypothetical protein CBG23298 [Caenorhabditis briggsae]
HKCFTKAVKEAANEPKKRTKSAEFGGSESQKRSEGSGNIAGHWPSFGHPNSKQMIPPVAVPSADVEHSKIAQTTNAKSNVCAELAIDVTAADAPQQHRNLPPLPPHPPPPSSASANSSAAVVSSSNLLQCSLSQPTIHDSVVVGGAFASSISSGNGGQLAHSEWHPTSAHLCAYHDCRSLAYAWGLGTSTSSLETTRPTGASQAQSPSEDDPGDGKCNDLLANCPAFRNELGEEPIRRIALSRQTFPTTSSGQCQQHNVKQQHHTNGRRRTPPEELAETWHREHMAAEVPAEDRSIVMYVSF

SEQ ID NO: 136930 - protein, 439 aa, Heterodera glycines
  Coding regions on vcDNA: vcDNA=SeqID_63353; Strand=-; Position=1 -31,89-209,263-281,341-436,505-559,1751-1785,1832-2022,2079-2164,2226- 2496,2594-2685,2780-2878,3035-3086,3134-3171,3255-3389
  Homolog annotation: Hit_ID=CAE66320.1; Match level="QueryCoverage =74%, HitCoverage=95%, E-value=3e-86, Identity=48%"; Hit description =Hypothetical protein CBG11571 [Caenorhabditis briggsae]
ILDVKDSDYELVIKIEELFEEYNLFDRAIVCSFFPWIIYWIKRRNSHILTGFTFRRRNISYTDLKMTIPRFSSPFYHCSAVALDALYRWSIKVCLPHFLGVDMLLIERPDATNVNNWHWVEKNATPWSRERLRVLLLGQTLEKGPVRIEFSDFKKLEGEATANNRKAKLIFFFEWSIDVNFIATVSGSETEYKGSVEILNLSDENEAHEIEISVHIETAGPHENEIRHILSTDGLSFVRSKVGTYVRELKEEFSKGIILPVDSKGAIRPQAVATQGKTVVDKKRFQNDIIQKTEEKVTTAETQNALKTGGFELTETFKVPPERLFEILTASELVSVWSPNSSIDAREGGQFSLLGGVMSGHFTKLANAALISMAWRLKSYPSGHFADVTFTLKDKGDSTDLELKADQVPEQLIEDTKTGFSRYYFQNIGKKFGISLNLF

SEQ ID NO: 136931 - protein, 138 aa, Heterodera glycines
  Coding regions on vcDNA: vcDNA=SeqID_63354; Strand=-; Position=1 -57,341-506,550-603,662-714
  Homolog annotation: Hit_ID=NP_510569.1; Match level="QueryCoverage =87%, HitCoverage=22%, E-value=2e-47, Identity=73%"; Hit description =nadh dehydrogenase, General Anaesthetic Sensitivity abnormal GAS-1 (54.6 kD) (gas-1) [Caenorhabditis eleg
GEVKIDDHKVVPPNRAEMKDSMESLIHHFKFFTEGYQVPPGAVYVPTEAPKGEFGVYLVADGTSKPYRCYIRAPGFAHLSKIHDISYMFAHLSKIHDISYMHLIPDIVAIIGTLDLVFGEVIVAIIGTLDLVFGEVDR

SEQ ID NO: 136932 - protein, 76 aa, Heterodera glycines
  Coding regions on vcDNA: vcDNA=SeqID_63355; Strand=-; Position=1 -55,99-271
MALGELRKYVNHLELFADDRQKIFFKIDIDISSVPESTPEARPALRGWFVLPLILLALVQFMRPMDFYASNQLTIP

SEQ ID NO: 136933 - protein, 23 aa, Heterodera glycines
  Coding regions on vcDNA: vcDNA=SeqID_63356; Strand=+; Position=1-95
IKLLTKFVNRSDKMKWTYKEENS

SEQ ID NO: 136934 - protein, 278 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (133)..(133): Xaa can be any naturally occurring amino acid
  misc_feature (149)..(149): Xaa can be any naturally occurring amino acid
  misc_feature (215)..(215): Xaa can be any naturally occurring amino acid
  misc_feature (272)..(272): Xaa can be any naturally occurring amino acid
  Coding regions on vcDNA: vcDNA=SeqID_63357; Strand=+; Position=1-852
  Homolog annotation: Hit_ID=BAB33421.1; Match level="QueryCoverage =96%, HitCoverage=96%, E-value=9e-87, Identity=67%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNPTLGEFCFAMIGRADIEGKSDVAMDAWPPQASYPCGNFSDTSCWKLYTLKDRXATLSRSVFVLKIRIKXAFAFLLYERFPSSLSALGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 136935 - protein, 77 aa, Heterodera glycines
  Coding regions on vcDNA: vcDNA=SeqID_63358; Strand=-; Position=1 -38,257-332,513-632
MGFSGRVWTTHHQIKAIFQYSNLSHKTRVERYRYRYRPHLFICISGQVAKASYFIISRLGSIPHWDRIFFIFSLPLF

SEQ ID NO: 136936 - protein, 83 aa, Heterodera glycines
  Coding regions on vcDNA: vcDNA=SeqID_63359; Strand=-; Position=1-252
MIASTLEQFNSLDDQELDRRILNAGLPIGLGEEQTAKGETSQEEMEILYQQLMGEEKKKFTELADGIFHDELANQMNCFVKKK

SEQ ID NO: 136937 - protein, 23 aa, Heterodera glycines
  Coding regions on vcDNA: vcDNA=SeqID_63360; Strand=+; Position=1-72
HSQTSEYDGRGRGMYSFHQQDVK

SEQ ID NO: 136938 - protein, 224 aa, Heterodera glycines
  Coding regions on vcDNA: vcDNA=SeqID_63361; Strand=+; Position=1-6,58- 726
MQWILTIIWRMMSKCRRIWTLTINNRRPGPQQQKRESNARHKQRKPQPKPTGTSMLLGTVHFARPISSYNVVLHSCGNNWLSILSGGGPMHVTEFLPQSPRRDNIFMALELLAKLQSFAVADLLSADQIADFRATADQFRVHMLEHLRRHCSTSKFHHLVHHAPEFAENHGFWCLLSEQPVEKFHALFNDDLARKANTKDLHDILMFCARESAIRNAIFDSNEL

SEQ ID NO: 136939 - protein, 81 aa, Heterodera glycines
  Coding regions on vcDNA: vcDNA=SeqID_63362; Strand=+; Position=1 -151,435-526
MSRNIAHSATLNNGVFLSRDIEQLRMSMSSVEDEGSDGRADEMAKLQKWLCDGARLTPALRCHDGRLPAAADTRQDSPPRH

SEQ ID NO: 136940 - protein, 135 aa, Heterodera glycines
  Coding regions on vcDNA: vcDNA=SeqID_63363; Strand=-; Position=1 -105,344-489,608-767
  Homolog annotation: Hit_ID=NP_506170.2; Match level="QueryCoverage =94%, HitCoverage=28%, E-value=1e-34, Identity=59%"; Hit description =putative nuclear protein of eukaryotic origin (47.8 kD) (5N183) [Caenorhabditis elegans] emb|CAA99907.2|
KFHCSFRELDDGIAEAVSSLLWVAPRIGHEIAEFKVINDELTHKYGKQFAEAARMNQLPEPSRVSPKLVQKLSVSAPSKLLVEKYLVTIAQSAGVDFAPDAKVMREDDDEIARAERNLINFMNGVMPWGGDGPLN

SEQ ID NO: 136941 - protein, 163 aa, Heterodera glycines
  Coding regions on vcDNA: vcDNA=SeqID_63364; Strand=+; Position=1-491
MKFAKKMLMIPEAEYLALRSAMNSGDYLQNEKASLDAKISQNLQDPGISEYLKAKRHDWLYKERRTVKGILENRPQKVVIENHVPGPNVAPYLGLNNQSKPQETEEPRKIIIPRKRLKERTPDPESNNDTLEELTPEPQTTSTHKTPVPIKTIIHPTLLNGLF

SEQ ID NO: 136942 - protein, 116 aa, Heterodera glycines
  Coding regions on vcDNA: vcDNA=SeqID_63365; Strand=+; Position=1 -94,149-405
MSGCTNAHNMGCDIHTNPMTELSICDEPASDESVNSKFSNRLMKSSEFSTFGFDLGDFLQAMMTLLHSILTSSYPDPAGFSLDSVPSITISTPTLVYPSRFEATFELSMLNASNDS

SEQ ID NO: 136943 - protein, 411 aa, Heterodera glycines
  Coding regions on vcDNA: vcDNA=SeqID_63366; Strand=+; Position=1 -128,187-302,356-737,797-916,2060-2197,2249-2340,2522-2781
  Homolog annotation: Hit_ID=NP_505985.1; Match level="QueryCoverage =60%, HitCoverage=24%, E-value=2e-72, Identity=58%"; Hit description =alpha-catenin, embryonic body elongation factor, HuMPback, dorsal lumps, defective body elongation in emb
GTQPADSSSQASASDMENQQQIMRQLPEESKREIQKQIDVFKITQRKFEYEVGKWDETGNDIIALAKKMCQIMMNMTDFTKGRGPYKTTMDVIKAAQEISENGGKLNELARQIGNESVESNTKKDLCAYLERVTLFCHQLNVTSKVLNRTISFATHPLLVQVKADIQVVGDELRVSGLEAATSLIQNAKNLLNAVILTVKSAYIASTKYRRKENTNPNVVEWRMVAPQKQPLVSASATKAHGVIRRASIYNLLGMLSSFPLLLSLVGLIAVHAEVFFKEEFSDDSWTDRWVTSKSKDDSGKFDLSAGKLFGDKVRDQDAMGNQRRAFTKQGWPQKFDDIKLSPFLPKRAQIPEIEGCLAYGERIIIPSSLRNNILKSLRFAHPGIVRMKAIARNHVYLPGIDSEIERVVKQ

SEQ ID NO: 136944 - protein, 223 aa, Heterodera glycines
  Coding regions on vcDNA: vcDNA=SeqID_63367; Strand=-; Position=1 -25,227-873
MPSSCCVPMPISAKERFPANEIGKEKSVEAVKDPFEKESKASRDEPFLSSKYATAPGGSAVLPPVIYPTSAALRQSFVPQQQSPSAYNFQPPFQQQQFQQPQQQQDRFPFPSQSYGQCQCPQIQSSRPFATPQMPVQNCCIGRSQRQCRLGMERKKVFGLRTLLDKGTEKGKRDGEKGKCDAKLGKIMEEVINGGRRHGNQLRRPNEINPFRIRTWKWQRQKK

SEQ ID NO: 136945 - protein, 94 aa, Heterodera glycines
  Coding regions on vcDNA: vcDNA=SeqID_63368; Strand=-; Position=1-577
IIFIQKIFFWVFGAVPLNRCAQIYGETESFRNSFTIACTLILRWIFAPHNCLSTPNGHLKKSIYFCFRGSPPEPMRPDLWGDSNPSGIASSIAL

SEQ ID NO: 136946 - protein, 109 aa, Heterodera glycines
  Coding regions on vcDNA: vcDNA=SeqID_63369; Strand=+; Position=1 -135,202-319,423-499
  Homolog annotation: Hit_ID=NP_499400.1; Match level="QueryCoverage =94%, HitCoverage=18%, E-value=3e-27, Identity=61%"; Hit description =cuticlin protein family member (3M5) [Caenorhabditis elegans] pir||T23760 hypothetical protein M142.2 - C
MQLEFVALLARRLNISSDGTHLAVIQFAESAQLEITLNQYACESQLEWAIQRIRYLGGATNTGKALNFALENGYQNARGGIVPKVAIVVTDGQSQDEVEETGHIFLFFI

SEQ ID NO: 136947 - protein, 149 aa, Heterodera glycines
  Coding regions on vcDNA: vcDNA=SeqID_63370; Strand=-; Position=1 -134,365-494,540-725
MEEAKSNFNILWTNVRLRLIMAKSTKEIVDKYTQKENNEMEKRKGLLPPLSVPKCPSPQLTLGKWTLWGYECGDFPVHINAKEQCPFCLVLCKFRILFKNAVFEGKDRWENYLRKGQSFVGNSHALPTENELGDLLPSKLATEICEFRC

SEQ ID NO: 136948 - protein, 79 aa, Heterodera glycines
  Coding regions on vcDNA: vcDNA=SeqID_63371; Strand=-; Position=1 -127,2239-2348
MLVISGWQTLVQGRQDGEESVWSTDRCPPPRSGSSQATRDQPATLGTIISTINSEQAMRLPLEFGTGSPAPSTLTWPTT

SEQ ID NO: 136949 - protein, 44 aa, Heterodera glycines
  Coding regions on vcDNA: vcDNA=SeqID_63372; Strand=-; Position=1-189
CNFIKNGKNLNLIGNVPPLRRSIQKIFVCLHSILIHFSHKNVLI

SEQ ID NO: 136950 - protein, 26 aa, Heterodera glycines
  Coding regions on vcDNA: vcDNA=SeqID_63373; Strand=+; Position=1-79
REKKIMFFSGTLYLLVHISFFETVCL

SEQ ID NO: 136951 - protein, 177 aa, Heterodera glycines
  Coding regions on vcDNA: vcDNA=SeqID_63374; Strand=-; Position=1-534
  Homolog annotation: Hit_ID=AAS38609.1; Match level="QueryCoverage =99%, HitCoverage=32%, E-value=2e-19, Identity=30%"; Hit description =hypothetical protein [Dictyostelium discoideum]
MEEEQKEKAEEEQKGEQKVEEKWKRKWKRKWKRNGRGTERESGRGTERGTESGREMEEEQKEKAEEEQKGEEEVEEEQKGEQEEEQKEEEKWKRKWKRKWKRKWKRNGRGTERESGRGTERGTESGREMEEKVEEKWKRNRKRKRKRNRKGNRKWKRNGRGTERESGRGTERGTEEG

SEQ ID NO: 136952 - protein, 77 aa, Heterodera glycines
  Coding regions on vcDNA: vcDNA=SeqID_63375; Strand=-; Position=1-230
VASVCDGFASPCGPTTDQNGKKRMIKTHKIHSSAIYYFRPYFCTENEGVENLLVFSEKFKSKKLRQNAVPSVPNSSA

SEQ ID NO: 136953 - protein, 137 aa, Heterodera glycines
  Coding regions on vcDNA: vcDNA=SeqID_63376; Strand=-; Position=1 -185,231-352,438-543
FFITPRASSIGTSNKANKVRSKSTPRRRPRFKVIGNGNCAQSRQMIIDAGQKKIGLEQCIKCGMVYSLNDPKDVEQHAKFHHRFTETRSFQVSISQLSAWKEVLFTEHVEIPIGGCLFLVDAFSTSTLRRKMESVIS

SEQ ID NO: 136954 - protein, 26 aa, Heterodera glycines
  Coding regions on vcDNA: vcDNA=SeqID_63377; Strand=+; Position=1-121
GDHSQRNVPGTNSVISMPGLTGSHKH

SEQ ID NO: 136955 - protein, 33 aa, Heterodera glycines
  Coding regions on vcDNA: vcDNA=SeqID_63378; Strand=+; Position=1-5,88- 184
MKKSKLPALLKQLFSCPNKTNMQIPRIPSPELY

SEQ ID NO: 136956 - protein, 169 aa, Heterodera glycines
  Coding regions on vcDNA: vcDNA=SeqID_63379; Strand=+; Position=1 -159,433-609,972-1071,1219-1289
  Homolog annotation: Hit_ID=AAO85459.1; Match level="QueryCoverage =68%, HitCoverage=59%, E-value=1e-29, Identity=51%"; Hit description =putative gland protein G20E03 [Heterodera glycines]
MSGIQTLVCVQQRELDQALDQALDQALDQALDQALDQALDQELDQALDQELDRCDLITCPAGRTCGILIGFARLGTGPFEPFLYPKCVSNPLELTRNTEQNGNEKILTNGPGCNCGTTQCAAGFQCQVRSSIVRLGNRPFAQIIGGFPQCVGNYSIYQNPFTIVPYGPG

SEQ ID NO: 136957 - protein, 79 aa, Heterodera glycines
  Coding regions on vcDNA: vcDNA=SeqID_63380; Strand=+; Position=1 -100,247-317,440-508
  Homolog annotation: Hit_ID=AAO85459.1; Match level="QueryCoverage =97%, HitCoverage=40%, E-value=5e-18, Identity=56%"; Hit description =putative gland protein G20E03 [Heterodera glycines]
CNCGTTQCAAGFQCQVRSSIVKLGNRPFAQIIGGFPQCVGNYSIYQNPFTIVPYGPGCAEIPACLEGITCVTAVGIAKY

SEQ ID NO: 136958 - protein, 85 aa, Heterodera glycines
  Coding regions on vcDNA: vcDNA=SeqID_63381; Strand=-; Position=1 -7,263-337,399-574
MKSKLSSILHNHPDKEGTLSKKEVFSNEFQPPFKIGNLSDAKNVEKLEKKGFIVDILPKSDGNRAGVMNELKNMKLKPTKQISIF

SEQ ID NO: 136959 - protein, 120 aa, Heterodera glycines
  misc_feature (33)..(33): Xaa can be any naturally occurring amino acid
  misc_feature (37)..(37): Xaa can be any naturally occurring amino acid
  Coding regions on vcDNA: vcDNA=SeqID_63382; Strand=-; Position=1 -100,576-840
  Homolog annotation: Hit_ID=NP_640928.1; Match level="QueryCoverage =83%, HitCoverage=30%, E-value=6e-37, Identity=71%"; Hit description =arabinogalactan endo-1,4-beta-galactosidase [Xanthomonas axonopodis pv. citri str. 306] gb|AAM35464.1| ar
LDQKNQSVRGNKRQNQNCFEVRQFKDINGSYIXIRLXVNPSGGWCDGADTLHKAQRAKAQGMAIMIDFHYSDSWADPGQQNIPAAWKSHSLAQLNTDVYEHTYGILNYLKSNGISVAWVQ

SEQ ID NO: 136960 - protein, 95 aa, Heterodera glycines; identical to SEQ ID NO: 130684
  Coding regions on vcDNA: vcDNA=SeqID_63383; Strand=-; Position=1-677

SEQ ID NO: 136961 - protein, 82 aa, Heterodera glycines
  Coding regions on vcDNA: vcDNA=SeqID_63384; Strand=+; Position=1 -54,579-772
  Homolog annotation: Hit_ID=CAE70835.1; Match level="QueryCoverage =78%, HitCoverage=15%, E-value=2e-18, Identity=62%"; Hit description =Hypothetical protein CBG17615 [Caenorhabditis briggsae]
MSMSKSSYTYNRKTFEDANVDRALEQTDGTVPYGELAKLTDAGTNEMLRKLARNQPYYNRNLPHICSFFVKGECTRGEECPY

SEQ ID NO: 136962 - protein, 128 aa, Heterodera glycines
  Coding regions on vcDNA: vcDNA=SeqID_63385; Strand=-; Position=1 -129,201-458
MSSQQRQAERAQLRARLNLLVDDVDFVVQGLINNYQADGLINAAPDDGQLMVMDHGQGLQHEQQQQPWELDPPLPEQHLEIDPQLPDAWELVPYQPTPQWDQVVHVEQQPQQQQHYHHQQQQQQQGVG

SEQ ID NO: 136963 - protein, 231 aa, Heterodera glycines
  Coding regions on vcDNA: vcDNA=SeqID_63386; Strand=+; Position=1 -159,212-746
  Homolog annotation: Hit_ID=XP_320889.1; Match level="QueryCoverage =76%, HitCoverage=24%, E-value=2e-18, Identity=28%"; Hit description =ENSANGP00000012033 [Anopheles gambiae] ref|XP_313651.1| ENSANGP00000013044 [Anopheles gambiae] ref|XP_314
MAEAAIRQLSDVFQQFLTAQQANVAAPAQPIPMQIWQISTVLVLVTMAKATSRDDLKVKLLLTKLSETAYAEYSKHCLLKKPTEFDFAKTSEMLKSLFAKQKSVWINRYECLKAEKQDEEEFRGFINRHKRLLSDFEFKKLNEEQFNCLMLLVALKSPKDAELRKRILSKLAADGDRATYENVVNDLQMFLSTISEAKAMERPSNSNILAVKRRQQPKKDNFGEKGKKQQS

SEQ ID NO: 136964 - protein, 226 aa, Heterodera glycines
  Coding regions on vcDNA: vcDNA=SeqID_63387; Strand=-; Position=1-678
MDGTAQPSSFIVEEEMLESVADEMAGKEGHVEFTGETSGKEEVQQQHLVLLKSPEPAEGGGGSSATMATSRQIGTNEAFDRPADAALLFEDIDDKDVTYAPEIQSLEVPPDQLSQADSLNLVDEEQFSEEHQRVIVTDGEDEVPPKEAEKQRERHEPEKLEEQEAGEAPQRELTPHEEENLQRIIDRLRRTPSPRPHRMDQAQVPQAPQFLRSYFNDESTSSLSST

SEQ ID NO: 136965 - protein, 150 aa, Heterodera glycines
  Coding regions on vcDNA: vcDNA=SeqID_63388; Strand=-; Position=1 -69,112-187,257-366,418-616
  Homolog annotation: Hit_ID=CAG08516.1; Match level="QueryCoverage =88%, HitCoverage=10%, E-value=4e-13, Identity=36%"; Hit description =unnamed protein product [Tetraodon nigroviridis]
VRTAFLFGKNNVLAFSGDREAPGYLSLHHDQNRMLILKWIPNSLLLSKPGGSTTNAVKSPSHSSHCVPVSIKFETVSHLHLHKNEGTLSSSIVLIDSDGVQQFCFSFSLEQHCFSFLKTLEGALFPLFKIDPPLNSIKIECGATGRPLMG

SEQ ID NO: 136966 - protein, 111 aa, Heterodera glycines
  Coding regions on vcDNA: vcDNA=SeqID_63389; Strand=-; Position=1 -175,229-388
AMQFKKYAKPAEIVRFVENGMTALVLDYRENQTETIEYKSTHGTIKVVHISRRDIMPGSLLHSLFKALDISVRPLLENISHVDLVALLGDPNDITDEKGTKTTILMEALTT

SEQ ID NO: 136967 - protein, 146 aa, Heterodera glycines
  Coding regions on vcDNA: vcDNA=SeqID_63390; Strand=+; Position=1 -69,118-204,249-425
  Homolog annotation: Hit_ID=AAA61195.1; Match level="QueryCoverage =100%, HitCoverage=24%, E-value=3e-35, Identity=53%"; Hit description= transducin-like enhancer protein
IFSLGCCPNDEWVAVGMENNNVEVLHMNRQDKYVLDDHQSCVVLHMNRQDKYVLDDHQSCVLSLKFANSGKWFVSTGKDYVVNCWRTWFVSTGKDYVVNCWRTPYGYRLLKSKENSSVLSCDISHDDRFLVTGSGDKKASLYELSF

SEQ ID NO: 136968 - protein, 250 aa, Heterodera glycines
  Coding regions on vcDNA: vcDNA=SeqID_63391; Strand=-; Position=1 -198,684-1025,1274-1486
AIGRLLPLAFSSALNSLTISQCQLNKAIGKVVERACEAIDGLREVRSDDAIPPFEIDILRKHAQFWFLDSFLSDLLSVHSSIVSRQGDPGPVLQLFRLLLNDRQLQEIEENPDGYFEFTALCELPIKVKWNDFSFRCHQIFLKLSVGKGRPKVKTLAVSVLGSLLQLNKQSQMYRRVLRLLISLLDSPYASLREQAAEQLFEFFSCESDDSEHGTEMALKLLTETDWGRGREGLGENRRRISAILLANAR

SEQ ID NO: 136969 - protein, 103 aa, Heterodera glycines
  Coding regions on vcDNA: vcDNA=SeqID_63392; Strand=+; Position=1-312
MTGGAVPPKPCRGPTIPMAQTRKPLDSNWTTFAHRRTNPPATNTTKAVPQAKTIRNLTYLRICISSRLSLDCWPVVKCAIWPITVWAATRITAKNGKRKITEF

SEQ ID NO: 136970 - protein, 259 aa, Heterodera glycines
  misc_feature (246)..(246): Xaa can be any naturally occurring amino acid
  Coding regions on vcDNA: vcDNA=SeqID_63393; Strand=-; Position=1 -28,127-293,346-575,644-935
  Homolog annotation: Hit_ID=CAE66142.1; Match level="QueryCoverage =92%, HitCoverage=20%, E-value=3e-47, Identity=43%"; Hit description =Hypothetical protein CBG11371 [Caenorhabditis briggsae]
GNRVPADCRILHILHCSELKLESSSITGESEPIEYQAEEVAESVSVFEARNVAFNGSLCVEGDAIAIVIRVAAQTVIIRVAAQTVIGQIAHLTTGQQSNESRLEMQIRKYVKFLIVLACGTAFVVFVAGGFVRRWANVVQLLSNGFLVCAIGMVPCGLPATVTSVPCGLPATVTSILTVIARRLASRNVYVKRLDICEALGQVAIIASDKTGTLTKNEMHVTALWHCNKFISGQIEGEGVRSIREXLENGKKKYELRNS

SEQ ID NO: 136971 - protein, 231 aa, Heterodera glycines
  Coding regions on vcDNA: vcDNA=SeqID_63394; Strand=-; Position=1 -233,263-725
  Homolog annotation: Hit_ID=EAA21475.1; Match level="QueryCoverage =90%, HitCoverage=13%, E-value=1e-12, Identity=22%"; Hit description =hypothetical protein [Plasmodium yoelii yoelii]
MYKFVHCLFMEMYKFVHCLFMEMYKFVHCLFMEMYKFVHCLFMEMYKFVHCLFMEMYKFVHCLFMEMYKFVHCLFMEINVQIRPLSIYGNVQIRPLSIYRNVQIRPLSIYGNVQIRPLSIYGNVQIRPLSIYGNVQIRPLSIYGNVQIRPLSIYGNVQIRPLSIYGNVQIRPLSIYGNVQIRPLSIYGNVQIRPLSIYGNVQIRPLSIYINVQIRPLSIHTVRKNEMCTNK

SEQ ID NO: 136972 - protein, 140 aa, Heterodera glycines
  Coding regions on vcDNA: vcDNA=SeqID_63395; Strand=-; Position=1 -83,162-259,857-1095
MSGGWQLEQLLSAFQIISAQRGGTNENGIFPFQIIRIDAQTKKHFWDEIKANSAREPQFIENFNFLLKLGEFTLSYYEVYKVLEAILMRWSNTEKSSADNNGEQPPELYTFMEQYFNSKLNSQILQKKDKKQIGSSSKRR

SEQ ID NO: 136973 - protein, 22 aa, Heterodera glycines
  Coding regions on vcDNA: vcDNA=SeqID_63396; Strand=+; Position=1-68
MVEDKSLVGTVKYDGAKQCFYD

SEQ ID NO: 136974 - protein, 127 aa, Heterodera glycines
  Coding regions on vcDNA: vcDNA=SeqID_63397; Strand=-; Position=1 -57,281-604
  Homolog annotation: Hit_ID=AAH82521.1; Match level="QueryCoverage =98%, HitCoverage=57%, E-value=2e-37, Identity=63%"; Hit description =MGC79546 protein [Xenopus tropicalis] gb|AAH76657.1| MGC79546 protein [Xenopus tropicalis] ref|NP_00100500
MSEKKIIADIKKMAKMGQMFIMMRANIQAVSLKVQTLKSQDSMAQVLPLGLKIGMIRLINFKAMKGVTRAMRSMNKQLNLPQIQKIMNEFEKQSEIMDMKEEMMDDAIDEAMGDADEEEETDKVVQQ

SEQ ID NO: 136975 - protein, 82 aa, Heterodera glycines
  Coding regions on vcDNA: vcDNA=SeqID_63398; Strand=-; Position=1 -172,477-553
MELEEGEYVEEEELFTRNQRQKNKFQLNREHLNSSVLKRRREEDDYETVSMELESDPGSNEESEEANNERTRLRNAKRNGGK

SEQ ID NO: 136976 - protein, 163 aa, Heterodera glycines
  Coding regions on vcDNA: vcDNA=SeqID_63399; Strand=-; Position=1 -315,396-572
  Homolog annotation: Hit_ID=NP_508294.1; Match level="QueryCoverage =67%, HitCoverage=11%, E-value=9e-11, Identity=29%"; Hit description =predicted CDS, endonuclease/exonuclease/phosphatase family and RNA -directed DNA polymerase (XC178) [Caeno
MVVMKKLNYLLTYLQIRLTILRLTQAAINWGNTFANQCFISDIDFNIIETQKLLKKLPNKNGTSPDDISYKTLKNCHSSLATVITDLFRISLDSGSLPDIWKESIVMERILSQNIYNFLLKNNKISEYQFGFVRNRSTTSQLIAVVEDWYEAIIKWKKCDRSC

SEQ ID NO: 136977 - protein, 111 aa, Heterodera glycines
  Coding regions on vcDNA: vcDNA=SeqID_63400; Strand=-; Position=1-333
MPIVKPWFLPYVSTRTISNATKLIEVVRIFNHISMELSERLTNKYYFYQLNLLNEDKLSNYKANFGNLNAIRKRFDEKLKIMFKNEREIEEGYTNDSNYLQSSPFYDKIIK

SEQ ID NO: 136978 - protein, 105 aa, Heterodera glycines
  Coding regions on vcDNA: vcDNA=SeqID_63401; Strand=+; Position=1 -88,191-420
MFRSHSHSVLLNILLNYTSSIEAKIAYSLDCRKPFLWHSVFPQKILPNSTLDGHHFPFRYRFPSVPCPVGNKSAELICVDGGKWRAIGCQEEGDENENYGKTVKH

SEQ ID NO: 136979 - protein, 189 aa, Heterodera glycines
  Coding regions on vcDNA: vcDNA=SeqID_63402; Strand=-; Position=1-567
MKILLILLCALIFENTINQIEAGKINQEKSFAEIFGQRWDERTEENMYRIGPIIYEENADQNNQFGQNDQHIDQIVDESLEVKEEQSEEMSTDCDELGGQLPMSTNIGQICEDFSKAIDKKKREIVEKFQKIKEKVKQMEKKYSTKEWQKIERKIAKKLGTNQKKIYEWKTEFGMIKKHYYTDDEKYKK

SEQ ID NO: 136980 - protein, 96 aa, Heterodera glycines
  Coding regions on vcDNA: vcDNA=SeqID_63403; Strand=-; Position=1 -41,379-490,783-920
  Homolog annotation: Hit_ID=NP_741797.1; Match level="QueryCoverage =79%, HitCoverage=15%, E-value=7e-27, Identity=80%"; Hit description =MEChanosensory abnormality MEC-2, stomatin-like protein required for mechanosensation (51.9 kD) (mec-2) [
MLLSIFVFQMRPFRPWGVKVERVEMKDVRLPVQLQRAMAAEAEATREAGAKIIAAEGEQKASKALSEAAHTVAQSPVAIQLRFLQTLTSIRQKAWK

SEQ ID NO: 136981 - protein, 86 aa, Heterodera glycines
  Coding regions on vcDNA: vcDNA=SeqID_63404; Strand=-; Position=1 -105,792-947
MPAESPHKAIANCLRAQPALFFASVDGIPWHKIICRTFEFEKRESVVNFDQQQQTRPSSFCNTTDDGDDIALDTTPTPFPSITGIF

SEQ ID NO: 136982 - protein, 34 aa, Heterodera glycines
  Coding regions on vcDNA: vcDNA=SeqID_63405; Strand=+; Position=1-105
PNFVEFMKDRPDLLHKWHTMENFMKECIKQFEEN

SEQ ID NO: 136983 - protein, 18 aa, Heterodera glycines
  Coding regions on vcDNA: vcDNA=SeqID_63406; Strand=+; Position=1-56
YREAIPEGFGLPINLGAS

SEQ ID NO: 136984 - protein, 56 aa, Heterodera glycines
  Coding regions on vcDNA: vcDNA=SeqID_63407; Strand=-; Position=1-173
RKKLQQKSFDEIFGEKWEEKEEEKREIIGKFYKIKEKIKEKGRNIQQKNGVKSMRK

SEQ ID NO: 136985 - protein, 116 aa, Heterodera glycines; identical to SEQ ID NO: 127487
  Coding regions on vcDNA: vcDNA=SeqID_63408; Strand=+; Position=1-351

SEQ ID NO: 136986 - protein, 141 aa, Heterodera glycines
  Coding regions on vcDNA: vcDNA=SeqID_63409; Strand=+; Position=1 -113,390-468,557-790
MHLVKVLKIHCWKEKGPNFGSKNFSRLVGAILHYMSKWLKNKDDILMDKQAEVLKHLELYELLMDSVPNLSQNEINNDMIMQLLYEQRKELFPNLNIVKFSNFDSPQGGETDAKSAQQFLHGKILQKLVLNSEFLTQLKGL

SEQ ID NO: 136987 - protein, 157 aa, Heterodera glycines
  Coding regions on vcDNA: vcDNA=SeqID_63410; Strand=+; Position=1 -118,562-706,909-1116
MHLVVQSHSFVLGQVAKDCAEFVQFVNQNGIGILKNLYCENIAFNERITYYKTILGSPNSEERKVAEALLVIKMTFSEILQIEKANFKASKFDDQIGIFRAELIALMKMLQIVLGETKAMFWMFCPILTYFHFLKTKQGHSSEKLDYNLLNMCFKNT

SEQ ID NO: 136988 - protein, 95 aa, Heterodera glycines
  Coding regions on vcDNA: vcDNA=SeqID_63411; Strand=-; Position=1-649
MFEYPKRTLEKIDFFVFGAVPPNRCAQIYGETESFGNSFPIACTLILRWIFAPHNCLSTPNGHLKKSIFLFSGQSPRTDAPRFMGRPNPSGIASL

SEQ ID NO: 136989 - protein, 131 aa, Heterodera glycines
  Coding regions on vcDNA: vcDNA=SeqID_63412; Strand=+; Position=1-393
EKPDEFEEPSNGEKKPKGGAEDQADPKKKPDGVEEEPKSENKPNEAVSKEEENQAEEPKKAPELKTAENSEKPPVSQEKAPPNGTAEDDVQVGKQGEEHQKQEQMQQAGDQQPQSDEVAPARGNRRRRGAK

SEQ ID NO: 136990 - protein, 241 aa, Heterodera glycines
  Coding regions on vcDNA: vcDNA=SeqID_63413; Strand=+; Position=1 -145,248-828
  Homolog annotation: Hit_ID=XP_320889.1; Match level="QueryCoverage =94%, HitCoverage=31%, E-value=8e-43, Identity=36%"; Hit description =ENSANGP00000012033 [Anopheles gambiae] ref|XP_313651.1| ENSANGP00000013044 [Anopheles gambiae] ref|XP_314
MQECHDWIWTQPLINGHPVKLAADSCSHLTIIQEPLWISLGSPKLRKQVANTDAPNIMGLDWIVPFEQATQSPIATTLDLSIATTKVNAIEPTDEPTNLAEQMKNSFPQVFRPGLGVCTKMEATLHLKPGAQPVFCRARPVPHGVSEAVNSELDRLVEIGAIHPVDFSRWAAPVLAVRKKSGEIRVCVDFTTGLNDALELNRHPLPRTDDIFHALRGSKVFSQLDLRDAYLQLELDEKSNR

SEQ ID NO: 136991 - protein, 94 aa, Heterodera glycines
  Coding regions on vcDNA: vcDNA=SeqID_63414; Strand=+; Position=1-285
  Homolog annotation: Hit_ID=NP_113997.1; Match level="QueryCoverage =84%, HitCoverage=5%, E-value=9e-09, Identity=41%"; Hit description =cyclic nucleotide-gated channel beta subunit 1 [Rattus norvegicus] emb|CAA04133.1| cyclic nucleotide-gated
MKIALGKEERRKRKRGKGKIRSKEGEKEEEKDENSSGEGGETEEKERKRKNSKQGGGKEEEKDENSIGEGGETEEKERKRKNSKQGGGERRGKG

SEQ ID NO: 136992 - protein, 34 aa, Heterodera glycines
  Coding regions on vcDNA: vcDNA=SeqID_63415; Strand=+; Position=1 -28,196-272
MISKIKILEELSNKNEWIYVNNSLDNYPKSTMTS

SEQ ID NO: 136993 - protein, 234 aa, Heterodera glycines
  Coding regions on vcDNA: vcDNA=SeqID_63416; Strand=-; Position=1 -199,423-928
  Homolog annotation: Hit_ID=CAE66469.1; Match level="QueryCoverage =98%, HitCoverage=28%, E-value=1e-15, Identity=33%"; Hit description =Hypothetical protein CBG11746 [Caenorhabditis briggsae]
MEQQQQRQQQHMEHMVAAAKLLSAAAQQQNQQQHQAVQEAAAAAAAARMPSLEGLLNQQMVLSTLHAQLPAHMRRSTPNLFSVPDYQQPSAFRPPPPAAAAVANLLQSQQPPQQSPSSVAANASATVAAVALSNALSSVQQLLQHQQQQHQQQQQQQRLAAMAVAAAGAATANGLFRQHSFGGIGFTEQQQQQQQQQLVQLQQIAATQPTPPPLPQQQQQQQQVAHNQQQNPPK

SEQ ID NO: 136994 - protein, 124 aa, Heterodera glycines
  Coding regions on vcDNA: vcDNA=SeqID_63417; Strand=+; Position=1 -136,891-989,1534-1673
MRQRVPTVGAVAEPPEADLRGRGRRVPAGPNPLPMQPVRGTIWHTGRVPSTLSSGLAQVQTGQQQQRCQQCRLGTGHGGLSDHWLLINMVMPQLIARFFLVLSIDQKWISWSSFDFNFQGPDQR

SEQ ID NO: 136995 - protein, 653 aa, Heterodera glycines
  Coding regions on vcDNA: vcDNA=SeqID_63418; Strand=-; Position=1 -519,1139-1769,2343-2468,2782-3099,3467-3609,3928-4150
  Homolog annotation: Hit_ID=CAE72619.1; Match level="QueryCoverage =20%, HitCoverage=18%, E-value=2e-36, Identity=57%"; Hit description =Hypothetical protein CBG19812 [Caenorhabditis briggsae]
SVLTTFRTEQWTPVVCFFFVALPLRHTECQNQTATFGTGPPRLPPVSPSYPTSDLGSSPRSSISASHYTALGINASNWQAFRDAYVARRRSGECELLSVDEAASAKAGGAGGGGGFLTPHQLLSPAPFSPFSDYGVADLHMGGTSVTGTPFSSRSPNLSPSPVHRAGTNLHFSFDQIRSRSSLSNPIAGFYGLDAFGAGSECHLRIPSQSRVLDAEVRERSLSDGETLHSGGGGGGSEHQRLLQSHQHQLDDEDERMDTSDATSSSPLVVAMTVSRPSSSNGTQQQLHAGQKRRLLHQHKRAAGAASAEGRHSPVPPASVCVLKQQSPPVHAASLLSSRPPESGGDGEALASAIVANAQVSRQPTIEEPPPSPTLAELFQPGDLDKDRKRQVEDWIRQQTAALEAFRHSLIPPQQEANLLQASGVVPTIVPQNSLEHLWPSPSATNSSAGPIRPATMWRRSRSESDVSAATEAAAATASAESGGGGCGDASATTPATGTKMHQRRTSQQHTVPLLKVPLNEATHVCEHCGQGFSMHDRLAKHIASRHRDRSSSMNDENSRVHKCTLCPKSFGRSDMLTRHFSQVVKGSTFSTTNNPSKAQFRWHRHMRLHTGIRPYACQLCGQVFSRSDHLSTHQRTHTGEKPYQCPQCNYSA

SEQ ID NO: 136996 - protein, 96 aa, Heterodera glycines
  Coding regions on vcDNA: vcDNA=SeqID_63419; Strand=+; Position=1-291
MLVRLQQSLVLAAAAAAAAVQRLAIGQRALAHLRVKHTRLRRNTEVAFATGTKRVQPVEAGDRIGEGAARADLIKTEKMDPRVNECDYPAPIESIT

SEQ ID NO: 136997 - protein, 35 aa, Heterodera glycines
  Coding regions on vcDNA: vcDNA=SeqID_63420; Strand=-; Position=1-105
MVEIEVNLVNNTNNNCTNDVLRKYRVEITNYVFFL

SEQ ID NO: 136998 - protein, 293 aa, Heterodera glycines
  Coding regions on vcDNA: vcDNA=SeqID_63421; Strand=-; Position=1 -84,142-202,272-418,473-561,608-668,719-871,923-1072,1142-1241,1292 -1328
  Homolog annotation: Hit_ID=XP_420618.1; Match level="QueryCoverage =94%, HitCoverage=30%, E-value=1e-27, Identity=30%"; Hit description =PREDICTED: similar to Hypothetical protein KIAA1223 [Gallus gallus]
MNDPLYTRQRFALIVSVMQGHTEIAALLLEKGADVHQTTLGQVNNVTMAVTPLWIAVNMRQLELCSVLIAHGANVDLGSDASLTPLLLACDKGSTEIVTLLVENGADVNLGDSEGATPIMITSRAGRIDLASFLLTHGANVEQIDYSGTRFALLDAAAHGHLEVCRLLVEEWAADVNQQATDGITALMGACIHGRLDITVFLIEHGAHIDHADMDGYNALMWAVKQKKTEVARHLLAIGANADQVGIDGKRARDLARESRRAELIDLFRTTANNEQREDGNAQQDEQPQQQQQ

SEQ ID NO: 136999 - protein, 26 aa, Heterodera glycines
  Coding regions on vcDNA: vcDNA=SeqID_63422; Strand=+; Position=1-79
GPVLTSFDRDREIPGFFPGFPSQKVP

SEQ ID NO: 137000 - protein, 41 aa, Heterodera glycines
  Coding regions on vcDNA: vcDNA=SeqID_63423; Strand=+; Position=1 -66,195-254
MLSNINFLFDKNQAFMLFYILQVNVCSYKFITNTKYILQRI

SEQ ID NO: 137001 - protein, 90 aa, Heterodera glycines
  Coding regions on vcDNA: vcDNA=SeqID_63424; Strand=+; Position=1-303
GGRCAIDLLFFEGIFKFILYPRKMSISFFEKFYTSQKRLRMRRRAVHNRHFISQRIFIFRGYPRKMAISFFDKFYTHTNALEHDREGGAQ

SEQ ID NO: 137002 - protein, 164 aa, Heterodera glycines
  Coding regions on vcDNA: vcDNA=SeqID_63425; Strand=-; Position=1 -19,265-322,583-742,797-1054
  Homolog annotation: Hit_ID=NP_491127.1; Match level="QueryCoverage =92%, HitCoverage=52%, E-value=2e-32, Identity=46%"; Hit description =thioredoxin-like protein (31.1 kD) (1D801) [Caenorhabditis elegans] gb|AAF60759.1| Hypothetical protein Y
MQCDRSETKNTYGVSAMPTFIVLLNGQRVDLLRGADKTALQNLAHKWSKNCPTQMVSPIPGQCELSPLFNKVQCECLNEDDSNNLNNLLNGVGPLISDCDEQLLISVSFIQPVKVHSVLFNGPKEKAPKTVKIFANITNTLGFDQAQSTEPIQVQKMCQPMLID

SEQ ID NO: 137003 - protein, 138 aa, Heterodera glycines
  Coding regions on vcDNA: vcDNA=SeqID_63426; Strand=-; Position=1 -146,367-637
MVHESVTKGLIKGTHKCPVRLWHFHTEIPPPPPAPLKRCMPTEQQQKQGDASHSHPKTFRQFVFPGIENWSDGKDTSPSEGERTELGLVMGAFCEFAVAALAMLTDANVRDNGTAANIQLLTSHLKGGEKGGRRKKIL

SEQ ID NO: 137004 - protein, 91 aa, Heterodera glycines
  Coding regions on vcDNA: vcDNA=SeqID_63427; Strand=+; Position=1 -121,283-435
MARQQLNIRRRSVVSYVGISEHGQCGYCKFTKRAHDKAKFAASTSECNASVDASTVASSTNNDGQQQANPPNAHEENANDDTNGGGDSAVF

SEQ ID NO: 137005 - protein, 32 aa, Heterodera glycines
  Coding regions on vcDNA: vcDNA=SeqID_63428; Strand=-; Position=1-155
TDHLSQIENQLKSDGSDSSHSRPFTGKATDER

SEQ ID NO: 137006 - protein, 125 aa, Heterodera glycines
  Coding regions on vcDNA: vcDNA=SeqID_63429; Strand=-; Position=1 -220,376-533
MANALASELIERVVSRQFHLCANKIFSQRMALEMAVSQSESLLDQIVPKLLHSTVHRIRANKARHINEKMHNIRNGTLTLSPSQPLFRPNAKKMTPERMKQMATKKMQQMENERKKRREQKAMQI

SEQ ID NO: 137007 - protein, 30 aa, Heterodera glycines
  Coding regions on vcDNA: vcDNA=SeqID_63430; Strand=-; Position=1-91
MKRPGLKLLRNHPNSPIPGKKLPEAVEHPQ

SEQ ID NO: 137008 - protein, 63 aa, Heterodera glycines
  Coding regions on vcDNA: vcDNA=SeqID_63431; Strand=+; Position=1 -83,482-590
MKENGKHCDDVKDSTNMTADYEKMFAKRPPIALGYQGLKKLVEPDIGANVWAIVKIIGPEIFN

SEQ ID NO: 137009 - protein, 179 aa, Heterodera glycines
  Coding regions on vcDNA: vcDNA=SeqID_63432; Strand=+; Position=1 -124,498-606,1269-1470,1572-1674
MDDFMRHSDFQEEDGDVFTTEAVEIFVMRILEDEEGEVIIKVLRSCNSEMLLSAAKIRNSQYKRLLYIFRLAVRELPLPKPKEKETIIESILDGDEEDGETGGGRGTCGMPKKMKMNGIEEGRGHCGDSHQTLTIGDEEDSKVKKTIPFPSFEHTFAIELGTKRFRRKFNIPSTYFVVR

SEQ ID NO: 137010 - protein, 360 aa, Heterodera glycines
  misc_feature (19)..(19): Xaa can be any naturally occurring amino acid
  misc_feature (164)..(164): Xaa can be any naturally occurring amino acid
  misc_feature (349)..(349): Xaa can be any naturally occurring amino acid
  Coding regions on vcDNA: vcDNA=SeqID_63433; Strand=-; Position=1 -323,380-482,1180-1417,1467-1637,1678-1880
  Homolog annotation: Hit_ID=CAG12206.1; Match level="QueryCoverage =94%, HitCoverage=34%, E-value=9e-64, Identity=38%"; Hit description =unnamed protein product [Tetraodon nigroviridis]
RVRRLPIFGHLTQRRIRAXAERHVERLPVLTSWHRRPYFTYWISTVHLLITFFMLIFHGIGTDYSNGLNVIERSGDVMGSSLSPLHIVVWEQNNIWMGPRFADLVHTGAADLVHTGAKFTPCMRRDDKIYEQITEERKTEAESSCCVGLSGCFQTSECSVRKCXLIVSIFVQKQFATLLKWTNGKMNYSRVVCGQDPRYCARPRSVHPYVWGLNISNWPICEKICEKHSPSIPKSEKHMHCTVTGRPCCIQMHGQCRITSREYCDFVRGHFHPNATLCSQISCLNEVCGMTPFLISCLNEVCGMTPFLRRDIPDQLYRLFTPLFIHAGLVLSTLVETINLTVISDPMRXSLTLYLTIMCR

SEQ ID NO: 137011 - protein, 110 aa, Heterodera glycines
  Coding regions on vcDNA: vcDNA=SeqID_63434; Strand=-; Position=1 -92,311-401,662-811
MEDLGTNFIRWPHIYANKFLPEFDLGATVCWYESLYNRTQFDSREEQLAMLDKEFYLQLPNVRFQKFKKQLLLSKNQSNGLTNLPSHKELMQFECVIEKNLEYPLNEKYH

SEQ ID NO: 137012 - protein, 19 aa, Heterodera glycines
  Coding regions on vcDNA: vcDNA=SeqID_63435; Strand=-; Position=1-57
SPYRDRDLSFSKSGTGNRD

SEQ ID NO: 137013 - protein, 127 aa, Heterodera glycines
  Coding regions on vcDNA: vcDNA=SeqID_63436; Strand=+; Position=1-384
SLYFKNDYILKWINVQKIKHSFLTLITALLYGSDTLSAKVIILSDSTTASSSSCSFCCTRGAVDQVNDAPVQRVRGCLLVGKRSYYGQICFCDDNVLITTNKHSYSKNIHSIESNLIITTLYNNYLA

SEQ ID NO: 137014 - protein, 50 aa, Heterodera glycines
  Coding regions on vcDNA: vcDNA=SeqID_63437; Strand=+; Position=1 -135,408-425
MIYLKINFLFTFLFVNFCFVIAMDNDELTKIVKSSNKATKNKQKVNHVIL

SEQ ID NO: 137015 - protein, 85 aa, Heterodera glycines
  Coding regions on vcDNA: vcDNA=SeqID_63438; Strand=-; Position=1-573
FIRALLRISLKISGRQFYILAIFYFICDRKFLHTSHFLFYCDQAYLSSYFWDFFQNVVIELNYLYFFYEYYVRIFSTKHNQFRVS

SEQ ID NO: 137016 - protein, 189 aa, Heterodera glycines
  Coding regions on vcDNA: vcDNA=SeqID_63439; Strand=-; Position=1-570
  Homolog annotation: Hit_ID=XP_146481.3; Match level="QueryCoverage =50%, HitCoverage=9%, E-value=1e-10, Identity=36%"; Hit description =PREDICTED: similar to carboxylesterase 2; carboxylesterase ML3; acylcarnitine hydrolase M1 [Mus musculus]
MAAGVKTIIGGAVEAVIATIMRTTKVEVIRVKLEEDQWMGQNGLKGEEEEEKEKGEQKGVGGREGEKEEEKEEEEQLEEQKGVRGKEEEEQLEEQKGVGGREGTEMHKNGKKEQQQQQKEQMEPKQYLAVYTAQTCIKRAAGGRISNCLNNLFNKSQPQFKRKAENGKRNKTEQQKRGMKTNCQFTATH

SEQ ID NO: 137017 - protein, 91 aa, Heterodera glycines
  Coding regions on vcDNA: vcDNA=SeqID_63440; Strand=+; Position=1-276
MRTRKLEEGAAAITDEQMETMRQQMEQKFRQNLLEAEQRIDHKWATMLNKEQQRTQRIAAQSATVIGQLMSKRVTERGEEKENTRETEEKS

SEQ ID NO: 137018 - protein, 22 aa, Heterodera glycines
  Coding regions on vcDNA: vcDNA=SeqID_63441; Strand=-; Position=1 -17,578-631
YQGQEANALFEAFKVREGLNED

SEQ ID NO: 137019 - protein, 19 aa, Heterodera glycines
  Coding regions on vcDNA: vcDNA=SeqID_63442; Strand=+; Position=1-57
AIVEATPEGFGLPINLGAS

SEQ ID NO: 137020 - protein, 106 aa, Heterodera glycines
  Coding regions on vcDNA: vcDNA=SeqID_63443; Strand=-; Position=1 -102,148-365
MYKKAEERAKSANKINADKYLLIINSKFDDQLTWTEDALFSEFVKGLATNSETFFKMAEEYSNYLCRRKEEGSIYGNDRPMISHGLYEIEKIKKHLAQKYEAHLGV

SEQ ID NO: 137021 - protein, 168 aa, Heterodera glycines
  Coding regions on vcDNA: vcDNA=SeqID_63444; Strand=-; Position=1 -81,131-556
MLCYISAFSFIIIAQHFLVPISNANPSVENKMLIAFVRNDQKMQISEYSMQKYDAHLGIFYFMRMNWKCDKIAGKFEEYELTECQKYRKYLDILYEYLCREYVGIHTVKPKFVFKHKIEINGAIIYAVNCLAKISQFYFNSSLSSFLNYKLNNFFTYNSEPKLLNEND

SEQ ID NO: 137022 - protein, 166 aa, Heterodera glycines
  Coding regions on vcDNA: vcDNA=SeqID_63445; Strand=-; Position=1-501
  Homolog annotation: Hit_ID=CAE74275.1; Match level="QueryCoverage =96%, HitCoverage=41%, E-value=6e-13, Identity=30%"; Hit description =Hypothetical protein CBG21967 [Caenorhabditis briggsae]
MLGLLFALVEVSLFALLVSPYLSKLPNSTVALLDHAIHFNPGGLAQMEHRFGCIFDQNLYETFKRQINPRVRPSLCPFELAELAEHLRPVPSVLLRAAASPLRLRPPPTSTHFCFLFLNTRTIRRQKQLLASKRMCQSFPVTLRHTNSTKASAVGLHGSQKKVGTK

SEQ ID NO: 137023 - protein, 76 aa, Heterodera glycines
  Coding regions on vcDNA: vcDNA=SeqID_63446; Strand=+; Position=1 -117,175-288
MPFFFPSFSFSFHHILNFVTKINCKTANCANYSKINEQTLDLQRRVDGHCKLTIWRDITIHKDEGTRKIQKKFVLS

SEQ ID NO: 137024 - protein, 50 aa, Heterodera glycines
  Coding regions on vcDNA: vcDNA=SeqID_63447; Strand=+; Position=1 -22,422-552
MEEGSEEGSTHTVINRHERISEDEHRTRSLYGAFAPTDQEDVHLKMPKIV

SEQ ID NO: 137025 - protein, 31 aa, Heterodera glycines
  Coding regions on vcDNA: vcDNA=SeqID_63448; Strand=+; Position=1-94
VNIDHRPQTQKCLKTVRIDVKRFEMGWKNRI

SEQ ID NO: 137026 - protein, 108 aa, Heterodera glycines
  Coding regions on vcDNA: vcDNA=SeqID_63449; Strand=+; Position=1 -56,334-426,586-654,734-842
MADKSADNNDKTITGTKWSKTSVAPNLALEHELQMEDENVVKKGNMTCSSSSSSARKLTLRKELTSANDDNFRTFHLIGLIKRVVRFTKVRFCAESRRIQSAMTEILI

SEQ ID NO: 137027 - protein, 18 aa, Heterodera glycines
  Coding regions on vcDNA: vcDNA=SeqID_63450; Strand=-; Position=1-54
MRTRPIWQVKQRLLTSQK

SEQ ID NO: 137028 - protein, 252 aa, Heterodera glycines
  Coding regions on vcDNA: vcDNA=SeqID_63451; Strand=-; Position=1-759
MWNIMQSTTATATFQSKSASRRRRSTHSSIQSFTSSQRHHHSQETGEGLFAHLDEWLRLDQYKSKEKEHKTARALTLGALPSGVIGLTEEWFMDKLRLLVSYWTTACCIYVTFIFGRDVLIPLVWVYLMGPVIVTVRNLVTGNQWTQRNRATRGTRRAPAISRIEAIELVPPPMPQEMRANETASSQQEDPEPSPLVMDLKRQMVASRSAQNDVFKVVGMSRLNVSRECPSSGQMGRTGRNERSSERGVIDG

SEQ ID NO: 137029 - protein, 55 aa, Heterodera glycines; identical to SEQ ID NO: 134944
  Coding regions on vcDNA: vcDNA=SeqID_63452; Strand=+; Position=1-167

SEQ ID NO: 137030 - protein, 156 aa, Heterodera glycines
  Coding regions on vcDNA: vcDNA=SeqID_63453; Strand=+; Position=1 -10,810-1270
MADTNDNFLTTIYSKTLQQLSHKNDHTKRYEHLAQCFGTISFFYGQIYKALIVAQNWLKPSVKFDQKLTELKQQCDDATNELAKTNPKLAENNSIKNLLLDNDGIKNLTKTFHDIKSIVNSPKSKSAKNRLTEENGGAIEMIEFDDDLKNMGNQRG

SEQ ID NO: 137031 - protein, 45 aa, Heterodera glycines
  Coding regions on vcDNA: vcDNA=SeqID_63454; Strand=+; Position=1 -57,149-229
MNTINSRKRDAKTVFIAIKNLNNNNLEKLIEVISIQFIYIFLNDE

SEQ ID NO: 137032 - protein, 34 aa, Heterodera glycines
  Coding regions on vcDNA: vcDNA=SeqID_63455; Strand=-; Position=1-117
GFLVHIEAQDGRFAPVFKFVGLGRALRARYSNFV

SEQ ID NO: 137033 - protein, 27 aa, Heterodera glycines
  Coding regions on vcDNA: vcDNA=SeqID_63456; Strand=-; Position=1 -49,256-290
MHKIKSKFKWMREWVKTLAITIGWVAW

SEQ ID NO: 137034 - protein, 71 aa, Heterodera glycines
  Coding regions on vcDNA: vcDNA=SeqID_63457; Strand=+; Position=1 -164,466-519
PSFAVSAAPKKANESGQAINLRQLRSHADIEVDDEEEEKKNRRPDGRRRKVPKVPRRCDKCPMEIPRSVEA

SEQ ID NO: 137035 - protein, 252 aa, Heterodera glycines
  misc_feature (73)..(73): Xaa can be any naturally occurring amino acid
  Coding regions on vcDNA: vcDNA=SeqID_63458; Strand=-; Position=1 -152,403-847,1066-1235
  Homolog annotation: Hit_ID=NP_492998.1; Match level="QueryCoverage =100%, HitCoverage=26%, E-value=9e-24, Identity=43%"; Hit description= VAB-10A protein family member, Variable ABnormal morphology VAB-10 (vab-10) [Caenorhabditis elegans]
AREALLQWARHVTSGYPGVNVANFSGSWKDGLAFCALLHFYHTWLINSEEISPQSVKKSVTIIARHKLIRRGXGFLARIDQFEPSKYSDSLSGDNNVYQTSLLLYHTPTSNQGNLDDLVSRLTRGIGITNEKLDHLLTRIDSVDAAERGERIELLERQVRQIGDDLKMLKPPIDELFLDVDTLRQHRHADAADFNKQVIGLEQRRTAYLHRESLALAREHATSLNATRPHRGTRGNAFRRVEDAIQWIRDRM

SEQ ID NO: 137036 - protein, 77 aa, Heterodera glycines
  Coding regions on vcDNA: vcDNA=SeqID_63459; Strand=+; Position=1 -154,750-829
MSHQTHHSITNPLDGILNSTKSVATRAGRCGRVAFSDVACSLAKAKLSDGGARFKLIYSGEKSLSPSDQFMSCDYGD

SEQ ID NO: 137037 - protein, 94 aa, Heterodera glycines
  Coding regions on vcDNA: vcDNA=SeqID_63460; Strand=+; Position=1 -207,525-602
MVKVQKGTECQPVLPTAGKVGNIDTGVSGRNMASPLEQCFTCSQQCKWEFGAVSAAAVDSALACGVPLLNQRISELCSRRTQETGFEPINYSDF

SEQ ID NO: 137038 - protein, 87 aa, Heterodera glycines
  Coding regions on vcDNA: vcDNA=SeqID_63461; Strand=+; Position=1-264
MVKILNFSPGGFPYFGFLLHILCACFVISLLSIIDSPNDKTTINLLIAFCRRSNFLIEEREHSHARKNPPNVINFTVEQELFISRPV

SEQ ID NO: 137039 - protein, 58 aa, Heterodera glycines
  Coding regions on vcDNA: vcDNA=SeqID_63462; Strand=+; Position=1 -135,482-523
MTNSYSSIGLSKFAQLVGLDESSGTVQELLQKCNWTVSEDGFISPIDSTMFFDAMAVQ

SEQ ID NO: 137040 - protein, 148 aa, Heterodera glycines
  Coding regions on vcDNA: vcDNA=SeqID_63463; Strand=-; Position=1 -102,176-262,319-424,483-634
MATLDDDTKIGVDLRCGAEESERRPDAIPYNAQRIDIIEMENVGHANFTEVKVNFIREQGKGKAPRQPSQLFRAVFGDAATADDFVIRIEYTTPTSDSDDFTAKKETLAQELNQKIQKARAGDSDQIIQIITLISTLTLVQVWIFNYD

SEQ ID NO: 137041 - protein, 217 aa, Heterodera glycines
  Coding regions on vcDNA: vcDNA=SeqID_63464; Strand=-; Position=1 -374,428-708
LWITSPHNTDGQRIWDIFVREIWPIFSENIHHLDFYDSVGLDNLLRRTTPTILTDLNQLTSINLYGRFPAAFGDDFDGPNSTISAGQALSKWLHSPRNDGQPKRLRCKDFKEQPNLDWINNFKEHFLRANAISSVSYQFNFSVPVPSMQIVPFELVNEWTKEKLTLAKTKGWDNRWIMKRCKIIGETAAIQQQKKDENWGNSCNNVFIWLNSYTNCI

SEQ ID NO: 137042 - protein, 327 aa, Heterodera glycines
  Coding regions on vcDNA: vcDNA=SeqID_63465; Strand=-; Position=1 -147,182-344,391-605,649-797,1292-1601
  Homolog annotation: Hit_ID=NP_507780.1; Match level="QueryCoverage =50%, HitCoverage=11%, E-value=4e-10, Identity=30%"; Hit description =predicted CDS, DNA polymerase type B, organellar and viral family member (5T899) [Caenorhabditis elegans]
MKPSWKSTVKNYKHEVCVIFIDGEGGVEGHYDPVKNVGKLFSARNYCFGAENYGTVLDTLPPIENYYPGGLFPADRAKFEQWYDENRETGLELTEVIADYCKTDVQILAYGMVKMRQLFLSETRHDITDSVTIPSGCMKYWVQLAHHDKERVTIIPHLGYEKRGKQSSIARKYLKWRAEEELRENGRVLRHVESPGGEFKFGNYSLDGMMERPDEDKNLAIEVNGNMYTNYPVGHPTVVQFDKDVEWRSPADIVGDDGIRLEGIIKCYAVPPRHCHYDIPVLPYRVNNRTLFPLCRTCSEMYPRGLIDPEYNCKHFEDSERGGFRNF

SEQ ID NO: 137043 - protein, 47 aa, Heterodera glycines; identical to SEQ ID NO: 133285
  Coding regions on vcDNA: vcDNA=SeqID_63466; Strand=+; Position=1-644

SEQ ID NO: 137044 - protein, 47 aa, Heterodera glycines
  Coding regions on vcDNA: vcDNA=SeqID_63467; Strand=-; Position=1 -8,109-241
MKNYIFFGFTVKRLMYESISAYDSDGLARNNGEIKKNAKHSYGVGDT

SEQ ID NO: 137045 - protein, 21 aa, Heterodera glycines
  Coding regions on vcDNA: vcDNA=SeqID_63468; Strand=-; Position=1 -54,373-384
MRTRPIWQVKQRLLTSQKKGF

SEQ ID NO: 137046 - protein, 79 aa, Heterodera glycines
  Coding regions on vcDNA: vcDNA=SeqID_63469; Strand=+; Position=1-366
CFFYQKGRWRKIFLKIFPYILVISFCFWWGAWNSGIMRTRPIWQVKQRLLTSQKVRCRDETNQHCLPRGTRHGPPKEWI

SEQ ID NO: 137047 - protein, 89 aa, Heterodera glycines
  Coding regions on vcDNA: vcDNA=SeqID_63470; Strand=+; Position=1 -54,269-484
MRRILSILQEAQTDCTDTAYVFHAACFDAFRRKRSRKWPNRGQTVVSSERTQQRCESGTSNFDFGPEILGNGKSAVRFVTGGLEMALII

SEQ ID NO: 137048 - protein, 87 aa, Heterodera glycines
  Coding regions on vcDNA: vcDNA=SeqID_63471; Strand=+; Position=1 -101,452-574,889-930
  Homolog annotation: Hit_ID=CAE57679.1; Match level="QueryCoverage =97%, HitCoverage=15%, E-value=3e-25, Identity=62%"; Hit description =Hypothetical protein CBG00673 [Caenorhabditis briggsae]
VAELSLRNVVRVVGLADPVTPVSAILRRCSVKTLMLHYGIAEFGDCDQFLAHLSRRFGRLKKGGRPDHNAAARQVLTDWNSKLRYYT

SEQ ID NO: 137049 - protein, 78 aa, Heterodera glycines
  Coding regions on vcDNA: vcDNA=SeqID_63472; Strand=-; Position=1-236
MPKFVWTAKRLATDLWHWANKKEKKRAASPLRVIEKKLGISIWLYKHKTHDEFVKKHPEELEPVPDPCEEAKLKLKKK

SEQ ID NO: 137050 - protein, 103 aa, Heterodera glycines
  Coding regions on vcDNA: vcDNA=SeqID_63473; Strand=-; Position=1 -105,574-680,724-823
MGGGAGRKLEQGQHLPEVERKRREPWRLFANLAKNAQFAAAKPPLGMPSAAIPTDWSPRSAKLAYHPPSIGSLDEAESGGRQLDISAPREEYESRLSTPDELR

SEQ ID NO: 137051 - protein, 139 aa, Heterodera glycines
  Coding regions on vcDNA: vcDNA=SeqID_63474; Strand=-; Position=1 -270,414-563
MATFFGTEVPTAKENKKRKSNEEKSLYEELHSPKFIDDSARTEDEGDNEQKEPKRTAGDGVAVGTALSATSKSRARVINYLINNSQFQKALTTKSRPSSAWCPPAKHSLAFRLEGPLAPLGRPIIHSPRLMCVSTAWRE

SEQ ID NO: 137052 - protein, 78 aa, Heterodera glycines
  Coding regions on vcDNA: vcDNA=SeqID_63475; Strand=+; Position=1 -192,283-327
MTQKAKAEMEEEEQKTKQEQQREFEGEEEEENCEENGSEENGVPKEATAKCHQQNGRRENGTGKSHGVKEKSFAKTGR

SEQ ID NO: 137053 - protein, 96 aa, Heterodera glycines
  Coding regions on vcDNA: vcDNA=SeqID_63476; Strand=+; Position=1 -85,209-412
MPQHSPPGSSANSSSSSASLLRFRAALDTIFGRPIAPRQWRRSRGSPAAFFGTAVALPSCRAVPRRQQRAAAAAQSPLADHATAAGVAAEFGGGCA

SEQ ID NO: 137054 - protein, 67 aa, Heterodera glycines
  Coding regions on vcDNA: vcDNA=SeqID_63477; Strand=+; Position=1 -101,236-338
MDNFPLHRAVFSNEVQMVKQHMTEMNKKDKQGNTNCADFVGEGAKLRSRTTVNGTRWMRPSRMATLD

SEQ ID NO: 137055 - protein, 67 aa, Heterodera glycines
  Coding regions on vcDNA: vcDNA=SeqID_63478; Strand=-; Position=1 -104,873-972
MACHWAATAVFGKVPLIATMLPSVLAKGLTSNELSAGDRFGDALAPIGESATKELGDELPLMAEPLL

SEQ ID NO: 137056 - protein, 68 aa, Heterodera glycines
  Coding regions on vcDNA: vcDNA=SeqID_63479; Strand=-; Position=1 -155,1138-1189
MAMPSQEKRIRRAKKREEEGRRMATTNDERWQRNRNRNTFGPWQRPTKKKPKLIRMRFSKYPGQPGGP

SEQ ID NO: 137057 - protein, 113 aa, Heterodera glycines
  Coding regions on vcDNA: vcDNA=SeqID_63480; Strand=-; Position=1 -155,489-674
  Homolog annotation: Hit_ID=XP_317642.1; Match level="QueryCoverage =48%, HitCoverage=6%, E-value=5e-20, Identity=78%"; Hit description =ENSANGP00000018525 [Anopheles gambiae]
GSGGICIGVGGADAVDVMADFPWELKCPNVIGVKLTGRLSGWKASKDIILKLDDIKNSNDIRFEAAEKITNNIKQSADDRYNSIEKVSREAINGQLQGFGLKVFAFNAGLAGS

SEQ ID NO: 137058 - protein, 139 aa, Heterodera glycines
  Coding regions on vcDNA: vcDNA=SeqID_63481; Strand=+; Position=1 -124,530-825
MWNGILADLKIFLGLARGGNPNVNAGGTRMEQIQDLDRERITGLTQMQQNLQKDSKFSVQMVPVPQQQMMTMGGGAMDGPARTYFTSRNPTSIAVPGPAQSKASDCDEKGTGNFGNIPPLDGFMTREIRKFRHETCETM

SEQ ID NO: 137059 - protein, 53 aa, Heterodera glycines
  Coding regions on vcDNA: vcDNA=SeqID_63482; Strand=+; Position=1 -38,136-256
MFGTFILSATFYIPLNSSPVLCAWSAAFCSPGQRHNFSKFISGSSITRDAMDT

SEQ ID NO: 137060 - protein, 51 aa, Heterodera glycines
  Coding regions on vcDNA: vcDNA=SeqID_63483; Strand=-; Position=1 -45,105-164,365-414
  Homolog annotation: Hit_ID=NP_502437.1; Match level="QueryCoverage =98%, HitCoverage=4%, E-value=2e-13, Identity=72%"; Hit description =UNCoordinated locomotion UNC-31, EGg Laying defective EGL-22, Ca2+ -dependent activator protein for secreti
EWYDGQTQMLNEWLTERLQQSLSNTQLTSLLLIVKKIYSDFELHGIDEERL

SEQ ID NO: 137061 - protein, 499 aa, Heterodera glycines
  Coding regions on vcDNA: vcDNA=SeqID_63484; Strand=+; Position=1 -338,528-664,709-947,1076-1399,1578-2039
MWTNCFYEPIRLYKSVGDLDEEDRLLIKQFISASISSISLLLDQFVDIRATLFIHLGDLHRYSYTTVEQNMQHLTAAAEYYKKALRLDPKNGHPFNQLALLLKEHNLEHSLSLRVSFEDERKRFDGLFDELLKQSHYLFAVRLIHSFALASIYTLLNEEDDEKFRCSVSFLFRKWALLLVEVEKHLEEHTLKEDEQQLAKKRRQNRKSSSSSESSEENLEFKNGTAGEESQICADFAWQFQNLLKTLVDILNELLPKLSAKMQKNDNEMETMEQIAEWSINGPFTEGNEEEQCEIAASFIRHVVKKQKFAIVFDKFFQMSSNLMEEKELKPIEAFSKMHLQHVTNENEKTSKVPVYVAPDSSVFLHKLDLVKHLLLSMNQTIIIARSVLSRLDKVKRENNNAREAIRQKAHEQQPMGHFWAFPLFRWIQSRIPEGRVRMLPHTGEKFINECLQFVREKGLLDKKTLFCSILTTGEASEEYERQKEEMRQYNCQFRRQFN

SEQ ID NO: 137062 - protein, 634 aa, Heterodera glycines
  Coding regions on vcDNA: vcDNA=SeqID_63485; Strand=+; Position=1 -72,128-227,576-984,1046-1119,1170-1465,1806-2069,2326-2425,2488 -2632,3375-3462,3542-3898
MAQVDDDYEANKRVAESLREYMGRRLNVANAFETPILEGLMAAVKVEPLQRIGTVLDEKIAPFQNDDWQNDRDEVETVNANDEGGDKSGTIASGEDGEGSGEGNKRDKNKLSKPLDSSRKAKLLTRETHQLAEGLWKRFASAQHFGDTEDDLHALFDQLSTDVTGTVMKRRLGAVHGSLDRKDNQFSIEDAIYRKISKDFEEGSARSFVSNQILMNDHGNFLILHTNWPGDEPSNPLPSLVNHLSAASAQCQTKALDQMTSAVKRAQSKRPSEFALLTQICADDGQNLPTIDFQEENSYEQRIDCVVDVFENDGGDEHASTLESGDGAPLHSCRMAVDETIANSPFADSAIAPLTNGINVPHGNLEEDGLIVETFSQNIDEGTDNESKATTAYLGRDGEAFGTEVGDQNVDHGLAPTDEIRPKKGKTKRLIHEAGSAKAKRRLQKGNDFEEISGIADDMCWIPKRVVSSFVKRAIADIQRTSLAKRSEIKQIYYQTNLNVAKVKKAMLRVISSHKKCAPPAVDFVMGLDDEADAEDHLSSCPSEDNDSEQIESDVESMAAISDDGTPTAEGVQVGTAESLVKALWTALSEHRSESPGDQQQRVIRECPAFFEWNDKAKFDCHKFIRCSAASMQR

SEQ ID NO: 137063 - protein, 234 aa, Heterodera glycines
  Coding regions on vcDNA: vcDNA=SeqID_63486; Strand=+; Position=1 -260,306-393,502-858
MDGQGTADTEAADVISLDNGEENWQMDDQNGTLGDEVPIDAEFAVSPHMASDDGSPKRRRWGSDCTDEEDDDQLDTGFGFLNNITLSEIKQIYYQTNLNVAKVKKAMLRVISSHKKCAPPAVDFVMGLDDEADAEDHLSSCPSQDNDSEQIESDVESMAAISDDGTPTAEGVQVGTAESLVKALWTALSEHRSESPGDQQQRVIRECPAFFEWNDKAKFDCHKFIRCSAASMQR

SEQ ID NO: 137064 - protein, 202 aa, Heterodera glycines
  Coding regions on vcDNA: vcDNA=SeqID_63487; Strand=-; Position=1 -126,185-222,270-361,422-451,507-582,630-681
  Homolog annotation: Hit_ID=CAE58634.1; Match level="QueryCoverage =88%, HitCoverage=95%, E-value=1e-40, Identity=50%"; Hit description =Hypothetical protein CBG01802 [Caenorhabditis briggsae]
LLIVLGLIMIMANCGQAMRQQAVAVRGQLRCGNRPASGVKVKLWDEDDLWDEDDGPDPDDVLDEAFTDSSGSFQMRGSLDEAFTDSSGSFQMRGSTRELTNIDPVLKIYHDCDDGHDCDDGIMPGQRKVKLRIPSQYITNGGLQRKVKLRIPSQYITNGGLARRTFEVGVLNLETVFAGEERDFIGVLNLETVFAGEERDFI

SEQ ID NO: 137065 - protein, 49 aa, Heterodera glycines
  Coding regions on vcDNA: vcDNA=SeqID_63488; Strand=-; Position=1-148
EEINKCQMSNARTIKIPICRLTFGNSLSVSGIGQLSTDCWDASPTQTNT

SEQ ID NO: 137066 - protein, 148 aa, Heterodera glycines
  Coding regions on vcDNA: vcDNA=SeqID_63489; Strand=-; Position=1 -126,186-223,271-362,424-469
  Homolog annotation: Hit_ID=CAE58634.1; Match level="QueryCoverage =83%, HitCoverage=63%, E-value=1e-26, Identity=50%"; Hit description =Hypothetical protein CBG01802 [Caenorhabditis briggsae]
LLIVLGLIMIMANCGQAMRQQAVAVRGQLRCGNRPASGVKVKLWDEDDGPDPDDLWDEDDGPDPDDVLDEAFTDSSGSFQMRGSTRELTNVLDEAFTDSSGSFQMRGSTRELTNIDPVLKIYHDCDDGIMQVRGHDCDDGIMQVRGGG

SEQ ID NO: 137067 - protein, 60 aa, Heterodera glycines
  Coding regions on vcDNA: vcDNA=SeqID_63490; Strand=-; Position=1-194
EEINKCQMSNARTIKIPICRLTFGNSLSVSGIGQLSADCWDASPTQTNTSRHPCSNCPTF

SEQ ID NO: 137068 - protein, 331 aa, Heterodera glycines
  Coding regions on vcDNA: vcDNA=SeqID_63491; Strand=-; Position=1 -111,153-939,980-1076
MDRTVNDFSFQHFSATSTPMPTSTCQYLKKRPLLKEKNNTISASPASKKTPISAEESLSNETMPDLFFYDKKSSDGFSFEEEGQENRQKKVLSSVSEVTSCSNSSQKKEIIECSLSPIHVKNDHKYKAKKIISSDVEDSIVSSSSNGNENRQNEQNSIVAAEEDQNRKRVLSDSSGTDEGRQLQVQSEDESGRSSEEEAQVEHNSSETTAEEETEEDIETVGDSQSEGESVLIDEDEESADKVGALPNRIEGRKNLPGESLRLYIHHLQRILGNVPRTILLSQPTIVSEQNRAEIYNAMPVQPGRLFGGKMTDERFMKISSVSNDVINAMH

SEQ ID NO: 137069 - protein, 44 aa, Heterodera glycines
  Coding regions on vcDNA: vcDNA=SeqID_63492; Strand=-; Position=1-134
MRARWTMTKARTEAQDSQIGLTLFFYRSCKDYRENPPYLLPLEM

SEQ ID NO: 137070 - protein, 49 aa, Heterodera glycines
  Coding regions on vcDNA: vcDNA=SeqID_63493; Strand=+; Position=1 -94,628-681
MDKRTEKEPNRPTDGRTETKTEDKMPRICVIKLHGIGSGIPGPPGPGCP

SEQ ID NO: 137071 - protein, 66 aa, Heterodera glycines
  Coding regions on vcDNA: vcDNA=SeqID_63494; Strand=+; Position=1 -153,673-720
MALESATAALGANKHCECEHCSEWISALRRSRTDRPMDGRRRKLRTKCQEYFSCYYFFDICRIAKQ

SEQ ID NO: 137072 - protein, 264 aa, Heterodera glycines
  Coding regions on vcDNA: vcDNA=SeqID_63495; Strand=+; Position=1 -151,197-313,845-1015,1161-1325,1404-1594
MEIVNKFMEMKNRFYESGEKRPFRQVDKEIADKLDVNARTIYKWKKRFGLKLGENRKIGILKKINELKSKNPQITLAQIEKELPTLGYYRKDFKESYKQLETIRKFDKIVAKKLSPLSFEEKTKIAAELGVKIRTLYDWKKKLGINEERGYGKKEKIAILKRYDQIKKENPQKTMGQIVKEMQVSQSMFYLWRKEFKVKIKPHFLSEDEKRKIVAKFNKIKEIKGQSIKREDKKKIAKRLGFSLNAILRWKNQFGQKGRLIAEN

SEQ ID NO: 137073 - protein, 208 aa, Heterodera glycines
  Coding regions on vcDNA: vcDNA=SeqID_63496; Strand=+; Position=1 -94,339-507,891-1019,1106-1255,1480-1536
  Homolog annotation: Hit_ID=NP_493832.1; Match level="QueryCoverage =100%, HitCoverage=48%, E-value=2e-66, Identity=59%"; Hit description= acyl-coa dehydrogenase SHORT-CHAIN SPECIFIC (45.2 kD) (2B138) [Caenorhabditis elegans] gb|AAK85472.1| Hy
AGLSRSDAALVFEQLAAGCCSTAAYMAVHNMVPWMIDRFANEELKQRYIPELASFTKLASYCLTEPGSGSDSAALRTNARREGDHYIVNGSKAFISGSGVSSVYLVMMRHKDAPPGPKGIFALIMTPDMPGFQLGKDENKFQLGKDENKLGWCTQPTRILTFEDVKVPVTNQVGADDEGFTIAMEGLNGGRVNIEKCSLGAAQMSMDL

SEQ ID NO: 137074 - protein, 114 aa, Heterodera glycines
  Coding regions on vcDNA: vcDNA=SeqID_63497; Strand=-; Position=1 -69,162-437
  Homolog annotation: Hit_ID=NP_505777.1; Match level="QueryCoverage =87%, HitCoverage=34%, E-value=8e-13, Identity=38%"; Hit description =putative protein, with a transmembrane domain (24.9 kD) (5L375) [Caenorhabditis elegans] emb|CAA98457.1|
MFTTVHYNFFLQKRALRFTADQLGYFSLKIRLHWFSECLKFVHFWVDASELPKDRRFWLPLATCLAHSYPMLLPLDANCYSDQTAFKLLTKNIKLPTEEEEEGKSEGMDEDDRR

SEQ ID NO: 137075 - protein, 56 aa, Heterodera glycines
  Coding regions on vcDNA: vcDNA=SeqID_63498; Strand=-; Position=1 -97,202-275
MWQLGVNDEAPQEDEEDVHLIKQDTSRLVKKNSCDTGETLNCTSTESGDEKDEILM

SEQ ID NO: 137076 - protein, 74 aa, Heterodera glycines
  Coding regions on vcDNA: vcDNA=SeqID_63499; Strand=+; Position=1-280
QLHFFTKNDQILAVLRQKTCKNSGKGRSGGADRRRRENFWKLECYLLRKLPIKLFNFRLGGEFEKNFHYLLENF

SEQ ID NO: 137077 - protein, 267 aa, Heterodera glycines
  Coding regions on vcDNA: vcDNA=SeqID_63500; Strand=+; Position=1 -163,207-573,619-892
  Homolog annotation: Hit_ID=NP_507780.1; Match level="QueryCoverage =96%, HitCoverage=17%, E-value=8e-20, Identity=29%"; Hit description =predicted CDS, DNA polymerase type B, organellar and viral family member (5T899) [Caenorhabditis elegans]
AANYGIVLDSLPPLDDYYPGGHFPEELKKPEQWYEENRNTPFDLREVIADYCKADVQILAHGMVKMRQLFAAATSQELTDSITIPSACMKFFVVLSHVGKERVAIIPHLGYEKRGKQSAIARKYLKWRAEEEMRDNGWTLRHVESPGGEYNHGNFLLDGMLEERIGEDKNLAIEVNGCYWHACPHCFPEDDAIVGGGETAGAIRARDEKRIRQIARDFEVEIVWECQLGRMLEVDPQMKAFFDNTPDSGPIDFHDAFFGGHFFPIFG

SEQ ID NO: 137078 - protein, 212 aa, Heterodera glycines
  Coding regions on vcDNA: vcDNA=SeqID_63501; Strand=+; Position=1 -517,766-887
MKNLKLMAQIPNSFFSRKTWINAFPHRQCKITLYNVLVTKTYMQKRRGNDLPKETIGKPKDVPKSKIEKPFNMPKTIIAKPNDVPKQKNAKKKASKNDGGQKKEKLVVSRPSSPNGVPIEFELEINEYTNGQLINKNTISGQWDKRNEKIIDEMLKNKKVGVTQLGPIQSKADILPLKPGQFETEFHFFSDNHANSQQSTVASTSKNQVRNF

SEQ ID NO: 137079 - protein, 86 aa, Heterodera glycines
  Coding regions on vcDNA: vcDNA=SeqID_63502; Strand=-; Position=1 -15,80-322
MDFRPVRIVATYFVPPRRLVFRRWRRFRRRCLRAIDANDEMSTARVNGHQLGVLAAHRQNSDRTGRDADAGQWSTVTVGSYGAGET

SEQ ID NO: 137080 - protein, 278 aa, Heterodera glycines
  Coding regions on vcDNA: vcDNA=SeqID_63503; Strand=-; Position=1 -147,356-1045
MADEDGKRVSRSENGQHIKKMFVNSALGSSVMIENKSGGDNEPNYEESEPKSLSESENRKSETISTDDKFIVIQTGINWTLASRLTEVSSWPHFLLMKKKSQSDEYFRLGEIIDIKEFVENESNSLNASNKFATNFTLLPEDGCGSIERILKCEKTGKIIAVDVCFDVGESLQRFYSHQFGSDVDVSAIVDDAWVELITLGFRIQGFEDSLSTLTGLNTLSDKPTQIVPHQYIGTSIDLVIKIVRQIDPVEEDYRQWCEFLAKQRSTSNHDQDYHHRR

SEQ ID NO: 137081 - protein, 55 aa, Heterodera glycines
  Coding regions on vcDNA: vcDNA=SeqID_63504; Strand=+; Position=1 -31,61-197
MYLSIFISRKSPYLDGYKSDENQPKKYLGDDSIVLILLFRMSIYLFKTIKISETS

SEQ ID NO: 137082 - protein, 75 aa, Heterodera glycines
  Coding regions on vcDNA: vcDNA=SeqID_63505; Strand=+; Position=1-228
MPLATVLPGEKKVDVKWSAIADKKCCGWMTGGRGGGAGGRSAVGEAEEMMPSPTTAVPEDETDFCGWRGEAAADE

SEQ ID NO: 137083 - protein, 57 aa, Heterodera glycines
  Coding regions on vcDNA: vcDNA=SeqID_63506; Strand=+; Position=1 -3,303-473
MNFLTTRICLRNVIENEESFVDQADCNTGTAADDWVRDPISANCRNRPQSNSLIVNT

SEQ ID NO: 137084 - protein, 74 aa, Heterodera glycines
  Coding regions on vcDNA: vcDNA=SeqID_63507; Strand=+; Position=1 -47,104-281
MSDNPKDVEKEMEKAIFIAADCWLKVFDLLPRSQLGLGIALISRRFDYFVEEHFKTRKWKLGETIYAMEIGQKI

SEQ ID NO: 137085 - protein, 36 aa, Heterodera glycines
  Coding regions on vcDNA: vcDNA=SeqID_63508; Strand=-; Position=1-108
MLRTATVHDWPEYPVRGILLDTSRHYLNKNVILRQI

SEQ ID NO: 137086 - protein, 257 aa, Heterodera glycines
  Coding regions on vcDNA: vcDNA=SeqID_63509; Strand=-; Position=1 -102,482-619,700-802,1860-2011,2293-2400,3463-3528,3899-4003
  Homolog annotation: Hit_ID=CAE68910.1; Match level="QueryCoverage =92%, HitCoverage=23%, E-value=7e-26, Identity=29%"; Hit description =Hypothetical protein CBG14886 [Caenorhabditis briggsae]
MYKLKTGRHFEKNVAAHIASLQAAQAANGGEEKALIVPVVSHAVADVELCLDSRQLLVASRSGQVTLFLFAKTECCQEIATLVLPQLCRSTISTTFLPTTAPPSPKNGGQEVPKGYQPELVCQIPWINGIRPELVTALALNSAHGLIALGTRVGFALIDAHTAAQVYAWSNDELFGREPIPYWSSALNSQIDEMTISPATEFIIPIITHITFVHRERSDQFGLESRIPSFIYGSGNSVFYYHKFPGCAISTLNYRNP

SEQ ID NO: 137087 - protein, 88 aa, Heterodera glycines; identical to SEQ ID NO: 124691
  Coding regions on vcDNA: vcDNA=SeqID_63510; Strand=+; Position=1 -96,135-305

SEQ ID NO: 137088 - protein, 220 aa, Heterodera glycines
  misc_feature (171)..(171): Xaa can be any naturally occurring amino acid
  Coding regions on vcDNA: vcDNA=SeqID_63511; Strand=+; Position=1 -33,279-420,464-578,650-952
  Homolog annotation: Hit_ID=CAE65866.1; Match level="QueryCoverage =87%, HitCoverage=10%, E-value=1e-35, Identity=44%"; Hit description =Hypothetical protein CBG11009 [Caenorhabditis briggsae]
SQSLNTASPFGRIELALLYLRQKRELIISLSGAFDLFPRTNGTPRNAYVKLFLLPDRSENSRRQSKVIADTENSRRQSKVIADTLAPVWNEHFFYEALDERAIAERVLEVTLWDFDAFGSHVTLWDFDAFGSHSFLGETLIELSKAPLNNRTLVYPITDLDDDDLIRLVSXLSFLFHSPVNQQLRQRRFSSMTPPMGQRSRSHWPGGATEHNSRGGGGGG

SEQ ID NO: 137089 - protein, 104 aa, Heterodera glycines
  misc_feature (95)..(95): Xaa can be any naturally occurring amino acid
  Coding regions on vcDNA: vcDNA=SeqID_63512; Strand=-; Position=1 -109,451-656
  Homolog annotation: Hit_ID=NP_491005.2; Match level="QueryCoverage =88%, HitCoverage=8%, E-value=2e-27, Identity=63%"; Hit description =PaTched Related (ptr-12) [Caenorhabditis elegans]
LFREFNSSLVRVMTFSTTYVEVEVVRAGLSMLPFLMVGFAIMATCTSVSVLLSAVYWRQWHVQKLALALMACVCPFMACGTALGLLFLAGVRYGXKFVKILKIK

SEQ ID NO: 137090 - protein, 66 aa, Heterodera glycines
  Coding regions on vcDNA: vcDNA=SeqID_63513; Strand=-; Position=1 -56,202-343
MMMKQVLKAKGKQEKDVIPWQKTVQKIGNTEKRRKEIKWNLEEESVESLDQLTYRGLKRQGAIEDN

SEQ ID NO: 137091 - protein, 34 aa, Heterodera glycines
  Coding regions on vcDNA: vcDNA=SeqID_63514; Strand=-; Position=1-102
MSFRARKVPLKKLEQKVPKCSLEFYFADSALSCS

SEQ ID NO: 137092 - protein, 183 aa, Heterodera glycines
  Coding regions on vcDNA: vcDNA=SeqID_63515; Strand=+; Position=1 -36,196-709
MFAFYLSKCGTIALRWADEKCRQNAIECSSENRRAALGPALFKIRFPLIPSDAFVKQIGRNLIVFRPLRFFAVPSGVLSNEEFVGVYQFHCHPNFCGVPGLNPLKFPWNGRIFDWNTAKGNRGTLTMEIGRFSEFTQKEVGSKCFSDYEIRINGFGWKILAGIKPKSNQKWLGFYLCCTAPKE

SEQ ID NO: 137093 - protein, 62 aa, Heterodera glycines
  Coding regions on vcDNA: vcDNA=SeqID_63516; Strand=+; Position=1 -26,553-715
MTFKINFSRLRIMENLGGLRISVTENTFTPAPFNNINGKKVTKKKVHFQFFDTRRNWAKRVV

SEQ ID NO: 137094 - protein, 221 aa, Heterodera glycines
  Coding regions on vcDNA: vcDNA=SeqID_63517; Strand=+; Position=1 -150,240-368,414-559,608-641,701-769
  Homolog annotation: Hit_ID=CAE61720.1; Match level="QueryCoverage =97%, HitCoverage=83%, E-value=2e-52, Identity=35%"; Hit description =Hypothetical protein CBG05670 [Caenorhabditis briggsae]
GPNQLERFAFDVQAQQCVPFAYRGLKGNRNNFLSQEECEVACLPNSCPSGSPFVGADGRASPFVGADGRAQSCAVSTAMSTCPNGYWCHVGANAATTMCCPEANASPCQLPMSTGNASPCQLPMSTGEGPFRLDRFYFDLGSKSCKSFIYKGLKGNQNNFLSLRACQLSCLRACQLSCLPLDNPCIGQPAKSTSGQVFFPCIGQPAKSTSGQVFFCSASIA

SEQ ID NO: 137095 - protein, 20 aa, Heterodera glycines
  Coding regions on vcDNA: vcDNA=SeqID_63518; Strand=-; Position=1 -31,155-186
MIYIKQFLLTGRFTEFFCCS

SEQ ID NO: 137096 - protein, 117 aa, Heterodera glycines
  Coding regions on vcDNA: vcDNA=SeqID_63519; Strand=+; Position=1 -8,115-460
  Homolog annotation: Hit_ID=NP_955828.1; Match level="QueryCoverage =83%, HitCoverage=18%, E-value=3e-13, Identity=36%"; Hit description =internexin neuronal intermediate filament protein, alpha [Danio rerio] gb|AAH65939.1| Unknown (protein fo
MSGETEEQKMEKDEEKEEYKEENKEEGKRKMKKNSEEEGQKGEERERGEENEEKRGREEQNNDEEREEQKETGRGKGDDGRKKRKRKEREGGTESDKQKKRAQLNYSPNFLPISRID

SEQ ID NO: 137097 - protein, 59 aa, Heterodera glycines
  Coding regions on vcDNA: vcDNA=SeqID_63520; Strand=-; Position=1 -49,128-255
MSDADHFNAHESFNDTMWPGSIGGGDLVEKSAIPWWKRMEFWRNSLIILLILLFGLIFL

SEQ ID NO: 137098 - protein, 47 aa, Heterodera glycines
  Coding regions on vcDNA: vcDNA=SeqID_63521; Strand=-; Position=1-141
MTKQRMVVNIYKSKYAKRKTEEISLISQVKEIEEIERLTFDENKSIF

SEQ ID NO: 137099 - protein, 173 aa, Heterodera glycines
  Coding regions on vcDNA: vcDNA=SeqID_63522; Strand=+; Position=1-522
  Homolog annotation: Hit_ID=CAG83749.1; Match level="QueryCoverage =83%, HitCoverage=26%, E-value=4e-14, Identity=42%"; Hit description =unnamed protein product [Yarrowia lipolytica CLIB99] ref|XP _499823.1| hypothetical protein [Yarrowia lipol
MHSIFIKTFPYLFNFKQYCTSPNNVVPLLITVVPLLITVAPLLITAVPLLITVVSLLITFVPLLITFVPLLITFVPLLISVVPLLITLLIAVVPLLFTVVPLLITVVPLLITVVPLFITVVPLFITVVPLLITVVPLLIPVNPFTVYVENLLKSQVLFPTKYPTTHAPPIYYI

SEQ ID NO: 137100 - protein, 291 aa, Heterodera glycines
  misc_feature (1)..(1): Xaa can be any naturally occurring amino acid
  misc_feature (17)..(17): Xaa can be any naturally occurring amino acid
  Coding regions on vcDNA: vcDNA=SeqID_63523; Strand=+; Position=1 -282,334-523,578-655,703-773,839-911,969-1037
  Homolog annotation: Hit_ID=CAE60514.1; Match level="QueryCoverage =89%, HitCoverage=53%, E-value=3e-39, Identity=34%"; Hit description =Hypothetical protein CBG04133 [Caenorhabditis briggsae]
XQNLRQRRYKKILFANXLLISTLIVSVLSPLSSQCSAASIFHSHIVEVPFRYLHKLPLSGYEVRDFTIQTSEFRSLGIDIEFSVDCNGERLTGRVCRVRPEERLTGRVCRVRPEQKISFYAKVTLSDCSRPNLAAVSVGIYGYNTVSAIFVTPLCGCECEHGRERHSPRCSYMGNLERHSPRCSYMGNLICGQCQCDQGKGGEKCECDLDKYGEKCECDLDKYGVSSADELVGLCREHNKAPHNKAPICSGKGQCSCGKCQCHANYLSLSGRYCECENTNCPLSVEGRMCA

SEQ ID NO: 137101 - protein, 131 aa, Heterodera glycines
  Coding regions on vcDNA: vcDNA=SeqID_63524; Strand=-; Position=1 -102,552-845
MAETDAIAILCDPDIKLNAGVGRAIRNTGGQDFMKIQIVDTNDFHMRSLHKFIIAKLRAQSQLQNGSSASSNSENNQSDDSRLTVSTPTGNTDSEQSFRLVGSGTSQSPIELFCSTGAGPGRNLREFYLIN

SEQ ID NO: 137102 - protein, 115 aa, Heterodera glycines
  Coding regions on vcDNA: vcDNA=SeqID_63525; Strand=+; Position=1 -186,237-398
MSSAKNKKSIENVIISVRNEFGYLNQLWDTVYMDLPTREFRVEEACEFMFNLLQVIRKSEEKVVRNIVSDLEIRREAVTNLRKFLGLPSFDESLFPPQSIALVPHIFSNILTAFF

SEQ ID NO: 137103 - protein, 43 aa, Heterodera glycines
  Coding regions on vcDNA: vcDNA=SeqID_63526; Strand=-; Position=1 -95,147-183
MIAEPEVPSATNVDNDGNGDEQTKNDQPVIYSPDDQPIELQFS

SEQ ID NO: 137104 - protein, 115 aa, Heterodera glycines
  Coding regions on vcDNA: vcDNA=SeqID_63527; Strand=+; Position=1-524
NISIQTSDNPKIFYRVFASDKMPKLKDRHFPYCFVANTDRAGTIGEHWVACFVNSPTEIEYFDSLGDYPNEDLSSYLNLFERILINDRIVQHQFSDACGQFCIYFLTQRCSGIPY

SEQ ID NO: 137105 - protein, 850 aa, Heterodera glycines
  Coding regions on vcDNA: vcDNA=SeqID_63528; Strand=-; Position=1 -205,252-807,851-1113,1141-1350,1398-1673,1720-1919,1964-2399,2438 -2509
  Homolog annotation: Hit_ID=NP_001004509.1; Match level="QueryCoverage= 96%, HitCoverage=52%, E-value=2e-85, Identity=28%"; Hit description =si:busm1-180o5.3 [Danio rerio] emb|CAD60788.1| novel protein similar to DNA polymerases [Danio rerio]
FGETCLLMPVKLESLKATFNLDCEDKPFFPYYYNKKENYGIRLEHLLPMEDYSPGSMNKDKFIKFEKWYNENKETPFYLDEELRNYCRYNENKETPFYLDEELRNYCRNDTEILLLSIIEFRRILINDITKGFDPLPRSCTNAGVAMNIFKAMFLLTEQLSIVPEKGYERCDRASVMAIKYLEWRSKRDGIEIRHAGNGREVKIGNYKLDGFIDNGASDKCIEVMGCYIHGCLNCYDPAAELIGGRTAQELNDESQVVELRKTLDVEEVWGCQIEKELKKDEEMRGCQIEKELKKDEEMRDFFDDRGREGADDPRMAYEGGRTGPMKLFAKSDEKKKISVYDIVSLYPSVNYGTAYPIGLPEIILPKSDEIDKYNGLYKVRVNPPRGLRVKYNGLYKVRVNPPRGLRVPVLQLKCDERLLFPLCWRCVSKFKKETTRCNYKCPHDGAQRRYVATYTSVELAKALECGYTVDRAKALECGYTVDRFYRAWHYEEEANDLFKGYVRLFLKLKEEASGFPKGVETGEQKDMWREEYKEKYGIDIELAKVKKNPGLRYISKLMLNSLWGKFSMGKFSMRNCLNKNAVIDRASEFYKIACDHKIELCDIVEYSEEAIRLIYRDKEDFVMEHKSSNIVISLWTTSMARLKLLELAESHGGEILWTTSMARLKLLELAESHGGEILYTDTDSIFVLHDRDVEPITTGKFLGEMSEEGGHEIEEYCCGGAKQYALKMKNKQTGETEYVMKIRGITFDVDNRKTLHYDTFREMVLSYGKGEVDPAFFVYKNDFGYVFQTFDSLKNQYLHKMYRPVCQKGIIDEELNVMPFGFQYLHKMYRPVCQKGIIDEELNVMPFGF

SEQ ID NO: 137106 - protein, 33 aa, Heterodera glycines
  Coding regions on vcDNA: vcDNA=SeqID_63529; Strand=-; Position=1-111
RKELKKRISALKFFHLDVTFRHYKSLFWGFVTK

SEQ ID NO: 137107 - protein, 34 aa, Heterodera glycines
  Coding regions on vcDNA: vcDNA=SeqID_63530; Strand=+; Position=1-105
YCSSINIYLLIVFLKPSDRTIGAVTKIWTLLTSS

SEQ ID NO: 137108 - protein, 68 aa, Heterodera glycines
  Coding regions on vcDNA: vcDNA=SeqID_63531; Strand=-; Position=1-204
MDLPFVEIDERGVERHYSRAVVDEWGLRRAFRNERRKNGAKHEMVDKKHEKLALRNAAKNNEIAQYTK

SEQ ID NO: 137109 - protein, 241 aa, Heterodera glycines
  Coding regions on vcDNA: vcDNA=SeqID_63532; Strand=-; Position=1 -369,427-716,777-843
MGTKLTLWPYRTEKDQSIWDVFVREIWPIFAPNIRHLGFHDGDYLDKLRRRTSPTILTDLDQLNAIDSGFLFPEGIADFDVLNPTAAQALTKWLHTPSKNGQPKRLYYFNSPRNLGWVNSFKEAFRRATTSISYKIRFNLYLEPMPIEPFELVNKRTKEKLTLTKEIDEFDVNVCNWLLQRCPIGETATVPAIKWKDSVNPSANLNNVTFDLWSFDKSIGPLSPPTEEEKEEADQSNGNVI

SEQ ID NO: 137110 - protein, 104 aa, Heterodera glycines
  Coding regions on vcDNA: vcDNA=SeqID_63533; Strand=+; Position=1-315
MKLCLLFFLIVEIEIGAEKKKVQQKTFEEIFGEKWEEKENEQKKRDKIELKIGKKLGTNRNKIYKWIKELGIYKKWHNKSKTDVQKIEIVQKFNAMKNEYKQNG

SEQ ID NO: 137111 - protein, 82 aa, Heterodera glycines
  Coding regions on vcDNA: vcDNA=SeqID_63534; Strand=-; Position=1 -88,213-373
MKAKNEKSVQLKLEVPSPPPLPNEFELKNVFGISPNPLRQKNCTKDIQSQNADVQQQYDDLEMQFMIQSTIGMLNEFEDENE

SEQ ID NO: 137112 - protein, 45 aa, Heterodera glycines
  Coding regions on vcDNA: vcDNA=SeqID_63535; Strand=-; Position=1-135
MALNWTFRKECVIIFVMNLVNYVSLMAMVHFLYSRRAKNRKRYCI

SEQ ID NO: 137113 - protein, 83 aa, Heterodera glycines
  Coding regions on vcDNA: vcDNA=SeqID_63536; Strand=-; Position=1 -16,67-302
MQRSTKTAILKLGGSRRADPFKSNRFRVSPMLFKSDSQISRLGTSFHLDKNLNSHVFSPTVKLIKKSLLPIKLMSPNNGLKTQ

SEQ ID NO: 137114 - protein, 132 aa, Heterodera glycines
  Coding regions on vcDNA: vcDNA=SeqID_63537; Strand=-; Position=1 -117,213-408,663-745
MVSDQNRIIFNLRSQMIDQRAVILQNLSRIERLECFASNNRGGRGNFRLRYNPMAAVELTLLGNRLEDRARRHRVAIGASTSASTVNEANGGEHGEGSSAQNQNVPSFGPTIERHMERSRHRLLHDEMVQRS

SEQ ID NO: 137115 - protein, 78 aa, Heterodera glycines
  Coding regions on vcDNA: vcDNA=SeqID_63538; Strand=-; Position=1-234
MPIQTKREMETPNEQQQQNCNEAIELPCVNEKGGQSNGSERPKQTIKRKPQQMAKGEECDLLSDEFLFENGNSIDLEW

SEQ ID NO: 137116 - protein, 243 aa, Heterodera glycines
  Coding regions on vcDNA: vcDNA=SeqID_63539; Strand=+; Position=1 -310,369-428,485-573,616-758
  Homolog annotation: Hit_ID=AAC38987.1; Match level="QueryCoverage =99%, HitCoverage=15%, E-value=3e-66, Identity=56%"; Hit description =P-glycoprotein [Haemonchus contortus] pir||T31073 multidrug resistance p-glycoprotein - nematode (Haemonch
MLGRSGEALTKTLRTEAFRNLMRQDIAFFDDERHSTGKLCTRFATDTPNVRYVFTRLMVVISSVVTLLGAIAIGFVNGWQLALILLAIIPLILASGYFEMQQQFGKKMRDTELLEDAGFGKKMRDTELLEDAGKVASEAVENIRTVQSLNKQLFAVENIRTVQSLNKQLFFHRKYASLLSAPHSANMHQVHIYGFVANMHQVHIYGFVFAFSQSLIFFMYALAFWVGSLFVLNGIMRPASVFR

SEQ ID NO: 137117 - protein, 162 aa, Heterodera glycines
  Coding regions on vcDNA: vcDNA=SeqID_63540; Strand=-; Position=1 -18,148-615
MHVWLLENIDYSANGTEGVQLENVEEVRRGGFFRQNIYGIYKLMSIFVYAYNNNHLMMAKRINWTNESIQKKEQNEEDTQNSGEQQQREEEKDDEMAENNWEKGEEEEEGGRGNGGEEDPIEVLLKDIFGGHGGTAAVAAETAAEEEPTTSGEMQQNATNEK

SEQ ID NO: 137118 - protein, 86 aa, Heterodera glycines
  Coding regions on vcDNA: vcDNA=SeqID_63541; Strand=+; Position=1 -31,102-214,257-288,583-667
  Homolog annotation: Hit_ID=EAL28989.1; Match level="QueryCoverage =75%, HitCoverage=18%, E-value=4e-10, Identity=38%"; Hit description =GA11309-PA [Drosophila pseudoobscura]
MARIVHNDGTSNLFNQIPSIPVDNELECAICLDQIGAGILAKRMPSCEHIYHENCIITWFRVGHNTCPICRQQIIEMPMIQPQNGP

SEQ ID NO: 137119 - protein, 55 aa, Heterodera glycines
  Coding regions on vcDNA: vcDNA=SeqID_63542; Strand=-; Position=1 -58,566-675
MPGPGPGPGFHVGPGPGFPGHILAFSDFYFILYNFFDIIYVVLNTLSIMDFKFYI

SEQ ID NO: 137120 - protein, 71 aa, Heterodera glycines
  Coding regions on vcDNA: vcDNA=SeqID_63543; Strand=+; Position=1 -12,313-516
MFLFGITKSKTGGEFAHYVPCNFDISLLSIEKAAIPHHLKTEKHKKAAKAANSALAITAFMPSKSAPTEEG

SEQ ID NO: 137121 - protein, 78 aa, Heterodera glycines
  Coding regions on vcDNA: vcDNA=SeqID_63544; Strand=+; Position=1 -124,482-594
MKKELSVNGDKRPYGEKYKEICAKLGASSRSIYKWKRKFGFNCDAKIKVCPHSEAINVFSDLSQSTQRWRKAVRFQSM

SEQ ID NO: 137122 - protein, 78 aa, Heterodera glycines; identical to SEQ ID NO: 128403
  Coding regions on vcDNA: vcDNA=SeqID_63545; Strand=-; Position=1 -86,158-308

SEQ ID NO: 137123 - protein, 213 aa, Heterodera glycines
  Coding regions on vcDNA: vcDNA=SeqID_63546; Strand=-; Position=1 -150,509-574,664-802,1272-1378,1442-1618
MPNGTQELRFDIFLLEHWFVIMVSGKQLGDVFWPNEWWHGEAWKNITAIRLNGQMLLLYGPELDAYGIENENFKFSVPLPFSTGINGLHENSSCFFRVQMLNVYEAKLLIVNFTNDKSASDLATFSIILGKSFNNDTSFNNDTIVFEVELRVFYDGKWLENEHRNATITFKNISVLELFFGITNGNDVIKLNGVQMFEEYSNSAPYCDMKKIE

SEQ ID NO: 137124 - protein, 75 aa, Heterodera glycines
  Coding regions on vcDNA: vcDNA=SeqID_63547; Strand=+; Position=1 -97,160-290
MISAKVENILCNKSVMLSEINSIGFDMDYTLAGYISPNTEELIFKLCIEYLQKHKGFWIEAIAFCVIEQRMAENS

SEQ ID NO: 137125 - protein, 40 aa, Heterodera glycines
  Coding regions on vcDNA: vcDNA=SeqID_63548; Strand=+; Position=1-122
MYPRNMVQLNGEVKVMNTFYDLPETDLLSQLVHLFDKNSG

SEQ ID NO: 137126 - protein, 182 aa, Heterodera glycines
  Coding regions on vcDNA: vcDNA=SeqID_63549; Strand=-; Position=1 -180,255-366,831-1087
HSDFKRWKIIVAWILPIILLNFNLLFALKSTENDTYTILVSSSSEERVKCQYNYSLHEAYYFFYWPRSFFTFLLPTLVVLVANLTIIIKLRGRSILTGNVNSSAVARANNVVLFAIPVVYIVLNIPYSVRSLMKFVMDSVSNEKLYQNHYLLYAGSFYIYCFNFSVNFIIYALSRSESKNKI

SEQ ID NO: 137127 - protein, 55 aa, Heterodera glycines
  Coding regions on vcDNA: vcDNA=SeqID_63550; Strand=+; Position=1 -84,154-237
MRFALLEEKMALVRLLRRYSLAKNEQTEKFLKVNSQVVLNPGAVMVQLNLREENF

SEQ ID NO: 137128 - protein, 218 aa, Heterodera glycines
  Coding regions on vcDNA: vcDNA=SeqID_63551; Strand=+; Position=1 -426,594-731,776-865
MAEASSNVTEISGTVIFAAYAMAFLELGTLIPTIPILAFCSSIVYKTSILHRNLKGILLAQLFGIFMSLWPRVFLLVDKIFVTKNFFLLVPNFIAGASTAALTFINIVGHVLIVERICATVYVDTYERYRSWAFTVVWLSITLSALKIILSLGLTIYQTLVLDSMFSLTNIFVGIYNGAMIASLIEIFLFSIITKFNQKMFDLRQGNCKNQQLSVRYQ

SEQ ID NO: 137129 - protein, 180 aa, Heterodera glycines
  Coding regions on vcDNA: vcDNA=SeqID_63552; Strand=-; Position=1 -170,215-331,382-477,528-629,1099-1156
  Homolog annotation: Hit_ID=NP_112614.1; Match level="QueryCoverage =88%, HitCoverage=22%, E-value=6e-53, Identity=60%"; Hit description =prolyl endopeptidase [Rattus norvegicus] dbj|BAA25544.1| rPOP [Rattus norvegicus]
MFIVLQKGVKLDGSNPAILDGYGGFGSSQTPYFSVTRLMLAKHFGIVSVIANIRGGSEYGEKWHEAGMLDRKQNVFDDFIAAADFLISEKYTNNKKLAIHGGSNGGLLTAVCSQQRPDLFGAVVTRVGVLDMLRFNKFTVGAAWATEYGDPDKPDDFSFIYSGCSNSNGRRFDFVMLCKT

SEQ ID NO: 137130 - protein, 165 aa, Heterodera glycines
  Coding regions on vcDNA: vcDNA=SeqID_63553; Strand=+; Position=1 -151,508-687,737-891,1353-1364
MASETTPSSLPLPNSSQSIYPLTTQSETAAVCFSSTSSPKLAVYNNNHSVKSLQPPQKRIKTAILAKKLLAAAADSNLIDSIGVGQPNGNGTPKRMSSDEHFGNENLSIFEGTQRETEGIGEGLFEEDEEETEEQEERELDERPDGGRTDAATSVVVQEQKKNNN

SEQ ID NO: 137131 - protein, 58 aa, Heterodera glycines
  Coding regions on vcDNA: vcDNA=SeqID_63554; Strand=+; Position=1-176
MARIAAETVRRTIESKQRNGGSAPPGQRTHSDDDAKRSDKNGGSAGTDGRKADTFHNG

SEQ ID NO: 137132 - protein, 21 aa, Heterodera glycines
  Coding regions on vcDNA: vcDNA=SeqID_63555; Strand=-; Position=1 -63,241-243
MATKRTALASAATTTVHDQNL

SEQ ID NO: 137133 - protein, 139 aa, Heterodera glycines
  Coding regions on vcDNA: vcDNA=SeqID_63556; Strand=-; Position=1 -132,187-471
  Homolog annotation: Hit_ID=CAE61818.1; Match level="QueryCoverage =67%, HitCoverage=37%, E-value=1e-11, Identity=46%"; Hit description =Hypothetical protein CBG05788 [Caenorhabditis briggsae]
MEHCFHLAKIERRHRRADSETNKNIPSFLELNLNNNTYEQYKTNFSAADGNVTTNSTNNYSNNKKATTEFDIEKPPVFKTKTEENAFRRKEVEEKRKKEEEEEQQKGKKEEKKERKMGQEKEENPKSEEEQKKKNEEQK

SEQ ID NO: 137134 - protein, 132 aa, Heterodera glycines
  Coding regions on vcDNA: vcDNA=SeqID_63557; Strand=+; Position=1 -181,226-441
MSLIELLAKTTSAARAVKKRQRLQKRPKPWLNCFNTQTSLQQIWKINVRAPPLLTIFYYYFTSPTTSKNDGPPTADGFTFTAAAQEECPSSSSSKSIATLITDRFRPNRGTFYRYTPAPVVTPAVVHKLLLN

SEQ ID NO: 137135 - protein, 2721 aa, Heterodera glycines
  Coding regions on vcDNA: vcDNA=SeqID_63558; Strand=-; Position=1 -750,903-8318
  Homolog annotation: Hit_ID=NP_508324.1; Match level="QueryCoverage =48%, HitCoverage=48%, E-value=1e-142, Identity=29%"; Hit description= predicted CDS, peptidase family A16 and RNA-directed DNA polymerase and Integrase, catalytic domain and
MSGFLRTKIAIELKALEKAKTATELYAEPDQTLTSLENAILLESAAERIKSEVEAVNAKIEQIWITASKWHDVIQKMDKDERKSEQTAYEQFQTTEKLNTKMEAANTKLTELKDLEMKVEAGAKLQRSKADRDARVEQREHAKAMAKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEYKKLYKPFLREILEEKAKNPDFWDTSSLRKALGSALSKELAIKEVMREYGFEGKEANPEHGFKRQLRRNRFGGSVNVATTHFGKPNGERRKIPEQKMPSPRQGQRSFQQTPQNSAFRERKGQGRSPKIQRNPTAVNTQGELFLCVFCGGKHRHDSCEKARTVQQRFAVLQEKGLCYKCLKSNHIGRNCPCPMKCFKCQQAHPTALCHQTNNPQRATEWRNMANKVMNVRKEEKPDKRDEFKEVSFTPSQCNSVQGNSRVLLRTAEVTIFNPSNPKRSMVASVFVDDGSERSFIRANVAKQLGLPVIETEECHLTGFGEKEAKRYVSNVVRVGFLGVNGDPYICALNEMEFIVKAMPIVTLNSMDEAELSKKKLSLPSRPRQPDILLGMDVRHDLKIRDETEKLPSGFTLSTSRVGRMISGYGQVQGPMDMSVQVTYTGALISALQCANSRRDADEEIEEQIKTFFGLNIIGLSDNPEENDKEEVMRTFRKSLTFKEGRYECGLPWNERVKDLPTNFQQARARLCGTVKKLRELNLVDEYQKIFNEWERNGIIERVPDPTQTTGPVHYLPHRPVIKMDKATTKIRIVMDASAKPANRKGAPSLNECLHTGPLLLNELTGILLRWRRMKDLILADIEKAFLQLSVREEDRDATRFLWLEDPQKTEISSPTYVRTVVFRFCRVSFGLTTSPFLLNATIREHLSFYDTVLPQTIMENLYVDNILINVKKNEDMAQICHESIELFRQGGMKLQEFFCSKPIAIRSLPAELLAKNQKEIKVLGIPWTNEDDEICFRFKKFAGKHTKRNILAHIAKIYDPLGLVAPAVLPAKHFLQKRFEAKNGWDEGLEEELIHEWNQIMETWQTKEGTEVQIRFARRVDNEDEVDKEMHCFADASGKGLGVAIYIRESTEKMSVNLVFAKSLVKPSNISDVAATIPKMELQSITLGVKLLKYVLQHLKLKPTQTTIWTDSLCSVERIKEHKKCDRFVSNRLAKIRGQFEVKHLVSADNPADVASRGTTPRELSRNLLWKHGPKWLSEEKALWPKPAKVYHPDEEKLRGSAEDEEVKTAAVMNEVPFQPTIDVNRYSSWKKAKTVGAYVLRWIHSVAKNGYNGNLLPILSKMGPKKHGNQDKGVLSVPELCASEHLLIWEAQRQFPTEEKTKENLRLFKDKEIWRCRGRIGEATVKEDTKFPIFLPPEAWTTKLIVLEAHWKMKHPTHSTLLGYMREKYWIPKGRRFIRNTILSDRHGCLNCRKERLKPYAYPQMPNLPSERVAMIRPFEKTGVDYFGPLTIKGGVKVYIALYTCLVIRAVHLEVADDCTATEFLRTFRRFSSRRGLPSLMWSDNGTNFIAGAECIKEEWRREILVETSHSGVSWKFNVPRAPWQGGAWERLVGITRSALRRTVGKSLMERQEFDTLVCEIEAVVNTRPLTFQSEEEFTQPLRPVDFLLPYKRVETSLPLSDEDPMDPDYTYQPRKRGELHQLMRVAIKRIDRFWKQWKTEYLLSLRERDRTNRAEGSLPREGDIVLVEEEEDPRSIWTMGKVEKLLKGRDGLVRTARVHTKGKTLVRAINLLYPLEINTSAEDEVSQIQVTAIMDSPSAVMEGGDPQAATTESSLPPGTVMQDSQIVTTESSLSPVRGRKERQAVKERRIRKRQPTEEVRGKGKSKKNGPYDPLRPGNYRIPRRNPFFPSQVAYNEQTRTYRRRRGRTIDLSGLRKLFAGLGGTEFVRRELQEKANPALREERLRKDKVKFMEDDARRVAESERKAAEEKLEKSMKDSQRQTNVESSSGGTTRNPFEPMEVLPGDPEPEVPLEELARQEKFDREMALEQRKMYEKRRAERNAEKDRRRWGLPRGMVRRKGHYAPHQGINKRQKWHRGRHINEIQTGRKYRHPRAHDISPLRQPNGATTELLALSSEMEGQIRNDKRARDESQSKEPVRSQRRFKARDPLDEQLKRRQKGQQAEENPGRIKLAPASPGYRRTINYSLFTRCEPGVKGHEGCQRNCTMGSLSHGRLTKIPQAESKAVCLAQAFAFDWLGRMHAKKFNENWCALLGSGSEIEDSLKNWWTKVLQNNEKTIPQKQLECVLMAWDNSCQVFGQEWKGKIYGPVGLEEVPVKTNVISAEAQFESWLRNLTERFGQTLTKLRAKEYWKDCHLQSKRVLVVSNQEAAELVAKEFEEEGSSWFVHFGDKPLREKMFPANWNIKIIFNLELRREEREELEVFKEDIKDIARAGLEVHLATRKNARLPREFEEFAEMQGCGIYQYEKIGELAAAIRGTPANTGTNPESGESAQKSTTGWRRAVTKSLTGLTMLVMLLITLLQPMMINGQVIRPERNGRWIPVNPFGRPLRMEELVGFTEPTVPRLSLDKRGQITPTLPTTAADMSIAHIREWYKKARMQTSGTTQTSAATTTVRTSTSASTEMTTLRTPETTVTTRTTTKTKGVTTQPQRKTTNQEPRTDSRRRQWTQTPSRRWTDQI

SEQ ID NO: 137136 - protein, 45 aa, Heterodera glycines
  Coding regions on vcDNA: vcDNA=SeqID_63559; Strand=+; Position=1 -56,577-631,845-871
MRGGNAKGKMAQLGGTKVGCCICNKIVDEPQHTKLFFVLYLQQNC

SEQ ID NO: 137137 - protein, 101 aa, Heterodera glycines
  Coding regions on vcDNA: vcDNA=SeqID_63560; Strand=+; Position=1-306
MSNPPNPPNSPYHFLKEFQIPWQPPSRSPSPLPCPHQPPSTPTGATTPPGCEPLITWPPEDWSPEECMQTNNFDLLWNSKINIGSSSQCMPEEPQIVQTDV

SEQ ID NO: 137138 - protein, 62 aa, Heterodera glycines
  Coding regions on vcDNA: vcDNA=SeqID_63561; Strand=-; Position=1 -77,1150-1261
MAVRSILGNYNWSEVSFVYTPDDQRIFAFIIGSMRGLGMTQPGEQFFKQILETIIIANRIVY

SEQ ID NO: 137139 - protein, 78 aa, Heterodera glycines
  Coding regions on vcDNA: vcDNA=SeqID_63562; Strand=+; Position=1-237
MHPQFSAPIHHHLITGTQPTNIPINGTQSTNISITGTQSHQSFSNTITGTQFSDISITGTQPQQRNTELFKRNPEIEI

SEQ ID NO: 137140 - protein, 154 aa, Heterodera glycines
  Coding regions on vcDNA: vcDNA=SeqID_63563; Strand=+; Position=1 -75,563-704,1303-1550
MTDITFSSQETLSWQIGYFVFTFCTLGPSSSASGSTSSSSADSEAMVAPKSNGIEAPPKISEPFQLAHTANGVNGPFHPCKLLNEPPIVMLGDGISCSAIGGGAGCVAGSARRRSRSPGARRNAHSVQQPQPIRAAQQLQHQQQQQQYHGANNG

SEQ ID NO: 137141 - protein, 143 aa, Heterodera glycines
  Coding regions on vcDNA: vcDNA=SeqID_63564; Strand=+; Position=1 -111,216-351,394-518,565-624
MPAETANSNSNVNSSATANNNAISTHMLREKNSDEAMSVLEFAFGVSIDDNNGIAQEFSSSPELLLQLQDSVRTILTSLCLKTDEVSQSLLLDELIFTAVNLIKPSNGFSSSNSIPNSDDSLAVPLIISLEHGNDANVCSTNR

SEQ ID NO: 137142 - protein, 256 aa, Heterodera glycines
  Coding regions on vcDNA: vcDNA=SeqID_63565; Strand=-; Position=1 -203,383-443,499-769,818-851,907-1069,1180-1219
  Homolog annotation: Hit_ID=NP_497505.3; Match level="QueryCoverage =93%, HitCoverage=20%, E-value=4e-30, Identity=35%"; Hit description =actin-binding FH2 (123.9 kD) (3D239) [Caenorhabditis elegans] gb|AAK29921.3| Hypothetical protein Y48G9A.
GLKVAQNAAAQAKLAEQQRQTANSTQKTTPTTQTTPTVTAAKVGKEKVREQRDSSKQRTTQQTDKEMDSVDSASVNSAPRTNPSQQQAPPKKAVAPPPPPPPPPPPLFVQPKKVVQNGPKAAGGMPPPPPPLGLFVSTAEAVPKKKIAKIGSKMPMINWTALNPNQVKGTVFNNMNDEKLAEELDLSKLEAMFSLDEKKPSSESQQQNVDANAAVKPRGQPSPNATVNCGKNTVLSTKRLQNIAIIRRKNREKGNG

SEQ ID NO: 137143 - protein, 74 aa, Heterodera glycines
  Coding regions on vcDNA: vcDNA=SeqID_63566; Strand=+; Position=1 -75,122-270
  Homolog annotation: Hit_ID=AAD41086.1; Match level="QueryCoverage =94%, HitCoverage=7%, E-value=5e-21, Identity=64%"; Hit description =ubiquitin-specific protease homolog [Homo sapiens] sp|Q9Y4E8|UB15 _HUMAN Ubiquitin carboxyl-terminal hydrola
NSSSNDLMRGVCGLQNLGNTCFMNSAIQCLSNVPELTTYFLEDNYVDEVNTSNPLGTGGRLVKQYADLLKDMWS

SEQ ID NO: 137144 - protein, 218 aa, Heterodera glycines
  Coding regions on vcDNA: vcDNA=SeqID_63567; Strand=-; Position=1 -121,287-339,587-723,1162-1276,1748-1978
  Homolog annotation: Hit_ID=CAE71503.1; Match level="QueryCoverage =66%, HitCoverage=37%, E-value=3e-40, Identity=54%"; Hit description =Hypothetical protein CBG18435 [Caenorhabditis briggsae]
MGTELLRSLVWERQCPDEFGMYRYKKYNVHRLIVRFYVFIGYFFLGICFNQLMVDIAKYTIGRHRPHFMDVCKPATQMPIRSPDGSTQMVLKEYRSNCPAEEHSYVTDFECLGDNKYLIHESMLSFYSGHSAFSFYAAWYTANYSIFCCFFVPVVFASTHLSSTGQQIGAACCPICAVRRCRVCGVHAGQQLQTPLVRRVGWHTDRLSDRPDQCMCIW

SEQ ID NO: 137145 - protein, 208 aa, Heterodera glycines
  Coding regions on vcDNA: vcDNA=SeqID_63568; Strand=+; Position=1 -96,402-615,1152-1249,1370-1501,1557-1643
  Homolog annotation: Hit_ID=NP_494886.1; Match level="QueryCoverage =89%, HitCoverage=35%, E-value=3e-66, Identity=63%"; Hit description =phosphoglucomutase (61.8 kD) (2F181) [Caenorhabditis elegans] gb|AAA83163.1| Hypothetical protein R05F9.6
MSTTLSTPFIPSTVQTKPFAGQKPGTSGLRKRVPEFQQPNYTENFVQCVLDGGLGEAKRGAVLVVGGDGRFLCPQAVNVIIKIAAANGVRLKKTHLGALGFSDGGIILTASHNPGGPKNDFGIKFNCENGGPAPDNVTERIYQLSTNIAEFRICPNLDIDFGQIGTTIATIEGIGQFVVQVIDSVQDYADYMEKIFDFPKVLDSKWAI

SEQ ID NO: 137146 - protein, 35 aa, Heterodera glycines
  Coding regions on vcDNA: vcDNA=SeqID_63569; Strand=+; Position=1 -61,372-415
NGWPRNRRDSPSDNALNSRRRPECSAPSNTFGQQQ

SEQ ID NO: 137147 - protein, 18 aa, Heterodera glycines
  Coding regions on vcDNA: vcDNA=SeqID_63570; Strand=+; Position=1-56
YREAIPEGFGLPINLGAS

SEQ ID NO: 137148 - protein, 18 aa, Heterodera glycines
  Coding regions on vcDNA: vcDNA=SeqID_63571; Strand=-; Position=1-67
LIPDHNYYSLIMSAWANG

SEQ ID NO: 137149 - protein, 34 aa, Heterodera glycines
  Coding regions on vcDNA: vcDNA=SeqID_63572; Strand=+; Position=1-105
CPFGVLKQLWGAKIQRRIKVQAIGKLFPKDSVSP

SEQ ID NO: 137150 - protein, 28 aa, Heterodera glycines
  Coding regions on vcDNA: vcDNA=SeqID_63573; Strand=+; Position=1-215
AYQNSSNLALSILIQIAPNFFYSLTRPY

SEQ ID NO: 137151 - protein, 86 aa, Heterodera glycines
  Coding regions on vcDNA: vcDNA=SeqID_63574; Strand=+; Position=1 -128,216-348
MKDNEFWIKGVSIRGKGADEPDDGDKAEIWRDLVPMKKCPKNRKSLFKMHYLNVIQEILNFQFAIESCLKFAHLNMSMGIIERKSI

SEQ ID NO: 137152 - protein, 33 aa, Heterodera glycines
  Coding regions on vcDNA: vcDNA=SeqID_63575; Strand=-; Position=1 -18,103-186
MYHGQIQLPVQTTTTTTIATDTKTQPNVNPVRF

SEQ ID NO: 137153 - protein, 58 aa, Heterodera glycines
  Coding regions on vcDNA: vcDNA=SeqID_63576; Strand=-; Position=1 -92,465-549
MAIMATVWKTKAPNPVIAVRPITTLNVVWDKQTAATELQPSPTTTTVFYHKIYFITKT

SEQ ID NO: 137154 - protein, 93 aa, Heterodera glycines
  Coding regions on vcDNA: vcDNA=SeqID_63577; Strand=-; Position=1 -48,296-433,635-730
MLSFVVFLLFAVGLAQLPSGIVPACRETVEMFCQCGAVCVPKAGWAGDKCCPDGFSILCGCPVKERNGSQTIGQLTIRQRTIRQKWIRLLDSE

SEQ ID NO: 137155 - protein, 229 aa, Heterodera glycines
  Coding regions on vcDNA: vcDNA=SeqID_63578; Strand=+; Position=1 -107,154-318,389-694,758-785
  Homolog annotation: Hit_ID=NP_492638.1; Match level="QueryCoverage =99%, HitCoverage=22%, E-value=2e-83, Identity=66%"; Hit description =eukaryotic Initiation Factor (103.8 kD) (eif-3.C) [Caenorhabditis elegans] emb|CAB03403.1| Hypothetical p
SIYHHALHDRWHKAKNLLLMSHLQALVDHSDASTQILYNRTICQLGLCAFRHGFVRASTQILYNRTICQLGLCAFRHGFVREAHQNLSEIQNTQRAKDLLAQGIPPRQSEKTAEQELKELKERSLQVPYHMHINLELMECVYLICSMMLEIPNIACYEYDVRRRLLSRSFHYQLKFSEKAALIGPPENTREHVVAASRAMLRGEWIKCRNYIINDKMNAKVWNLFRNSD

SEQ ID NO: 137156 - protein, 182 aa, Heterodera glycines
  Coding regions on vcDNA: vcDNA=SeqID_63579; Strand=+; Position=1 -421,463-590
MAFSEDPLIKIEEDNPRADASTHNLPTNEKLLPQNNHFASNVLKAQTDWHSQTEQQQYQIINFVDNNAPPHSELTSSFNDFADLLSNTKTNDVVPDFGMTQMRKIEPKHFNEPKILNNVTHLNQTAASQVSNNSKQFHELGMYVAKLLSKTPQNGIAEAIRLKGQIFSMCTSKQIDLMSESM

SEQ ID NO: 137157 - protein, 65 aa, Heterodera glycines
  Coding regions on vcDNA: vcDNA=SeqID_63580; Strand=-; Position=1 -83,136-249
MRLIRMKLNSLEKGKMDNAYDEAVKRVQSLDEMRKKLEDLKCNMENGETEASGEGTTKAQLELEE

SEQ ID NO: 137158 - protein, 145 aa, Heterodera glycines
  Coding regions on vcDNA: vcDNA=SeqID_63581; Strand=-; Position=1 -105,310-489,574-726
MDLDPKAHATLSDMTTQDKLGMARELIDRINKGDLYSNRALVSKLIESYDGLMAQEKEFIALMRDIIKSYHEAIDAVTSELNSIQQSQQKQQIAENNVSTQLDGLVNGFTSLENMVTEMEKTSLMDEQFKICIELHYEQVKKHFV

SEQ ID NO: 137159 - protein, 526 aa, Heterodera glycines
  Coding regions on vcDNA: vcDNA=SeqID_63582; Strand=-; Position=1 -178,225-466,518-783,829-1031,1080-1265,1321-1426,1727-1985,2128-2270
  Homolog annotation: Hit_ID=NP_499558.1; Match level="QueryCoverage =96%, HitCoverage=73%, E-value=1e-122, Identity=44%"; Hit description= TOPoisomerase (85.4 kD) (top-3) [Caenorhabditis elegans] gb|AAC13567.1| DNA topoisomerase III [Caenorhab
TFQGISQTFVFTSVTGHLMNYNFHESYKQWVESRIYDLFEGQVVLDIDSGMRDIETNLKRESRKAHTLLIWTDCDREGEFIGNEVVKVCRKENSLLTVRRARFSEITDQAISRAIQNLTAIDQNWVDAVDCRMELDLRIGAAFTRLQTLYLKKNFYQFLRDNDPKSVISYGSCQFPTLGFVVERYRENKEFVSQEFWKLSGKDGSTNIEFLWEREGLSTQLFDREAILALYEACTAVVHSARVKEVDSHPKTKWRPPPMDTVQLEKLGSKFLKMNVKRIMESAEKLYQHGLISYPRTETNCYSADFDLDSIVNRLTENDQWGDFAMNDVQMCGGAKPRNGRKSDKAHPPIHPVKNANRNEIASMDEWKVYELVCRYFLASVSRDASGRETKVKPPPLLTEADLIALMDKKGIGTDATHAEHIERIKFRKYVVLNNANRFEPTKVGLALINGYDRMEHRHKVSKPNLRAELEADLVKICEGAKTKQTVLREQINIYKELFRNTELKVHKLGESLRAIYQQNNNGLIR

SEQ ID NO: 137160 - protein, 17 aa, Heterodera glycines
  Coding regions on vcDNA: vcDNA=SeqID_63583; Strand=+; Position=1 -39,295-309
MEKACKIWRDYIDNYWS

SEQ ID NO: 137161 - protein, 96 aa, Heterodera glycines
  Coding regions on vcDNA: vcDNA=SeqID_63584; Strand=-; Position=1 -253,294-331
MPNKNEIVVKYSFLDLTWFLMIEAVFYAISKTVIPNREIFESGFQKKCLVVKTIFHISLHNFVSSARIETGIRPLERAARALQEEIRINSPMWPKF

SEQ ID NO: 137162 - protein, 120 aa, Heterodera glycines
  Coding regions on vcDNA: vcDNA=SeqID_63585; Strand=-; Position=1 -243,399-516
MAPKVCADGIIGSDDSEHTLPTGPTHPLEEQLDTQTVEQRRAVLELVVSRLLFFVGEVVLKFLSYAECTFSVHIKDTILRRGLNTPNPKRPPSRHSELNFENTNKNNNGDEGGNDDELCQ

SEQ ID NO: 137163 - protein, 89 aa, Heterodera glycines
  Coding regions on vcDNA: vcDNA=SeqID_63586; Strand=-; Position=1 -95,351-524
MEMEMMQRSQNAKLAAVRNLHDFLLNGPKEPRSTKDQKRVGRIQKALLANFVSPFSRIVSAKCRKSDQKWAERHTEAKGGEGAAENDER

SEQ ID NO: 137164 - protein, 168 aa, Heterodera glycines
  Coding regions on vcDNA: vcDNA=SeqID_63587; Strand=-; Position=1 -93,275-352,560-731,784-947
  Homolog annotation: Hit_ID=ZP_00195689.2; Match level="QueryCoverage =97%, HitCoverage=97%, E-value=1e-26, Identity=35%"; Hit description =COG1926: Predicted phosphoribosyltransferases [Mesorhizobium sp. BNC1]
MSVHFIDRQDAGQKLYKALAQLDLQQQRDKIVRKIGAPDNDDSAIGAIAEGLARPILTYFGEHRTPIPLDGRVAIVVDDGIATGATARAALAVLRHKNVSRIILAVPVGPPETIDQFRAEGIEVICVATPPTFNAVGSFYVKFCQTTDEEVIRCIEKAKEWMHGERSK

SEQ ID NO: 137165 - protein, 194 aa, Heterodera glycines
  Coding regions on vcDNA: vcDNA=SeqID_63588; Strand=+; Position=1 -87,605-1102
MSIDKQSNIDIDPSSNEIVKMSIDDEENDPTSSYKRSKNHQTSKNEFIQQIDSLLEAKENLTQIYMDNWYVVDDMAKEYFSIVIKMLGQMPPKIKNLFENDIEILNFKFKNKYQQNIGGGGGGTINLDKILVENAMDYDEDTLRQTHRSLIERFAIKIGRMLEITINNAFVPSNGIMAIIELHIYQTFSEGLKK

SEQ ID NO: 137166 - protein, 40 aa, Heterodera glycines
  Coding regions on vcDNA: vcDNA=SeqID_63589; Strand=+; Position=1 -65,439-496
MREWVASGCCPVGTASTMLCHGKINAGAEIIIGLRENCCY

SEQ ID NO: 137167 - protein, 65 aa, Heterodera glycines
  Coding regions on vcDNA: vcDNA=SeqID_63590; Strand=-; Position=1 -69,249-377
MNLLSALNLYATAQQDAVHALVNYTCEPKDGEEEEEKPKNEEKHEVEKEEKESEKKQEKKNISSK

SEQ ID NO: 137168 - protein, 132 aa, Heterodera glycines
  Coding regions on vcDNA: vcDNA=SeqID_63591; Strand=-; Position=1 -282,374-490
MTFRCQLRVEKPLNVVVEMDETEKKRMERELAEEGQNILEKVICGRAANALEEVAQQKQRDGRELTKGGGIKPRVKGDEANPSEWGGSDGKGEGRINRRFALLPTKMTLSNLNASYVVEEVMRRMRRVRRQK

SEQ ID NO: 137169 - protein, 73 aa, Heterodera glycines
  Coding regions on vcDNA: vcDNA=SeqID_63592; Strand=-; Position=1 -18,115-237,295-375
  Homolog annotation: Hit_ID=NP_501505.1; Match level="QueryCoverage =91%, HitCoverage=53%, E-value=4e-19, Identity=56%"; Hit description =ganglioside-induced differentiation associated protein 3 like (4J504) [Caenorhabditis elegans] emb|CAA910
MASEPWEQQAKLSEKYYPNTPMLHYLVKMLKLHGLYFDEHLVWREVQNEIRISKGKIIYPPIGAGKQKMKAKI

SEQ ID NO: 137170 - protein, 732 aa, Heterodera glycines
  Coding regions on vcDNA: vcDNA=SeqID_63593; Strand=+; Position=1 -780,2195-2306,3000-3115,3261-4451
  Homolog annotation: Hit_ID=XP_319741.1; Match level="QueryCoverage =46%, HitCoverage=80%, E-value=6e-35, Identity=28%"; Hit description =ENSANGP00000006515 [Anopheles gambiae]
MDTVIQNLDVAQGTDVTTLSVCFRSHSALVRCTEAVFYKPHGEQLTARRDDAERALMTDQTAFKLPKKGVPLILVHQNTPAQRDEVSTSSANPGQTDTAMRALWRLAQTFPGILIRCICFYAAQALEIERLVAQQEIPDILVTMADATQGHESSLVVVVTTCSVFDSAADSQPFWADAAQGGRRHLPRQPWNDHHWRFAAAQPDGYVAALPGPSDNGDDSGRPGVLRLRAVQQPRQLLRQGRTADLSQRWCGTVRAFLQQLVDNVGLFGSVVTNMPSILCALNPQKYMYQPMNPGSQSVKETALLLKPGRLDISSSRVGSKILRKPSRLAKFVKSRQQTQINQLINVQRNNQPNPAIIQTIPSMPDVAIFEQCDEKHRITEWLERFTFAIDSCAPNAADDIKVKALINKLSETAFSEYSKFVLPAKVTDFDFDETISKLEKLFAKPQSIFVDRFACLIATKDDGEEFHQFVNRHKRLLKDFQFDKLNEEQFKGLMLLTALKSSKDAVLRQRILAKLTKDGDAVKYDELIEECINFLSTIHEAKLIETTSVSSRTVNAVKPNQRRERPKPQSKQGQPSATPNQLQCWRCGKTNHTHRECSHKSAKCPKCRYNGHLENQCEKVQEWRRKNFKVKKVGTLSIGIALKSINSASLIKIKVMLNGRIVKSILDSGAEINVIDEETYRQIGQPKIWKCAERGRMFDGTEKSFIGKGEGHFEFQGVQVKNIFMSPRRDR

SEQ ID NO: 137171 - protein, 350 aa, Heterodera glycines
  Coding regions on vcDNA: vcDNA=SeqID_63594; Strand=+; Position=1 -704,767-1116
  Homolog annotation: Hit_ID=XP_320889.1; Match level="QueryCoverage =86%, HitCoverage=40%, E-value=4e-79, Identity=45%"; Hit description =ENSANGP00000012033 [Anopheles gambiae] ref|XP_313651.1| ENSANGP00000013044 [Anopheles gambiae] ref|XP_314
AGKESRGKNAPINPTKVDGTPNKDAEKQISQLKQEYTNVLKNELGLCTKVKAHLELKPDAQPIYRKARPVPYNAKNAVDGELDRWEKMGVIGKVEHTEWAAPILVVKKVDGSARLCIDYSTGLNNALKDHQHPLPLPEDIFATLNGGQYFSQIDLRDAYLQVELDEASKKLCAIATHRGNYKVKRLPFGIKTAPGIFQSIMDQMLADFDFTTAYLDDIIIVSKGQKEHSEHLKRYEIKYLGQIIDKNGRRPDPSKITAISEMPEPTDVSSLRSYLGMVNHYQQFIKNMRFVRKPLDDLLKKDTEWIWSDKCKNAFDKIKGILSSELLLTHYDPLKEIIVAADASDQGIGQ

SEQ ID NO: 137172 - protein, 86 aa, Heterodera glycines
  Coding regions on vcDNA: vcDNA=SeqID_63595; Strand=-; Position=1 -147,189-302
MNLVSTKPIIHHEKCIGDPIEKLSVEQIDRQQRLKILTCTENIKTLWREGFQKAEEFDIATVAETDTEESLTYNYPTFDSIRRAYN

SEQ ID NO: 137173 - protein, 62 aa, Heterodera glycines
  Coding regions on vcDNA: vcDNA=SeqID_63596; Strand=+; Position=1 -90,521-617
PFPSTSTDPSTIDLTIQKHVHSIVEEQSEQLIHQFTGVTVNQNVVIAIAGMAKVFTGELIEE

SEQ ID NO: 137174 - protein, 115 aa, Heterodera glycines
  Coding regions on vcDNA: vcDNA=SeqID_63597; Strand=+; Position=1 -85,142-405
QRHGAETEQARIYCPGSGLRTKSEIEEEFKCARDGKYPEENLEDWSITGKRSLTQKALFHYTDRRAGKGYSDFGFVSSPLIPNRIRLFQPPPFTTVALTFGRPFAKLTDGTFSFV

SEQ ID NO: 137175 - protein, 99 aa, Heterodera glycines
  Coding regions on vcDNA: vcDNA=SeqID_63598; Strand=+; Position=1 -210,257-346
MDKILPCQPSTSNTSFTNNENNDNNIKIDSDKCTVTEMEEDEEEDEEFQPNETDLSSDDVISQPNVESDQLDSVYHTPNCETQWPKENDEQVAMLIKKM

SEQ ID NO: 137176 - protein, 53 aa, Heterodera glycines
  Coding regions on vcDNA: vcDNA=SeqID_63599; Strand=-; Position=1 -87,142-216
MKNNEKVEELTPNKSSQEENFEDELFGQQDSDLSFVTTWDPIERFGKKKIATK

SEQ ID NO: 137177 - protein, 29 aa, Heterodera glycines
  Coding regions on vcDNA: vcDNA=SeqID_63600; Strand=-; Position=1 -36,76-129
MALALAIAKCQKGVNQRGKDELIERHKSN

SEQ ID NO: 137178 - protein, 18 aa, Heterodera glycines
  Coding regions on vcDNA: vcDNA=SeqID_63601; Strand=+; Position=1-56
YREAIPEGFGLPINLGAS

SEQ ID NO: 137179 - protein, 23 aa, Heterodera glycines
  Coding regions on vcDNA: vcDNA=SeqID_63602; Strand=+; Position=1-72
VPAPQTQSVCRKSNNRGTCPMSF

SEQ ID NO: 137180 - protein, 92 aa, Heterodera glycines; identical to SEQ ID NO: 131693
  Coding regions on vcDNA: vcDNA=SeqID_63603; Strand=-; Position=1-362

SEQ ID NO: 137181 - protein, 92 aa, Heterodera glycines
  Coding regions on vcDNA: vcDNA=SeqID_63604; Strand=-; Position=1-304
MIGRAVRNSPFIFEGIFKFILYPRKMAISFFEKFYTSQKRLGMRRRAVHNRHFISQRIFIFRGYPRKMAISFFDKFYTHTNALEHDREGGAQ

SEQ ID NO: 137182 - protein, 48 aa, Heterodera glycines
  Coding regions on vcDNA: vcDNA=SeqID_63605; Strand=-; Position=1-144
MIGRAVRNRPFIFEGIFKFILYPRKMPISFFEKFYTSQKRLRMRRRAV

SEQ ID NO: 137183 - protein, 116 aa, Heterodera glycines; identical to SEQ ID NO: 127487
  Coding regions on vcDNA: vcDNA=SeqID_63606; Strand=+; Position=1-351

SEQ ID NO: 137184 - protein, 144 aa, Heterodera glycines
  Coding regions on vcDNA: vcDNA=SeqID_63607; Strand=+; Position=1-432
MMLIQRHIRGCRWSSRSGRLSIGRRIRRRSSRRSGWIIVSRRRSIRGRRRSSRSSGRLSVGRRIRCRSSRSGCVSVSRHRAIRNRRRCRRSRRSGRLSIGRRSRRRRSRNGFVGVGHRRSIRVRRCRWSSRSGRLSVGRRSRTG

SEQ ID NO: 137185 - protein, 178 aa, Heterodera glycines
  misc_feature (24)..(24): Xaa can be any naturally occurring amino acid
  misc_feature (171)..(171): Xaa can be any naturally occurring amino acid
  Coding regions on vcDNA: vcDNA=SeqID_63608; Strand=-; Position=1-536
  Homolog annotation: Hit_ID=AAS45959.1; Match level="QueryCoverage =100%, HitCoverage=61%, E-value=3e-22, Identity=38%"; Hit description= envelope glycoprotein [Equine herpesvirus 1]
VTTTAGNTAITPPTTTTAGPERRXPTPTNPGATTATNTEAPAATTPATTTNADGATVTNANEPVATTTTTAATTNTEATAATTPATTTAIADGAVATNTDATGAATATTDAATNTEAPAAATAPTTTADGAAATNNDPTGAATTPTTNAATNTEAPAATTPATTADVALDXHHGTTTE

SEQ ID NO: 137186 - protein, 144 aa, Heterodera glycines
  Coding regions on vcDNA: vcDNA=SeqID_63609; Strand=+; Position=1 -72,254-616
PAPITAIRKTLEAKMEELRKIREQNGAASHGQGVDYKQIADNALRAAEELQKQYREYQRHYTAEVQRLSGQLVKLEQELATRQQKITVVAPTETVAEHKQDGHNDDNDAVNVSAVIKMPTQHQAQHVTRPQRGYEVKQCRKRPI

SEQ ID NO: 137187 - protein, 97 aa, Heterodera glycines
  Coding regions on vcDNA: vcDNA=SeqID_63610; Strand=+; Position=1 -184,1122-1231
MGPTQKKARLNFTIDQLIVRPLRDSQRVNVVPPPTVTNAAQQTQQPPLAALQQQTLQQLTNAEKPFECPRCKKAFKVKSYLTKHKKSCGKSESKFDD

SEQ ID NO: 137188 - protein, 82 aa, Heterodera glycines
  Coding regions on vcDNA: vcDNA=SeqID_63611; Strand=-; Position=1 -86,140-302
MSNKTNVLDANSNAKGNTLGFVLIAGGVFLLLLLLINSVVLLIYRRRRQRTFVYNVNSEGKRSTKTNSPPADLTLISYKAFQ

SEQ ID NO: 137189 - protein, 140 aa, Heterodera glycines
  Coding regions on vcDNA: vcDNA=SeqID_63612; Strand=+; Position=1 -227,282-368,412-521
  Homolog annotation: Hit_ID=CAG11941.1; Match level="QueryCoverage =59%, HitCoverage=28%, E-value=3e-24, Identity=56%"; Hit description =unnamed protein product [Tetraodon nigroviridis]
VLPLVPENRPCVVFRALRHKNLTLHETPKRSNRKRGLTNGTRFIAAGDDSTKAECEICHKKFGRPWLLNGHMRTHSGDKPYSCEKCDKTFADRSNCRAHERTHGAEKPFGCPRCKKAFKVKSYLTKHKKSCGKSESKFDD

SEQ ID NO: 137190 - protein, 82 aa, Heterodera glycines
  Coding regions on vcDNA: vcDNA=SeqID_63613; Strand=-; Position=1 -86,140-302
MSNKTNVLDANSNAKGNTLGFVLIAGGVFLLLLLLIHSVVLLIYRRRRQRTFVYNVNSEGKRSTKTNSPPADLTLISYKAFQ

SEQ ID NO: 137191 - protein, 34 aa, Heterodera glycines
  Coding regions on vcDNA: vcDNA=SeqID_63614; Strand=-; Position=1-244
LRFCVLTLLFFPFFPIDHVNSFSIHLVSYFMKLY

SEQ ID NO: 137192 - protein, 81 aa, Heterodera glycines
  Coding regions on vcDNA: vcDNA=SeqID_63615; Strand=-; Position=1-244
MRTFWLLRRDNYTFFLKPPGEENAEHNQHQMGNTEEWEDNNNNTNDNNEFKPILDPEIFPRPKQNAAARRHQQPRDFCSSL

SEQ ID NO: 137193 - protein, 60 aa, Heterodera glycines
  Coding regions on vcDNA: vcDNA=SeqID_63616; Strand=+; Position=1 -143,430-469
MDDSSTLIDRDEVMKNFKENLSFVNNKYQIALPWNDSEAPSRGREEAEKGCETLQILFTC

SEQ ID NO: 137194 - protein, 87 aa, Heterodera glycines; identical to SEQ ID NO: 129152
  Coding regions on vcDNA: vcDNA=SeqID_63617; Strand=-; Position=1-814

SEQ ID NO: 137195 - protein, 296 aa, Heterodera glycines
  Coding regions on vcDNA: vcDNA=SeqID_63618; Strand=+; Position=1 -84,305-390,658-797,1728-1958,2475-2708,3171-3222,3339-3399
  Homolog annotation: Hit_ID=CAE67683.1; Match level="QueryCoverage =87%, HitCoverage=81%, E-value=3e-18, Identity=32%"; Hit description =Hypothetical protein CBG13248 [Caenorhabditis briggsae]
PMNTSLQTNSESVESTDGDESSSELRDPHSALGVEEIVNEEEARRRREQLNRRPSYRMILKDLETVGDKPMKKEMHDDGNNNTANTFNHDRNDRNTGTTLHQLGQLNLIGNPAASIAHQQQQNRLMATVAEMPSQPQPQQLSAATNSAPPPQPLLAAVNNLEMLGLKAPDALGTAAFGPNDWQNNLLSSYGRTQQQQSPQVSLMQQQQQQQNNAAGAVVGTMANSPLGMNNIGVVAGHAAALQQHHQQQHVTPPPHGLAPQTLGQRAAMTTPGKDKEAAKECRRKKKEYVKCLENR

SEQ ID NO: 137196 - protein, 24 aa, Heterodera glycines
  Coding regions on vcDNA: vcDNA=SeqID_63619; Strand=+; Position=1 -52,295-317
MEKACKIWRDYIDFSALELLELAS

SEQ ID NO: 137197 - protein, 84 aa, Heterodera glycines
  Coding regions on vcDNA: vcDNA=SeqID_63620; Strand=-; Position=1-253
MYSPFDLFLVSSGRQLSSFAHLFVPINCRIFAPNVRTMSTKPPADNESNNEGQQKSSNSLARDGNYEDGNMKNRDKQKEFGGPA

SEQ ID NO: 137198 - protein, 25 aa, Heterodera glycines
  Coding regions on vcDNA: vcDNA=SeqID_63621; Strand=+; Position=1 -58,102-121
MTSGATVKVTVFENFFTFFALLSYS

SEQ ID NO: 137199 - protein, 110 aa, Heterodera glycines
  Coding regions on vcDNA: vcDNA=SeqID_63622; Strand=+; Position=1 -196,326-461
MDEKIEFDAKQAHFKRKLGPLRYGNRIPKAEKAHYTPEQREADRWLSNHAWPPPAPFKGILFPAKIWHWKKGAAAYASHWRDEFLGSKNPDVKAAADAAAKGDFLKLGIN

SEQ ID NO: 137200 - protein, 20 aa, Heterodera glycines
  Coding regions on vcDNA: vcDNA=SeqID_63623; Strand=-; Position=1 -51,425-436
MTEKLSGLSSSVSSYLSDRY

SEQ ID NO: 137201 - protein, 436 aa, Heterodera glycines
  Coding regions on vcDNA: vcDNA=SeqID_63624; Strand=-; Position=1 -34,3247-4488,4748-4790
  Homolog annotation: Hit_ID=NP_509552.1; Match level="QueryCoverage =98%, HitCoverage=23%, E-value=4e-62, Identity=32%"; Hit description =reverse transcriptase RNase H-like protein family member (XJ813) [Caenorhabditis elegans] gb|AAA85753.1|
ISKSWRIFHFFITCDIEKAFLQVAVHPEHRDCARFLWLKDPHRPFSKSNMQIFRFTRVSFGLTSSPFLLAATIRHHLSKFPSELSQEVALNTYVDNILLSVQSPNEAQIKAKSIISLFQRAGMTLREFASNSENALSKLPDDIKLSGSEQKFLGLNWNTQTDSLEFNLSPPNNDFIPSKRSILSFIASQYDPLGLISPLILPLKIFLQSIFQNGSDWDQTLPTQIQNDWDCAIKNWKNAEKVSIPRCPVTLPLEGRNYQLHCFTDASSLAMCATVYLRITHPSFSPEVFLIFSKTKVKPTHNTPLTIPRLELIAVEIGTRALKFTQSHFSSLNLDPELTIWSDSSIVLSWLNSPQTLEIFVQNRIKSIKSTSNLVIRHLPGSENPADIGTRGLNSAQILSNASVWWSGPKWLPLLPINWPDKLKSKPITRPRTETL

SEQ ID NO: 137202 - protein, 193 aa, Heterodera glycines
  Coding regions on vcDNA: vcDNA=SeqID_63625; Strand=+; Position=1 -147,207-309,465-670,728-808,850-894
  Homolog annotation: Hit_ID=NP_741269.1; Match level="QueryCoverage =58%, HitCoverage=20%, E-value=2e-10, Identity=37%"; Hit description =coronin (67.1 kD) (cor-1) [Caenorhabditis elegans] emb|CAA83461.1| Hypothetical protein R01H10.3a [Caenor
MRKQRRANGEEKGDKSTKGSKGKNEKARRSNRREIKVFYGQSAVGNGSGGAEGGNTNYFANRDKDEEQQQNVINGEANDGKSDVAKELLICHSSSPTASPQPSGCFLTSANVVAESDGILREQNRSGEADGQSTAATTPNASRRPSNSSAAAVSGSVEDELAKIKVVLRQHERRIRLLEDQLADANMANAYGI

SEQ ID NO: 137203 - protein, 98 aa, Heterodera glycines
  Coding regions on vcDNA: vcDNA=SeqID_63626; Strand=-; Position=1 -141,210-364
  Homolog annotation: Hit_ID=EAL26331.1; Match level="QueryCoverage =100%, HitCoverage=12%, E-value=3e-14, Identity=39%"; Hit description= GA11884-PA [Drosophila pseudoobscura]
MAEARNIAALSFTVTHDGISVSYDQEVLRDIWHAFSRSYKKRIAKFENDFFAGIFPANIRSLAIVIFLVAALNVSFGNDKTPFNLADKLNYYVFSNIT

SEQ ID NO: 137204 - protein, 58 aa, Heterodera glycines
  Coding regions on vcDNA: vcDNA=SeqID_63627; Strand=-; Position=1 -70,406-512
MSHPIWQIGLFKCIKEDSVDCLEYDEESIDKYFAAIPCILSQWTIQSQSHLAISVPGL

SEQ ID NO: 137205 - protein, 48 aa, Heterodera glycines
  Coding regions on vcDNA: vcDNA=SeqID_63628; Strand=+; Position=1-147
  Homolog annotation: Hit_ID=NP_498599.1; Match level="QueryCoverage =97%, HitCoverage=16%, E-value=5e-10, Identity=63%"; Hit description =matrix metalloproteinase precursor lacking the classic cysteine switch (31.9 kD) (3I336) [Caenorhabditis
TLTHEIGHLLGLEHSSDPRAVMYPRKKEHQPGFELSDDDVRAIRFLYN

SEQ ID NO: 137206 - protein, 1013 aa, Heterodera glycines
  Coding regions on vcDNA: vcDNA=SeqID_63629; Strand=+; Position=1-3042
MENLERTLNHTRLTRQRAQNEGILLDRDGNVFFRENPPNRTLGVMNQNVVVADPNLENSEQLDSMEMRRRLLNPNNDSALGQLRQNERASLDENEEEEANQGFMRNRTDWTQNLGERAGPTQQIFRNFVFGHSQNEDDFFDHPNIRRTSTPVNENRCVGVGPQNLNEIGLLAEQIGRVIVGQLNSAHQNPNTNPAPNLTQHGVEIHQQIHHSAVFARRANNIPFRMPGQQNPAAIQQNFGRPQSQQIQPPNFQPRQPYAWQMNEQCVQVQQPPMPQMNYQPPPTFNTHQNQPNFGMGNFDFGIVLERIPDLSGTEGSDGIKKFFKKFDFYSLNWSDAQKIRALESKLYGRAERAFQTAQSTQPFRYEPIKREMLNLLDETDARNLNAFDELMQGVRRGPNESIDELANRISGLVQRAYNGLPQHLSNEYAIKFLVRAMGNPELALNLELVRTPGMTLDHFVSLAARAESTQKATQRFSRPDNRERTWRTNTPQHFSQTNNGPSRSNFEERGQQMQKFGTQSNRSWSCFNCNSPGHLARDCPQGKIFRAIERTNSSTTMNQQGKQQMGYNRQQMPEPNENPPNRHYQQKNYLKQNCLVLQEEQVHQNNFIVGELKQDLEDFFDEIRKCATEDKNSNFSKVGKVMAVLVEVFGTKTKAMLDGGAQISVIEAKFLYNLIRDKKLDVRNLSVLKAENRISDANGNPLECLGVICLPIKRHENSSEVKVAMHIAKSSIGFDLLFGTNALNELGYKMYDAISDTIIDFEKAKQNKINSLAVIYKTVLEPRATKFNGYGEPDQYEGREMLLPSDQGNDQIRLEPTIAISRDKQVMVKKEGKGGDKPPKKGQLQKRRTPYDVREDEGEQITAITKCKRVKNVSNLLPAVVPPPEGMSYNPPIDGYLRMAVINANEERQIEKKRRRTERRIGIGTDEVSALPALREEVTYSVRGGVTVRMKEEKVKEMAGGENEKVSPNELRLQKRKTTKGKKRQKLRIKKREKENGGKGSGGKDEKTIGQF

SEQ ID NO: 137207 - protein, 127 aa, Heterodera glycines
  Coding regions on vcDNA: vcDNA=SeqID_63630; Strand=-; Position=1 -225,891-1049
MYIEQIGRAQLSTVSIQGGWTCRCCNRHKWQGNVGSGGGGREVTHFAEKCVKRGYVKSESGVAAAAIFMYIIMYICLFEDFCVYFAIFLCLFRCLFRDFLCLKKEVLVIKKTNRKKYGQSWRIVSLI

SEQ ID NO: 137208 - protein, 136 aa, Heterodera glycines
  Coding regions on vcDNA: vcDNA=SeqID_63631; Strand=+; Position=1 -332,806-882
MMLPSFNAAPIIGICLLLVFIPCSTAALTSQQPHTKNNTNNDTDNNGSSTESSVLGPPSRPPSSSAAPSSSSSSMMVMAAQKSQLTVTNEDKLCVMRKICGKDGELRQNCPYPYQPFPINLTMEIEYKELCPQLFK

SEQ ID NO: 137209 - protein, 64 aa, Heterodera glycines
  Coding regions on vcDNA: vcDNA=SeqID_63632; Strand=+; Position=1 -32,790-898,1153-1203
MPTNYLIHAEMVTYKCNEVPDKFDHSCACIDCQHACTSSAPFPLLFHESCKVAGMDCKTAIRVL

SEQ ID NO: 137210 - protein, 85 aa, Heterodera glycines
  Coding regions on vcDNA: vcDNA=SeqID_63633; Strand=-; Position=1 -145,611-847
KKKFFFGNLCHFQLLFRTNSNFLFLKVRTSSTAFVLSILCGTSIELCTPKKFFQYIGTYSKVTHVPFTINVVMLNDSHQMQRSAG

SEQ ID NO: 137211 - protein, 73 aa, Heterodera glycines
  Coding regions on vcDNA: vcDNA=SeqID_63634; Strand=-; Position=1-9,52- 199,275-339
MNYIATGPGPGREFPVLRGHGPGSRSRILKISSPGPDRETGKNKHWYFNHQEDMQKSILPSLIVEFKNDNCTN

SEQ ID NO: 137212 - protein, 399 aa, Heterodera glycines
  Coding regions on vcDNA: vcDNA=SeqID_63635; Strand=+; Position=1 -28,178-305,1217-1310,1348-1530,1578-1687,1868-2020,2105-2243,2393 -2757
  Homolog annotation: Hit_ID=NP_060267.2; Match level="QueryCoverage =61%, HitCoverage=41%, E-value=7e-30, Identity=34%"; Hit description =BTB (POZ) domain containing 2 [Homo sapiens] gb|AAK25826.1| BTBD2 protein [Homo sapiens] sp|Q9BX70|BTB2_H
MYTSYFLISILFLQIINVSLRHLVHCYWAWNGINPWLPSVLIYKICPYLEGPLLQAHKLILKHASDVFEAMFRFDANKEKAEFALIIDYSLLINLINFELASTNCPVVEVPDVEASAFKVMLSFIYTEDLSELDGDNAMAVLYAAKKYDIPALVDQSLQIPISKLRNVFMAYVLAGLFGLENFANDCLFYIDKNADTLFESEEFLKIDQKILCEILERDELQISGEISIWNSSLRWADAKCRQNGIECSAENRRAMLGPALLKIRFPLLSNEEFSKKIVPSGVLSKDEVIGVYQFNSLLNCREISDVLQFPMQFPTNGRISDRKKGTLLMDIEKVSEFAREELESSRHSEKVFINGLPLKLLAQIKTKTESTDNEKCLCFFLLCDSPEKGANYLFINAN

SEQ ID NO: 137213 - protein, 142 aa, Heterodera glycines
  Coding regions on vcDNA: vcDNA=SeqID_63636; Strand=+; Position=1 -108,150-470
  Homolog annotation: Hit_ID=NP_490685.1; Match level="QueryCoverage =64%, HitCoverage=91%, E-value=2e-11, Identity=37%"; Hit description =transposase (1A616) [Caenorhabditis elegans] gb|AAB54166.1| Hypothetical protein F53G12.11 [Caenorhabditi
EIDLQIDVRDCSGSSSAGDIFSRFEKDAEFEQILNTATSPSPSALETRQKAEVEVNEYLRDPKIKSRADPSLYWEVNSQKWPMIGDVVRKFLSPPATSSESERLFSTAGLISDDLRKSLLPENLAKLLFLHHNLLLTGFSIE

SEQ ID NO: 137214 - protein, 29 aa, Heterodera glycines
  Coding regions on vcDNA: vcDNA=SeqID_63637; Strand=+; Position=1 -66,123-146
MAISFFEKFSMQQTLSNMKRSAKNGYLFF

SEQ ID NO: 137215 - protein, 29 aa, Heterodera glycines
  Coding regions on vcDNA: vcDNA=SeqID_63638; Strand=+; Position=1 -66,123-146
MAIYFFEKFSMQQTLSNMKRSAKNGYLFF

SEQ ID NO: 137216 - protein, 28 aa, Heterodera glycines
  Coding regions on vcDNA: vcDNA=SeqID_63639; Strand=+; Position=1 -66,355-375
MAIYFFEKFSMQQTLSNMKRSAEGSGIY

SEQ ID NO: 137217 - protein, 474 aa, Heterodera glycines
  Coding regions on vcDNA: vcDNA=SeqID_63640; Strand=+; Position=1 -1249,1365-1540
MQQLRQNKTSDKGNFVEQPQRQEGLQIGALEFVIAMERLPELNGTEGPNQIRKFFQKFLLATEEWPESRRVSALESKISGKAERAFDAAMKHRPENFNEICCGMKEILSEWDWTEMRAFNELWEGVKRRSDESLDEFAERLYGIVECAYPGLPSNFVDDFAVKHLIRAMENPEISVGLEIARRPGMSFDSFVALAVRAEAVQKATKSAGFGKEHRPNFQQKSTVPPQKIFAPRTNRVVCYNCNKIGHTSRNCILSPGLKHFDRPPKSPQHQKFVKKNAGFRKFSPAENKPNVFRLDNQLAAQRTNAEAGNKLKAPNRQRNSSSLCSVKRGKMEEKSAEIPKWFLNAIFAALVVFAGVFSKEKSKCGQIWKSKGSMSRTDEVKGRKAFGKLGTIFSPKAGEELADVAAANLENLLKIGLTLQRDFMPNRSTADTLAAPFNAECTTDEPKALRTSLLRGRGCANIVILKYIWRFVI

SEQ ID NO: 137218 - protein, 234 aa, Heterodera glycines
  Coding regions on vcDNA: vcDNA=SeqID_63641; Strand=+; Position=1 -125,188-338,396-431,492-625,687-765,857-883
  Homolog annotation: Hit_ID=NP_509014.2; Match level="QueryCoverage =88%, HitCoverage=28%, E-value=3e-49, Identity=53%"; Hit description =GABA/Glycine Receptor subunit (ggr-2) [Caenorhabditis elegans] gb|AAK68248.2| Gaba/glycine receptor famil
RFRPVSFSLCTRLFSDAYDINHLLIEWVDNAPITKNMNITMSDMDIVKLVPGTCDGNYSSDMDIVKLVPGTCDGNYSTGIWSCVTAEFFVSRELTHHILQTYVPTTLIVVISCFWLVISCFWLDVEAVPARVSLAITTLLTLSAVPARVSLAITTLLTLSTQANSVKNSLPEVSYMKSLDLFLAVSVLFVFGVLIEFTIFVFGVLIEFTIVNYTQRNGNLGEMPKPNIVWTVHL

SEQ ID NO: 137219 - protein, 63 aa, Heterodera glycines
  Coding regions on vcDNA: vcDNA=SeqID_63642; Strand=-; Position=1 -12,144-323
MNRCKNLLIKSVFRVFGETKTSTRRTKEGPSSNLNYARSARSTTAEPLTFLPRSNQRNNQNEE

SEQ ID NO: 137220 - protein, 86 aa, Heterodera glycines
  Coding regions on vcDNA: vcDNA=SeqID_63643; Strand=-; Position=1 -140,186-306
  Homolog annotation: Hit_ID=NP_496415.1; Match level="QueryCoverage =98%, HitCoverage=27%, E-value=4e-38, Identity=85%"; Hit description =adenovirus interacting protein 1 (35.8 kD) (2L593) [Caenorhabditis elegans] emb|CAA90136.1| Hypothetical
MSKRKVLLMGKSGAGKTSMRSIIFANYIARDTSRLGPTMEVEHAHVKFLGNMVLHLWDCGGQETFMENYMTAQRDQIFKNVQVMLF

SEQ ID NO: 137221 - protein, 30 aa, Heterodera glycines
  Coding regions on vcDNA: vcDNA=SeqID_63644; Strand=-; Position=1-90
MTEIKTDIGFARAFVRLALERKLLYLYLKK

SEQ ID NO: 137222 - protein, 237 aa, Heterodera glycines
  Coding regions on vcDNA: vcDNA=SeqID_63645; Strand=-; Position=1 -106,156-407,485-673,735-899
  Homolog annotation: Hit_ID=NP_472958.1; Match level="QueryCoverage =94%, HitCoverage=12%, E-value=1e-09, Identity=25%"; Hit description =hypothetical protein PFB0145c [Plasmodium falciparum 3D7] gb|AAC71819.1| hypothetical protein PFB0145c [P
MDNKTRSEKEKEITMTFGVSRTTIAKWKCQLRKRGDDQWSEEEANEHTSDEGTENLDGGEDGQQPMAHEDNANENDSENANSSENDSENANGRKNDSENANYSENDSENDTKIGAKESLGQNYPKRRDEWEKIVKIFDELKEKLIRKKSKLCNRLEIENKIAKKLGTHRLIIYKWKNKFENDKRKVYYSEKEKRKIIKIFYQIKDEKRETEEKVAQRMGINRELIYRWKKELGVGQN

SEQ ID NO: 137223 - protein, 52 aa, Heterodera glycines
  Coding regions on vcDNA: vcDNA=SeqID_63646; Strand=-; Position=1-158
TKAHHSAQTYAIYLGSKRNLDEIRAKYFKGGERTVKETARMVGLEVPEEQQW

SEQ ID NO: 137224 - protein, 76 aa, Heterodera glycines
  Coding regions on vcDNA: vcDNA=SeqID_63647; Strand=-; Position=1-231
MPQDQTIASVKKEDDQQRNAVPKDEGGGDDVSGAHQTDRRMPVKAGTHRNILVKDVTGENVIGQAEQERNGPNGGH

SEQ ID NO: 137225 - protein, 497 aa, Heterodera glycines
  misc_feature (462)..(462): Xaa can be any naturally occurring amino acid
  misc_feature (481)..(481): Xaa can be any naturally occurring amino acid
  Coding regions on vcDNA: vcDNA=SeqID_63648; Strand=+; Position=1 -129,175-220,268-366,417-595,623-702,988-1396,1449-1556,1604-1705
  Homolog annotation: Hit_ID=NP_495888.1; Match level="QueryCoverage =93%, HitCoverage=85%, E-value=4e-58, Identity=32%"; Hit description =mu opioid receptor family member (2J148) [Caenorhabditis elegans]
SLTGNLFAILVICAHRSVRTATNFFLANLAVADLLVAIFCIFQNMFHLVGTNDGRWLFNMFHLVGTNDGRWLFGATLCKLYAFVLHLFPCTSIGILVCGATLCKLYAFVLHLFPCTSIGILVCASVEKYIAVLHPLLALKVFTPRFLHPLLALKVFTPRFRVLLMASIWAVSLLFSLPYYIFTSYIFYKNVAVCTRFHWHSPISLSFVLWYCVPLLIILFLYTRNGLVLWHSPISLSFVLWYCVPLLIILFLYTRNGLVLWHSDSETHGSEEEDGGKGMKKHYLGKRGRRRKPSERRHSRETREWYHGMGQSSCQGLAKAMRNNEMLALPRQRMTLPRPRWAHPTAQCSWARWSLVKRCWEKQDRSTVAVQVIRLWSAIVFSFAVLTLPHHVRLLYTVWTEQIICSNSVWTEQIICSNSLEALVQPLTYLLLFLFSSCNPFLYAFMSQQFRSAIRDIFKCRXIFMSQQFRSAIRDIFKCRXIEWARGTDSAAEIETL

SEQ ID NO: 137226 - protein, 73 aa, Heterodera glycines
  Coding regions on vcDNA: vcDNA=SeqID_63649; Strand=-; Position=1 -84,340-477
MHEMPKYAQICKYAHKSRNMHKCAKYAHIISQNSPLFLHLAAIFIQFLPSMRKTFDDSRFLSMAIFIMVNTVS

SEQ ID NO: 137227 - protein, 94 aa, Heterodera glycines
  Coding regions on vcDNA: vcDNA=SeqID_63650; Strand=-; Position=1 -78,287-493
MCRDAHHAVALTCFFWCQFDVAYGTNSLILNFFRVMDPEISDNFPAENEQSEEVFIDENENNLSKLEPTEPSASFLRYYQFNKGDKNAKCRIFV

SEQ ID NO: 137228 - protein, 57 aa, Heterodera glycines
  Coding regions on vcDNA: vcDNA=SeqID_63651; Strand=+; Position=1-275
  Homolog annotation: Hit_ID=CAE61905.1; Match level="QueryCoverage =84%, HitCoverage=15%, E-value=1e-12, Identity=72%"; Hit description =Hypothetical protein CBG05897 [Caenorhabditis briggsae]
YVVSWQCLDIIRKDMVDPLSGKRMAESDIIELQRGGTGYAATNKLDAKLIRPQLELQ

SEQ ID NO: 137229 - protein, 92 aa, Heterodera glycines
  Coding regions on vcDNA: vcDNA=SeqID_63652; Strand=-; Position=1 -11,88-254,301-401
MNRRWICSDVWMDILPSLDRAQLGLKMALLSDRFDVMVDAHFDGKSELTLWKEIVIFKNVAGVRMGSDPHAIEELPDYALRNQIIFHSLGIS

SEQ ID NO: 137230 - protein, 58 aa, Heterodera glycines
  Coding regions on vcDNA: vcDNA=SeqID_63653; Strand=+; Position=1-177
LEHDEDFESPPHSSDEEAPEDEVDSDFDKDEEEDEPTPAEEDPEQIERRRKVFFLEGN

SEQ ID NO: 137231 - protein, 69 aa, Heterodera glycines
  Coding regions on vcDNA: vcDNA=SeqID_63654; Strand=-; Position=1-207
IKIVPSPKSGKFPKTTTTNNMKYLPPELLDEMTFYIYPNQNYSRILTSSWLLMEFLRPHIERWQKIFKL

SEQ ID NO: 137232 - protein, 132 aa, Heterodera glycines
  Coding regions on vcDNA: vcDNA=SeqID_63655; Strand=-; Position=1 -97,190-380,597-709
  Homolog annotation: Hit_ID=EAA68331.1; Match level="QueryCoverage =87%, HitCoverage=18%, E-value=3e-11, Identity=34%"; Hit description =hypothetical protein FG10105.1 [Gibberella zeae PH-1] ref|XP _390281.1| hypothetical protein FG10105.1 [Gib
YCRLVAEFPLNLLFNAYFEIIILKKQGDSGIGTIHFGLWAKKENASYQYWNNGIIIGTSFGIVGGFPAFGGGDTVGCGVNMTSKEMFFTKNGIQLNTTKIDVSETELVPFVGLLTPGDIIQANFGPNFVYNL

SEQ ID NO: 137233 - protein, 115 aa, Heterodera glycines
  Coding regions on vcDNA: vcDNA=SeqID_63656; Strand=-; Position=1 -85,292-554
MQKYFLLTFLIICLIQPIKSHLPPAEAEEFAPNEQSAVGQLATKEMKVAQSLTDEKVENNAIMKDSRNGSGIGQILLNSRNYVKLIIIIFTAAPVSAEEMQKLRDQFAEMVIENL

SEQ ID NO: 137234 - protein, 299 aa, Heterodera glycines
  Coding regions on vcDNA: vcDNA=SeqID_63657; Strand=+; Position=1-899
MFACRFGPILPIAAFFFDPTYATEYGNKLDALFKQWPEPLLINETEVSGGKTLGQKIIGSVLQRGKSPTKKGKEKVNEESSSAAEQEAFVMNRANFENLIKQNFETVKALMEQNSAYQVNRIYEWLYSTTTNRQQEMPKSQTETAIPLDDDYVLMPKSQNETAIPLDDDYMLVPKSQTETAIPLDDDYVLVPKSQTETAIPLDDDYVLVPKSQNETAIPLDDDYVLVPKSQTETAIPLDDDYVLVPKSQNETARLLDDDDMLIAFVTKDYANFENHCIEMNKQDLLAHVGLLSKRKGKG

SEQ ID NO: 137235 - protein, 264 aa, Heterodera glycines
  Coding regions on vcDNA: vcDNA=SeqID_63658; Strand=+; Position=1-794
  Homolog annotation: Hit_ID=NP_507780.1; Match level="QueryCoverage =71%, HitCoverage=13%, E-value=5e-14, Identity=28%"; Hit description =predicted CDS, DNA polymerase type B, organellar and viral family member (5T899) [Caenorhabditis elegans]
QLLREAGIPTTEPEYDAEIYIHQVQGLWNVKYPGEYKIFIFNDYQMSPITKSDITDYQFPILLYHNNNHFDGIKTLSKFFNKKNYCLSCESPYYKKIEHSLKCTSLCHGCREVGVDYPCEPQQGYSKKCEHCNNTFYNNSCYERHLHKDLCTKFQRCEDCGVIYNIKVHGSVGHKCGEQFCKLCKQFHIKEDEDDGMNPCTKCFIQPLKQQRIKSYRIIAYDFEATQDKKVENRFEHEVNFAAATIICTDCIINSDWNKSLQGK

SEQ ID NO: 137236 - protein, 78 aa, Heterodera glycines
  Coding regions on vcDNA: vcDNA=SeqID_63659; Strand=+; Position=1 -134,162-271
STYGAGCVSNIWFGKIIFFDLSEGANINNFFLKTHTYEKVTSIFLIRSEIVRGGNIVLPYQKIVFAFLYISFVLNLLI

SEQ ID NO: 137237 - protein, 24 aa, Heterodera glycines
  Coding regions on vcDNA: vcDNA=SeqID_63660; Strand=+; Position=1-76
ITGVSIIAVLFLVFLMLSQNLVRF

SEQ ID NO: 137238 - protein, 115 aa, Heterodera glycines
  Coding regions on vcDNA: vcDNA=SeqID_63661; Strand=-; Position=1 -60,106-393
  Homolog annotation: Hit_ID=NP_997839.1; Match level="QueryCoverage =83%, HitCoverage=8%, E-value=2e-09, Identity=29%"; Hit description =Exportin 4 [Danio rerio] gb|AAH48882.1| Exportin 4 [Danio rerio]
MAVSISNELSKLEFAAQVIMAPPNQVTSQDRKDAEALFMSLREGVISVEHCRQSLEATKNHFLMFELTRALVARLLKEWAQFSLDDVSNICDYLFNFPAVHTEYFLKVKLFISPN

SEQ ID NO: 137239 - protein, 48 aa, Heterodera glycines
  Coding regions on vcDNA: vcDNA=SeqID_63662; Strand=-; Position=1-158
IPIKFFKILPINWLIFSEKLFINDQNFQFFPRRRLSAPPAPPKTPIFS

SEQ ID NO: 137240 - protein, 101 aa, Heterodera glycines
  Coding regions on vcDNA: vcDNA=SeqID_63663; Strand=-; Position=1-306
LVAICDASLEYKTKFYDNGCILKHFWMTTKKIGQFYGKIDARYNGEPKHWITEIELGPLLWQFKHLINDPMAEKHPIELENLFVLDPCEEAKLKLKHSGNF

SEQ ID NO: 137241 - protein, 151 aa, Heterodera glycines
  Coding regions on vcDNA: vcDNA=SeqID_63664; Strand=+; Position=1 -139,307-457,501-620
  Homolog annotation: Hit_ID=CAE61217.1; Match level="QueryCoverage =100%, HitCoverage=32%, E-value=2e-50, Identity=67%"; Hit description= Hypothetical protein CBG05011 [Caenorhabditis briggsae]
CHDQDEAARVMSHFKILIRPMISNPPIHGARIASKILSDPKLRQQWGDVKGMADRIITMRSQLRDLLAKAGSKRNWDHIVNQIGMFCFTGISPEQVDRLAKEFSIYLTRDGVDRLAKEFSIYLTRDGRISVAGISSKNIDYLANALHEVTK

SEQ ID NO: 137242 - protein, 62 aa, Heterodera glycines
  Coding regions on vcDNA: vcDNA=SeqID_63665; Strand=+; Position=1-191
MLDQGDIIVPITPISSNVADAVFNQFIKVEQSVARKSLNIYGTPFVITVTVLNINGLRKNKE

SEQ ID NO: 137243 - protein, 112 aa, Heterodera glycines
  Coding regions on vcDNA: vcDNA=SeqID_63666; Strand=+; Position=1 -197,336-476
  Homolog annotation: Hit_ID=NP_501211.1; Match level="QueryCoverage =80%, HitCoverage=31%, E-value=7e-17, Identity=44%"; Hit description =voltage-dependent anion channel 2 (30.0 kD) (4I272) [Caenorhabditis elegans] gb|AAB00622.2| Hypothetical
DLTLFGGPLFTGSFVAKMSNDWLVGAQLKANLEQGTVGPTAISIGRKTAEYSLHSHTTDGTDFGASLYHRVHQNLEYGVQMGWKMRDALASWAIATKYNMSPELTLRAKMDH

SEQ ID NO: 137244 - protein, 92 aa, Heterodera glycines; identical to SEQ ID NO: 124679
  Coding regions on vcDNA: vcDNA=SeqID_63667; Strand=-; Position=1-705

SEQ ID NO: 137245 - protein, 104 aa, Heterodera glycines
  Coding regions on vcDNA: vcDNA=SeqID_63668; Strand=-; Position=1-314
MQMDYKFDLKDFKSNNCYNPSNLNFVELESELFRLTCHFDRRIRTFAISALEQMCEDASMKMLEKECLSLEYYPHLANLCKNSEQNVRVVALRILTKFALVYPE

SEQ ID NO: 137246 - protein, 103 aa, Heterodera glycines
  Coding regions on vcDNA: vcDNA=SeqID_63669; Strand=+; Position=1 -78,163-393
MDAESQHPFVVDNDSDGLYPHLGVGDLAFSIWRNELLMPLAAQLVAHIIELLGRIRNGISASFGIRISDLRGRRPLFWSMSMNPSIGSKSTVFVHVHWYPTTE

SEQ ID NO: 137247 - protein, 62 aa, Heterodera glycines
  Coding regions on vcDNA: vcDNA=SeqID_63670; Strand=-; Position=1-187
  Homolog annotation: Hit_ID=CAE70223.1; Match level="QueryCoverage =100%, HitCoverage=4%, E-value=3e-19, Identity=72%"; Hit description =Hypothetical protein CBG16703 [Caenorhabditis briggsae]
ASKDIVAVFHLRHILLDGHCFEDPSGNPPRGLQFVLGTRAEPALFDTIVMANLGYFQLKAGP

SEQ ID NO: 137248 - protein, 18 aa, Heterodera glycines
  Coding regions on vcDNA: vcDNA=SeqID_63671; Strand=+; Position=1 -51,726-731
MGNSGFNAPGVYCVHAKN

SEQ ID NO: 137249 - protein, 428 aa, Heterodera glycines
  Coding regions on vcDNA: vcDNA=SeqID_63672; Strand=+; Position=1 -35,269-380,454-578,660-725,783-1158,1235-1343,1389-1528,1578 -1614,1662-1707,1771-1850
  Homolog annotation: Hit_ID=CAE64863.1; Match level="QueryCoverage =99%, HitCoverage=68%, E-value=5e-78, Identity=41%"; Hit description =Hypothetical protein CBG09661 [Caenorhabditis briggsae]
PPPLPPSLSVPICSVSCPSREELFRLNIGGRSFSFRCEPFSRHASRTHLLLVRLDHSNRLLLTDGFLAKTNEYYLERNVRVAEHVVDYFLTGKLHKPIDVCPQRKLHKPIDVCPQRFSEELLFWRLGPVLLRSGGQQGPVLLRSGGQQPTEEGHRSGRQLDQGGERSEQRHDEFSGEVLPGDRKVIWHMMEAPSSSMVSKLFTIVSVLFILASVVGLVLGSMPEFQADNRFSENYHALLTARKGFGQSQRPQENENGTKNSFSDQFVYRPTDNPQPWLILLEYCCIGWFTFEFILRFLVAPRRMNFLVAPRRMNFLRQPMNLIDLFTVLPVFCEAALSTFGVNAERLKDLAGAMLVIRAMLVIRVLRVLRMARVFKLARYSTGLQMARVFKLARYSTGLQVFVFGMTLRNSLRELCMLSMFLLCGTGV

SEQ ID NO: 137250 - protein, 79 aa, Heterodera glycines
  Coding regions on vcDNA: vcDNA=SeqID_63673; Strand=+; Position=1-240
MKGCLLISSLFAFLITILISNNYVGSENKKLEQKSFDEIFGEKWEEKRNEEQKKREIIGKFNKIKEKIKQKGRKYSAKE

SEQ ID NO: 137251 - protein, 24 aa, Heterodera glycines
  Coding regions on vcDNA: vcDNA=SeqID_63674; Strand=+; Position=1-76
VTGVSIIAVLFLVFLMPLQNLVRF

SEQ ID NO: 137252 - protein, 282 aa, Heterodera glycines
  Coding regions on vcDNA: vcDNA=SeqID_63675; Strand=+; Position=1-850
  Homolog annotation: Hit_ID=XP_521668.1; Match level="QueryCoverage =96%, HitCoverage=98%, E-value=1e-23, Identity=24%"; Hit description =PREDICTED: similar to uncharacterized glycine-rich low complexity protein [Pan troglodytes]
FQSLGLNPPAFQSLGLNSTAFQSLGLNPPAFQSLGLNPTAFQSLGLSPPAFQSLGLNPTAFQSLGLNPTAFQSLELNPQHSNHWHSILLHFNHWDSTHQNSITGTQPTNISITGTQPNSISITGTQPTSISITGTQPTNISITGTQPNSISITGTQPTSIPITGTQFSCISITGTQPTSISITGTQPNSISITGTQPTSISITGTQPNSISITWTQPTAFQSLALNSPAFQSLGLNPPSFKSLGLNPTAFQSLRLSPPALQSLGLNPTAFQSLGLNPQYSNH

SEQ ID NO: 137253 - protein, 138 aa, Heterodera glycines
  Coding regions on vcDNA: vcDNA=SeqID_63676; Strand=-; Position=1 -162,533-676,1050-1159
RYRTVQLVRVKYGIELADALKKHLTDFEQLIDLLLIRQLERITSVYEEKQITKQMAQLTTAVDYKMVSKLGVSADELSAARCFLLKYDCARDQYVRPFNFRQRATCLHRLSESVAFVPRRATDDGKGQGGRVRVHWER

SEQ ID NO: 137254 - protein, 140 aa, Heterodera glycines
  Coding regions on vcDNA: vcDNA=SeqID_63677; Strand=-; Position=1-423
  Homolog annotation: Hit_ID=E86336; Match level="QueryCoverage=99%, HitCoverage=35%, E-value=6e-16, Identity=44%"; Hit description =hypothetical protein F14O10.11 - Arabidopsis thaliana gb|AAF88160.1| Contains weak similarity to an unknown pr
MIEVRQMASYKRRRQLWNAENERFEEEGEKEQEENEEGGGGEGNEWEKEAAEEEVENNEAEEENDDENEELEKEGVVTEEEEEEMSEEEDEEEEEEMMGKEVDYESGDEGIVLVRRKVPADGLKEQKEKPTDDTATNRKL

SEQ ID NO: 137255 - protein, 99 aa, Heterodera glycines
  Coding regions on vcDNA: vcDNA=SeqID_63678; Strand=+; Position=1-300
MLTIGSYDYNDFCPIHSTKLTDKDFVSLNFCRVTMTKKIARKAKREMKVGNVFAQFALQNGQIVHVIRNHSTANGTNEHIVNVNLDKSKRNNTMYTENV

SEQ ID NO: 137256 - protein, 515 aa, Heterodera glycines
  Coding regions on vcDNA: vcDNA=SeqID_63679; Strand=-; Position=1 -725,1120-1319,2268-2337,2431-2734,3381-3629
  Homolog annotation: Hit_ID=CAE72477.1; Match level="QueryCoverage =86%, HitCoverage=58%, E-value=4e-40, Identity=36%"; Hit description =Hypothetical protein CBG19653 [Caenorhabditis briggsae]
MTNRSISHSNNGKKPQQRHDATTSAQRVLLLLQPDQLNTDTHKTILDFFNNFKVPVLVEAHLPGERLLLELGDRPRFGLVVFTDYRSFHLLSSTEKDVLSQFCARHSVGVISFLELPSDEEQQHRTEFANFTAFGRQSVTKIVVSGTSPVHNVAKSGTEYSVPQKDGDAKLAFTLFKHALSHMNPILEAENELGHRFSIALQLEEHHVMFGAKPNQHWLVRVALLDAVTFLAPAIHDDDLERFVQIDIDDVFIGAIGSRMVADDVDYLSILQGKLREHIANFHFTLGFSGNFFRHGDPAEIQGDEILVKYPHLKPASGRRAFVHGNITVLPRQTCGLFTHTQFFHAYPDGVDNFLHNVLGGGDLFSSILMNKFSVFMTHQQNYANDRLGGFTFMNIAKFVGCWTNLRLKWTAPKNVADLYMKRFPNERTLLYTGPVRLVCSCRCTQTLAPMCPFPTHLKNSNFLLVQIMRLAWNGTQNSLPTTPPPCPFCLKRLQIILTTRGRPRRCTRWCQMRD

SEQ ID NO: 137257 - protein, 256 aa, Heterodera glycines
  Coding regions on vcDNA: vcDNA=SeqID_63680; Strand=-; Position=1 -115,368-686,813-1149
  Homolog annotation: Hit_ID=NP_500013.1; Match level="QueryCoverage =71%, HitCoverage=15%, E-value=5e-16, Identity=29%"; Hit description =predicted CDS, polyprotein family member (4B673) [Caenorhabditis elegans] gb|AAC02594.1| Hypothetical pro
MQMVPANTLFARVGLDLAGPFPMTISGNKYILNIICWFSKYITKEQPDFDEFLDYANFCYNTSVHSSTNETPYFLMFGRDPIFCIDQILDPKVRDPIAFTDETEFKQKLVISLRRAWKSASEVHADAQEKMKIQYDKTMRTPKLNCNSPQSNPRRVHINQLKKCVEILGPACTSPWLSPEENNALVEAESEEIADLPGHSHPIIIKEQIELPAQNHANDLVSDTQNIENDTSEPTQLPQYALRNRTKLNKPARYLD

SEQ ID NO: 137258 - protein, 68 aa, Heterodera glycines
  Coding regions on vcDNA: vcDNA=SeqID_63681; Strand=-; Position=1-207
MPTLADYKMGTLADLQNAHIGGFTKRDSTKNRHQTMELFGILVKDKLLDGVAFSLGSFFDSVFVIMVH

SEQ ID NO: 137259 - protein, 32 aa, Heterodera glycines
  Coding regions on vcDNA: vcDNA=SeqID_63682; Strand=+; Position=1-99
NDQSHKFCVHTRRGDFVKMMLGLEEGTYGERN

SEQ ID NO: 137260 - protein, 276 aa, Heterodera glycines
  misc_feature (265)..(265): Xaa can be any naturally occurring amino acid
  Coding regions on vcDNA: vcDNA=SeqID_63683; Strand=+; Position=1 -39,785-1534,2694-2741
  Homolog annotation: Hit_ID=NP_908986.1; Match level="QueryCoverage =97%, HitCoverage=19%, E-value=6e-63, Identity=47%"; Hit description =putative polyprotein [Oryza sativa (japonica cultivar-group)]
RGQRNINTGADRRSSSPWASPIVIAKKDGTLRFCVDYRKLNSVTVKDAFPLPNIDHILALGGRRVFSTLDFVSGYWQIKMDHSSMEKTAFSTEFGRHEFLVLPFGLCNAVATFQRFMTRLFSDCLNKFVFIYIDDILIASESWEQHTKHLKAVKRIENASLKLKISKCHFASSELPFLGHILSNEGLKMDMAKVKPVLELPNPATKKQLQSLLGFLAYYRKFIYGFGAAAPLNSLLKKDSDFALGEVEKKAIGALKSKIISAPIXQLPQIPSPSYD

SEQ ID NO: 137261 - protein, 150 aa, Heterodera glycines
  Coding regions on vcDNA: vcDNA=SeqID_63684; Strand=+; Position=1 -330,415-537
MAAMLIPADGQYQLCPSKPTEGITVTMSFPEEQNCTLPVEKPPLTVKSNLYIPIRIPRVFPAFKCWNVTTVTCTESFLRIMTLDHPDKKIEADASVEDCQASIHHSPMNRTVIEEGKAGILDGKRLITSWGDSLKIDKSLGEDGSWIRLK

SEQ ID NO: 137262 - protein, 238 aa, Heterodera glycines
  Coding regions on vcDNA: vcDNA=SeqID_63685; Strand=+; Position=1-714
MDLDALRRRIVTLEREMRENGGTRPGLPMPTTFDGTTDLQDYLKTFNLIATAHNWTPARCVQVLPLFLRGSARAIYESIEPDIKDNWRSLIDAMADKLKQMSPSLTARQKLAQRKQLTGESLEEFAQAIRNLVLRAYPDNSLEMDFGNLVLGALENDVKQANEVRLRQFRSEIARDFFRANMAPRLKERVIHMEEPQTLEEAVAQARRVEQVQGNLADDMWKNTQDAKAEVALAEVNA

SEQ ID NO: 137263 - protein, 45 aa, Heterodera glycines
  Coding regions on vcDNA: vcDNA=SeqID_63686; Strand=+; Position=1-136
MKANCASDSQKKLPSADLCNGRCSAERRIHCRELAKWGRQLTTLV

SEQ ID NO: 137264 - protein, 99 aa, Heterodera glycines
  Coding regions on vcDNA: vcDNA=SeqID_63687; Strand=+; Position=1 -85,138-172,227-405
MDNPGPSNGIDLIELGDSDDERMEKFAFGGNDTLSLISLKTDFERPPKEEAMLNLVDASFELIDPNPNVHELFVTFDHQFFSGTLNSNACVVEWSKTMT

SEQ ID NO: 137265 - protein, 138 aa, Heterodera glycines
  Coding regions on vcDNA: vcDNA=SeqID_63688; Strand=-; Position=1-415
  Homolog annotation: Hit_ID=NP_700900.1; Match level="QueryCoverage =97%, HitCoverage=92%, E-value=2e-21, Identity=41%"; Hit description =hypothetical protein PF11_0035 [Plasmodium falciparum 3D7] gb|AAN35624.1| hypothetical protein [Plasmodiu
MREKGKGGEKGEEKEEKKERKRRGKGKEKERKRRRKRRGKGGEKGEEKEEKKERKRRRKRRGKGGEKGEEKERKRRGKGGEKGEEKEEKKERKRRRKRRGKGGEKGEEKERKRRGKGGEKGEEKEEKKERKRRGKGGE

SEQ ID NO: 137266 - protein, 52 aa, Heterodera glycines
  Coding regions on vcDNA: vcDNA=SeqID_63689; Strand=+; Position=1-158
MANLCSAKLLKVFVLLLLLLLLNSLLVLPARILVALAPDNKSHLRSMLPLIN

SEQ ID NO: 137267 - protein, 264 aa, Heterodera glycines
  Coding regions on vcDNA: vcDNA=SeqID_63690; Strand=-; Position=1 -103,152-410,456-632,674-929
MANRMQQTYRRAFSVIQQRVEGVIPSSFMLDFEPAARSAFLDVWPNTMIRHCLFHLAQSVNRRVQREGLAPQFLVDIDFRKSVRSLSAISFLPLIYVEEGYQILRNHAPIQAHPIFDYFASTYLFRVDGNGNRRPALFVPETWNMHDSVLGDLGRTNNGLEGFHDSFNKRFSAPNPPLATFISRIKDEDEYQRNRMRPHELDQTRPVSEVPRSKKYLENDRAIRDLVAQFDEQDPDDRNEQHWLRHLHAISFRLTTKGIDNWIE

SEQ ID NO: 137268 - protein, 79 aa, Heterodera glycines
  Coding regions on vcDNA: vcDNA=SeqID_63691; Strand=-; Position=1 -12,427-654
MYFKKRQRQEQLKDAAMDQPEAAPRNLIGSSREGLSDDQLVRLPTYGASRIKIQRQRQIPGRDAVNAANPLEIEIEVSH

SEQ ID NO: 137269 - protein, 55 aa, Heterodera glycines
  Coding regions on vcDNA: vcDNA=SeqID_63692; Strand=+; Position=1 -94,653-726
MARRKVKNSRADLGLLMLYAVKGEGKQELFGYVLNDCLVLIINNLIAIFSKLRIF

SEQ ID NO: 137270 - protein, 132 aa, Heterodera glycines
  Coding regions on vcDNA: vcDNA=SeqID_63693; Strand=+; Position=1 -85,317-486,557-649,1087-1137
  Homolog annotation: Hit_ID=AAO33474.1; Match level="QueryCoverage =94%, HitCoverage=97%, E-value=5e-25, Identity=53%"; Hit description =gland-specific protein g4g12 [Heterodera glycines]
MSNITKTLLLLILLVAVSFRFSASTNGKKNANDGNGSNASVGIGTKIKRIVTAGLLFTSLATGGAGEIQRSNVQRRNVMGLTHPMPPRPPPELTPFQKAKAIIEEHAKKNNFTESERGYVSGGPDSLTIIEI

SEQ ID NO: 137271 - protein, 53 aa, Heterodera glycines
  Coding regions on vcDNA: vcDNA=SeqID_63694; Strand=-; Position=1 -72,332-421
MFFYDCFCFLKWSKLWRRWRRLEKLFTMFTRHGLGEYFQRQKMMKLSHNLKAN

SEQ ID NO: 137272 - protein, 77 aa, Heterodera glycines
  Coding regions on vcDNA: vcDNA=SeqID_63695; Strand=+; Position=1-236
LDISWAGHFVGQRKKWAALCLPTVSVLCYGQLGHLSYALSPPVSFCESPGGPNPHHHFNFTYPVDPIHSQSLKYRKK

SEQ ID NO: 137273 - protein, 151 aa, Heterodera glycines
  Coding regions on vcDNA: vcDNA=SeqID_63696; Strand=+; Position=1 -75,271-461,511-603,791-826
  Homolog annotation: Hit_ID=AAG21331.2; Match level="QueryCoverage =100%, HitCoverage=100%, E-value=1e-34, Identity=54%"; Hit description=hypothetical esophageal gland cell secretory protein 1 [Heterodera glycines]
LPNPFLLILLVAVSFRFSASTNGKKNANDGNGSNASVGIGTKIKRIVTAGLLFTSLATGGAGAIQRSNVQGGNATGLTHPMVQRIISNPPPPPPELTPFQKAEAIIENPPPPPPELTPFQKAEAIIEEHAKKINFTESKRESPGGPDPHHH

SEQ ID NO: 137274 - protein, 39 aa, Heterodera glycines
  Coding regions on vcDNA: vcDNA=SeqID_63697; Strand=+; Position=1 -44,257-332
MDSIQKFMLLLKLLNKIMPYFVPKKQLKLRILRNDPARF

SEQ ID NO: 137275 - protein, 211 aa, Heterodera glycines
  Coding regions on vcDNA: vcDNA=SeqID_63698; Strand=+; Position=1 -282,345-423,480-533,582-802
  Homolog annotation: Hit_ID=XP_326988.1; Match level="QueryCoverage =63%, HitCoverage=80%, E-value=3e-16, Identity=34%"; Hit description =hypothetical protein [Neurospora crassa] emb|CAD70926.1| related to Ypt-interacting protein YIP2 [Neurosp
MSNQSTSSAAAAGSTAPPSPSNEASSPSAAQASSQSSSAAGDSSASPNGPRLKPRKVPVNRFRDVRPALQLRLSQLKHPLIRKLEQDTGIDRERLFYMAMAYFVFLLLFTQCKLLLSTLIGSVYPAYQSIVTVHTQAKSEEIQWLTYWCLFSLFSLCDISFSVALPFYALVKTIILLYLALPQTYGAHNFYVIYVDPLVDQWMLMVNEIAG

SEQ ID NO: 137276 - protein, 129 aa, Heterodera glycines
  Coding regions on vcDNA: vcDNA=SeqID_63699; Strand=-; Position=1 -62,98-425
MAKQNTDQLSTSDGIVAKQKLDFPRRKHIGTDLASIGAQNWLFKRKDSIRQRTKGFFRPEENGNLMNKLQGLEASFDDISYLNTKLRLVLESQDKLEKSNFGIGKFTTKDDKYKKRFNHPSFNMKLYDK

SEQ ID NO: 137277 - protein, 119 aa, Heterodera glycines
  Coding regions on vcDNA: vcDNA=SeqID_63700; Strand=-; Position=1 -97,186-371,465-541
MKAHFNGISHNGEASMYAKIEQQSAEELIKLHKSAINQFESRGIPSLNPFNESHFVPHATILYLRSESDRKLIKWWAEEEAKWEGRKLGTENVKMLQLCNIDLDDQTEDYEVLYEVRID

SEQ ID NO: 137278 - protein, 32 aa, Heterodera glycines
  Coding regions on vcDNA: vcDNA=SeqID_63701; Strand=-; Position=1 -8,625-715
MLNACDALAATVQHFAQPLVVIYLVFEESIHF

SEQ ID NO: 137279 - protein, 96 aa, Heterodera glycines
  Coding regions on vcDNA: vcDNA=SeqID_63702; Strand=+; Position=1-288
MQFSSVGHLRQTLNDIIKDAYKQRFGLSPQKAAGTTVKAKRQIDVTDLFFHDHPGDYWEKIEELEKKLAELKEEIMTKEREHGAKGTEQKRKRNLK

SEQ ID NO: 137280 - protein, 118 aa, Heterodera glycines
  Coding regions on vcDNA: vcDNA=SeqID_63703; Strand=-; Position=1 -27,73-270,332-463
  Homolog annotation: Hit_ID=CAE68376.1; Match level="QueryCoverage =100%, HitCoverage=14%, E-value=5e-31, Identity=56%"; Hit description= Hypothetical protein CBG14132 [Caenorhabditis briggsae]
MGRALDKIHTFFERIEKHLENGAKPEEMSYEQQFSRMELKRAISSYPAKEVKKGLDNLYKKVEKHLCPGSPLLVVEEFLNQVKHYQELISRCYGASKIELDFSIGDVLQFFSEIAQQH

SEQ ID NO: 137281 - protein, 29 aa, Heterodera glycines
  Coding regions on vcDNA: vcDNA=SeqID_63704; Strand=+; Position=1-99
FIIKLYLIQSGEFESDFHLFGDLIEIPVG

SEQ ID NO: 137282 - protein, 95 aa, Heterodera glycines; identical to SEQ ID NO: 130684
  Coding regions on vcDNA: vcDNA=SeqID_63705; Strand=-; Position=1-677

SEQ ID NO: 137283 - protein, 84 aa, Heterodera glycines
  Coding regions on vcDNA: vcDNA=SeqID_63706; Strand=+; Position=1-252
MNEWMNKKGKRKKQTERNAPPPPHALAPPAAAIAAAAIKKPPASADVPPPTVTGEAPEMAALTVPALPNGKCCDAAVPPNADTT

SEQ ID NO: 137284 - protein, 181 aa, Heterodera glycines
  Coding regions on vcDNA: vcDNA=SeqID_63707; Strand=-; Position=1 -204,734-1075
  Homolog annotation: Hit_ID=CAE66469.1; Match level="QueryCoverage =93%, HitCoverage=17%, E-value=2e-13, Identity=38%"; Hit description =Hypothetical protein CBG11746 [Caenorhabditis briggsae]
MAMPPQSPASAAAAAAAAAAVVMQHQQQQQQVQSQLSKLDSLFGPGSPAAATAALLQLQQQHQQHQQQSAAAAAQCHQQQQQQANSELAAAALLASQFQRHNSSVVAASVAAQLLAAASPASPAAAAALSLMSSPLGMHNHPQQQQNHHNQQNQQQFANVAAAAASLIHQQQQVAPGLHAY

SEQ ID NO: 137285 - protein, 62 aa, Heterodera glycines
  Coding regions on vcDNA: vcDNA=SeqID_63708; Strand=+; Position=1-533
VTDIWRPNGIGEPFGIFPGSLSRFILKNVDQDPDKMDLNLVTLSWPDSQFRSRLLLILALSN

SEQ ID NO: 137286 - protein, 91 aa, Heterodera glycines
  Coding regions on vcDNA: vcDNA=SeqID_63709; Strand=+; Position=1 -190,546-631
MSTKAPPPTAATPSWSSTRWKSGGETNDAKENKKAHETSRTAATERTEGNVNFRLLAIAGIIAAESAFRVWPNPSNTAASSLSSSAHNEWE

SEQ ID NO: 137287 - protein, 260 aa, Heterodera glycines
  Coding regions on vcDNA: vcDNA=SeqID_63710; Strand=+; Position=1-783
  Homolog annotation: Hit_ID=NP_733106.2; Match level="QueryCoverage =91%, HitCoverage=79%, E-value=1e-33, Identity=40%"; Hit description =CG31439-PA [Drosophila melanogaster] gb|AAN14054.2| CG31439-PA [Drosophila melanogaster]
METTTIPLIIRPTTTIIPPATRTTTTAIPPITHTTTTAIPPTTRTISTAIPPIIRTTTTAIPLIIRPTTTIIPPTIRITTTAIPPTTRATTKAIPLIIRPTTTIIPPATRTTTTAIPPITHTTTTAIPPTTRTISTAIPPIIRTTTTAIPLIIRPTTTIIPPTTRTTTTAIPPITTTAIPPTTRTISTAIPPIIRTTTTAIPLIIRPTTTIIPPTTRTTTTAIPPTTQATTREMPQGTIETIEKLIKKLEKMTEIRTKTK

SEQ ID NO: 137288 - protein, 72 aa, Heterodera glycines
  Coding regions on vcDNA: vcDNA=SeqID_63711; Strand=+; Position=1 -18,198-398
MAYCKDLPVELLIILPAFFYYGSYFSLTKYVRNFVGVNRLRQPEVFGDEIALICKRNRGGNGQTTTKCRVGN

SEQ ID NO: 137289 - protein, 195 aa, Heterodera glycines
  Coding regions on vcDNA: vcDNA=SeqID_63712; Strand=+; Position=1 -403,451-634
  Homolog annotation: Hit_ID=EAL50144.1; Match level="QueryCoverage =49%, HitCoverage=27%, E-value=3e-12, Identity=45%"; Hit description =actin, putative [Entamoeba histolytica HM-1:IMSS]
MKKQKAKPEEKPAAPAEAKALVPEQKKAEETKEKLKQEEKAAEVPTSPEEKKRKEAEAKAKRDAEEKAKKEAEAKKKEEEIKKQKAKPEEKPAAFDANDFVALFSSYSSINFSVKFPSQTAQIEVVLSDCLLENVDSIKPSREPAPLYMKPKFVRGLSNVIDLMALNEATFECQFQGFPEPNVLWFIDDQPLTQK

SEQ ID NO: 137290 - protein, 23 aa, Heterodera glycines
  Coding regions on vcDNA: vcDNA=SeqID_63713; Strand=-; Position=1 -59,360-372
MKEAKFYHLLYDTLSEQSSEICA

SEQ ID NO: 137291 - protein, 117 aa, Heterodera glycines
  Coding regions on vcDNA: vcDNA=SeqID_63714; Strand=-; Position=1 -105,174-422
MEHEIGTYPSVTLSNSSIIAALQKRGCEGQLCQEKKFDPIPYKENLGIDNQAQGEQQPETPNRSPRRVRFADEQNEPLEQIQPIEPRRSTRQRKAPQQLDMEVTKTKYDYVKQGKTN

SEQ ID NO: 137292 - protein, 48 aa, Heterodera glycines
  Coding regions on vcDNA: vcDNA=SeqID_63715; Strand=+; Position=1 -22,538-662
MNNNWMISVLKRQNIEKSSESADKRRRHKTHILSDQNQFTDNKVAFEI

SEQ ID NO: 137293 - protein, 48 aa, Heterodera glycines
  Coding regions on vcDNA: vcDNA=SeqID_63716; Strand=+; Position=1 -70,145-220
  Homolog annotation: Hit_ID=AAG23825.1; Match level="QueryCoverage =100%, HitCoverage=4%, E-value=1e-12, Identity=62%"; Hit description =guanylyl cyclase [Heterodera glycines]
MGRIYKYVKEFGADAIIATPCMDVPPMLGHLASNFNLPMMVWGQSMAS

SEQ ID NO: 137294 - protein, 260 aa, Heterodera glycines
  Coding regions on vcDNA: vcDNA=SeqID_63717; Strand=+; Position=1-783
MAPEDQIPKPQAEKENVEPQADPEKQRKRRSPPAPIISELARMMDQLKASMVAEIQDCLEHVRNAMMDEVQLALDNLWAKIQPVMVDHGRSIAALADAFDEMTMKEAKDKMENPTEGGPGVNDPPANSPPESGGQNNQADNNNPPQSGGQNNQADNNNPQQSGGQNVQLANQFERPAQWQGRGSRGTWRGRRGFENGGPGRVSYLRRQLERESGGRVRIQHPYLEFRRGRGYGPSGRIDRAFGQYGGQNSGGPSRGRRGN

SEQ ID NO: 137295 - protein, 68 aa, Heterodera glycines
  Coding regions on vcDNA: vcDNA=SeqID_63718; Strand=-; Position=1 -190,404-420
MAFVQFAVLIWDTIVAYVHGKRADGTNANGEIDEKSEKIGHNRIQAFIAATKCFDLPEWRTNLAFLTL

SEQ ID NO: 137296 - protein, 59 aa, Heterodera glycines
  Coding regions on vcDNA: vcDNA=SeqID_63719; Strand=-; Position=1 -7,163-335
MTDRLVKVPLIKNAEKVFRRIDKARLNESEQNARCNAENEEKAGHHANNLGLGFIDFSA

SEQ ID NO: 137297 - protein, 219 aa, Heterodera glycines
  Coding regions on vcDNA: vcDNA=SeqID_63720; Strand=+; Position=1 -119,167-351,1141-1290,1643-1849
  Homolog annotation: Hit_ID=XP_308120.1; Match level="QueryCoverage =31%, HitCoverage=15%, E-value=4e-10, Identity=48%"; Hit description =ENSANGP00000017139 [Anopheles gambiae]
IMTTGSDRTQLQLQLHFNANNSSEASQSQNSSEQMQNCSTNERVSGEDSVPFIDRETFGDAESDRGRGPPPDRFRLVYLIVLLHGMGMLLPWNTFITIAGDNFYNYYVQKAAKARANNGTNILHEEETGEAKANRKVTHPPLKTYIAIFSEPFPDYLSLPICLRLLFLPLFWFCDYQYDNLTPRRFVFIHNQWVFTVLITLMALSHGYCSSLAMVYAPK

SEQ ID NO: 137298 - protein, 120 aa, Heterodera glycines
  Coding regions on vcDNA: vcDNA=SeqID_63721; Strand=-; Position=1 -105,221-476
MLAYFESEEQRLRANESTTGIYRIGDCDGGQNDGKQIVLGTWERFAFANVQPMVAGGHSAGQFHGNVLQFMQFVISSFALQKRRNRVDAQPKSFRGAQRGESSRRLTNRTTNGRRSATDA

SEQ ID NO: 137299 - protein, 270 aa, Heterodera glycines
  Coding regions on vcDNA: vcDNA=SeqID_63722; Strand=-; Position=1-810
  Homolog annotation: Hit_ID=NP_502721.1; Match level="QueryCoverage =72%, HitCoverage=14%, E-value=3e-24, Identity=35%"; Hit description =endonuclease/exonuclease/phosphatase family and RNA-directed DNA polymerase (4O953) [Caenorhabditis elega
MFSKFFSKGRNSIFKYIQKYEVNPFEIPNLVFETKCYHDGAEKCELFANLFVNSFNNSEDDPGCYSLGTTFANQCFISDIDFNIIETQKLLKKLPNKNGTSPDDISYKTLKNCHSSLATVITDLFRISLDSGSLPDIWKESIVLPLFKKGDKSNPENYRPISLTCSLCRVMERILSQNIYNFLLKNNKISEYQFGFVRNRSTTSQLITVVEDWYEAIINGKNVTGHVNQITRNAYLRMSSLFRIIKSKSSKIWITLYKTYIRPLLEYAPE

SEQ ID NO: 137300 - protein, 69 aa, Heterodera glycines
  Coding regions on vcDNA: vcDNA=SeqID_63723; Strand=+; Position=1-208
MLLRSFVQDRTNFAELCKKLEKLDLMKMITFVTRRRGKAVYDSGETVEYLRQQFEAYLGVMHLMRQTWA

SEQ ID NO: 137301 - protein, 117 aa, Heterodera glycines
  Coding regions on vcDNA: vcDNA=SeqID_63724; Strand=+; Position=1 -81,126-280,327-444
  Homolog annotation: Hit_ID=AAO49799.1; Match level="QueryCoverage =93%, HitCoverage=28%, E-value=8e-37, Identity=77%"; Hit description =arginine kinase [Heterodera glycines]
MRRLPLTLARTPPSRTIRLAFVTHALQGYPFNPCLMGTTVRASVHIRLPKISANHDDFKSICEELKLQIRGIHGEHSESAGGVYDISNKARLGLTEFEAVKQMYDGVKHLIELEKKA

SEQ ID NO: 137302 - protein, 126 aa, Heterodera glycines
  Coding regions on vcDNA: vcDNA=SeqID_63725; Strand=-; Position=1 -15,53-189,423-651
MAHTEEVTWPTISRAYAKNKIGTTAIVESEAEYKKVAQRVKEKLDIIGPKKYFHTVIVFPNWSNAFQLAILATQSHYFFLDGENEIKEKKINVIVVRCENDRFGRAIQAGQWFTQTVENQMKYMIK

SEQ ID NO: 137303 - protein, 94 aa, Heterodera glycines
  Coding regions on vcDNA: vcDNA=SeqID_63726; Strand=-; Position=1 -134,810-960
MPIVMLSNKHCEVITLSDDDGGQQQPMMAQQVQRHQPRQHGLQKSEYYGDCQSSNIAAIPNGRLPPNNQLHPRQQQQAQMQRQTLAQLLKAENV

SEQ ID NO: 137304 - protein, 143 aa, Heterodera glycines
  Coding regions on vcDNA: vcDNA=SeqID_63727; Strand=+; Position=1 -333,495-593
MVMSTGGPHSNLGLMSSSGGPHSNLGPMNPHSVQNPLSVQNPHSVQNPQSVTGIAPGSVKSYNDDMQHQMQQQKASGSKEEGANEELTVVEQYNESRDQFMNVCDNIERNMQLILEVNRQQSKLYNQQQNSAVAWVEVTSMLG

SEQ ID NO: 137305 - protein, 28 aa, Heterodera glycines
  Coding regions on vcDNA: vcDNA=SeqID_63728; Strand=+; Position=1-87
LGVFHLSQKNDRNNTNNRNSMTAVNQLA

SEQ ID NO: 137306 - protein, 53 aa, Heterodera glycines
  Coding regions on vcDNA: vcDNA=SeqID_63729; Strand=+; Position=1-159
  Homolog annotation: Hit_ID=ZP_00264951.1; Match level="QueryCoverage =98%, HitCoverage=13%, E-value=6e-22, Identity=94%"; Hit description =COG0446: Uncharacterized NAD(FAD)-dependent dehydrogenases [Pseudomonas fluorescens PfO-1]
MLSTGFAKNKDADGLSMAEPGAMAEQLNAEVRTHTRISGIDPGHKRLWIGEEQ

SEQ ID NO: 137307 - protein, 58 aa, Heterodera glycines
  Coding regions on vcDNA: vcDNA=SeqID_63730; Strand=-; Position=1 -51,632-757
MSDPALIFLHIPLEDLKSRFIRIAEYEQSLKRYVKLRVTLVAFNNALTPQCQLELMDA

SEQ ID NO: 137308 - protein, 60 aa, Heterodera glycines
  Coding regions on vcDNA: vcDNA=SeqID_63731; Strand=+; Position=1 -147,293-328
MVLLLLLLSLLLSVLALMPLLLLLLSQLLAQCQAVNELTFMLLLMLLSTTRNEFSEFPRL

SEQ ID NO: 137309 - protein, 95 aa, Heterodera glycines
  Coding regions on vcDNA: vcDNA=SeqID_63732; Strand=-; Position=1-285
  Homolog annotation: Hit_ID=NP_418310.1; Match level="QueryCoverage =100%, HitCoverage=22%, E-value=3e-48, Identity=100%"; Hit description=putative resistance protein (transport) [Escherichia coli K12] gb|AAB03008.1| ORF_o421 [Escherichia col
ILKSPSKYLCYTFIISTAALVLLIMLPHESMPVYLGMACTLGFGAIVFTQRAVFFAPIGEAKIAENKTGAAMALGSFIGYAPAMFCFSLYGYILD

SEQ ID NO: 137310 - protein, 93 aa, Heterodera glycines
  Coding regions on vcDNA: vcDNA=SeqID_63733; Strand=+; Position=1 -135,865-966,1292-1336
MAKRHRTERKEGEETEEREEKENKERGKEKETENEQEMRELGQMEKQTVTDANNPGEQKEASQSDAKALGEKQQNCYDEKTKANAEKQYEVGI

SEQ ID NO: 137311 - protein, 95 aa, Heterodera glycines; identical to SEQ ID NO: 130684
  Coding regions on vcDNA: vcDNA=SeqID_63734; Strand=+; Position=1-657

SEQ ID NO: 137312 - protein, 33 aa, Heterodera glycines
  Coding regions on vcDNA: vcDNA=SeqID_63735; Strand=-; Position=1 -59,602-644
MTIKIWDFVNTYECLKTLKGPLLFGVWPPKCRK

SEQ ID NO: 137313 - protein, 88 aa, Heterodera glycines
  Coding regions on vcDNA: vcDNA=SeqID_63736; Strand=-; Position=1 -34,190-329,478-570
MLTATPASFLYSGATKDELEEIKSQVNEVKQKWRTGDLEGADIQEDSAMRDELEALKGVNVKERFQPGQGEFQKSYDRSELDTSGVCV

SEQ ID NO: 137314 - protein, 140 aa, Heterodera glycines
  Coding regions on vcDNA: vcDNA=SeqID_63737; Strand=-; Position=1 -52,98-468
MADDSRIAGICESPLELGPAKQQQLSDAGGLPSSSSATVAADPKASGSFPLSFTDLTPIRSKSVKIEAKRRKVETALLTTKICETAAAAAAELPTLKEMQLKVLEKEDAKLTLEIRKLELELEVLELKKEKQTRKLLANF

SEQ ID NO: 137315 - protein, 86 aa, Heterodera glycines
  Coding regions on vcDNA: vcDNA=SeqID_63738; Strand=-; Position=1 -119,542-683
MSWQCPWTCNRCPPDGNVPTRPPQILDPPLPNRNCKDFLDCPAWARNGNCSLYSTSTRAAFCPITCQVGCAIGGGEGGVVLTSFNG

SEQ ID NO: 137316 - protein, 166 aa, Heterodera glycines
  Coding regions on vcDNA: vcDNA=SeqID_63739; Strand=-; Position=1 -107,158-373,415-592
MSDQIRCLIQSGVGSDHYAITSDGWSKPTLSPQLQSVTVHWIDKSFSRHDAVLAAFSMENFVHSGELISEKIALCLNQNGLTLNKMACCVRDDAKNMQSAIRQLEKESFQCCAHFLNLVVSDAMKTECLSEIIFKTKEVTNEMPDFCACQSGLAWQRWKQYLLLSK

SEQ ID NO: 137317 - protein, 87 aa, Heterodera glycines
  Coding regions on vcDNA: vcDNA=SeqID_63740; Strand=+; Position=1 -115,169-317
MFIINFSVILFVLISPVLSSFATICVRPNTFNYVGRLWYEESGRYSCIAFWVDLGICDQNDTNAMIQIIKADTNETVGIANGCDLCN

SEQ ID NO: 137318 - protein, 25 aa, Heterodera glycines
  Coding regions on vcDNA: vcDNA=SeqID_63741; Strand=+; Position=1 -19,770-828
MFIVLPMNPTYNSSDDNRYLSNSIF

SEQ ID NO: 137319 - protein, 48 aa, Heterodera glycines
  Coding regions on vcDNA: vcDNA=SeqID_63742; Strand=+; Position=1 -45,88-189
MPAARAPRQRVLYMLKMATEACSKSTLQYQANTASAFDLREKCPANLL

SEQ ID NO: 137320 - protein, 108 aa, Heterodera glycines
  Coding regions on vcDNA: vcDNA=SeqID_63743; Strand=-; Position=1 -92,152-233,451-600
  Homolog annotation: Hit_ID=NP_504760.1; Match level="QueryCoverage =100%, HitCoverage=12%, E-value=2e-18, Identity=41%"; Hit description= PaTched Related (ptr-15) [Caenorhabditis elegans] gb|AAC17680.1| Patched related family protein 15 [Caen
DDLRFLYSPEHSLSRFEYQIHKEFSGDSVNSSYIAIALEAAPPLAGVDDSSVEDAANLGTMNAILHNMTVELPDGSYHFGNDICARMALCPISNSPVQLFYDAYFSEK

SEQ ID NO: 137321 - protein, 107 aa, Heterodera glycines
  Coding regions on vcDNA: vcDNA=SeqID_63744; Strand=-; Position=1 -86,311-548
  Homolog annotation: Hit_ID=CAF90061.1; Match level="QueryCoverage =74%, HitCoverage=16%, E-value=4e-12, Identity=41%"; Hit description =unnamed protein product [Tetraodon nigroviridis]
MVLKGKGIKRLEQPGYGDQILNIKVNVPKHLTARQRTLMLEFAKLEAGRRGTVDGLDSGGGKGGGAAANDQAEEPEEMPAAGTKKKGTNGGGGEDKGGAGFKWSKFF

SEQ ID NO: 137322 - protein, 136 aa, Heterodera glycines
  Coding regions on vcDNA: vcDNA=SeqID_63745; Strand=-; Position=1 -230,287-465
GPPKAEEFDATGADTETEESLTYNFPTFVSIRRAYNRRRQQKHGISTDPYEIPAQLLLTRQGAIKLALNKPLSKDDNWVIYRNRDEGIIIFDTKTAELLSALAIGAAIATLLTPIVVGSVAIGYVIAYNVHKNNEK

SEQ ID NO: 137323 - protein, 74 aa, Heterodera glycines
  Coding regions on vcDNA: vcDNA=SeqID_63746; Strand=-; Position=1 -123,161-262
  Homolog annotation: Hit_ID=XP_414857.1; Match level="QueryCoverage =98%, HitCoverage=1%, E-value=1e-09, Identity=42%"; Hit description =PREDICTED: similar to CASK interacting protein 1 [Gallus gallus]
VIVHFDLKGAAPKPHYIKELLPFIKKLGFTEILMEYEVQEIDMFPYSFGLSVLRRKTAFDEMTTKQLKEVVYLH

SEQ ID NO: 137324 - protein, 24 aa, Heterodera glycines
  Coding regions on vcDNA: vcDNA=SeqID_63747; Strand=+; Position=1-74
RVINSWNLLPKNIMEINDPKKFRE

SEQ ID NO: 137325 - protein, 97 aa, Heterodera glycines
  Coding regions on vcDNA: vcDNA=SeqID_63748; Strand=+; Position=1 -35,84-342
MEPGFASPWMFKIWKQFTRKITEFVMVYDIKINLHDRDNVVKLQSLIHNQFQAPCFNDWLVFAWKKAGYYGDDTLPNFCHPNKYAFDVPKERYLRKI

SEQ ID NO: 137326 - protein, 23 aa, Heterodera glycines
  Coding regions on vcDNA: vcDNA=SeqID_63749; Strand=-; Position=1-71
RVPIFRQKPIFFLSSPWPETHAK

SEQ ID NO: 137327 - protein, 56 aa, Heterodera glycines
  Coding regions on vcDNA: vcDNA=SeqID_63750; Strand=+; Position=1 -35,431-566
MDKEKVVYCKKCYINDKSKFINALIKKAFDNGFNSSNDATFFARKTATGDNRRKEE

SEQ ID NO: 137328 - protein, 42 aa, Heterodera glycines
  Coding regions on vcDNA: vcDNA=SeqID_63751; Strand=-; Position=1-129
KATEMDSKEPKYDMTNAIWSLLFAASQETQGPHAKHTNGQSE

SEQ ID NO: 137329 - protein, 231 aa, Heterodera glycines
  Coding regions on vcDNA: vcDNA=SeqID_63752; Strand=-; Position=1 -195,314-812
  Homolog annotation: Hit_ID=NP_491240.1; Match level="QueryCoverage =100%, HitCoverage=20%, E-value=5e-47, Identity=35%"; Hit description= zn-finger, CCHC type and RNA-directed DNA polymerase  and Integrase, catalytic domain containing protein
MPYGVASAPAIFQQVMEDVLRGIDGVAVYLDDIVVTAPNDAEHLKRLEMTLQRIQKFGLRVKKENELKSFLGMVGYYRKFIPSMATISEPLNELRRSETKWHWGQQQQKSFEQIKIMLSSNELLAHFDPKKPLYLATDASDYGVGAILFHKDGTTGKFGVIAYASRTLSPAERNYAQIEKEGRAVIFGVEKFNQYLYGRKFILQTYHEPLKRIFGPKGELPVVAARRLHRW

SEQ ID NO: 137330 - protein, 161 aa, Heterodera glycines
  Coding regions on vcDNA: vcDNA=SeqID_63753; Strand=+; Position=1 -152,202-357,428-565
  Homolog annotation: Hit_ID=CAE66491.1; Match level="QueryCoverage =96%, HitCoverage=34%, E-value=1e-64, Identity=85%"; Hit description =Hypothetical protein CBG11771 [Caenorhabditis briggsae]
LPFCATGDSEVQRTMLELLNQLDGFEPTKNIKVIMATNRIDILDPALLRPGRIDRRIDRKIEFPAPDEKARLDILKIHSRKMNLMRGINMSKIAETIPGASGAEVKAVCTEAGMFAVCTEAGMFALRERRIHVTQEDFEMAVGKVMAKDGEKDMSLRKLFK

SEQ ID NO: 137331 - protein, 19 aa, Heterodera glycines
  Coding regions on vcDNA: vcDNA=SeqID_63754; Strand=+; Position=1-57
MSTISCQRQPLRTQFEQFT

SEQ ID NO: 137332 - protein, 857 aa, Heterodera glycines
  Coding regions on vcDNA: vcDNA=SeqID_63755; Strand=-; Position=1-2571
  Homolog annotation: Hit_ID=S60004; Match level="QueryCoverage=97%, HitCoverage=60%, E-value=2e-66, Identity=27%"; Hit description =hypothetical protein - common roundworm retrotransposon R4 (fragment) gb|AAA97394.1| reverse transcriptase cod
MALFRARSDKTPTHAGIPAPDEVREGGCGQNRTNPAAPRGKAVAIQRQNGITIPINACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDETETALAEVSRSSPFGEREPLDLGATERITRKRLRNAVRDVVPPRKRRVPSTSSRKEQDLVPEVDRPAPTDVLTHPPTESEPEPMLDPLSLVQLVKPQLGRAMGWAAEEMELGNVVMDVELKREFNREVRRVGRTPPDQMYKRGAGPPLPQKREPERVALLEQLIVARVERDINRGLDWFLELNVAVFAAARVLSRRERVETLADRLHINDSATLSEVSRRRAKAERKLRCAREQPWMSRRIRILGVRVERLKQLADLVRQRIAGRGNRSSYEGPRRRFRLRPSLRSVTEAPVNPPLNGNEVYTFWHSLWAQSLRANTDDCQLREFKNQLSAARHTDLTNVGTSSLVQMFSAALRKMKKGKAPGPDGIRAAWWGVFRRIAPYVATWVVQVIRGAEPVANWICNGLTVLLPKSSDNADPSNYRPITCLNTCYKLFTAVIAQITASYVDVLGGLPRQQVALRKGVWGTSVSLMIDALTVADARRAKRPLGVCWFDFKKAFDSVPHNLIRWILRVIGLPPVILSVIVSVMDQWVTRLKIGGKVMPKTIPVRTGVFQGDTLSPLLFCLSVWPISFALDQFPQYQFRCANHLQQGFSVGHVFYMDDLKCYCPDREVLTAVIQQVQKSASALGLTIHYKKSAWLDQDGGKSGKAVLGVPELVGTYKYLGMHERFMI

SEQ ID NO: 137333 - protein, 159 aa, Heterodera glycines
  Coding regions on vcDNA: vcDNA=SeqID_63756; Strand=+; Position=1-477
NQSSPLLMSRSTRATMSCSSRATRSGSRFCGSGGPAPRLYIWSGGVLPTRLTSRLNSLFSSTSITTFPSSISSAAHPIARPNCGFTSWTSESGSSIGSGSDSVGGCVNTSVGAGLSTSGTKSCSLREEVDGTLRFRGGTTSRTALRSRLRVILSVAPKS

SEQ ID NO: 137334 - protein, 160 aa, Heterodera glycines
  misc_feature (51)..(51): Xaa can be any naturally occurring amino acid
  misc_feature (84)..(84): Xaa can be any naturally occurring amino acid
  Coding regions on vcDNA: vcDNA=SeqID_63757; Strand=+; Position=1 -88,1438-1837
  Homolog annotation: Hit_ID=NP_671477.1; Match level="QueryCoverage =91%, HitCoverage=50%, E-value=9e-29, Identity=51%"; Hit description =rRNA promoter binding protein [Rattus norvegicus] gb|AAK21974.1| rRNA promoter binding protein [Rattus no
RLTTGGRGIGSVLAAPSLSDLIRGWYPGVVHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPQNVCEFICVTAQNIGREPSFLAWRGNV

SEQ ID NO: 137335 - protein, 182 aa, Heterodera glycines
  misc_feature (12)..(12): Xaa can be any naturally occurring amino acid
  misc_feature (50)..(50): Xaa can be any naturally occurring amino acid
  misc_feature (108)..(108): Xaa can be any naturally occurring amino acid
  Coding regions on vcDNA: vcDNA=SeqID_63758; Strand=-; Position=1-749
  Homolog annotation: Hit_ID=T02995; Match level="QueryCoverage=78%, HitCoverage=28%, E-value=2e-27, Identity=49%"; Hit description =unspecific monooxygenase (EC 1.14.14.1) - common tobacco dbj|BAA10929.1| cytochrome P450 like_TBP [Nicotiana t
PTRHLATLRESXTPAVYPRLIKFPWLNIQSTGQKSDTVNVHKDHPSPLFXLDSRIPRVRASSKLVVQRQPNAPQAALTTSPRTIPERTAHSHGQKPPVSRNSPADPTXSQFFSRSYESNLPTSLTYIILSTRGCSPWRPAADIGTIRQEIQIASLAFSRAVWSARDTTGTAVLYGRNIPISG

SEQ ID NO: 137336 - protein, 76 aa, Heterodera glycines
  Coding regions on vcDNA: vcDNA=SeqID_63759; Strand=-; Position=1-232
LYEEIVQNELSTFSEDTTLKLEEGGGAAQNIASFGQSDKREQHKDKEDEKRTKGNGKRKDKLVGKSKDKWKKALII

SEQ ID NO: 137337 - protein, 76 aa, Heterodera glycines
  Coding regions on vcDNA: vcDNA=SeqID_63760; Strand=+; Position=1 -78,473-622
MKDVREATDRLTDRIEQAQKNYAYFQVYEENSDVQKWMANANELERWLSEREQFLRDDWHSGATAENVEGVELRIR

SEQ ID NO: 137338 - protein, 551 aa, Heterodera glycines
  Coding regions on vcDNA: vcDNA=SeqID_63761; Strand=+; Position=1-1656
  Homolog annotation: Hit_ID=XP_318550.1; Match level="QueryCoverage =87%, HitCoverage=48%, E-value=1e-99, Identity=40%"; Hit description =ENSANGP00000020240 [Anopheles gambiae]
MVFGRKFTLLTDHKPLLAIFGSKKGIPIYAASRLQRWALILSNYEFDIKYVNTAAFGQADVLSRLIANYPRPEEDILIANICTETECFINSVFQVQIDQLPLTAAEIADATAKDEILSEISRLSKNGWPNKCNDPNIAPFFPKRDEIVEVEGCLLYQQRVIIPGILRDRALKALHLSHPGIVRMKALGRRHIYWPGLDSEIEKTVKSCEECQNAQKNPTKSTLAPWTPTSKVFERVHIDFAGPCDDGFMYFIMVDSYSKWPEVCQMKSINSQATVGFLRSIIYRLGVPEEIVSDNGTQFHSADFAKFCTEFGIKHTFTPPYHPQSNGQAERFVDTFKRAMKKSSKNDKDWAEKALLSYRTTPNATSNGYSPDQLFFGRKLRTKMSLVHLRGEPIEHIDHELIRQAKKEYASKMSNQFDKKHGAKRTDFGPGDPVLLLNYRNNKSHWLQGTILERVKNSPTFRVEVPILGGRIVHRHTNQLRRRFIFEDEQKVIGINRFTLIVDKMMSNSNNPSSQLMMFPNWQCADQNGSSSRGNFTRPARSRSAAATDQE

SEQ ID NO: 137339 - protein, 26 aa, Heterodera glycines
  Coding regions on vcDNA: vcDNA=SeqID_63762; Strand=+; Position=1 -40,1136-1176
MWGVANRWMDNEAEHFKCYRMVYYMM

SEQ ID NO: 137340 - protein, 103 aa, Heterodera glycines
  Coding regions on vcDNA: vcDNA=SeqID_63763; Strand=-; Position=1 -298,1062-1075
MVAATSQRRENSKEIEEKILFFLFKTIRRGTTVIRRGTTVIKRGKKVIRRGTTVIKRGTKVIRRGTTVIKRGTKVIRRGTTVIKRGTKVIKIGTTVIKREFLE

SEQ ID NO: 137341 - protein, 115 aa, Heterodera glycines
  Coding regions on vcDNA: vcDNA=SeqID_63764; Strand=+; Position=1 -66,179-278,854-978,1217-1273
MLCEILERDELQIREEISMWNAFSTLPQIGTVSARFEALVDKHFDDRTIFFIIPATGFAWCLDGHSPLLTVLNSASNWHCFLPVSMLQWTNISTAEGRRISIIFYYSFSQYTFCY

SEQ ID NO: 137342 - protein, 107 aa, Heterodera glycines
  Coding regions on vcDNA: vcDNA=SeqID_63765; Strand=+; Position=1 -125,467-667
GFALSLDGHSPLLTVLHSASNWHCFRPVSMLQWTNISTAEGIILSLFFCFISAGFLQHFVWAFLTIFNSAQIGIAFAPFQCSGGQTFQWQTGLLASFNFSQSNRSNV

SEQ ID NO: 137343 - protein, 269 aa, Heterodera glycines
  Coding regions on vcDNA: vcDNA=SeqID_63766; Strand=+; Position=1-810
MPSKQKNLRKKMQDVYRRQAERSVSRDNSPVSDGSADGNGEASASLRGTSTPSLSALQISTPASSIGSKKRGRPLRAGAKPILATQERVSLIDTPRTAVTQSDQGSPCKKRGKVAECGQPMFANEAIALTPVSTQSRGGRPAKKIRGPGRGRLTDSMSKSSEMDINLENAPIPATLHIVSEKIDFSTVPINFATSRNFACKIWRWAAIGLYERDGETAFGPRSGPRFIETCWNRPNEWLNDSFIVAYLAYIASISQRKTVVGGFFGIEN

SEQ ID NO: 137344 - protein, 1625 aa, Heterodera glycines
  Coding regions on vcDNA: vcDNA=SeqID_63767; Strand=+; Position=1-4876
  Homolog annotation: Hit_ID=NP_920205.1; Match level="QueryCoverage =63%, HitCoverage=63%, E-value=3e-62, Identity=24%"; Hit description =putative DNA helicase homolog [Oryza sativa (japonica cultivar -group)] gb|AAP52492.1| putative DNA helica
MPSKQRNLKKKKQDVYRRQAERSVSRDNSPVSDGSADGNGEASASLRGTSTPSLSALQISTPASSIGSKKRGRPLRAGAKPILATQERVSLIDTPRTAVTQSDQGSPCKKRGKVAECGQPMFANEAIALTPVSTQSRGGRPAKKIRGPGRGRLTDSMSKSSEMDINLENAPIPAPSHIVSEKIDFSTVPINFATSRNFACKIWRWAAIGLYERDGETALGPRSGPRFIETCWNRPNEWLNDSFIVAYLAYIASISQRKTVVVDSLASRTDVSRFSNVKNYTFGYDPNAVPEVVLMPLHFPNHWTLIVYDVAHGAYFLDSLHMSSLSDERMALIQSIIAEIVPGTASFAVEYVQQLTKQNDGNSCGYFVCLYAESWLMNNRTFVLPDLNINYEKKRILWHINELYGSDIVPFHPREGVSTSFAVVSHHNGDVAQTSSKDIVPIEVDDSAVLPSSEDTAVLAQAPVIGENQADTHGVVADTIVQQEPIAQADDVIFVRPKTPPRRSLRVQKRLSASVSRSPSPAPKRPPPANSLGMAMPITRRCSAFHKGWQCAAAAAKHFPEYCDSGKLGDKKCADCGAHLFSHEDSNICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQAREQLTELLQQQNQEELRFFRMTLLDSRRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDSEAESDNESCETQSIASSDAGSVADSDAESVASVSSQHRRIDKSKQFISLRDYCKYYLAIRDENVELQYHHILSCGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGHPDHLKMVNGLLCTSFTEAAIMHGLLEDDKIWDKTLAEAALSRWPDQMRWLFVSILVYGQPSNAIELWNKYKDQMYNPQGIISAAIRQAREQEALADIDWRLHFFNSSCMHCGLPDPPNSKAKNINLAVEEAFFGDDDLNMPPGQPNPRQQQNAPPPLNSDQQKVFDAVVRAIQSDPKDPTVPRRFFIFGDG

SEQ ID NO: 137345 - protein, 129 aa, Heterodera glycines
  Coding regions on vcDNA: vcDNA=SeqID_63768; Strand=+; Position=1 -114,643-918
AQQHHIDTRRHQQTQDGGNDNDEEGKEDGVVTNKRSKVSVTLDETEEISVLDEEEGKEEEAEEGELTDEEEEEKDENDADVLFVDARSRTTKKKKKGKSGGANVSLEEGEIVDESEEEQQQQMVVTKKF

SEQ ID NO: 137346 - protein, 94 aa, Heterodera glycines
  Coding regions on vcDNA: vcDNA=SeqID_63769; Strand=-; Position=1 -88,177-265,810-914
MANSVKMRDSDEKKPGFRRAGDEEELGFWSKKITVRAQIAPDDQVEDMVVRGNIDDVMRMHIRFAFQSVKRAYEGNGLGQFFVHNKVIVSIPPL

SEQ ID NO: 137347 - protein, 133 aa, Heterodera glycines
  Coding regions on vcDNA: vcDNA=SeqID_63770; Strand=-; Position=1 -166,547-782
  Homolog annotation: Hit_ID=NP_495862.2; Match level="QueryCoverage =96%, HitCoverage=30%, E-value=2e-21, Identity=40%"; Hit description =FUcosyl Transferase (50.0 kD) (fut-1) [Caenorhabditis elegans] emb|CAG32977.1| core alpha1,3-fucosyltrans
MTLKKRSAVQFVSNCNVPSGRDALTAQLQRLLQVDVFGKCNNNTNCKEECYQREQESHFFYFAFENAVCPNYVTEKFWKALRNLIVPIVLSRKVMEEVGIPNGTFIAADDFNSVKALAEYLKELQRDKDKYMR

SEQ ID NO: 137348 - protein, 102 aa, Heterodera glycines
  Coding regions on vcDNA: vcDNA=SeqID_63771; Strand=-; Position=1-309
VAIRFAFDAVKRTYERRNLGNFFVQHKVIVSIPPTQTRRTGPSASAAAALAILSCAAARANMTKMAFPLEKLNQFKKLDRWIRNQLSRKTLADVDDLFSLLI

SEQ ID NO: 137349 - protein, 158 aa, Heterodera glycines
  Coding regions on vcDNA: vcDNA=SeqID_63772; Strand=-; Position=1 -38,1674-1911,1958-2140
  Homolog annotation: Hit_ID=CAE67033.1; Match level="QueryCoverage =85%, HitCoverage=16%, E-value=7e-34, Identity=52%"; Hit description =Hypothetical protein CBG12435 [Caenorhabditis briggsae]
ALIFNMPNIFGCVWRRPFQIFELLKCVDLIWSPFLQRQSPQAAPAINRCIIVCPSSLVKNWDKEIAKWLHGRVNSLPIDSGKREDIIRNLKQFVSQTGQFVSQTGQRVPTPVIIISYETFRLYTDILHEKEIGLVICDEVGVIWEAEIGTLCQHFSPE

SEQ ID NO: 137350 - protein, 95 aa, Heterodera glycines
  Coding regions on vcDNA: vcDNA=SeqID_63773; Strand=+; Position=1-288
KGLCHNPALSDLICGVNESIDRQVDAARSARHFIHKRHKRYILQDAVIMRILADASYNNKGEIRDLMTALGLQIEGYAAKLKDFVNFDDSIVRIP

SEQ ID NO: 137351 - protein, 242 aa, Heterodera glycines
  Coding regions on vcDNA: vcDNA=SeqID_63774; Strand=-; Position=1 -84,135-410,466-834
  Homolog annotation: Hit_ID=AAL78214.1; Match level="QueryCoverage =59%, HitCoverage=75%, E-value=5e-10, Identity=26%"; Hit description =putative esophageal gland cell protein Hgg-20 [Heterodera glycines]
LFGVPMFVGGCAILWIYWDRFKKPKKKIFISADCWLCVFDLLEPSQLGLGISMISHRFDFYVDEHFKTRKWTLGLIRIWSKIGENGTKKMKIVNKYWTPLPIPQIEMPRKVTGFERIDINYIDQNAIAFLRRFRPLFAACQINLSISMRSDRISELILRNIWPMLGKNIHDIEMSASFFHLLRQMAPSILSDCPSLRFVIFYAGDLFAEFPCDDGAAASDGQSVAKWLFTPLQNNVPKVLNC

SEQ ID NO: 137352 - protein, 80 aa, Heterodera glycines
  Coding regions on vcDNA: vcDNA=SeqID_63775; Strand=+; Position=1 -91,172-323
VCAAKSCRKMSSESNMENFPVKLDMDYIKRANFLVAGYRKAVNRDVFGGQMFAQAIAAAEATVDGDEFAPNAAHSMFIRK

SEQ ID NO: 137353 - protein, 28 aa, Heterodera glycines
  Coding regions on vcDNA: vcDNA=SeqID_63776; Strand=-; Position=1 -46,784-824
MTFYASLVGYTGRNNKQGSETHQILFTC

SEQ ID NO: 137354 - protein, 19 aa, Heterodera glycines
  Coding regions on vcDNA: vcDNA=SeqID_63777; Strand=+; Position=1-70
NRTLTDDLMEKNPRRREFN

SEQ ID NO: 137355 - protein, 48 aa, Heterodera glycines
  Coding regions on vcDNA: vcDNA=SeqID_63778; Strand=-; Position=1 -46,328-428
MTFYASLVGYTGRNNKILSVESAFGILMSKSGTVNNILCFSCWIHGKK

SEQ ID NO: 137356 - protein, 81 aa, Heterodera glycines
  Coding regions on vcDNA: vcDNA=SeqID_63779; Strand=-; Position=1 -73,119-291
MLSFIYIEDLSELNGDNAMAVLYAANKYNIPGLDGPSLQISFSKLRNVFLAYAQANIFDLKVEFKNDLSPYWFGVILLILI

SEQ ID NO: 137357 - protein, 42 aa, Heterodera glycines
  Coding regions on vcDNA: vcDNA=SeqID_63780; Strand=+; Position=1 -84,445-491
YEEWLPLVLGRERWLRSGLSQEKGQQKADADNDYDLNLDGTH

SEQ ID NO: 137358 - protein, 38 aa, Heterodera glycines
  Coding regions on vcDNA: vcDNA=SeqID_63781; Strand=-; Position=1-114
MRRFRECESLEVLIVYAATLGYEADRYRIWTSDMPRKE

SEQ ID NO: 137359 - protein, 121 aa, Heterodera glycines
  Coding regions on vcDNA: vcDNA=SeqID_63782; Strand=+; Position=1 -64,133-317,369-485
MEYLEETLYQYSLEPTVNDWWAARRRATIKKFPAESAAEDDKWMNEADMFIAAKMFKINVIFYKLSDNPDHIWQIFTPGMQKSLLNPEQDREVPSIFIYNESGRFEIILEPERLSQKSMTN

SEQ ID NO: 137360 - protein, 48 aa, Heterodera glycines
  Coding regions on vcDNA: vcDNA=SeqID_63783; Strand=-; Position=1-146
FRVLNRFKNRFKCFSAPNFKLLYRSQHLRKPIKVFLCDFEPIPYSAIL

SEQ ID NO: 137361 - protein, 51 aa, Heterodera glycines
  Coding regions on vcDNA: vcDNA=SeqID_63784; Strand=-; Position=1 -48,448-555
MQIWYHWKAHKKCYPMNNEQMIERKLKGSERDIMCLFSKCSLKVRDMRIAW

SEQ ID NO: 137362 - protein, 58 aa, Heterodera glycines
  Coding regions on vcDNA: vcDNA=SeqID_63785; Strand=-; Position=1 -23,348-501
MFSTGKGRCGMWSGGHSMVLRLYTTVESCRKNMNKMILLMDLQNASYTITVSRFRISV

SEQ ID NO: 137363 - protein, 50 aa, Heterodera glycines
  Coding regions on vcDNA: vcDNA=SeqID_63786; Strand=+; Position=1-152
  Homolog annotation: Hit_ID=AAP30762.1; Match level="QueryCoverage =100%, HitCoverage=45%, E-value=6e-26, Identity=100%"; Hit description=putative gland protein G7E05 [Heterodera glycines]
GNYIVQKCVPDQPGARNYCKDFNNICQMGFFGMPIHCSSCKGDLCNEARN

SEQ ID NO: 137364 - protein, 56 aa, Heterodera glycines
  Coding regions on vcDNA: vcDNA=SeqID_63787; Strand=-; Position=1 -117,615-668
MERLKEGIEEEEKMNGKIQRKQNQRNGEGTAKGGETEEMLTNCRRLVYFCHFPYGH

SEQ ID NO: 137365 - protein, 87 aa, Heterodera glycines
  Coding regions on vcDNA: vcDNA=SeqID_63788; Strand=+; Position=1-264
EFRIHRGKAAVHEKGGGNNFGHRVTAQFDKTATVCGGGGGPSEDAIGTRSPTRGPRMDFSDIDVGTSIAIWPVLGRTENGLSVNKNI

SEQ ID NO: 137366 - protein, 174 aa, Heterodera glycines
  Coding regions on vcDNA: vcDNA=SeqID_63789; Strand=+; Position=1-525
MMLPGWTLLLVAYCVCLALGIVGTMGASAELIPSKMFNHNNNHNFNNNNDQKQLGANDFAENPQRQAGNNGGDNNNLLLAQPSAFQLQKQMMMRAAMAAAAKVAQQKQRQHHHHHMPHHNHHHHQQNNVDGSSKFGVVEQEEKSGEEFFMFNTGMRSVLIYQKCSDLKGPNLIK

SEQ ID NO: 137367 - protein, 179 aa, Heterodera glycines
  Coding regions on vcDNA: vcDNA=SeqID_63790; Strand=+; Position=1 -135,274-392,439-522,575-674
  Homolog annotation: Hit_ID=CAE61835.1; Match level="QueryCoverage =100%, HitCoverage=19%, E-value=2e-40, Identity=50%"; Hit description= Hypothetical protein CBG05805 [Caenorhabditis briggsae]
LPTKEDRSCDARSPTERLCLANQTAVLGGFHHLTHDCHCVQPCTEHVFETAYSAAAWPASNFNIGGDDCAIVLGANFTRENCTKYFAKNTALIEIYYEQLNYEYFAKNTALIEIYYEQLNYEKLKETPGYTLVNLFSDLGGNIGLLVNLFSDLGGNIGLWIGFSLITVMEVVELIFECC

SEQ ID NO: 137368 - protein, 86 aa, Heterodera glycines
  Coding regions on vcDNA: vcDNA=SeqID_63791; Strand=+; Position=1-359
GPERLGPRFWAPAFGPPFLGPGVVWAPVFGPRGRLGPNPKIEKCAFLKIKILKTKPEGSLATWHKLGLINIRSFFTILLIPNPIIF

SEQ ID NO: 137369 - protein, 99 aa, Heterodera glycines
  Coding regions on vcDNA: vcDNA=SeqID_63792; Strand=-; Position=1 -100,247-446
  Homolog annotation: Hit_ID=NP_872170.1; Match level="QueryCoverage =97%, HitCoverage=9%, E-value=2e-15, Identity=41%"; Hit description =ankyrin and patatin family member (5V188) [Caenorhabditis elegans] emb|CAD54162.1| Hypothetical protein W0
MSLLQLKHKELDLNVKNKAGFTPLHQFVMREDLGMVMCLLSYGAGLGEKADSGKMTALHFAVSKCNLQVTRLLLCLGADPNVTNAHGDSPRHLAAKLKE

SEQ ID NO: 137370 - protein, 19 aa, Heterodera glycines
  Coding regions on vcDNA: vcDNA=SeqID_63793; Strand=+; Position=1-5,72- 126
MRSALKSIRARLMPRMDNE

SEQ ID NO: 137371 - protein, 87 aa, Heterodera glycines
  Coding regions on vcDNA: vcDNA=SeqID_63794; Strand=+; Position=1 -83,343-523
MTWYGVIFCVVPLNISSISIAPLLFFTSTEYHNAFTKEWARLRALFVGLQPSNTIFATTVQPLQPMIMKMNNQNQSPTRIDNFLPNN

SEQ ID NO: 137372 - protein, 120 aa, Heterodera glycines
  Coding regions on vcDNA: vcDNA=SeqID_63795; Strand=-; Position=1 -39,87-292,347-464
  Homolog annotation: Hit_ID=CAG11240.1; Match level="QueryCoverage =60%, HitCoverage=83%, E-value=9e-12, Identity=49%"; Hit description =unnamed protein product [Tetraodon nigroviridis]
MDDIGTGNLAYDEIGREINEGLQVSGKPLDERLIHLAKAEELILKQDGTSILDNFLDEMVQFIHEREQKVRCFVISFIEKACKKDTEVFKRAIATLNWAMVDQSSGVIVQKKVSLLFFSI

SEQ ID NO: 137373 - protein, 361 aa, Heterodera glycines
  Coding regions on vcDNA: vcDNA=SeqID_63796; Strand=+; Position=1 -405,489-1168
  Homolog annotation: Hit_ID=CAE70527.1; Match level="QueryCoverage =65%, HitCoverage=85%, E-value=3e-12, Identity=20%"; Hit description =Hypothetical protein CBG17156 [Caenorhabditis briggsae]
MPTFRKAPQKGGDKDTTKRKKIVGETKDGESSRTSDKAEGRETEGDKHKQEKEGGNELKERGTENREKRDSVEKSDGDQNQQTERENADQQNTETTKQQQKGKESVAKGENKEGRDSETEKVDEKQKQTPNKPSTFSDQNNGQNLLLNEIATTTTEGQQNEEQMPTMPSMGKKQQKTTKSKAKTETETMAEKTNGKSGHSKSKPQQKKTTPTAYYSSTASAQAQYHYQPNNNNQQQQQFQHRPAFVLHRCASGDGRRSVVAIWPIQIPFASAMVAAYAPFLQNFMQNGGAATTSAYADASGTIFALLQQQRQLPTPQHQQHKIGQMFVGKMMGMASAAAANARQAEGKCRRRRQPQKAPAT

SEQ ID NO: 137374 - protein, 77 aa, Heterodera glycines
  Coding regions on vcDNA: vcDNA=SeqID_63797; Strand=+; Position=1 -73,142-302
MRQTLMTFFLPLFIFFAHLTASLFGLKCKFGDEMRPALIKKFMDSGQCPPTTDGQETKHCVAKICTTGPPSPAPNGR

SEQ ID NO: 137375 - protein, 86 aa, Heterodera glycines
  Coding regions on vcDNA: vcDNA=SeqID_63798; Strand=+; Position=1-263
HKNPGPADDQWDVLVWGCAETDAGTCAVLETKLSQVMNNTVAFSCECHYGARDVDLANEQLMLRHLFSPIAAPTDAVSIAVMAFII

SEQ ID NO: 137376 - protein, 112 aa, Heterodera glycines
  misc_feature (10)..(10): Xaa can be any naturally occurring amino acid
  misc_feature (12)..(12): Xaa can be any naturally occurring amino acid
  misc_feature (109)..(109): Xaa can be any naturally occurring amino acid
  Coding regions on vcDNA: vcDNA=SeqID_63799; Strand=-; Position=1 -82,392-492,639-792
  Homolog annotation: Hit_ID=NP_491472.1; Match level="QueryCoverage =91%, HitCoverage=19%, E-value=7e-27, Identity=56%"; Hit description =UNCoordinated locomotion UNC-38, alpha nicotinic acetylcholine receptor subunit (59.5 kD) (unc-38) [Caeno
KERIERVQNXNXNGLDWSVIFGCFSSPKVEKAFENVCFVAELLRRKDRDQKVAQDWKYVASVLDRLFLVLFALCCFCGTAWILLQAPIFYDRRQPIDLQFQPPNAVDVXIMG

SEQ ID NO: 137377 - protein, 428 aa, Heterodera glycines
  Coding regions on vcDNA: vcDNA=SeqID_63800; Strand=-; Position=1 -109,142-1109,1183-1392
  Homolog annotation: Hit_ID=NP_510849.1; Match level="QueryCoverage =80%, HitCoverage=26%, E-value=3e-63, Identity=37%"; Hit description =predicted CDS, zn-finger, CCHC type and RNA-directed DNA polymerase and Integrase, catalytic domain conta
MCSWQQLINSLVTTKEVAEQKQLDETLREVSEFCQNAYFTHRYKLSEVNGCLMFGERVIIPAELRQRILSALHFTHPGIVRMKALAQRHVYWPRMDLDIDRCVRNCDECALAAKAPPKAPLRPWPSTNKVYERLHMDFAGPCSDGRLYLIVVDAFSKWPEIFSVKSTTADNVIVQLEWLFSRYGFPCEIVTDNGPPFHSNAFSHFCRTKGIKQSFCPPYHPKSNGQAERFVDIFKKEMKKGAGKDKQWVTNSLFAYRNTPNIALNGRIPAELFLGRPPRTELSLLKPTVSHPTNGTKDYANNMAKQFNRQNGVRRRTFAIGDDVLIINYRNNKTTWLHGKVVEGSGVVWKVHVPILNAVQQHLQIVHQEPATEPNTPQRHVRFADEQPEEQPVPDEHNQNEVRRSNRNRRPPKLLDMDTSKARYDYTN

SEQ ID NO: 137378 - protein, 87 aa, Heterodera glycines
  misc_feature (84)..(84): Xaa can be any naturally occurring amino acid
  Coding regions on vcDNA: vcDNA=SeqID_63801; Strand=+; Position=1-267
  Homolog annotation: Hit_ID=AP_000511.1; Match level="QueryCoverage =87%, HitCoverage=30%, E-value=2e-37, Identity=100%"; Hit description= pVI [Human adenovirus type 1] tpg|DAA05349.1| TPA: pVI [Human adenovirus type 1] gb|AAQ10552.1| hexon-as
QIDEPPSYEEALKQGLPTTRPIAPMATGVLGQHTPVTLDLPPPADTQQKPVLPGPSAVVVTRPSRASLRRAASGPRPSSQGLKXVVL

SEQ ID NO: 137379 - protein, 214 aa, Heterodera glycines
  Coding regions on vcDNA: vcDNA=SeqID_63802; Strand=+; Position=1-645
MGNKRPTSSGFPWTNHWTLQREANQLSNKLFCATSNTVRQMAQSPTTVANPSRRPLQLRFRVLPAARQQFTHLDFSMSKRQLFHVRFPRSRRNPRRIHKLNGQITAFWISDDRQKALTFTETHAVQACDGRQIVLSEQNFGIPKEQFDIMMSNHTRAKRNVQPEQLASQLTAAQLATTMALSQLYLKECQRNVRVSNPTLQARKLLKRENLQAR

SEQ ID NO: 137380 - protein, 173 aa, Heterodera glycines
  Coding regions on vcDNA: vcDNA=SeqID_63803; Strand=-; Position=1 -439,579-771
  Homolog annotation: Hit_ID=CAA82797.1; Match level="QueryCoverage =82%, HitCoverage=22%, E-value=1e-13, Identity=34%"; Hit description =gag protein [Ascaris lumbricoides]
PHKHTHSSIPTLPQQGGQRRAGRSSSSFKSAIGTHALSKAEKFNLLRNLLGGEARELVAGFRLEDNNYDTALQLLKDTYGAPDEHIRALHFELANLKPCKNLRDTKEFLLQLERLTRELNNTGEDIEGPPTFLMLEKKLTPGFLRTILTKKGEDPARWNTTKFRDVLNEAVRK

SEQ ID NO: 137381 - protein, 255 aa, Heterodera glycines
  Coding regions on vcDNA: vcDNA=SeqID_63804; Strand=+; Position=1-768
MRILPLISKIASCSQFRYHHLQVQQKPNLWVRIDSKNGNVQRLSQTAIHELYETILNKTDNDLDLHPLIFHQWQLDNDTDFATFPHIDESEDSEEFKNKLEQHTTQRAEALGALPGGIEGWTVRWLQERLQEIIQWWMRLASAYSTFILCRDVILPCLIAYFLNPIRITLMTLIGFRPKKQPTLQIQAQHEDMPLREMPNTPIRRKRRQLPEQSTPPIRQDTTTATASFRTRARAHSATEDTPFGRLRPMKLADD

SEQ ID NO: 137382 - protein, 188 aa, Heterodera glycines
  Coding regions on vcDNA: vcDNA=SeqID_63805; Strand=-; Position=1-668
  Homolog annotation: Hit_ID=XP_318284.1; Match level="QueryCoverage =99%, HitCoverage=25%, E-value=2e-22, Identity=34%"; Hit description =ENSANGP00000021965 [Anopheles gambiae]
MKLREFYGSNIEELKKLQPDDLAKDLEDNKVLGIRWKPKHNRLIFKLPIFEGKITKRTILSQIAKVYDPLGLMSPVLLPAKLILQEVQNLNPKWDDELPANINKDWLKLMAQWLNRGEAITIEFPRHIQAIDSVEFHCFCDASKYGMGIAVYQKAKTIIRKDECNLIYAKSLVKPIKVAAHDGTIPKL

SEQ ID NO: 137383 - protein, 753 aa, Heterodera glycines
  Coding regions on vcDNA: vcDNA=SeqID_63806; Strand=+; Position=1-2262
  Homolog annotation: Hit_ID=CAA82797.1; Match level="QueryCoverage =85%, HitCoverage=84%, E-value=2e-19, Identity=26%"; Hit description =gag protein [Ascaris lumbricoides]
MAAPIQQKLSAALKVLSRSRTAAELNIQADQAASNLENAFNFEAQLEKVQKEAKTMDIFLDDVRESLTAWADLLRKLPATERDPAEADFNKFEKKERTTDKVDEAALKLRDLRDLISTLTVQSRLYRSKADKEERDAQAAHANAMQHTAQQQPNKTPSFTPPFYQFQPIQLDKFFGNKRKWPEFYESFKSAIGTHALSKAEKFNLLRNLLGGEARELVAGFRLEDNNYDTALQLLKDTYGAPDEHIRALHFELANLKPCKNLRDTKEFLLQLERLTRELNNTGEDIEGPPTFLMLEKKLTPGFLRTILTKKGEDPARWNTTKFRDVLNEAVRKESQIQEVMGEYGHSPQQRPQPQRPNFSASKFRDRAPIPQQRERTFITSAVDDNHKRLINRQPQHRPQQQRPRAPQPQQRNLRTFNNQRQFPTQRANATNNQRQFPTQRTNAINNRRQFPTQHANATFNQRKPPSPCIFCDNDHWNEECRKYSTIQQRREVLRTKALCFKCLKSNHQASNCPQPKKCFKCKQPHPTALCYADEKPPNQITAAMLGQTQQNMSITTQDGSNEPTASTSQMCNAVNGSDTRALLMTATSTVFNPAQPHLSMTAAIFIDPGSHRSFISAKAAQLLDLPVVHTEECHLTSFGEREPKRYISDLVKLGFLCTSGEKLIFNLNAMKFLVNDMPMIQLSELDKTELRQQKHNPPHEQRQPDIMLGIDVWHELQVQPIESCQAVSHCADPKSAKSSVDQDASKCIKRQT

SEQ ID NO: 137384 - protein, 185 aa, Heterodera glycines
  Coding regions on vcDNA: vcDNA=SeqID_63807; Strand=+; Position=1 -412,456-601
MIKMNKLRRSKSPMTRPPTQFNDKQKCEIVHKFDAIKEGIKKRGKYSAKGRGKIEQKIGVKLGINRLKIYKWKKEFGLNLKKDKHYYEKKKQEFVERIEEFKRMYKNGKQKQFAKELGIHKETFIKWKKKFGIEIGKRYSNEEKMNKMYEYLKMKKANPSLSDKEIAEFLKITQRTLIRWKQIFV

SEQ ID NO: 137385 - protein, 87 aa, Heterodera glycines; identical to SEQ ID NO: 134949
  Coding regions on vcDNA: vcDNA=SeqID_63808; Strand=-; Position=1-605

SEQ ID NO: 137386 - protein, 46 aa, Heterodera glycines
  misc_feature (3)..(3): Xaa can be any naturally occurring amino acid
  Coding regions on vcDNA: vcDNA=SeqID_63809; Strand=+; Position=1-140
FIXQRSRLIRSSPNFAGKLLRTLQMLINFLRIFCLEEHSSSHLPHK

SEQ ID NO: 137387 - protein, 113 aa, Heterodera glycines
  Coding regions on vcDNA: vcDNA=SeqID_63810; Strand=-; Position=1 -62,406-531,659-698,769-865
  Homolog annotation: Hit_ID=NP_499041.1; Match level="QueryCoverage =92%, HitCoverage=13%, E-value=1e-33, Identity=61%"; Hit description =MSF1-like conserved region and Cellular retinaldehyde-binding /Triple function domain  and Cellular retin
ESKLESEYIQRLLGQLTPLEESRLCELKYGLQSMHKGKMPNDAHLLRFLRARDFDVQKATQLTLNSLLWRKQHKIDSLLDDSLLDDFVPPALFKKYFPGGWHHNDSEVGGLSI

SEQ ID NO: 137388 - protein, 314 aa, Heterodera glycines
  Coding regions on vcDNA: vcDNA=SeqID_63811; Strand=+; Position=1 -284,560-739,893-1037,1273-1608
  Homolog annotation: Hit_ID=NP_508085.2; Match level="QueryCoverage =94%, HitCoverage=48%, E-value=5e-57, Identity=37%"; Hit description =glutamate carboxypeptidase ii homolog family member (85.5 kD) (XA925) [Caenorhabditis elegans] gb|AAU0554
MIKLFIMKMPFPHFPCRPIQNVIGYIWGSERPDEWVMLGNHFDAWVFGAIDPNSGTAVLAEVAKGLAETVRTTGWRPKRTIVFCAWDAEEPGLIGSVSTVPSLFHSAVAAAKVVKNPLDDQLTVFDSWAKHFPSKTEWLPDIPEMSIPGGGSDHITFLNFLGVPVIDFLYKDAESPGYSYPLYHSRYELPFVNEHLFDNNQLAPILDLSSQFPSTCGPAKTQLDNLIQNGHQFMAQAEEFERHAQGQSASANLAQLAWANDRLRKLEQCFVNPAMGLAREEPLKRHVLFATSKDNFYASNTMAIVYKKVTKTNL

SEQ ID NO: 137389 - protein, 135 aa, Heterodera glycines
  Coding regions on vcDNA: vcDNA=SeqID_63812; Strand=-; Position=1-408
MAELFRIANESSDEFEQRNAKKAIENINENFKLIEENVKKMLEKLGIYQLGMEENVLKIGKNGIEKNDKIVKMVQRLSENSKWEGTIEKTNEIISLIKSAEESARKEAIEALESLEMIDEQNDRDKIVIRKSDRN

SEQ ID NO: 137390 - protein, 122 aa, Heterodera glycines
  Coding regions on vcDNA: vcDNA=SeqID_63813; Strand=-; Position=1 -127,513-754
MCRTNAENGQTFVLHLPNVDEETANFNIFFFFYVKSTKNEYKADIDDENPSDEGPFFDPKFNLELEDIRTMFRMAYVTLYRPNFSKLYTVNLGQIDPTELFLKSRVFLETKIPMRRVLFGYW

SEQ ID NO: 137391 - protein, 188 aa, Heterodera glycines
  Coding regions on vcDNA: vcDNA=SeqID_63814; Strand=-; Position=1 -126,435-876
  Homolog annotation: Hit_ID=XP_528877.1; Match level="QueryCoverage =67%, HitCoverage=48%, E-value=7e-09, Identity=33%"; Hit description =PREDICTED: similar to endoplasmic reticulum membrane protein family member with at least 5 transmembrane
FKPVIQTVVDKFNRSVIVLQCGADSLGSDRLVCFNLSFDGLGNSDHSIAITGNQLSCISITGNQTTKIQSLGLIAPTFQSVGLNPTAFQSLGLNPPAFQSLGLNPPAFQSLGLNPTAFQSLVFNPPAFQSLALNSHAFQSLGLNPPAFQSLGLNPTAFQSLGLSPPAFQSPGLNPPAFQSLALNPTAC

SEQ ID NO: 137392 - protein, 81 aa, Heterodera glycines
  Coding regions on vcDNA: vcDNA=SeqID_63815; Strand=+; Position=1 -188,913-970
MSQFIRWELNLTELVRRMNLIGYGRDAIMLITLHSADQLNAPGGLRRHASGRRMAETPVSLTRCDFNNSRRKYCVNEVKCR

SEQ ID NO: 137393 - protein, 159 aa, Heterodera glycines
  Coding regions on vcDNA: vcDNA=SeqID_63816; Strand=+; Position=1 -48,140-307,447-608,678-779
  Homolog annotation: Hit_ID=CAE65834.1; Match level="QueryCoverage =93%, HitCoverage=20%, E-value=2e-35, Identity=48%"; Hit description =Hypothetical protein CBG10959 [Caenorhabditis briggsae]
MVILVCSLLQVLISIQGLIFVRHPYFNEPGFEKLQGTSRGDELSRKYNLCIENATLNYAIYEQWKNGSPYFTDVIRRHFWLKRHAVIRQAERWLKEVTENVRNSGKMQLPDTDGMADGVLSSQSLQRQTVRKLLEEFRKMENPLKEAEAEEAKKGGGQA

SEQ ID NO: 137394 - protein, 101 aa, Heterodera glycines
  Coding regions on vcDNA: vcDNA=SeqID_63817; Strand=-; Position=1 -170,217-294,348-405
DVSAIYDSLPPEIEFFRFVESLRPCSPNETAEEKEEEQREAKRIFNERLEQLRERQEALKYAEMTKSVDVSRNRSLMQDFGKEMREANRHLVAVINTLITV

SEQ ID NO: 137395 - protein, 58 aa, Heterodera glycines
  Coding regions on vcDNA: vcDNA=SeqID_63818; Strand=-; Position=1 -90,526-612
MASLFRSESVDNPTRLKDEEWDRVVAVFVQERVLKHHHILFSSYFRHSDALYIKKGEE

SEQ ID NO: 137396 - protein, 555 aa, Heterodera glycines
  Coding regions on vcDNA: vcDNA=SeqID_63819; Strand=-; Position=1 -282,766-879,1001-1029,1122-1248,1501-1799,1994-2009,2279-2827,3314 -3562
  Homolog annotation: Hit_ID=CAE56701.1; Match level="QueryCoverage =44%, HitCoverage=15%, E-value=6e-28, Identity=33%"; Hit description =Hypothetical protein CBG24486 [Caenorhabditis briggsae]
MLLLVLCLFVVPTAHWVQQQMPPAQPLGAAQFFQPIISFKASTAQQQQQQQQQQQIMYNGGGAEQQQQTEHQQQEQQQQAGQAVRISRFDPTLKTKSNDGYLSASAGQGTFVRIGPTANAPPLQILVEDRDLLPGMPSAVYHYILTGYGAERFAVDHLGNLYLNVDELDTDATGTPLFVLHVMAREVDTTPQRSSAPISLTIHLLDDDMDNDEVDGVETEQEQDQPQQHVQQQQLQHLQGTVGGGPTLPQTVYVANVSAAAGPGERRVIAQVKARESESNSAVLYRIVEVVIEARDTDGLVGHAVVLVQALAADHLPSKAAFSSPSSSAARASLFGSGQVPVIADHQPFPLSSSAFVPPLAKAVGVGIPPALPASPPSAQMSSSLSQNVPPAAGSQQMMSSALIASSAGGYWQPISNGGNNKANSNQKPNPFWRVDPTTTLATPAAAVKLNPMLIPFATTTTAVPPPPSQSTFQFLICPFQEQTLFVELSESAPVGTLVTSLGNEFSAGKVHFVLLDEEGNIGTMFGMEDEQEGTIVTKGTLDREQTAQYKLRIE

SEQ ID NO: 137397 - protein, 29 aa, Heterodera glycines
  Coding regions on vcDNA: vcDNA=SeqID_63820; Strand=-; Position=1 -27,267-329
MTTMGQLYQDRHEEDLFMYIAYSEENVYG

SEQ ID NO: 137398 - protein, 211 aa, Heterodera glycines
  Coding regions on vcDNA: vcDNA=SeqID_63821; Strand=-; Position=1 -165,219-686
MGQCRNGKLLSSAPGTKKAMTIMNNVATTTSKMANGGQRNSEGQQKRGPKGGRTENKGKAVHSSKKLTANTPSTVTTLTAIKPKMLGRNIGNGRGRPLGSAHKAVGKAVDGSSSGDSSDDDSSIDQHVQLASESRDVKLNGGGESTIMKGTGRRGRRKGRTRDESSPDLATTTVAEDWTGGNGDPELCAHKKCQRPLHMSINWVQCDDCDK

SEQ ID NO: 137399 - protein, 45 aa, Heterodera glycines
  Coding regions on vcDNA: vcDNA=SeqID_63822; Strand=+; Position=1 -106,169-200
MELLRIAMYHRFMPFLFLCFLLCRGAPANDVKKKKGVWNISVLFL

SEQ ID NO: 137400 - protein, 21 aa, Heterodera glycines
  Coding regions on vcDNA: vcDNA=SeqID_63823; Strand=-; Position=1 -21,283-327
MKYWSGYIKSVLLKVQSETIG

SEQ ID NO: 137401 - protein, 264 aa, Heterodera glycines
  Coding regions on vcDNA: vcDNA=SeqID_63824; Strand=-; Position=1 -124,176-475,540-910
MAKRKVLIKLQSKKAAQKRWRMREGRRAKAQIAAQVRWTKKTAPQTDPDADTPQPSEDEPPASEAPARDNDGRPPSTPTPVTPLELDVPSVDMVETDVPITSTPADDDQEAEPVPSTSTARCDLMATPSTSKCAGAFGLDDVHMFDELRRRHVWTEEELQRQRRSNAFLRKQLKAQRDRSTSLERSASACRQRKALSDVTNTQQGDNKLSAANDLLITLDSGISFKAREALKRLFTDQGLDVWSPTREMKRLKAELCEAVNEGC

SEQ ID NO: 137402 - protein, 223 aa, Heterodera glycines
  Coding regions on vcDNA: vcDNA=SeqID_63825; Strand=-; Position=1 -124,176-475,542-789
MAKRKVLIKLQSKKAAQKRWRMREGRRAKAQIAAQVRWTKKTAPQTDPDADTPQPSEDEPPASEAPARDNDGRPPSTPTPVTPLELDVPSVDMVETDVPITSTPADDDQEAEPVPSTSTARCDLMATPSTSKCAGAFGLDDVIMFDELRRRHVWTEEELQRQRRSNAFLRKQLKAQCDRSTSLERSASACRQRKALSDITNNQQEDNRLSALNDLLITLDAGI

SEQ ID NO: 137403 - protein, 127 aa, Heterodera glycines
  Coding regions on vcDNA: vcDNA=SeqID_63826; Strand=+; Position=1-384
MASQIETKKQKLKLPHGGHLYTFDKMSKDETTKFWRCEFKDSVNKCKGRIWTDLNNNFIRLATPHTCPANSSNVEAQRVKTTIKLRAIATLEPPSIIRSEALQNVPSPAALLVTKRLANDVREFFNK

SEQ ID NO: 137404 - protein, 130 aa, Heterodera glycines
  Coding regions on vcDNA: vcDNA=SeqID_63827; Strand=+; Position=1 -76,309-625
MPDPVLLFSFCTELTKESEAARLMAGFWTICWASSSQWHMVTTIVPSGAVERLPTDIGWRCEDEQHRRSGTKKRGKYLAADRRILNMVRNYIPLNAVNDHDYLPPIPQPNQFHTILEFLRGISHHYQMNP

SEQ ID NO: 137405 - protein, 19 aa, Heterodera glycines
  Coding regions on vcDNA: vcDNA=SeqID_63828; Strand=+; Position=1-60
EPVNSCIGCKCRRCCTPNS

SEQ ID NO: 137406 - protein, 83 aa, Heterodera glycines
  Coding regions on vcDNA: vcDNA=SeqID_63829; Strand=+; Position=1-252
MHIIWPIVGILMSSIGTTLTIRISPDVNSFEVLSQEAYILLYKQKETLEDEEAMEEDEMLEEEEEWVEANSSDEMETEGGNGT

SEQ ID NO: 137407 - protein, 123 aa, Heterodera glycines
  misc_feature (113)..(113): Xaa can be any naturally occurring amino acid
  Coding regions on vcDNA: vcDNA=SeqID_63830; Strand=-; Position=1 -83,200-226,691-959
  Homolog annotation: Hit_ID=CAE72770.1; Match level="QueryCoverage =77%, HitCoverage=33%, E-value=1e-35, Identity=67%"; Hit description =Hypothetical protein CBG20021 [Caenorhabditis briggsae]
YSASYCNVLKYTEGNNGYWVWFITSKMFELVDTVFLVLRKRPLMFLHWYHHILTMMYAFYSYPITPAFNRWGIYLNYFVHSYVYSVRFFKTIFFSCPCSIFWIFFFEGRATFXLIFRKIPHDR

SEQ ID NO: 137408 - protein, 107 aa, Heterodera glycines
  Coding regions on vcDNA: vcDNA=SeqID_63831; Strand=+; Position=1-321
MTGNGNELMRTEDDENSVNFMHLFDNLELTDSENLASLREIEKIVADTSPPPAGPSPIESSVLGFVFISHPILWALVQPDILGERNELSDRKNLSLESDQLVFQVHP

SEQ ID NO: 137409 - protein, 109 aa, Heterodera glycines
  Coding regions on vcDNA: vcDNA=SeqID_63832; Strand=-; Position=1 -175,221-375
MGKSFYEEKKRKFIEQFDEFKELYGQGKQKEFAKELGISEKTFWNWKKELVPNYHKSQKQYTNEAKLRKMRKYYEIKEKNQKLSDVLIARKLEIGSSTLKNWKTNLLQH

SEQ ID NO: 137410 - protein, 238 aa, Heterodera glycines
  Coding regions on vcDNA: vcDNA=SeqID_63833; Strand=+; Position=1-717
  Homolog annotation: Hit_ID=NP_608540.1; Match level="QueryCoverage =98%, HitCoverage=64%, E-value=4e-30, Identity=32%"; Hit description =CG2839-PA [Drosophila melanogaster] gb|AAF51469.2| CG2839-PA [Drosophila melanogaster]
MPRERERNANAKRERKKCQERKKEMPMPREKERNANSKRESKKCQCQERKKEMPMPREKERNANAKRERKKCQCQERKKEMPMPREKERNAKRERKKCQCQERKKEMPREKERNANAKRERKKCQCQERKKEMPREKERNAKRERKKCQCQERRKKCQCQERKKEMPMPREKERNAHAKRERKKCQERKKEMPMPREKERNAKRERKKCQCQERKKEMPMPREKERNAKRERKKCQCQ

SEQ ID NO: 137411 - protein, 75 aa, Heterodera glycines
  Coding regions on vcDNA: vcDNA=SeqID_63834; Strand=+; Position=1 -54,205-378
MGLGIYLLVSSVSFIFGVLRLARERGVAGGVGGDTGTATGSTRTSSGRKSDDDECRQQNGAWECGRQQLSSSDSD

SEQ ID NO: 137412 - protein, 30 aa, Heterodera glycines
  Coding regions on vcDNA: vcDNA=SeqID_63835; Strand=+; Position=1-210
ADPQNVQPTKCPSLEFEFFIIQMGLRLGKG

SEQ ID NO: 137413 - protein, 70 aa, Heterodera glycines
  Coding regions on vcDNA: vcDNA=SeqID_63836; Strand=+; Position=1 -127,711-794
MPTLFFRLNSSFEPSKAFPSDSPLASSISSLREVFEEFFPIHVKIWKFWPKFPTKMENFGNLVSIGMLPR

SEQ ID NO: 137414 - protein, 70 aa, Heterodera glycines
  Coding regions on vcDNA: vcDNA=SeqID_63837; Strand=+; Position=1 -139,230-303
  Homolog annotation: Hit_ID=NP_490687.1; Match level="QueryCoverage =92%, HitCoverage=7%, E-value=5e-13, Identity=60%"; Hit description =PaTched Related (90.7 kD) (ptr-11) [Caenorhabditis elegans] gb|AAB97556.1| Patched related family protein
MLLTVKSDLIGSIAVTIVCMAVVCSLFIYSRLGVGAIALCITSICFTLVGVLSWCGADLDPVTMVRSFKR

SEQ ID NO: 137415 - protein, 111 aa, Heterodera glycines
  Coding regions on vcDNA: vcDNA=SeqID_63838; Strand=-; Position=1 -57,312-464,593-718
  Homolog annotation: Hit_ID=CAG03307.1; Match level="QueryCoverage =75%, HitCoverage=24%, E-value=1e-09, Identity=40%"; Hit description =unnamed protein product [Tetraodon nigroviridis]
MRENKIGIYNNHLNAYVTTDFTKVFASKKSKKELYKIASGEMAPHFLLNVGDNFYDEGVTKEDVAERFEQNFTKVYNYGSLNVPWYTIAGNNDWESKDGIEPQIEHPSGKW

SEQ ID NO: 137416 - protein, 115 aa, Heterodera glycines
  Coding regions on vcDNA: vcDNA=SeqID_63839; Strand=+; Position=1 -221,510-637
  Homolog annotation: Hit_ID=CAE58749.1; Match level="QueryCoverage =80%, HitCoverage=15%, E-value=8e-13, Identity=36%"; Hit description =Hypothetical protein CBG01939 [Caenorhabditis briggsae]
HINAVLVGGFDVFFTDRYDLAESEWTHRRIHGNDPQLSLDSLSPSTTYFVRIDVRNSDGTVVKSQSAYRFTTFVRTLANLWTDGTELTWKIPKRFRSLDNIGNYEEINQLSDHLN

SEQ ID NO: 137417 - protein, 188 aa, Heterodera glycines
  Coding regions on vcDNA: vcDNA=SeqID_63840; Strand=-; Position=1-567
MATICDAYREDEHVDEKAENAQLIQHKIQSSRKSLSNLTKNGIQNGFKHYVELEHHLGSLLWSYKYKIQEPRTVGLPEKAKQLLMIKHEPCEEAKLKVTRMEKHDQSDVGEIFNQVQDISIGDQSKVIENRKDNKNKDTSDQSNVGEIGNHVQNMSIGDQSNKDGSDQLEVIGSGNDDQNMANDNQSN

SEQ ID NO: 137418 - protein, 90 aa, Heterodera glycines
  Coding regions on vcDNA: vcDNA=SeqID_63841; Strand=-; Position=1 -58,103-317
MYLANKDEWQAELLQNVGLSNFAGIYEEIKEQMERQRIVEQFRIVLFDFLWQLFDLKQSQVPNFTGIHKSIQKIWDNTNELGLGKFYHDQ

SEQ ID NO: 137419 - protein, 93 aa, Heterodera glycines
  Coding regions on vcDNA: vcDNA=SeqID_63842; Strand=-; Position=1 -69,618-701,953-1080
MELLRSTQNLKNREAENYLVQRGIEKGSTVMAAKKEPGKGGSTVATQVTTNLFGIDMKRPVTRVRYEVKISGHIMLRSGEEVIIDLTEQTKSS

SEQ ID NO: 137420 - protein, 43 aa, Heterodera glycines
  Coding regions on vcDNA: vcDNA=SeqID_63843; Strand=+; Position=1 -55,404-480
MSVIPGVDQKFSQPINKLGSEILFGNPFRTPNPEFEQKILESV

SEQ ID NO: 137421 - protein, 320 aa, Heterodera glycines
  Coding regions on vcDNA: vcDNA=SeqID_63844; Strand=-; Position=1 -273,481-1170
MPLAQNYEDLTSSRESATVDKHSPLTPTTNVVVDRIFSGDPEMADEDGKRVSRSENGQHIKKMSVNSALGSSVMIENKSGGDNEPNYEESEPKSLSESENRKSETISTDDKFIVIQTGINWTLASRLTEVSSWPHFLLMKKKSQSDEYFRLGEIIDIKEFVENESNSLNASNKFATNFTLLPEDGCGSIERILKCEKTGKIIAVDVCFDVGESLQRFYSHQFGSDVDVSAIVDDAWVEVITLGFRIQGFEDSLSTLTGLNTLSDEPTQIVPHQYIGTSIDLVIKIVRQIDPVEEDYRQWCEFLAKQRSTSNHDQDYHHRR

SEQ ID NO: 137422 - protein, 41 aa, Heterodera glycines
  Coding regions on vcDNA: vcDNA=SeqID_63845; Strand=+; Position=1 -23,171-273
MTSSANRNVDLAFDSAGITSDNDCLFNMPLIKERNLSLPAA

SEQ ID NO: 137423 - protein, 215 aa, Heterodera glycines
  Coding regions on vcDNA: vcDNA=SeqID_63846; Strand=+; Position=1 -8,395-812,904-1045,1247-1326
  Homolog annotation: Hit_ID=AAL78214.1; Match level="QueryCoverage =38%, HitCoverage=42%, E-value=2e-09, Identity=43%"; Hit description =putative esophageal gland cell protein Hgg-20 [Heterodera glycines]
MDKYFDGEVIIFLHRIRRLFSTDVSLQFNIRRTQTRGWKAMARHIWPLLKNGLIMLVNVKRLHLIRMHKYVSPTVLFDCAELFQISGTVLPESPTTYSNSPDLSTRLLYNWLHTPRPDGRPVVFKLSKWKSGWENFVNELITSFTRAVGPVKYMVLASFDVNYTRREQMVNIRTEEKLTLSSDVHQRPDDQCLRTEKPIGLRTEKDNCGSTTDEP

SEQ ID NO: 137424 - protein, 96 aa, Heterodera glycines
  Coding regions on vcDNA: vcDNA=SeqID_63847; Strand=-; Position=1 -139,192-343
MPKRQKEKTLSSLFGSQKNAENKSKIVGTFEQKLELLKKAFAQQKLDQMIFEEYKNNENLTLFIEMKDKINFNEKNAQIFPTEKWHALKFTEEMEN

SEQ ID NO: 137425 - protein, 113 aa, Heterodera glycines
  Coding regions on vcDNA: vcDNA=SeqID_63848; Strand=+; Position=1 -28,89-203,411-482,536-608
  Homolog annotation: Hit_ID=NP_508983.2; Match level="QueryCoverage =100%, HitCoverage=13%, E-value=3e-34, Identity=66%"; Hit description= c-terminal binding protein like (79.5 kD) (XG491) [Caenorhabditis elegans] gb|AAC69110.3| Hypothetical p
CGFPNCKFRSRYRGQEDNRHFYRYRGQEDNRHFYRIPKRPPILRQAWLCAIGRSEETVVSQLRICSAHFYGGEKHEGDIPVADPQIDPIDPPEFIELPPKEVRSSERRARLKV

SEQ ID NO: 137426 - protein, 18 aa, Heterodera glycines
  Coding regions on vcDNA: vcDNA=SeqID_63849; Strand=+; Position=1-54
MYFSRFSLHAVFCGPPPA

SEQ ID NO: 137427 - protein, 176 aa, Heterodera glycines
  Coding regions on vcDNA: vcDNA=SeqID_63850; Strand=+; Position=1 -297,352-382,544-746
MKNANSVALPFCPSTSAASDGANSEANRTDKKRRIHTRNVRSVISSIYCRRKNATIGRPSIGCWLALLLPLSSLALVFNDQLDQQSPVFYSAKKKLKEQEIIQKVLRDYDTGGPVIVSVNVCYHCCFLTPFIYVDRFISAQSPKLMTSTWNVSFWEVIETKHQIRSQKMDIWASKN

SEQ ID NO: 137428 - protein, 89 aa, Heterodera glycines
  Coding regions on vcDNA: vcDNA=SeqID_63851; Strand=+; Position=1 -112,1288-1445
  Homolog annotation: Hit_ID=CAA77131.1; Match level="QueryCoverage =51%, HitCoverage=12%, E-value=4e-15, Identity=84%"; Hit description =GBR-2 protein [Ascaris suum]
MPQLGVSFIYSTIYEKFRNVLHVNANIQSAPVVSALADSAQFTFREEWWDPRLAYGRFADDETEVPAFVVLATSEQADLTQQIWASVET

SEQ ID NO: 137429 - protein, 105 aa, Heterodera glycines
  Coding regions on vcDNA: vcDNA=SeqID_63852; Strand=+; Position=1 -36,103-180,469-590,713-743,875-900
  Homolog annotation: Hit_ID=NP_491723.3; Match level="QueryCoverage =100%, HitCoverage=24%, E-value=1e-33, Identity=68%"; Hit description= altered AVeRmectin sensitivity AVR-14, GABA Receptor subunit, inhibitory amino acid receptor subunit, gl
AVDVWIGVCMAFIFGALLEFIFGALLEFALVNYAARKDISTTQQRMRRVRPPCLPGDRSAFASLCCRLFVRRYKERSKRIDVVSRLVFPIGYACFNVLYWAVYLM

SEQ ID NO: 137430 - protein, 92 aa, Heterodera glycines; identical to SEQ ID NO: 125147
  Coding regions on vcDNA: vcDNA=SeqID_63853; Strand=-; Position=1-304

SEQ ID NO: 137431 - protein, 16 aa, Heterodera glycines
  Coding regions on vcDNA: vcDNA=SeqID_63854; Strand=+; Position=1-50
MSYKWIKGRQHQGSCH

SEQ ID NO: 137432 - protein, 77 aa, Heterodera glycines
  Coding regions on vcDNA: vcDNA=SeqID_63855; Strand=+; Position=1-234
  Homolog annotation: Hit_ID=NP_641065.1; Match level="QueryCoverage =100%, HitCoverage=18%, E-value=1e-32, Identity=90%"; Hit description= glucose-galactose transporter [Xanthomonas axonopodis pv. citri str. 306] gb|AAM35601.1| glucose-galacto
RYLTISAVLGVVFCLGAWVTHGYVSVGFVAALGFANAMMWPAIFPLAIRGLGRFTETGSALLVMGIAGGAIIPQLFA

SEQ ID NO: 137433 - protein, 181 aa, Heterodera glycines
  Coding regions on vcDNA: vcDNA=SeqID_63856; Strand=-; Position=1-546
QRTQRQESNFASSISAATTGLDFGQMSTQQPTHQNRSEASDFFSPIAAATMAMDVEQKKTNPKPRQQQTDASNFFGPISAATMGIGAEKPKPKMKQQQQGVASQFASAISAATMGRSNEQPKQQPPIEKQKEQTDEEILDEFLESVSAATTYLDVSQKKKPKKKGKKEAEDEEAAAIASIS

SEQ ID NO: 137434 - protein, 158 aa, Heterodera glycines
  Coding regions on vcDNA: vcDNA=SeqID_63857; Strand=+; Position=1 -205,288-559
MISSGLNETEKMKEHLKQKYEAHLGVMYLMAENWQCDKIAHQLTANENGMNVKNIVNMWTFSMNIFSDSKNLNVSEQLVPLMKPLLITEISLDSLIGVIKNLNYISKCFWQRDKNEPWNFNYWEMDLINEDELNYEIKEEKSGENPSKNEIEKNCKTS

SEQ ID NO: 137435 - protein, 37 aa, Heterodera glycines; identical to SEQ ID NO: 127515
  Coding regions on vcDNA: vcDNA=SeqID_63858; Strand=+; Position=1-117

SEQ ID NO: 137436 - protein, 128 aa, Heterodera glycines
  Coding regions on vcDNA: vcDNA=SeqID_63859; Strand=+; Position=1 -128,172-220,269-412
  Homolog annotation: Hit_ID=NP_507797.1; Match level="QueryCoverage =100%, HitCoverage=43%, E-value=1e-28, Identity=56%"; Hit description= putative mitochondrial protein family member of bilaterial origin (26.5 kD) (5T994) [Caenorhabditis eleg
STFNSEQSSGQHSRAESCLELEALAAVHRFAGIVQEIAVSEMLPRTADLIFVNVTTLEALPRTADLIFVNVTTLEAQPFCLEQPFCLELTAKGWRVTSLRTDCMQGDFTRMELFTYYQSLHQLMDAIS

SEQ ID NO: 137437 - protein, 165 aa, Heterodera glycines
  Coding regions on vcDNA: vcDNA=SeqID_63860; Strand=+; Position=1 -66,118-201,517-864
MASTIFLLNIAGQLQIRRANRANNLLTSVLIINELFISFLPHFLPFICERVFGAGSSLGTGPLSELMNSFEVLFFSSIYSYKFSARNNTSMHGTGGTFNNNAVQQYQQQSYCMEMNYSRQNMERRRADRVVPMAPGQPQPAQILIRQVTPVENVNGRPRTSMARF

SEQ ID NO: 137438 - protein, 105 aa, Heterodera glycines
  Coding regions on vcDNA: vcDNA=SeqID_63861; Strand=-; Position=1 -93,397-621
MNPQQKLTHTAVIGRAVSSSGRPGTWQDLGRTLPDSEILQILESNEKDNFNAIDPNLFVDPSTKTILAPILRLLLDGHFPSYFFFPKKNIQCKKRDILSIVISHL

SEQ ID NO: 137439 - protein, 69 aa, Heterodera glycines
  Coding regions on vcDNA: vcDNA=SeqID_63862; Strand=-; Position=1-212
SHFVQHCSEKTFQLLVNDMEQYNARENSEIKSEARFGFSGLDLATKTAFNKFPTDQSKVLTRTIKVIGF

SEQ ID NO: 137440 - protein, 126 aa, Heterodera glycines
  Coding regions on vcDNA: vcDNA=SeqID_63863; Strand=-; Position=1 -54,242-568
MLLLPSFLCPHCLVGVVEKIWIFFEFLTSNNLDNEAADENGDGATNVGYIRKLSNAVVGTLGAMASITGAFGINQNGNGTQNLHWHKTGHHGICKVASKCRHACRFLERSIIQKAQNGTIGKLKMA

SEQ ID NO: 137441 - protein, 48 aa, Heterodera glycines
  Coding regions on vcDNA: vcDNA=SeqID_63864; Strand=+; Position=1-194
FWKILGSSAKALAVVCQTPRNLEEMVASFGNLLLFLESSLNLKAFMGF

SEQ ID NO: 137442 - protein, 33 aa, Heterodera glycines; identical to SEQ ID NO: 134141
  Coding regions on vcDNA: vcDNA=SeqID_63865; Strand=-; Position=1-100

SEQ ID NO: 137443 - protein, 80 aa, Heterodera glycines
  Coding regions on vcDNA: vcDNA=SeqID_63866; Strand=+; Position=1 -78,204-368
MVMEVKRREYIGDGQGDLLPRAFVIHLHWMMREIKTKMNKLREFLFLDTSKLCPSNNTDELCKYEPIQFFSYTKRSKIHL

SEQ ID NO: 137444 - protein, 17 aa, Heterodera glycines
  Coding regions on vcDNA: vcDNA=SeqID_63867; Strand=+; Position=1-67
HKHLFDLFYHIHNLIKI

SEQ ID NO: 137445 - protein, 104 aa, Heterodera glycines
  Coding regions on vcDNA: vcDNA=SeqID_63868; Strand=+; Position=1 -8,290-596
MSGSLFNLVAIYVVKWVVFLDIFFIFALDLSAISSPTRVPEEKEAEFWFSTPTARRGNYRRMRKTNGQGDFPSPPAEPLDPNKKGRSAEAGDADRKIRREDIPG

SEQ ID NO: 137446 - protein, 57 aa, Heterodera glycines
  Coding regions on vcDNA: vcDNA=SeqID_63869; Strand=-; Position=1 -113,170-230
MWNLLGLMKCWRSIAFTAEDASGDGSTKCQTRTIASSRAKNCVIDCCWTSPKNCTKH

SEQ ID NO: 137447 - protein, 142 aa, Heterodera glycines
  Coding regions on vcDNA: vcDNA=SeqID_63870; Strand=+; Position=1 -139,291-577
  Homolog annotation: Hit_ID=NP_740904.1; Match level="QueryCoverage =100%, HitCoverage=34%, E-value=4e-22, Identity=41%"; Hit description= EATing: abnormal pharyngeal pumping EAT-16, regulator of g-protein signaling 7 (54.7 kD) (eat-16) [Caeno
VLESFLDSEFSSENLRFWCCIQDLKFSPNCQVKTKGQHILDEFLAPVSEEHVFTLMSKDSYPRFLRSGIYKAVLDAAKAKGGRKRIIDLIRELSGSAVNTKKVPAKYHKTSRGSADVDNTQQLSLNANNFPKQCSSDSLPVK

SEQ ID NO: 137448 - protein, 207 aa, Heterodera glycines
  Coding regions on vcDNA: vcDNA=SeqID_63871; Strand=+; Position=1 -83,126-219,271-474,735-836,1076-1142,1195-1265
  Homolog annotation: Hit_ID=CAE58648.1; Match level="QueryCoverage =60%, HitCoverage=34%, E-value=4e-34, Identity=50%"; Hit description =Hypothetical protein CBG01816 [Caenorhabditis briggsae]
GLEKTEKLHFGGGNTDWEERNLGRFKTSETRFVEILDYVCKRDSSAEIGFSGIKDLQFKCHSLLEAHEELLGQWFFEHQENGPTLGKYLCIENLKLCCDEGYFGSDCSPCPGMKLSGKPCFGNGQCQNVSTDVLVVVAVRAQKIVGLAELGIKWIPKSAVMISTNVQRKGNVTSPMKNVSTLLVPSSANVSMGLNDWTPANVPSMSK

SEQ ID NO: 137449 - protein, 220 aa, Heterodera glycines
  Coding regions on vcDNA: vcDNA=SeqID_63872; Strand=+; Position=1 -220,294-443,531-823
MFCLLPGREKAEVGQTVGDEPRLLRGSDSLCAPNQQKPFGGQFSLLAAGRPVAAVPNGGKFRREQFAVEQNTTAQATPGGMLKSVFNVPGMPQKAFSPSPRSAMFVSNLGASSASPRGRPSGSAEFVSAKPPLCSDGLSSRPTTAVVDPTESEQFSDGSTASVRLQFRVSFRTDDGQPAGQSQSIFPGAIARRTKNRANVIRIKLKFEQWGRSESKRTMN

SEQ ID NO: 137450 - protein, 233 aa, Heterodera glycines
  Coding regions on vcDNA: vcDNA=SeqID_63873; Strand=-; Position=1 -418,481-767
  Homolog annotation: Hit_ID=CAE58491.1; Match level="QueryCoverage =99%, HitCoverage=48%, E-value=2e-41, Identity=40%"; Hit description =Hypothetical protein CBG01635 [Caenorhabditis briggsae]
NKRHESIAEAHVSGWDIEQMEIQVARHADERTNESLPKKDSKYVVQLLGDWRQNPFDIQSTNCELCVQLQRNAVYWLAELLAPALVTAALTLCAVLFQLALPQALLLAFSLFSQLLAMQLMNTRMPSYTGTAPAILKFKFAAFNLLSTGALFVATLLLRRFSQTNSNIPLPRSVYALASILDKLMPLPKGSKELTEENLPQGNYADIALTLNNLLFCLFTFTYGWTIIFTLII

SEQ ID NO: 137451 - protein, 242 aa, Heterodera glycines
  Coding regions on vcDNA: vcDNA=SeqID_63874; Strand=-; Position=1 -144,253-412,470-625,673-748,784-831
  Homolog annotation: Hit_ID=CAE58491.1; Match level="QueryCoverage =92%, HitCoverage=44%, E-value=2e-61, Identity=50%"; Hit description =Hypothetical protein CBG01635 [Caenorhabditis briggsae]
CALLLRRSAAAETAARAASPAVQSNCVDSDPKCSLWASQGECQTNAIWMMSNCRRSCQSCQGGDRAWQLRTQLAKSYDNTTNTKTRTVRIESVRISHMEIDETRELARLFGRLVLSWNDSKDETRELARLFGRLVLSWNDSKVSWDREHWGVSWLNFYWVQIWTPQLMQINSSASTTPGQINGKVLASTTPGQINGKVLAANYTGQVYMWTDDAMPNSFRLQFVFPTDAMPNSFRLQFVFPT

SEQ ID NO: 137452 - protein, 128 aa, Heterodera glycines
  Coding regions on vcDNA: vcDNA=SeqID_63875; Strand=-; Position=1 -30,217-573
MNQDRGKRKRNSAQTPFEQIYEAADYLREQSPIPTIYSTMSNGQKSKPKMRIYSEGGGYDNLERLREEIRRQKAELEGKRRKGKETEDSEQLAKGKKPWQSKKETPNWAQNANGTTEHNEEFVGWTKC

SEQ ID NO: 137453 - protein, 96 aa, Heterodera glycines
  Coding regions on vcDNA: vcDNA=SeqID_63876; Strand=-; Position=1 -87,286-489
MNGYQPSRNEHTGDESSKKKRHNTNYFRYIYNGNSEQFGLCVAITEFNTENMPNYITEKLKNEFKIYRKLSKDSKHMLKVFERSLKPKRFFFNFII

SEQ ID NO: 137454 - protein, 444 aa, Heterodera glycines
  Coding regions on vcDNA: vcDNA=SeqID_63877; Strand=-; Position=1-1335
  Homolog annotation: Hit_ID=NP_913627.1; Match level="QueryCoverage =73%, HitCoverage=23%, E-value=4e-42, Identity=34%"; Hit description =putative helicase [Oryza sativa (japonica cultivar-group)]
MRWLFVSISSWGQRSNALELWNKYKDQMYNPQGITSAAIRQAREQEALADIDWRLHFFNSSCVHCGLPDPPNSKAKNINLAVEEAFFGDDDLNMSPGQQNPRQQQNAPPPLNSDQQTVFDAVVKAIQSDPRDATVPRRFFIFGDGGTGKTFLFGQIIRRLRKVPYTYKVLATASTGCAAILLPYGKTAHSTFRLGREVSLDKLPSIPLESFFARRIREAQLIIIDEITMLHNTVIEVIDRVCKEMAIPQHKDLLFGGKTVIFSGDFKQSLPVVPHEGLTAQVTACFQTNPLFGQFTTMKLTINQRLGQGQQAYLQMCRQIGLGETGEHFWIPPQFLVKSREELIDFVYPNFQQLLGNDKELLNRLILAPHIDTCDEINEIMMANVPGQVREYLSSDKPLDERPLDIDEIESEVAALNRRTDSGMPPHRLRLKVGSRRCSPYQQK

SEQ ID NO: 137455 - protein, 101 aa, Heterodera glycines
  Coding regions on vcDNA: vcDNA=SeqID_63878; Strand=-; Position=1 -133,176-348
MPSKDRRRKEADRLRWRAAIQTPDVANALGGPNTSGQQPFGIDQEPSTSTGIRAQIRQLRNDGQAIVGTPAMQLDTSVVSTPTTVGLRALTIVGGLNLSKI

SEQ ID NO: 137456 - protein, 139 aa, Heterodera glycines
  Coding regions on vcDNA: vcDNA=SeqID_63879; Strand=-; Position=1 -63,147-274,387-440,690-864
  Homolog annotation: Hit_ID=NP_741481.1; Match level="QueryCoverage =65%, HitCoverage=5%, E-value=2e-23, Identity=54%"; Hit description =PDZ domain-containing guanine nucleotide eXchange Factor (163.8 kD) (pxf-1) [Caenorhabditis elegans] emb|C
MSSSGLFYNALIRRPNERTEEDVSVIFNQLRRLDVFERLHDSPLRSVCRTARLERHPANYVLFRKGQLATCWYILLSGSVFMNKQIYLPIGWYVCFGLIDIIFIYLSMLKISLHFLQTSAPFAPIIFLKSSKWLQILAI

SEQ ID NO: 137457 - protein, 37 aa, Heterodera glycines
  Coding regions on vcDNA: vcDNA=SeqID_63880; Strand=+; Position=1-111
MDPKLYFDSDDPQWLSWIGQFSKEMSRCSLNTDELNS

SEQ ID NO: 137458 - protein, 121 aa, Heterodera glycines
  Coding regions on vcDNA: vcDNA=SeqID_63881; Strand=+; Position=1 -66,128-218,437-494,534-683
SWIGQFSKEMSRSLLNTDELNSVRVCTREQFYGPAGVEAMKRSGELYAEHRNDNVLVLVSGASSVPRGSTKVFHAHLVLPRVGKCEVSERRNANDGFKTFAIAQQLNSHSSKHFHSLFLLN

SEQ ID NO: 137459 - protein, 169 aa, Heterodera glycines
  Coding regions on vcDNA: vcDNA=SeqID_63882; Strand=-; Position=1 -15,311-439,493-590,640-784,892-1014
MPRNEELEEELEKEEYGKEAKTEREVGQREEKVEQKIEEDKKMEEKQTSDSPQQCQQLFDMFADGEEDGEEKMGEPMELDRISVETNAQTVICTEGTDLWPDSSVSSHLNEVNSAFAASRTEALRKLFTEPQRFAQPFQRDACSYRSYRAEKRKANDLEYITERHVIHW

SEQ ID NO: 137460 - protein, 23 aa, Heterodera glycines
  Coding regions on vcDNA: vcDNA=SeqID_63883; Strand=+; Position=1 -44,271-298
MAWTWIQEKSMPGSRKKLAFCHN

SEQ ID NO: 137461 - protein, 56 aa, Heterodera glycines
  Coding regions on vcDNA: vcDNA=SeqID_63884; Strand=+; Position=1 -69,101-202
MQLENKFKSTIIFCMMANLEQLKEMILILKHQNQMLCLAALVNIVLTQRREADFHR

SEQ ID NO: 137462 - protein, 51 aa, Heterodera glycines
  Coding regions on vcDNA: vcDNA=SeqID_63885; Strand=-; Position=1 -81,213-287
MIETMFKKSIFEPHVKSLCSKSLKYGHASFDVLNAVLHKKAFLEPFNGIVN

SEQ ID NO: 137463 - protein, 59 aa, Heterodera glycines
  Coding regions on vcDNA: vcDNA=SeqID_63886; Strand=-; Position=1 -89,148-238
MAKSGANFSPDAMPANNSEGIIVDSLYLAWQKFGDPNALLLIVVGQAYQTFEQKQVEYF

SEQ ID NO: 137464 - protein, 24 aa, Heterodera glycines
  Coding regions on vcDNA: vcDNA=SeqID_63887; Strand=+; Position=1 -63,178-189
MPNPKKKSWCQNQDSRGGCRQDNP

SEQ ID NO: 137465 - protein, 182 aa, Heterodera glycines
  Coding regions on vcDNA: vcDNA=SeqID_63888; Strand=+; Position=1 -110,168-606
MARCVTSIAFLPIGDLTPGIIALDMALPDELTPVLDWFVMNYTGRIKHDGSRTRPRFDPNIWSVYTRTLQGDDRTNNHSEAANRRLQCAFACSHPSIWHFIDLLRKDQKLSDDDFAKCSTGQEPPQKAKKYREADRRILTMVQNYLPLNNADTNIFPIHHPFNHHFIITFLIGISRNYEMRP

SEQ ID NO: 137466 - protein, 20 aa, Heterodera glycines
  Coding regions on vcDNA: vcDNA=SeqID_63889; Strand=-; Position=1-60
SAFAAAILLMCHSVVRERPQ

SEQ ID NO: 137467 - protein, 94 aa, Heterodera glycines
  Coding regions on vcDNA: vcDNA=SeqID_63890; Strand=+; Position=1-285
MTQNILSEHFETPIGQLMAQFDIQIQIRDTDFGDARFVDMEKNWSAEPVDNRGAYKVMLHPKVGARRIVHGQEERSSSQMSNRQNEMFGNQTAF

SEQ ID NO: 137468 - protein, 95 aa, Heterodera glycines; identical to SEQ ID NO: 128262
  Coding regions on vcDNA: vcDNA=SeqID_63891; Strand=+; Position=1-705

SEQ ID NO: 137469 - protein, 84 aa, Heterodera glycines
  misc_feature (80)..(80): Xaa can be any naturally occurring amino acid
  Coding regions on vcDNA: vcDNA=SeqID_63892; Strand=-; Position=1 -128,177-286
  Homolog annotation: Hit_ID=CAE66658.1; Match level="QueryCoverage =90%, HitCoverage=18%, E-value=8e-24, Identity=69%"; Hit description =Hypothetical protein CBG11995 [Caenorhabditis briggsae]
MFFLDKFLQGLKPQFDDDIVDRLNYYYTPMLFIIFALTLSAKQYVGQPYVGQPIQCWIPAQFTGAWVSHFINYFIIIRIXLFNN

SEQ ID NO: 137470 - protein, 16 aa, Heterodera glycines
  Coding regions on vcDNA: vcDNA=SeqID_63893; Strand=-; Position=1-48
MDKKWYSRAGIYEMDQ

SEQ ID NO: 137471 - protein, 129 aa, Heterodera glycines
  Coding regions on vcDNA: vcDNA=SeqID_63894; Strand=-; Position=1 -20,541-605,1067-1181,1226-1415
  Homolog annotation: Hit_ID=NP_741237.1; Match level="QueryCoverage =66%, HitCoverage=11%, E-value=2e-23, Identity=56%"; Hit description =CaLPain family member (clp-1) [Caenorhabditis elegans] gb|AAM15551.1| Calpain family protein 1, isoform d
MAATGEKASNSSSIRSNEIHLIEKCLRACIFHFHFWRYGRWTEVIIDDRLPCRNDNGQLLYSRPPTENVFWAILLEKAYAKMYGGYAVLSGGKVSDSLSDLTGGITEEWDLKSLDVAKRRDMELVIKKI

SEQ ID NO: 137472 - protein, 49 aa, Heterodera glycines
  Coding regions on vcDNA: vcDNA=SeqID_63895; Strand=-; Position=1 -138,271-282
MCARCGRFGRPHSEQLCALGTVQKEAVPTRDDDTLKQASKYNKYILKFF

SEQ ID NO: 137473 - protein, 64 aa, Heterodera glycines
  Coding regions on vcDNA: vcDNA=SeqID_63896; Strand=-; Position=1-361
TFLVLFESIRKMLLACKFSKFFIYAQKNQSKKSSNYWGFEFLLAITFLKLNENFCRFCKLIINT

SEQ ID NO: 137474 - protein, 28 aa, Heterodera glycines
  Coding regions on vcDNA: vcDNA=SeqID_63897; Strand=+; Position=1-169
VGVKNANAFKYKTKCLNSLTVIKFLIKG

SEQ ID NO: 137475 - protein, 226 aa, Heterodera glycines
  Coding regions on vcDNA: vcDNA=SeqID_63898; Strand=+; Position=1 -44,476-631,787-838,1390-1504,1591-1733,1805-1975
  Homolog annotation: Hit_ID=CAE62167.1; Match level="QueryCoverage =80%, HitCoverage=25%, E-value=1e-49, Identity=47%"; Hit description =Hypothetical protein CBG06214 [Caenorhabditis briggsae]
MTRPLRTRRKRKWSKEALSPPLLHPDANFDILTNSLAETMHILHGLYRTLKSNMHMTQEEVEQFAMRLQSFSDQNLIPFVEMFKGFRYELTVNNRQMFGDYDPVRPLSDSVFSALELLMADCVLATEPSLNPILVTNNLFSINCGALARGVVFKQFDVQVVSEEMAEHIQSEMRRQRLLQQPSPIAQVPAAALLAMKPTSGTKRSNSQAITGQRDGPSKIAIILDE

SEQ ID NO: 137476 - protein, 335 aa, Heterodera glycines
  Coding regions on vcDNA: vcDNA=SeqID_63899; Strand=+; Position=1 -177,355-486,944-1153,1207-1370,1437-1760
  Homolog annotation: Hit_ID=CAE62167.1; Match level="QueryCoverage =97%, HitCoverage=41%, E-value=5e-44, Identity=51%"; Hit description =Hypothetical protein CBG06214 [Caenorhabditis briggsae]
DLSPNGMDMKSAGGGSSGKRPIFYFYIRATMFSPSGRFADAHTLSLPFTIATRRNQDYQDGLLLQWVETAMGWEKFKFLFMQHFRINAEVERGLQDKDFDLLQVSDTLSSYPSALLMRLSFVTGGTICITLKSTVHSEDRAPSVPMHLEPLDLKKLQAKSLTDYLRDIAVAEKIKYLINSQGEPVLISDLLEQFSERTGGGIEELETSRCISSNVTHSGDIDAMQQITFTAMRIAVVTCKVKPPSADLMEYEEAALLRGDVQPKVHSPVPSSSNGYPSPSFNPASVFPGSAGGGGGGYRLPSVSAANDDFVREVTQLCNFWGKSKQVNSQLANLR

SEQ ID NO: 137477 - protein, 235 aa, Heterodera glycines
  Coding regions on vcDNA: vcDNA=SeqID_63900; Strand=-; Position=1 -9,259-345,408-489,720-802,1035-1104,1577-1671,1846-2103,2571-2594
MNKSRSKSRGAKPMYNAQPRRTQPEQMLSLETQVVLCPKCSLTFSSHRSLSLHNRIHKKENPKEPRTTRSAGTDAAPLTPPRQRMVNLDESSGPDDVFAEAHPMQPVAADGTPTLPGGIPRNSQAQIDVVRKSTSACGKKNSGEVPIETIHTVFALIIPHGGLFFNLLVDWGIIGDWGIKIEGLFFKPLLDWGIIGDWGINGDWGIIRANTVYSILFPPVQMAHTNGRVHKRKTN

SEQ ID NO: 137478 - protein, 66 aa, Heterodera glycines
  Coding regions on vcDNA: vcDNA=SeqID_63901; Strand=-; Position=1 -34,482-646
  Homolog annotation: Hit_ID=CAA32191.1; Match level="QueryCoverage =87%, HitCoverage=28%, E-value=6e-24, Identity=86%"; Hit description =protein phosphatase X (203 AA) [Oryctolagus cuniculus]
MEGYKWHFNETVLTVWSAPNYCYRCGNVAAILELDEQLNKDFTIFEAAPQEVSGVKIKTNNVPNQR

SEQ ID NO: 137479 - protein, 308 aa, Heterodera glycines
  Coding regions on vcDNA: vcDNA=SeqID_63902; Strand=+; Position=1 -174,226-337,397-623,712-891,941-1023,1313-1461
MPMRPAKAELTARKRRRRTIKRRKTPRLSVHNEEVAKKESKKGVEDEREDDSFGEKNKRRTSLTDSPLTELSPSSTTSNGDSADDTEVAKSSSKQGSSCGTVSNSSSSNFYVVNAPPSSSYSSVGERQQHQNMHFLSEITEEENINEVEREYAFEIVINQKKVQFLKECERHLIKQLKYNKWTEQLCQSIFGGDFRTFYRRFKMVMICLRKRKSAHYERLTDAQLASHVAEMIIEKFHNKENQTTILMVLLSNSEREVKIAHMLLKLLTRSQLEKLLEVTAAKSGKNALHLATATGQSCQLQVLLALT

SEQ ID NO: 137480 - protein, 282 aa, Heterodera glycines
  Coding regions on vcDNA: vcDNA=SeqID_63903; Strand=-; Position=1-859
  Homolog annotation: Hit_ID=YP_075278.1; Match level="QueryCoverage =96%, HitCoverage=97%, E-value=2e-56, Identity=45%"; Hit description =hypothetical protein STH1449 [Symbiobacterium thermophilum IAM 14863] dbj|BAD40434.1| conserved hypotheti
LTNIRIVTDSTADIPLALRQELNIEMVPLKIHFGDEEYLDTVTLQSEEFYPKLTSSPHFPRTSQPSPAEFLDLYQGLLGEPDTEVISIHLASVLSGTYQSALLASTMLEDCKVHVFDSCSASYGIGALAVAAARAAKAGQSVDEIELVRTMRENFYIYFLVDTLEFLQKGGRIGKASALFGSLLNIKPILSLETGEVAAIDKVRGHKKAVARILELLAADVPGKTIRSLHIAHANNLEGAEQLRAAIMQQFVVEHVDYITLGPVIGAHAGPGTIGVREYGVR

SEQ ID NO: 137481 - protein, 141 aa, Heterodera glycines
  Coding regions on vcDNA: vcDNA=SeqID_63904; Strand=-; Position=1-425
  Homolog annotation: Hit_ID=NP_243364.1; Match level="QueryCoverage =98%, HitCoverage=24%, E-value=7e-38, Identity=52%"; Hit description =hypothetical protein BH2498 [Bacillus halodurans C-125] dbj|BAB06217.1| BH2498 [Bacillus halodurans C-125
LCPVQSIPQGLAAILAFQEKADAKTNTEAMSESLRRVKSGQVTYAVRDTNTDGIDIKQGHFIGIQDGRIVSSQPSLLDACKKLLEEMIEESSEIVTILTGEDAVDAETEELEAFIQAAYPDIEIELHPGGQPLYAYLFSVE

SEQ ID NO: 137482 - protein, 24 aa, Heterodera glycines
  Coding regions on vcDNA: vcDNA=SeqID_63905; Strand=-; Position=1-73
MHCLCVASWDHVLVRVLTLLAQLG

SEQ ID NO: 137483 - protein, 23 aa, Heterodera glycines
  Coding regions on vcDNA: vcDNA=SeqID_63906; Strand=+; Position=1 -22,72-121
MRTTLETGFSTQLPARVISSRSE

SEQ ID NO: 137484 - protein, 258 aa, Heterodera glycines
  Coding regions on vcDNA: vcDNA=SeqID_63907; Strand=-; Position=1 -47,101-379,440-890
  Homolog annotation: Hit_ID=AAL78214.1; Match level="QueryCoverage =58%, HitCoverage=78%, E-value=1e-14, Identity=29%"; Hit description =putative esophageal gland cell protein Hgg-20 [Heterodera glycines]
MSDSRKEAEEKMAKAIFISADCWLCVFDLLEPSQLGLGISMISHRFDIYVDEHFKTRKWALKFIRIRGKIGENGTKEMKIVKYYDWKPLPIPQKPLPKRVVGFKAISIEYIDQNAIAFLRRFRQLFAKCQINLSIDIYYIYTDRIMVFLLHNIWPMIGKNIYAIELRVRIFRRLRQFVDPSILNNCSSLRVVISCADDFFIEFPSADNAMASDGQALAKWLFTPLQDNVPKMLKCSLDMDYDGNLVTNVEAFKAVISN

SEQ ID NO: 137485 - protein, 153 aa, Heterodera glycines
  Coding regions on vcDNA: vcDNA=SeqID_63908; Strand=-; Position=1 -138,190-467,521-566
MLNKNRQTVAKWLFTPLQENGVPKVLKCSLEKDDGKWPLKIEAFKAAFANASSPANFIVVISFLWSFAVPFVLTNEFTREQLALKRINNSHRFLLDRCPIVRNVSKWTKWEKEAIGWQFNGQWNKINIRIDNERQIGDGLLNAMIGPCVLQKK

SEQ ID NO: 137486 - protein, 40 aa, Heterodera glycines
  Coding regions on vcDNA: vcDNA=SeqID_63909; Strand=+; Position=1-123
KPNLCQVARDPSGLVFRILIFKKAHFSIFGLGPKRPWGPK

SEQ ID NO: 137487 - protein, 215 aa, Heterodera glycines
  Coding regions on vcDNA: vcDNA=SeqID_63910; Strand=-; Position=1 -111,167-223,264-362,406-516,729-764,1270-1379,1784-1848,1904-1959
  Homolog annotation: Hit_ID=NP_502164.1; Match level="QueryCoverage =58%, HitCoverage=20%, E-value=1e-28, Identity=53%"; Hit description =white family member (67.1 kD) (4M237) [Caenorhabditis elegans] emb|CAB05682.3| Hypothetical protein C10C6
MQQDDLFMGMLTVKEHLMAQDWMVGDTKRTMRRRVNEVIDEFGLEECRHELVGFSGVEKSILGGETRRLLFASELVNNPQIIFADEPTTGLDFSMAESVISVMRALALSGRTIICTIVQPPLDIYWMAAGNNARLTRDELFSAIACQRRSIVRLDTERARFRRLNGAQFRVVVRLKFLDLGGFLPNFAAVMPQQQNVVNVAAVLANANPNGQNYN

SEQ ID NO: 137488 - protein, 309 aa, Heterodera glycines
  Coding regions on vcDNA: vcDNA=SeqID_63911; Strand=+; Position=1 -103,716-1226,1270-1582
MIFTENVVPICLANSTSEKVFNNNLHIVGWGHQNEMANPIATKKQKVKLSYEGHLYTFAKMSSDGMTKFWRCEFKNSTDKCNGRIWTDLHDQFIRLATPHTCPADASRVDAQMVTTTIKRRAIATFEPPSVIRAEALQNVPSPSAILVSKQAAKDVKNCTDSVFAENARMITSVAFVPLCDIRMAVAALDTEFGNLAVFQPLIDWLLINYVGQPRPNGTWSQPTFRPEQWNVYTRTLNADARTNNHSEAEHHRLQGAFNCRHPSIFHFIDVLRREQKPTDVKYASFMAGEDPPPKERKFLPTDEQILNL

SEQ ID NO: 137489 - protein, 24 aa, Heterodera glycines
  Coding regions on vcDNA: vcDNA=SeqID_63912; Strand=-; Position=1-80
RTLSTAVRQRSYKIYSMPQILWAG

SEQ ID NO: 137490 - protein, 24 aa, Heterodera glycines
  Coding regions on vcDNA: vcDNA=SeqID_63913; Strand=-; Position=1-80
RTLSTAVRQRSSKIYSMPQILWAG

SEQ ID NO: 137491 - protein, 538 aa, Heterodera glycines
  Coding regions on vcDNA: vcDNA=SeqID_63914; Strand=+; Position=1-1621
  Homolog annotation: Hit_ID=S08405; Match level="QueryCoverage=98%, HitCoverage=45%, E-value=6e-79, Identity=33%"; Hit description =hypothetical protein 2 - silkworm transposon mag
FGDVLTKDGYSPSLNNREVIEAFPVPKNAKEVKRFLGMMSFFRKFIPDFAKLAYPLNQLTKQEKEFKWADQETEAFENLKRQLLKAPCLRAPDYKLPFYLFTDASATAYAGALMQSEKSDEMHAVGFWSRTLTATEAKLPATHGELAAIVHAVQNFRPIIYGSEIIILTDHRPLTFLFSKSSSNPKLNRWLMALQEFEPKVIYLEGKANRVADALSRVPIKWEQIEAKIKEEIPYLLVSEENENEISRDKIEKETIEDPILSEIVLKIRENWSEPVEEKLKPFYRIRDQLYLEGKLIRKKPLRQIVIPEKMRDPILKLIHRAHFGIVRNKDRAKGLVWWPGINESIEDFVKKCWTCQRNANKPREKPDRRWPEARFPFERVHSDLAGPIWGTNFFIVIDAFSKFQFVYQMSSTHSSTLINALHELFGICGSPKTFVTDNGTQYVSNEMEEFLKGEGVRHLTSAPYHPSSNGEAERFVRTFKEGVGKLLDEGKSLKIAQFVFMQEYRASPCAAAEGESHPKSFWERIRTVLDNIMSTNA

SEQ ID NO: 137492 - protein, 113 aa, Heterodera glycines
  Coding regions on vcDNA: vcDNA=SeqID_63915; Strand=-; Position=1 -49,413-705
MWFSCISRRVKAAEKITFRQRIRLAILSPVQCHHLHPIPMGHRSLHFGVVQLAAVVHKRQISAPINWHFFAKTPFAVNEGTKCCCSIGQKQCLNYSAALSFIKMGSEMTEADN

SEQ ID NO: 137493 - protein, 124 aa, Heterodera glycines
  Coding regions on vcDNA: vcDNA=SeqID_63916; Strand=+; Position=1-375
MALGGWKRERARLRSLQNLNRLFVRPALTKEQLKEEYEARVRKRQQNSAPVAPAMQHRQTNVPTPVKKNGPNQKEASDDISKPPEVFDQTILVCYEALKSLPPNDKIVHQIQSLEKQYPRLFNK

SEQ ID NO: 137494 - protein, 95 aa, Heterodera glycines; identical to SEQ ID NO: 124528
  Coding regions on vcDNA: vcDNA=SeqID_63917; Strand=-; Position=1-855

SEQ ID NO: 137495 - protein, 189 aa, Heterodera glycines
  Coding regions on vcDNA: vcDNA=SeqID_63918; Strand=-; Position=1-570
MLSESADKTLLSHSLTNDSQTAAAIQIVTALKDTILSPNVSLVVICLYSYQKESLQTEFEKQRIEVLVVTVDGYQAQESDLVILVTTRTSLRDGALRALQAARPHLSREKEERMSPTKVRVHAEMRHGGRSNVLDNSAVPFLSEVANQRVLVVLALCANVSGIWQRTVDMRMDNQQDVVNQGAKGNGNK

SEQ ID NO: 137496 - protein, 1168 aa, Heterodera glycines
  Coding regions on vcDNA: vcDNA=SeqID_63919; Strand=-; Position=1 -148,249-386,566-3783
  Homolog annotation: Hit_ID=EAK97852.1; Match level="QueryCoverage =38%, HitCoverage=42%, E-value=2e-23, Identity=26%"; Hit description =hypothetical protein CaO19.8554 [Candida albicans SC5314] gb|EAK97791.1| hypothetical protein CaO19.939 [C
MYMWAKASAFGDEEAASAILRTPNPKECKRIGSRIRLFGTTALATHKHIPNDVYWGAGVALSDVEKIRDINRWPGKNILGRILSALMKKFLRKKSEMSAPTAPPNVRDLSEFPPLEKLTLEDVRKKNKIASASPSGNSNISKETCSSAISVDLVASASQITWGGEKGNSGQEKGEKNQKLNKNVASASPRDYEKFANQGFDKNPDEMAEEMMEEFSSFNVRENEGKIVEYLVCQVEENIVIGGKLRTMANKGWPHFVAISNEVAEKAREFKKKLQMGDIVGVKKFEWKNDYRYLAKRETDKSHFNKMWYVQKINSQATVIDLGHIRYAILREHPGLVLRIREMVSNGVTKKLCAIIISPGLQLSSRCYRRQLSELELESLQEGQLIKVWTAFVPEQTLVENSFILPPQSQFRLGTEKQIEEGKGVLSIVGNHAPWPYQSNSRNVFFPLLPEMTLPEIELSEQIMSSAIAYSFEDEEKRIVECKFEGRAEWQNDTFWLRFAEIDTEKMKKLKEVWTEEANVFFRTALDLPHFAFGYVKQIDIERIREEGKPKFNFWIMAKVTNVQERKFRDVHAELEAAEEGGVFVVHPIIPIGVKHRRDCFASNLPSKIANLETKQGKMMRAVLGRTEEIIEENVDQNASAIQINHALMKKLNEKQQQTAKLLLSKESHFVFQHAPPGVGKTYVAAIVAAILLSIEKEIKIAIVTAANLPLAKLVQELNDVFGSDEMEESGSVAFFSGYAKEKYKEMLEKLKRHLLISKISNEEIISKFETQDDVKEIETYCKNFEVRPRLTKERKVANLYSEVADLRIVFTTVSMAENLIHTALDGTTVLIFDEATQGSWVCLAHLVARMPKLEKVLVTGDQLQLGVHLQKLPPLLQSGFGLESMVDQLIMSPTVVQTRLTTCYRMHPTLVKAVASAVYEPNGEKFEPGRAAEDRSLLTASKFPLPIQNCPIVLLNVVGKCRQDPLSHSLTNDSQTAAAIQIVTALKDTILSPNVSLVVICLYSYQKESLQTEFEKQRIEVLVVTVDGYQAQESDLVILVTTRTSLRDGALSENSEFLKDSRRATVALSRAKSGLFLIGDFKTLSEGEVWNKFLETASEDSQIVGEEYLQILRNGRYMRDRYGQLIDGIGRVVQDLQWLQKNDENWRTMQQQSTSSSTSTFESRKRN

SEQ ID NO: 137497 - protein, 340 aa, Heterodera glycines
  Coding regions on vcDNA: vcDNA=SeqID_63920; Strand=-; Position=1 -520,639-1138
  Homolog annotation: Hit_ID=NP_294987.1; Match level="QueryCoverage =44%, HitCoverage=65%, E-value=4e-18, Identity=35%"; Hit description =hypothetical protein DR1263 [Deinococcus radiodurans R1] gb|AAF10836.1| conserved hypothetical protein [D
MPTAKVVISQDGRKLVPFFTSAYPFSNHFSCRFVIDGLEFSSSEQMYMWAKASVFGDEEAASAILRTSNPKECKRIGSRIRLFDTTAWRRISIFVMTCANWHKYRQNEHLMRHLFNFGPDAEFVECTANDVYWGAGVAISDVEKIRNTNRWPGKNVLGKILSALMKKFLRKKSDMSAPPAPPNVRDLSEFPPLEKLTLEDVRKKNKIASASPSGNSNISKETCSSAISVDLVASASQITWGGEKGNSGQEKGEKNQKLNKNVASASPRDYEKFANQGFDKNPDEMAEEMMEEFSSFNVRENEGKIVEYLVCQVEENIVIGGKLRTMANKGWPHFVAISNE

SEQ ID NO: 137498 - protein, 369 aa, Heterodera glycines
  Coding regions on vcDNA: vcDNA=SeqID_63921; Strand=-; Position=1-1110
  Homolog annotation: Hit_ID=NP_500013.1; Match level="QueryCoverage =70%, HitCoverage=18%, E-value=4e-46, Identity=40%"; Hit description =predicted CDS, polyprotein family member (4B673) [Caenorhabditis elegans] gb|AAC02594.1| Hypothetical pro
MCTPPVNTLFAKVGLDLAGPFPKTENGNKHILNIICWFTKFVISVPLPDAKAKTIASAFLKNCYLRFGGCTELITDNATAFTSDFFKSLCALLYINKTYAIPHWSQGNAVTERSFRTFHNILSKYISKDEPDFDEHLDFVSFCYNTSVHRSTNETPFFLMYGRDPIFCIDLILDPKIREPVAFSDDEEIRQKIVVTLRKAWQAANLANQEAQARTKSSYDKLVRNPTISVGDRVLLRNYSGKIGTSKKFHLPWKGVFRVIDIEGVRTTILSCNSPQSNPRVVHINQLKKCIEPLGPACTIPKLDDDEEKALHEANAKELINEPGHYHKLGQKSNSEVEKEVEETDEPEQISPRYNLRKNPRARKLSLNN

SEQ ID NO: 137499 - protein, 368 aa, Heterodera glycines
  Coding regions on vcDNA: vcDNA=SeqID_63922; Strand=-; Position=1 -115,220-1209
  Homolog annotation: Hit_ID=NP_507948.1; Match level="QueryCoverage =35%, HitCoverage=14%, E-value=1e-09, Identity=27%"; Hit description =predicted CDS, retrotransposon gag protein and Zn-finger, CCHC type family member (5U981) [Caenorhabditis
MVILSQMTYQIHEKDTKITATISQEWEEVESQMIKAVIGNGRLGNLLFGTTIQKAGRRVRKLRETKIQQGEIYEEPINQINWPPRIRRAGNSFKKSFTRPFKRNRHGPNPTQMSTHFELNSLMGQLGSLNNNKMTVTTLVSLNNFQMKCLVDTGSSTSVAPKALADYLGIKTFKSEAHLMSASGHPVHVKEAARVTLKIGNEYVDIIIRLFDDELSWTMKDYNFILGCDALASLPPITFDFQNKWLSIGNATLPLGNATNKILYGLKIYATDTTELSPNEQCIVKAKTKSLQKLRHEIVFNEIDKKLLNEGIGFVPSLSDFKSETISVIITNPTSTVKRIFKGTCLGNANEVLKTENSTIFTEIEKED

SEQ ID NO: 137500 - protein, 63 aa, Heterodera glycines
  Coding regions on vcDNA: vcDNA=SeqID_63923; Strand=+; Position=1-297
RHFFRGHFDRSATDVYIDFAVHTGRFRPIRLAHPNVVMQGFDGLKKNMLPIKCITVSPCRIAQ

SEQ ID NO: 137501 - protein, 41 aa, Heterodera glycines
  Coding regions on vcDNA: vcDNA=SeqID_63924; Strand=-; Position=1 -88,1211-1248
MFFRCDNFTAGPPRPTPSRRRSTSAGSGGGLGFVLRCQVHT

SEQ ID NO: 137502 - protein, 757 aa, Heterodera glycines
  Coding regions on vcDNA: vcDNA=SeqID_63925; Strand=-; Position=1-2272
MTDQIIDRKSKQNQNFPNPNYGREIGVNHPIQNTRDFGNGPNFQNFHPVRNINQPNYQQRPNPNFENLAPQPNHFPNVQNFEFVPQQNFQQNQIPDIVMELHKVTLSNQYANTLREIPNLYGTEGRDKIKDFFLNVQMCAGEWRPEKQKELLQTKLKGKALKAYHIALNKFGNEATFGILKTEIMSILRETDYKEANAFSELTQNGKRKPNEDIIKFGERIQRLVNCSYIGLDENQLDEVSKKHFISNINDVNLARFLECQTKANQTFDELLMMANRLSLIEDGKNRERNESVGIPVQFQQTGPQQKPYSPFQNPNYGQRFERNFPNFGMGAQNNFRPNRQSGFKNQTFQQENRNYCPNKNFDHFQNQNLVPYQTYGPKNQWVSDPQNGFQNDIFYESNPNSRPSQRFVHFQNQNSDHQQDVNDHKIEAISANRTQFDSNQQSNPMATQNMELNMIKVKGKGTEKCEKKSVKISHIEHSEPPAYEKFFNSLIAHSTEFPSPNPTQISNSECIVLELNVAGLKATALTDSAAEINAANPEFLHKVAVEKGVNLIDWGFSPNKGKSEIPFEVESFTGGRVPVIGVLNVPMEKGNWQGKINCVVTKKPFPYDFVLGQNALSSLGYYIGNVITNEIINFGESPKHSNNSLPNSGRISSLKIVPRPIQSRIISNEVIKSISPVKRIKFIQKVSSNSKIASNKTDQTPFVKLQKIPKKIPSPPIKLVINAIRHKNEDLDQKQTKRERRRVFVNSKYKNVFRQP

SEQ ID NO: 137503 - protein, 111 aa, Heterodera glycines
  Coding regions on vcDNA: vcDNA=SeqID_63926; Strand=-; Position=1-333
LEEEHRLVNTVRSLIRIKNPNDRLCLARAVLLGLHDWRSRSPGGGGPTAFKSFANRQHTHGPEARNLLRRAAIPRNKHMYTIDDVQKVQDWIDQRYGPGEIRIAVFEKERE

SEQ ID NO: 137504 - protein, 83 aa, Heterodera glycines
  Coding regions on vcDNA: vcDNA=SeqID_63927; Strand=-; Position=1 -206,293-338
MYTIDDVQKVQDWIDQRYGPGEIRIAVFEKEREYRIVFKAASGEAAKFNLCLLFEPDKIWLYKIGWPFCNKFDLNNLILGFRY

SEQ ID NO: 137505 - protein, 176 aa, Heterodera glycines
  Coding regions on vcDNA: vcDNA=SeqID_63928; Strand=+; Position=1-531
  Homolog annotation: Hit_ID=AAA93301.1; Match level="QueryCoverage =90%, HitCoverage=43%, E-value=1e-22, Identity=33%"; Hit description =HASI
MEKSIKNVLERLYNDPKSPAAFAGVDRLWLEAKKELGNKIRKNDVKHYLEGHRTYTLMRPRRVNFLRARTTAAGFMTDCQVDLADFQALSQHNSGNRYLMVVIDVLSKRIFVTPLRTKKSDDMVEGFKRVFSTMPMKPHRIFSDKGTEFRNQQLKKILMKRKLRNMRAHILRRKQH

SEQ ID NO: 137506 - protein, 256 aa, Heterodera glycines
  Coding regions on vcDNA: vcDNA=SeqID_63929; Strand=-; Position=1 -438,621-953
MSNNPLPPTTTLTDTNDLHLLEMLTLEEEEEASKGRITASASQNEDQTRNLSRETCSNEFGVQSVASASKIEGACTGHMVGNGQENSETNKNISQNIASASQSTNEKETKRIAEINHCREMIRKTMAALAIKCDTEKTSELRDTKKRMGECAMAVRLGKEDKWPYFALVHPNVKLNQYPRLGSIISVPKVEKLEYFSSLNSELYSSNPNEESGTIYNIIKSVRNEIKAIDVDFNVYDDESDDNILSASNWTGCKKS

SEQ ID NO: 137507 - protein, 36 aa, Heterodera glycines
  Coding regions on vcDNA: vcDNA=SeqID_63930; Strand=-; Position=1-110
ILIDSYASYSADKNRLFQTLVKFECRGIEPTSFDPR

SEQ ID NO: 137508 - protein, 206 aa, Heterodera glycines
  Coding regions on vcDNA: vcDNA=SeqID_63931; Strand=-; Position=1 -110,153-282,336-454,843-963,1012-1150
MKFLDRDVLQTMQLVTNKHCLIVDKYFDVFPLRAVARCKLRTTRSNDMKLLLIYRGRTIESNSDLHLWLRHCFVGCIEFIEFKFTSEILRDLQGMGQRIFQLNYCVFDYQGRSSSQLISHVWLNSLCDEHCDDSANPKALSLKGFDYSALSLDLIETLHEDFVNSTNKQSFILNVECDDEMNLERKEENRITGEKFKVNATAEGDI

SEQ ID NO: 137509 - protein, 36 aa, Heterodera glycines
  Coding regions on vcDNA: vcDNA=SeqID_63932; Strand=-; Position=1 -46,160-230
DFKVKKCFVCFMPVFALQMSANLIGSLTFVRRITTT

SEQ ID NO: 137510 - protein, 47 aa, Heterodera glycines
  Coding regions on vcDNA: vcDNA=SeqID_63933; Strand=+; Position=1-284
KRKHEKILLISAIIKKHKTLNCITKLKKLKSKIFWKRVKMNKSRILS

SEQ ID NO: 137511 - protein, 30 aa, Heterodera glycines
  misc_feature (16)..(16): Xaa can be any naturally occurring amino acid
  Coding regions on vcDNA: vcDNA=SeqID_63934; Strand=-; Position=1-95
AMRKAAVRLCAKMEAXMRAQIDETAKKLLA

SEQ ID NO: 137512 - protein, 229 aa, Heterodera glycines
  Coding regions on vcDNA: vcDNA=SeqID_63935; Strand=+; Position=1 -93,265-351,410-496,547-613,673-767,815-861,909-928
  Homolog annotation: Hit_ID=NP_503169.3; Match level="QueryCoverage =96%, HitCoverage=41%, E-value=8e-50, Identity=47%"; Hit description =rhodopsin-like GPCR superfamily (5A756) [Caenorhabditis elegans] gb|AAF60815.3| Hypothetical protein Y58G
FKRFAIVYGCLFSFGLLGNGSVLLAFAQNKRLRSARNLFLLNLILTDILLCLTAVPVTPWYALTKDWSFGSLMCRLVPYALTKDWSFGSLMCRLVPLSNSCAVFVTSWSLTAIAVDKFMWSLTAIAVDKFMHIIDLTRQPFSLRTAGFVTFVSLRTAGFVTFVIWTLSSLLNIPYLLSYSLVNGDYYVPKNSTPFCGQFCGDYYVPKNSTPFCGQFCDELNWSDELNWS

SEQ ID NO: 137513 - protein, 50 aa, Heterodera glycines
  Coding regions on vcDNA: vcDNA=SeqID_63936; Strand=-; Position=1 -104,250-298
MVAFGSMARKKSFGRGREPTLKQKVEIEVEKTLACQFKNIKKPKVAFFVL

SEQ ID NO: 137514 - protein, 59 aa, Heterodera glycines
  Coding regions on vcDNA: vcDNA=SeqID_63937; Strand=+; Position=1 -94,148-233
MRKAKCETPKNANNAKGEMRKAKPRPIGYGRVHLWWRTERSADLFNALFICVYLFDFTH

SEQ ID NO: 137515 - protein, 47 aa, Heterodera glycines
  Coding regions on vcDNA: vcDNA=SeqID_63938; Strand=-; Position=1-141
MWHHKSRHSLLSFSVANFCLFSLFFWHFDAILAREENYEPIPDEKAT

SEQ ID NO: 137516 - protein, 112 aa, Heterodera glycines
  Coding regions on vcDNA: vcDNA=SeqID_63939; Strand=-; Position=1 -326,790-802
MSCKIGIFTSKSTHSSSRSSYLDKEIANGDKELLNGLIRGLNELIDDYSCPHLCPTDGHIVQKFVPILFDTLRKWHQQKVKYVKRSQTMALACSVVEHLLARLETLITIEAT

SEQ ID NO: 137517 - protein, 184 aa, Heterodera glycines
  Coding regions on vcDNA: vcDNA=SeqID_63940; Strand=-; Position=1 -443,590-701
MSQAGGFFISILALRQVAVELRQNAQFELPSGQQSFNPDNFKQKVKNKFDFVIRTLKEMENTENYEQIWNWKRRRLSSSRSGLSISPPPHNGIVLGCVLLHFGIALSKRANVEHTKFENFSKLKNANGECPTVQYERRDYQCGKVPFRSAPIELQLFNEAISNYTRTIRIISNKCQDWKYNYRD

SEQ ID NO: 137518 - protein, 108 aa, Heterodera glycines
  Coding regions on vcDNA: vcDNA=SeqID_63941; Strand=-; Position=1 -20,220-389,456-592
MVIGLKCHFSDLANAFDSQKGIGFQPNELIADQLTGDQFQVQFVAMLATFDLNVQRRVISLTRVLQSEYEAFYAFLDWNSIFGQHQQGTSGQNQQQGPPPPPPAGGTF

SEQ ID NO: 137519 - protein, 84 aa, Heterodera glycines
  Coding regions on vcDNA: vcDNA=SeqID_63942; Strand=-; Position=1 -85,136-294,355-363
MHQFQKARDYLISLAYVLEPHYRISLRNHLANAFDCSKGIGFQPNELIADQLTGDQFQVQFVAMLATFDLNVQGKVISLTRVLQ

SEQ ID NO: 137520 - protein, 92 aa, Heterodera glycines
  Coding regions on vcDNA: vcDNA=SeqID_63943; Strand=+; Position=1-707
LFEYPKRTLEKIVFFVFGAVPPNRCAQIYGETESFRNSFPIACTLILRWIFAPHNCLSTPNGHLKKSIYFCFRGSPPEPMRPDLWGDRILRE

SEQ ID NO: 137521 - protein, 62 aa, Heterodera glycines
  Coding regions on vcDNA: vcDNA=SeqID_63944; Strand=-; Position=1 -180,340-348
MNTSETQKKHQLTTSTPIGCTVKNHQKPPLRKRSVADGSGDRENGTAATINWAKADLSVCLA

SEQ ID NO: 137522 - protein, 98 aa, Heterodera glycines
  Coding regions on vcDNA: vcDNA=SeqID_63945; Strand=+; Position=1 -187,240-347
MIPSVCNGESSSSDDEYYNNFSKYKAKAALALRRNDCKSGKEITKNGKSTTKKVSSEPSDVEVFTSCPLSEQLISRAEVDPEICVVQIADTSVNSVVD

SEQ ID NO: 137523 - protein, 42 aa, Heterodera glycines
  Coding regions on vcDNA: vcDNA=SeqID_63946; Strand=+; Position=1-3,85- 210
MPNGKKSNKLIYCPIKNEHFIADISVAPKLSIGAFSLIVMAF

SEQ ID NO: 137524 - protein, 43 aa, Heterodera glycines
  Coding regions on vcDNA: vcDNA=SeqID_63947; Strand=+; Position=1-133
STVLALSGGDSQRCNACSHVPINLIFVKYVPLCIRLHFCKKIQ

SEQ ID NO: 137525 - protein, 23 aa, Heterodera glycines
  Coding regions on vcDNA: vcDNA=SeqID_63948; Strand=+; Position=1-6,69- 134
MMKLNIFLLLFSRKSPQNDFFFL

SEQ ID NO: 137526 - protein, 155 aa, Heterodera glycines
  Coding regions on vcDNA: vcDNA=SeqID_63949; Strand=+; Position=1-470
QFLVFFKALDIIEVSMALVTVNFRALFRTWEPESHPATFLAALLAFNSVSFFGPKGHFTANTKIFDAKKPGHRFDPVPVIAFSYHANFVLTDTFPLENWLKSKFLKKCKKWVNFKLIWLPFQKPQCETYPGIPCPKIFVQPQGVGTKSFVTHANP

SEQ ID NO: 137527 - protein, 23 aa, Heterodera glycines
  Coding regions on vcDNA: vcDNA=SeqID_63950; Strand=+; Position=1 -47,587-611
MADLKKMKRDTEAEKTNYGVMNF

SEQ ID NO: 137528 - protein, 97 aa, Heterodera glycines
  Coding regions on vcDNA: vcDNA=SeqID_63951; Strand=-; Position=1 -72,174-396
  Homolog annotation: Hit_ID=NP_741917.1; Match level="QueryCoverage =100%, HitCoverage=25%, E-value=3e-40, Identity=84%"; Hit description= UNCoordinated locomotion UNC-9, OPUS protein, innexin family member (45.2 kD) (unc-9) [Caenorhabditis el
WYFLAAATVCSLFYIFISVMPSRQLNFVGKYLTGIEGYKMVDSQSLRRFVFHFLRQDGVFLLRMVATHAGELACYDLAKKLWDNFMVHKEGAKMHDV

SEQ ID NO: 137529 - protein, 100 aa, Heterodera glycines
  Coding regions on vcDNA: vcDNA=SeqID_63952; Strand=-; Position=1 -112,814-849,902-981,1030-1055
  Homolog annotation: Hit_ID=NP_741917.1; Match level="QueryCoverage =94%, HitCoverage=22%, E-value=1e-36, Identity=79%"; Hit description =UNCoordinated locomotion UNC-9, OPUS protein, innexin family member (45.2 kD) (unc-9) [Caenorhabditis ele
PNMLLYYFASAVKSIQFHVDDDIIDKLNYYYTTAIIIVFAILVSSKEYLGNPIQCWVPANPIQCWVPATFTEPMEQYTENYCFVQSTYFLPLSTYFLPLN

SEQ ID NO: 137530 - protein, 104 aa, Heterodera glycines
  Coding regions on vcDNA: vcDNA=SeqID_63953; Strand=-; Position=1-314
LKKNAPLLRPSADGKSEQLDNHLAELELLMNGAREALSVDELLQNETQLILVLFEMKNSIFGDKITLNSKNLCEGENFLQFLFILHENAIGELMRKAEFTAQLK

SEQ ID NO: 137531 - protein, 92 aa, Heterodera glycines
  Coding regions on vcDNA: vcDNA=SeqID_63954; Strand=-; Position=1-278
MVKLSQMTYQIHEKDTKITASISQEWEEVESQMVKAVIGDYRKIWLIIMSLILTILSIDLAIRLTIGLSEIYAGNGRLGNFYLVQQFRKLGK

SEQ ID NO: 137532 - protein, 217 aa, Heterodera glycines
  Coding regions on vcDNA: vcDNA=SeqID_63955; Strand=-; Position=1 -208,259-335,1660-1903,2077-2198
  Homolog annotation: Hit_ID=NP_500617.1; Match level="QueryCoverage =100%, HitCoverage=38%, E-value=4e-36, Identity=56%"; Hit description= dehydrogenase, E1 component and Transketolase, central region (115.7 kD) (4F462) [Caenorhabditis elegans
MPHRGRLNVLANVCQQPLSTVLALFNTLKLMDEGSRDVKYHLGVCIERLNRQSQRMIKIALVANSSYLEAVDPVVQGKVRAEAFYSNDLHCDRHMEYVDKELKNYGAILEKAHESAKQVTELCNRNWSDTPLYDGKIPSQLLPTGIERDSLEHIVNKISQVPDGFNLYPRLLRLLKGIHVRLSGQDVERGAFSHRHHALHDQLIDQKTYNPLNDLSE

SEQ ID NO: 137533 - protein, 322 aa, Heterodera glycines
  Coding regions on vcDNA: vcDNA=SeqID_63956; Strand=-; Position=1 -198,669-1175,1513-1776
MFPIRPPPSAVHINALLNPPDEFDEKPKHNLFRWLHTPRKDGRPKIVTIRKWRKPQWASFMPSLITFFIAPSAVPVNFLVICHIACNTNFQKMERENEETDERLTPNAQVTAHAVIVRQRNGTDQRTVAKWKWEANRILDTAMHQQFGFSIFSSRMANDVWLDTLFWIDRTEVGTKFCTDRRALRQAGGHAFQTAQMEAGRAGYSSGTKRMGLGRHGDCHRYGRPPVDEATAACQYFEAPSAIAVNYVVVCHRASRRNIEVVERENERTGEWLTLRWRVPVEAVVVRQRSGTDRRTVAKWEWDANHTLDTMLCINIQDSDIG

SEQ ID NO: 137534 - protein, 95 aa, Heterodera glycines; identical to SEQ ID NO: 130305
  Coding regions on vcDNA: vcDNA=SeqID_63957; Strand=+; Position=1-660

SEQ ID NO: 137535 - protein, 56 aa, Heterodera glycines
  Coding regions on vcDNA: vcDNA=SeqID_63958; Strand=-; Position=1 -73,222-316
MNVNYIEKRIYNYCRNQPLSNTPAAYPIEKEEQKEEEREDEKGEEKDEGKEEEKEK

SEQ ID NO: 137536 - protein, 84 aa, Heterodera glycines
  Coding regions on vcDNA: vcDNA=SeqID_63959; Strand=-; Position=1 -55,139-254,514-594
MASSIGSSDSFFRSTTDQTPAASAAEEVGKYEVFSWHGNLSDQLSAELFVTDQQLLKECREKLAKSELKETKLLWNNGELNAES

SEQ ID NO: 137537 - protein, 128 aa, Heterodera glycines
  Coding regions on vcDNA: vcDNA=SeqID_63960; Strand=-; Position=1-387
  Homolog annotation: Hit_ID=XP_550305.1; Match level="QueryCoverage =78%, HitCoverage=7%, E-value=1e-09, Identity=39%"; Hit description =helicase-like protein [Oryza sativa (japonica cultivar-group)] dbj|BAD68127.1| helicase-like protein [Oryz
MARQIGLGETGEHFWIPPKFLVKSKEELIDYVYPNFQQLLGNDNELLNRLILAPHIDTCDEVNEIMMANVPGQVREYLSTDKPLDDRPLDIDEIECEVAALNRRTDSGMPPHSLRLRVGCVVVLLIIK

SEQ ID NO: 137538 - protein, 91 aa, Heterodera glycines
  Coding regions on vcDNA: vcDNA=SeqID_63961; Strand=+; Position=1 -185,490-580
MVISSMMMSCASRIRRANKLSSGMLGSLSNDTSLPRRNVEWAVFPYGSKMTAHPVDAVASTFSAKSFLSKGSVLITIVVGAYNILSVILFS

SEQ ID NO: 137539 - protein, 18 aa, Heterodera glycines
  Coding regions on vcDNA: vcDNA=SeqID_63962; Strand=+; Position=1-56
YREAIPEGFGLTINLGAS

SEQ ID NO: 137540 - protein, 328 aa, Heterodera glycines
  Coding regions on vcDNA: vcDNA=SeqID_63963; Strand=-; Position=1-986
MPSKQRNLRKNEQERYQRRTEKSVSRDTSPVSVGSADGNGEASASLRGTTTPSLSALQISTPASSIGSKKRGRPLKAGAKPILATQETVSSIGTPRTAVTQSDQGSPCKKRGKVTECDKPTFANEAIASTPVSTQSRGGRPVKQLGGHAGKGRGKTNESMSKCSEMDQSVENALSPAPSHIVFEKIDFSSVQINFATSRNFACKIWKWAAIGLYERDGETPIAPRSGPRYIETCWNDMTQFLNDGFAATYLAYLATISQRKVVVVDPMVWSNGLDRVMPYKNMTFGYDPNVPAEVILLPVHFPGHWTLIVHDVQFGTHFADSLPTTYG

SEQ ID NO: 137541 - protein, 58 aa, Heterodera glycines
  Coding regions on vcDNA: vcDNA=SeqID_63964; Strand=-; Position=1 -165,369-380
MRVVQRHLMNISFFDRLQLGLKLALLSPRFNAFVDKHVDDESELTIWRAIEIRRKYWA

SEQ ID NO: 137542 - protein, 33 aa, Heterodera glycines
  Coding regions on vcDNA: vcDNA=SeqID_63965; Strand=-; Position=1 -30,95-166
MTRVNIWIYYKLEYLEKKLRKFLSLDRLPSALA

SEQ ID NO: 137543 - protein, 16 aa, Heterodera glycines
  Coding regions on vcDNA: vcDNA=SeqID_63966; Strand=-; Position=1-49
EAIPEGFGLPINLGAS

SEQ ID NO: 137544 - protein, 42 aa, Heterodera glycines
  Coding regions on vcDNA: vcDNA=SeqID_63967; Strand=-; Position=1 -61,299-366
MSAAQCHVILVRYTNLCYENEIYDEFRMKIRQIKGENRQIII

SEQ ID NO: 137545 - protein, 102 aa, Heterodera glycines
  Coding regions on vcDNA: vcDNA=SeqID_63968; Strand=+; Position=1 -14,71-365
MNCRCWICNDVWMDILPSFDHAQLGLKMALLSPRFDALVDKHFDGKSELTIWRPITICKDAVAAVPNLAVLIDQGNSDNFVPFPLPNHSLPNKIRFNNLWIE

SEQ ID NO: 137546 - protein, 55 aa, Heterodera glycines
  Coding regions on vcDNA: vcDNA=SeqID_63969; Strand=-; Position=1-166
MSVPISLFSFHTASKRNQSQQNERAIGLEAALDQLTVGQMTTEKHAVEAAKKLDY

SEQ ID NO: 137547 - protein, 18 aa, Heterodera glycines
  Coding regions on vcDNA: vcDNA=SeqID_63970; Strand=+; Position=1-56
PYRDRDLSFSKPGTGNRD

SEQ ID NO: 137548 - protein, 66 aa, Heterodera glycines
  Coding regions on vcDNA: vcDNA=SeqID_63971; Strand=+; Position=1 -75,200-293,350-381
MFCVRRPRRRPQCSDPILRSYRRGKEHVVLELGSPMAIRDNDEDGANKEIIDQELEVTLEGNEKEC

SEQ ID NO: 137549 - protein, 28 aa, Heterodera glycines
  Coding regions on vcDNA: vcDNA=SeqID_63972; Strand=+; Position=1-231
NFLKYKPKLFGLFKKELKIFKIFIHLPF

SEQ ID NO: 137550 - protein, 73 aa, Heterodera glycines
  Coding regions on vcDNA: vcDNA=SeqID_63973; Strand=+; Position=1-222
MTFQSLELNSPAFQSPGLNPPAFQSLGLNPPAIQSLGLNSQAFQSLGLKSPAFQTLGLNPPTFQSLGLNPTAF

SEQ ID NO: 137551 - protein, 89 aa, Heterodera glycines
  Coding regions on vcDNA: vcDNA=SeqID_63974; Strand=+; Position=1 -160,389-498
MPNQIFSPGFLTILELGEMSLDQELQRGKPKKSKNQLITMVKDIVSTLDVLHKVAMHLDFKPLNLLLFKKLSLFSSTDVSIKLTDFDGN

SEQ ID NO: 137552 - protein, 26 aa, Heterodera glycines
  Coding regions on vcDNA: vcDNA=SeqID_63975; Strand=+; Position=1-89
HTGASRPFFSLLGRFAALDGRLAPVI

SEQ ID NO: 137553 - protein, 75 aa, Heterodera glycines
  Coding regions on vcDNA: vcDNA=SeqID_63976; Strand=+; Position=1 -118,169-238,292-329
  Homolog annotation: Hit_ID=NP_780528.1; Match level="QueryCoverage =98%, HitCoverage=14%, E-value=4e-19, Identity=60%"; Hit description =RIKEN cDNA C330005M16 [Mus musculus] dbj|BAC33559.1| unnamed protein product [Mus musculus]
FDLGPAHFIAFSTEFYFWPNYYRFESLAAQWHWLIRDLEKANLNRHQVPWIITMGHRPMYCSDFSGDDCTRYDSI

SEQ ID NO: 137554 - protein, 121 aa, Heterodera glycines
  Coding regions on vcDNA: vcDNA=SeqID_63977; Strand=-; Position=1-368
FIINYAGRLRNNGTRTRPLFRSEEWSVYERTMNGTDRTNNFAEAYHRTLQHAIGHGHPPIWKFINILRERQKIIDVDFEHFLAGNAPPQKAKRYREADRRILRILERYNREKAQPQINDDH

SEQ ID NO: 137555 - protein, 76 aa, Heterodera glycines
  Coding regions on vcDNA: vcDNA=SeqID_63978; Strand=+; Position=1 -65,118-205,268-345
MNLLNGMPSPWKFHLEAKWTTIEPSDCQLMDDPMVEDKRAPFLGRILQFCEENKRKYCSTTLCSTLCDFVLSAAKQ

SEQ ID NO: 137556 - protein, 201 aa, Heterodera glycines
  Coding regions on vcDNA: vcDNA=SeqID_63979; Strand=+; Position=1 -115,445-542,632-746,793-900,1437-1606
  Homolog annotation: Hit_ID=NP_741623.1; Match level="QueryCoverage =62%, HitCoverage=47%, E-value=8e-18, Identity=66%"; Hit description =amiloride-sensitive channel like (5L55) [Caenorhabditis elegans] emb|CAD44144.1| Hypothetical protein T21
MYKCQSWQGTTRKNDRTRRVFGIAMGIGNDDGDVQFGDAKFHATLPEDELRRRRSDQNPNNDHLAFANATLPVFDMDNSKPITDQGQFFMLVLKHNADKLNGQQVDCMSVDFHGRPSSTTRFMGSKGITKDGFTDEVVTVDGNSKKLTTVVLNWGSFEYLTLEQDWVWSVTTFISAIGGSIGMWLGLSILSLIQAILDCHC

SEQ ID NO: 137557 - protein, 19 aa, Heterodera glycines
  Coding regions on vcDNA: vcDNA=SeqID_63980; Strand=-; Position=1-58
LLIVKEEHPEEEATEGVSK

SEQ ID NO: 137558 - protein, 103 aa, Heterodera glycines
  Coding regions on vcDNA: vcDNA=SeqID_63981; Strand=-; Position=1 -109,278-392,456-543
MEPFIVRISYAGNLRPYELAEYETISMLKVRVAVFEDDLSRAAVINSPRPKPSFCASNPFSGLIVRRSASMGDARIRQMTAHNRNTENGQNEKDEMAGKKFKN

SEQ ID NO: 137559 - protein, 128 aa, Heterodera glycines
  Coding regions on vcDNA: vcDNA=SeqID_63982; Strand=-; Position=1-387
  Homolog annotation: Hit_ID=Q03400; Match level="QueryCoverage=76%, HitCoverage=78%, E-value=1e-10, Identity=42%"; Hit description=S -antigen protein precursor pir||A48459 S antigen, heat stable - malaria parasite (Plasmodium falciparum) gb|A
MAHRTPLLFAAAALGAGVAGFTAWWLWTRRDVAGGGGPNFGGDEVPNGGGDEVPNGGGVEVPNGGGDEVTNGGGVEVPNGGGDEVTNGGGVEVPDGGGGGANIGWANEEEEEGGPPHPLQNPLPDQQN

SEQ ID NO: 137560 - protein, 81 aa, Heterodera glycines
  Coding regions on vcDNA: vcDNA=SeqID_63983; Strand=-; Position=1 -108,229-366
MKKKGEREMDRDGESGEEKEIEKYQLTHLYLKIIMIRDFKKRNIKWSNKKRQTHKQKNDWELIVLRKFVVAIHPIQRKMHF

SEQ ID NO: 137561 - protein, 26 aa, Heterodera glycines
  Coding regions on vcDNA: vcDNA=SeqID_63984; Strand=-; Position=1-78
MSSLSLFLSLSLSLWSLVCLLLSLVS

SEQ ID NO: 137562 - protein, 227 aa, Heterodera glycines
  Coding regions on vcDNA: vcDNA=SeqID_63985; Strand=-; Position=1 -42,99-183,249-349,399-485,584-644,684-780
  Homolog annotation: Hit_ID=NP_493344.1; Match level="QueryCoverage =84%, HitCoverage=19%, E-value=6e-47, Identity=52%"; Hit description =guanylyl cyclase (85.3 kD) (gcy-35) [Caenorhabditis elegans] pir||T24458 hypothetical protein T04D3.4 - C
IVTFTNICSFCTPYDVIKLLNDLYQRFDRIVGDVIKLLNDLYQRFDRIVGLHDVYKVETIGDAYMIVGDAYMIVGGVPKESQNHAEKILNVAIGFLMESRFVTNPTNELAISIRIGVHSVTNPTNELAISIRIGVHSGPVVAGVVGVKVVRYCLFGDTIHLANRMESLGMPSKIHVSKTAKALAIRNNPSFMESLGMPSKIHVSKTAKALAIRNNPSFLFTERGAIK

SEQ ID NO: 137563 - protein, 18 aa, Heterodera glycines
  Coding regions on vcDNA: vcDNA=SeqID_63986; Strand=-; Position=1-59
IVDFSVFFIRLIYNKMYF

SEQ ID NO: 137564 - protein, 29 aa, Heterodera glycines
  Coding regions on vcDNA: vcDNA=SeqID_63987; Strand=-; Position=1 -43,100-144
MVDKNLFTKEQQAKDAKRPQPLAGPQFVS

SEQ ID NO: 137565 - protein, 118 aa, Heterodera glycines
  Coding regions on vcDNA: vcDNA=SeqID_63988; Strand=-; Position=1 -69,751-871,1091-1182,1228-1302
MSESLQGILEIFRGKPTKMEKKKTNIGKTVTENEEGEKREDEARKKAVDQYKKEMSPADRKLLSTREASHSAIARASGAYVPTYLRMNGDCTGAAWRRPIPRCKTVKELKMDVVIGQN

SEQ ID NO: 137566 - protein, 81 aa, Heterodera glycines
  Coding regions on vcDNA: vcDNA=SeqID_63989; Strand=+; Position=1 -49,140-217,485-551,607-656
  Homolog annotation: Hit_ID=NP_495993.1; Match level="QueryCoverage =96%, HitCoverage=24%, E-value=1e-18, Identity=48%"; Hit description =grey-lethal osteopetrosis like (2J643) [Caenorhabditis elegans] pir||T22084 hypothetical protein F42A8.3
ANTTSLDNRTCTTVIYNSYRISYAQKMNSALSESIWEASNCHDCLRIDWNFEHGNSTFEFDNKTVQFKNYLWQWRNCVVQQ

SEQ ID NO: 137567 - protein, 95 aa, Heterodera glycines
  Coding regions on vcDNA: vcDNA=SeqID_63990; Strand=-; Position=1 -36,145-396
MAFIYEHGGEKKMDLEKDSAEARKEEPGLFRILLGGKPDNPSDPAANRRVPISARFLTGEPKWRYFVLPLLFGAFVFAIRPWQWQRPGGRKSEGK

SEQ ID NO: 137568 - protein, 102 aa, Heterodera glycines
  Coding regions on vcDNA: vcDNA=SeqID_63991; Strand=-; Position=1 -229,493-572
MDEQLKRSKENADKYRHRAMKLDERLRRKTEKIEEQKTQIEEAINAKRMAEDELSKVKAENALIKQQQEQVDTNWSKCKQSPTCSWCRSNNNISICSGFGPS

SEQ ID NO: 137569 - protein, 40 aa, Heterodera glycines
  Coding regions on vcDNA: vcDNA=SeqID_63992; Strand=+; Position=1-120
MLSSFPLLLSLVGLIAVHAEVFFKEEFSDDSWTDRWVTSK

SEQ ID NO: 137570 - protein, 21 aa, Heterodera glycines
  Coding regions on vcDNA: vcDNA=SeqID_63993; Strand=+; Position=1 -33,78-110
MFLLAYLFTGEIYNSATKDIK

SEQ ID NO: 137571 - protein, 155 aa, Heterodera glycines
  Coding regions on vcDNA: vcDNA=SeqID_63994; Strand=-; Position=16-483
MVLVIEFCAQILGCSPKSLRDKLNHPEDRVKALKELVGKKVRTTYQDRNEIQKTFFVDGISDHGAALTPAYGRLRQPYNINIAAHFYARHRIKLHLPYVPCIVEKYSGCGEDRYYPMELLEIVDDDYTNKERWLGKLFTEIEDDFIPVKRLGRVD

SEQ ID NO: 137572 - protein, 90 aa, Heterodera glycines
  Coding regions on vcDNA: vcDNA=SeqID_63995; Strand=+; Position=1 -112,158-318
MKLPEEQQVKAKKPNVDERFLWKITRGQFVLAIRLCSEDWKHLFHNKDKACRLEDGRVAIGLEMCEECARIIACVSDMIADPKQSQKPPK

SEQ ID NO: 137573 - protein, 144 aa, Heterodera glycines
  Coding regions on vcDNA: vcDNA=SeqID_63996; Strand=+; Position=1 -48,474-564,850-1145
MIGLASLEEADQMRRQIHLRLPELVGGEKQRVNELMEMLSIRSSGNDMLGLVQFFYTNVLLSSVNSVANEAKWQNEIAQMNAFALIHRIDAFHWRNGRIANDWAEVRKAVGTLVDELGTEQTGKLTSQVKEEAGDNLEEKIKAN

SEQ ID NO: 137574 - protein, 24 aa, Heterodera glycines
  Coding regions on vcDNA: vcDNA=SeqID_63997; Strand=-; Position=1 -32,77-119
MPFILGFYAFQRHKVNDANQNLIN

SEQ ID NO: 137575 - protein, 311 aa, Heterodera glycines
  Coding regions on vcDNA: vcDNA=SeqID_63998; Strand=+; Position=1 -357,1196-1296,2185-2664
SDAEHLALAYEQLLSNKSYRFSNQAEFADRINSMPIAVAAPLWLFSAFVDDLLVYLEANFKMDEYYDMPMAKDTVMNELWTAWGRLQLLQATAQGGEREREKVKLCQVYCFLGTTVAHYWAIRKSWPHIGDTASFAIILDNIHWKDFEATTLLKNLNLNSQNGAAPLKGPICTESVADRLFAELTNAQNFGFLHTHAIFTLIKRRTNGILAFLCSKKKLNEIMEVKERIQMLTRSVDKLDWLEMAFPDILHIGKRKEAGSTDAFVAEISLGRNVIDITHIGMINDSRTHLLSTIDINAFFWQGWHWHYFMT

SEQ ID NO: 137576 - protein, 319 aa, Heterodera glycines
  Coding regions on vcDNA: vcDNA=SeqID_63999; Strand=+; Position=1 -445,809-1323
  Homolog annotation: Hit_ID=NP_586080.1; Match level="QueryCoverage =52%, HitCoverage=17%, E-value=7e-09, Identity=28%"; Hit description =similarity to ribosomal protein L5 [Encephalitozoon cuniculi] emb|CAD25684.1| similarity to ribosomal pro
MAADITVFVRLIEAVPRGAKFDKIWKEKKENQIIDLYDSFFEMDYSNEYRTQMHFTWKLFDAVRSELADLGFLINEKKLRQKWDGMEKRAQRDAADQTASDDGTVPTAPILVAKLHAQTLQKLAFENAETAKRKTAEMAKHFREKLKTELSESTGARHQLLLFLELSDIKVLLEQLGIEFTEKEFEDDPMEEEGQKSTSDQQQTEKRKKKKKNRKKGGMKKKADKAGETVQNGESAEKPCDQSGRENVQIEEKAAEKLENGRESVQNEENRKNSPAENGEKRVKNEESAEKTEQIICDLQRKTIERADSHPPIIRQDRE

SEQ ID NO: 137577 - protein, 86 aa, Heterodera glycines
  Coding regions on vcDNA: vcDNA=SeqID_64000; Strand=-; Position=1 -93,232-399
MSCLRVVMMGKIVPLEMVEQAFFNMPEDYSLAVQLFFFQELTIRRLSLVLQIQFISFYPDSMCISLSMLTNSFLSPLVPQKIDVPP

SEQ ID NO: 137578 - protein, 26 aa, Heterodera glycines
  Coding regions on vcDNA: vcDNA=SeqID_64001; Strand=-; Position=1-80
MNTKHNKTETLSLSLSLSLLLCAFLS

SEQ ID NO: 137579 - protein, 233 aa, Heterodera glycines
  Coding regions on vcDNA: vcDNA=SeqID_64002; Strand=+; Position=1 -234,1436-1648,1902-2156
  Homolog annotation: Hit_ID=AAO51818.1; Match level="QueryCoverage =82%, HitCoverage=12%, E-value=5e-20, Identity=36%"; Hit description =similar to Kaposi's sarcoma-associated herpesvirus (KSHV) (Human herpesvirus 8). ORF73 homolog [Dictyostel
MSQHPHQGDLWIKKGIWKFENPKLDSLSVYGTSAGAGGYPPQQQQQQPQQQQAVDQQQQQFLGAASVAAAAAAQQMSNQQNQQYHHQQQQQHIQQPRQVAVVQPQQQQQQQHQQLQQLHQRTIGGATGVGTSTVAIGGSPFMASAVQQNVVHQSAFGVAQQHPQQQQQQPQQHVKQVHQQQQLISQSHVQLQQSPQKQHEKWDPLKEFGLHKDEVALKSPPSNVCSVVPIANS

SEQ ID NO: 137580 - protein, 43 aa, Heterodera glycines
  Coding regions on vcDNA: vcDNA=SeqID_64003; Strand=+; Position=1 -98,223-256
MQQANQVLANTDESLADYLSTLLSDTTDELRKMSILNKKKCRY

SEQ ID NO: 137581 - protein, 32 aa, Heterodera glycines; identical to SEQ ID NO: 125422
  Coding regions on vcDNA: vcDNA=SeqID_64004; Strand=+; Position=1-100

SEQ ID NO: 137582 - protein, 173 aa, Heterodera glycines
  Coding regions on vcDNA: vcDNA=SeqID_64005; Strand=-; Position=1 -83,130-273,331-623
  Homolog annotation: Hit_ID=CAE65129.1; Match level="QueryCoverage =94%, HitCoverage=20%, E-value=4e-38, Identity=45%"; Hit description =Hypothetical protein CBG09994 [Caenorhabditis briggsae]
MDAQPVINKISDDEGRRTEDAFTRFIKSFETDGGNVYIQQIDELRGPERNTLEVEFAHISAYSAVLAATIELQFYRLYPFLCHAICELVVERCDAADQHEHLRRKQYYLAIVGVKTRHQVRHLTSDKIGKLIRISGQVVRTHQVHPELALGTFVCEDCGVVTRDVPQHFKYTP

SEQ ID NO: 137583 - protein, 26 aa, Heterodera glycines
  Coding regions on vcDNA: vcDNA=SeqID_64006; Strand=+; Position=1-80
YYYEPPNLAKIGLFIRIKEDSVDCLE

SEQ ID NO: 137584 - protein, 35 aa, Heterodera glycines
  Coding regions on vcDNA: vcDNA=SeqID_64007; Strand=-; Position=1-106
GEENIPENAEELEEHNAKVKRDNRQIDNLDEGPKL

SEQ ID NO: 137585 - protein, 51 aa, Heterodera glycines; identical to SEQ ID NO: 126696
  Coding regions on vcDNA: vcDNA=SeqID_64008; Strand=-; Position=1-638

SEQ ID NO: 137586 - protein, 62 aa, Heterodera glycines
  Coding regions on vcDNA: vcDNA=SeqID_64009; Strand=-; Position=1 -145,512-555
MDGKYGIYLLYTVAGHFDHQNTTVGTMFSRCAILSFFLPSIVQEELSSSLSDDIKYIQFGQL

SEQ ID NO: 137587 - protein, 159 aa, Heterodera glycines
  Coding regions on vcDNA: vcDNA=SeqID_64010; Strand=+; Position=1-480
  Homolog annotation: Hit_ID=DAA04499.1; Match level="QueryCoverage =96%, HitCoverage=11%, E-value=8e-41, Identity=51%"; Hit description =TPA: pol polyprotein [Schistosoma mansoni]
MRHVPYAYREKIAAMLQDYLGRGVIQSSISPWASPIVLVPKRDGTLRFCVDYRAVNSVTRKDSFPLPNIDNILLMLGGKKFFSTLDFMSGYWQIKMEDNSVEITAFTTEYGLYEFKVMPFGLTNAVATFQRFMTRLFEGMINDFVFIYMDDIVILFRIV

SEQ ID NO: 137588 - protein, 163 aa, Heterodera glycines
  Coding regions on vcDNA: vcDNA=SeqID_64011; Strand=+; Position=1 -339,392-544
MILILLRVNINYTTCFIILEILTKLLNENRLNYEQKLSINEMILQLAIDTANNYKTNETLDKIIQPKFEEYLEEMFKKAEESAKKERPWNANKINYDKHLIILYTKFDDHLIWILNFRNFVKGLATNLEKLFKMAKEYSNYYRQMKEKGFMASYGLYEIEKMK

SEQ ID NO: 137589 - protein, 349 aa, Heterodera glycines
  Coding regions on vcDNA: vcDNA=SeqID_64012; Strand=-; Position=1 -826,946-1167
  Homolog annotation: Hit_ID=NP_498959.1; Match level="QueryCoverage =99%, HitCoverage=17%, E-value=2e-17, Identity=24%"; Hit description =zn-finger, CCHC type and RNA-directed DNA polymerase  and Integrase, catalytic domain containing protein
MKQQLDSTDAKSTCAFDELMAGVRRCGNAEKNGSAVGKIMLVKVSILEQKADAMLDGGAQISLISVEFFNKILNSSTLNKEFLKPDRQIARVIDINGKEVKCYGVVTLPVKRQERTVQVRLHVAQTSFGYDLLFGTNSLSELGFKIFYELSKTMVDFKQNVNTQNSVHVIFKTTLMPLATTLVEMTSSTKKDKELAIFPSNDRKKVMRIEPAVVNPNNGKFIAPITNFSALPITLEKDEIVGQFEHFANPRELNDSMLFTLTGKNDEDQNSSKSKNIFAVSDWELTQTNLVQHAIDTKDAEPIRSQMRPIPYAYRGKVTEMVQDYMGRGLIRPSSSPWASPIVLVPKRD

SEQ ID NO: 137590 - protein, 224 aa, Heterodera glycines
  misc_feature (12)..(12): Xaa can be any naturally occurring amino acid
  misc_feature (174)..(174): Xaa can be any naturally occurring amino acid
  misc_feature (212)..(212): Xaa can be any naturally occurring amino acid
  Coding regions on vcDNA: vcDNA=SeqID_64013; Strand=+; Position=1 -322,865-965,1041-1101,1333-1486
  Homolog annotation: Hit_ID=EAL38489.1; Match level="QueryCoverage =79%, HitCoverage=79%, E-value=2e-38, Identity=44%"; Hit description =ENSANGP00000027014 [Anopheles gambiae str. PEST]
FPYNLTELLICXLIILNKSINFIFHGRLSISKAFAADNIVPDVVSQAPERLVTVEYDGGVYAELGNELAPKKLAKAPNLSWDAEECKKYTVAMVDPDAPSREHPKNREWLHWLVVNVPGTDVAQGEQLIDYMGPAPPKGTGLHRYVFLVYAQKLHRYVFLVYAQKEEAVVNAIXLAPHFPGRSHFNIREFAKEIYVGPPLAGNFFNAKYHGXIRPNLSGNERTM

SEQ ID NO: 137591 - protein, 246 aa, Heterodera glycines
  misc_feature (6)..(6): Xaa can be any naturally occurring amino acid
  Coding regions on vcDNA: vcDNA=SeqID_64014; Strand=-; Position=1 -269,325-434,629-715,758-805,858-979
  Homolog annotation: Hit_ID=NP_509899.2; Match level="QueryCoverage =99%, HitCoverage=50%, E-value=2e-76, Identity=57%"; Hit description =organic cation transporter family member (46.6 kD) (XL967) [Caenorhabditis elegans] gb|AAG28557.1| organi
CDHGFXSAHVHLSYSLGYLVGCLMGGFISDRYGRKPAIYGFSILSTIFGFLLSFSREFEVFLVVRFLLAACNEAADLAAYVYCMEITGMQYRSVVGMQYRSVVGSLLQAPWACGYAFLALVAYIWRSWTSIQLITTVFHLLALFLIHHLPESPRWLIATNRDLQAEKIIRKACHFNKNRDLQAEKIIRKACHFNKSSLPSDLELVRSSLPSDLELVRHAEQRKWLKYNQRPHFIDSFKSPTMAFRK

SEQ ID NO: 137592 - protein, 22 aa, Heterodera glycines
  Coding regions on vcDNA: vcDNA=SeqID_64015; Strand=-; Position=1-66
MAISFFEKFSMQQTLSNMKRSA

SEQ ID NO: 137593 - protein, 29 aa, Heterodera glycines
  Coding regions on vcDNA: vcDNA=SeqID_64016; Strand=-; Position=1 -66,123-146
MAISFFEKFSMQQTLSNMKRSAKNGYLFF

SEQ ID NO: 137594 - protein, 29 aa, Heterodera glycines
  Coding regions on vcDNA: vcDNA=SeqID_64017; Strand=-; Position=1 -66,123-146
MAISFFEKFSMQQTLSNMKRSAKNGYLFF

SEQ ID NO: 137595 - protein, 29 aa, Heterodera glycines
  Coding regions on vcDNA: vcDNA=SeqID_64018; Strand=-; Position=1 -66,123-146
MAISFFEKFSMQQTLSNMKRSAKNGYLFF

SEQ ID NO: 137596 - protein, 138 aa, Heterodera glycines
  Coding regions on vcDNA: vcDNA=SeqID_64019; Strand=+; Position=1 -31,99-484
  Homolog annotation: Hit_ID=XP_146481.3; Match level="QueryCoverage =99%, HitCoverage=13%, E-value=5e-18, Identity=40%"; Hit description =PREDICTED: similar to carboxylesterase 2; carboxylesterase ML3; acylcarnitine hydrolase M1 [Mus musculus]
MIKKRLERKEEKNATKEELNEDGIMAQMKEMFKQMNLGNLNDLMGGMGEEEEEEMREGEEQLEEEEEEEKEEEKAAEKEGEGEEEKEEGEEEEKEQEKEEGEGQCSKSNEEGGQCMAKEGEENAEKSETKMKEDRDEL

SEQ ID NO: 137597 - protein, 16 aa, Heterodera glycines
  Coding regions on vcDNA: vcDNA=SeqID_64020; Strand=-; Position=1-49
EATPEGFGLPINLGAS

SEQ ID NO: 137598 - protein, 637 aa, Heterodera glycines
  misc_feature (2)..(2): Xaa can be any naturally occurring amino acid
  Coding regions on vcDNA: vcDNA=SeqID_64021; Strand=+; Position=1 -24,196-461,603-664,709-853,910-1037,1175-1421,1465-1701,1760 -2014,2307-2567,2679-2822
  Homolog annotation: Hit_ID=NP_492221.2; Match level="QueryCoverage =100%, HitCoverage=14%, E-value=1e-118, Identity=35%"; Hit description=abnormal CHEmotaxis CHE-3, altered AVeRmectin sensitivity AVR-1, OSMotic avoidance abnormal OSM-2, abno
GXRERREEAHSLCTLAEQIVQLLGRRGVRESVFSAIDAALRNAMPFGGTGEQWAERHGAAERALDPFIEEIMPTLRARLQFQPNVSRELVSNLHRYRHFLARKQVKEKLQSEREVLITHLAEQIREVLITHLAEQIRAQRREIERMSAMAVPTGKFLTEIAAKIAWIRSNSTQIDKLIDKLSKASAKFFDDLPMFSSFSQSLRTLAEELKAAEQEQFDAWCRDMLAHVDDRGDSISLQTTGRLMVLERDRGVLNVSYSDRLARLLREVAQLQAMGLRIPTKISQCVRQGEKFYQYGVLLKQVAHFYNTIEQQMLPCQQAMVAHFYNTIEQQMLPCQQAMLLDEALTFERLVLPAGGQREGRGAAAVSITWENPEKLKQYIDKLREAAFNLTSHNRRLRKHAEIGQIVAELADTDLLREEHAEIGQIVAELADTDLLREEEKWTAKLMEVRQIFVEEEAFVAVKTNMQPWANHWNRQLYKVLQLQFRWAMENVDNQMPTLNAQLVFRDQRLQLRPPLEELRLQYYRALRKLLSTPQRLRGVQNNARETELFGRIVARNTRHFQKLYERSEEMFERLRTADREFDEWVALAQVNLEDLLEQKLRNASDEHQLNLLKQKQRSVDKIPNEIRIECVRLSTA

SEQ ID NO: 137599 - protein, 96 aa, Heterodera glycines
  Coding regions on vcDNA: vcDNA=SeqID_64022; Strand=+; Position=1-288
VRTQRVQQWSAVEESAIKDVVVRNTDDRGLINWAKGVLPEWQRLCQLNPTMYMSRSSPSLSNKWASMRRSHVGPGCPSKEGSGPSQDLSDVKIQPA

SEQ ID NO: 137600 - protein, 36 aa, Heterodera glycines
  Coding regions on vcDNA: vcDNA=SeqID_64023; Strand=+; Position=1-109
MSAVQFKQSFDKVCATTANAFRFSLQWCFVPLVVIL

SEQ ID NO: 137601 - protein, 273 aa, Heterodera glycines
  Coding regions on vcDNA: vcDNA=SeqID_64024; Strand=+; Position=1 -111,160-203,261-289,337-462,519-757,817-856,906-1009
  Homolog annotation: Hit_ID=XP_397369.1; Match level="QueryCoverage =89%, HitCoverage=41%, E-value=9e-57, Identity=48%"; Hit description =similar to hypothetical protein FLJ13946 [Apis mellifera]
LSVESNLADSFSKLQYLLGNNPFPPETFANLLLLYCKFEYFFEYFDLAADVLAENAHLTYKLLNQHLTYKLLNQFQFDYLFQFDYLDALITQQSSESEAYAKFDALAMDRLNELRKKHQKLQELREEELREEDNGRALQCAVDSVEETIDEFLPALMAQAKLLWDKAQWAQIEQLFRHSAEFCHANETWKLNLAHTLFMQEKYKEASDCYADCYAPLVHASFDRLLDVSAVVLANLCACLLDVSAVVLANLCACYIFHKSASPFFFAFFTFSI

SEQ ID NO: 137602 - protein, 162 aa, Heterodera glycines
  Coding regions on vcDNA: vcDNA=SeqID_64025; Strand=+; Position=1 -88,497-711,1046-1231
SSSTDAILEYKKSLEPPRIEINGTIENYATTTTVSEDKALIAERAPALKFFQRANGSKFAHSLDRYNTVKKKGNLISDQSLKNAIEQILTNAIMLNIYQWKMFVPKCVRCHCAVPPRVPCRRCCTSNGACSASAAARAVAHIAHAEVPAAWPALGKRTYSAG

SEQ ID NO: 137603 - protein, 21 aa, Heterodera glycines
  Coding regions on vcDNA: vcDNA=SeqID_64026; Strand=+; Position=1-65
MGFFLLDFCPENRRYGHGFFK

SEQ ID NO: 137604 - protein, 137 aa, Heterodera glycines
  Coding regions on vcDNA: vcDNA=SeqID_64027; Strand=-; Position=1 -170,414-657
NIVEIKRTDFERNGSFPYHLCKIVNLAAKASYKCGNIGRLKDLVVALTAYKPSSSSREILGDSMIREMMANVLRGFKCLVDKQIKAQYGHDIQHLGKLIEHMEAVIGKLKRSSKENKFNQKMINLFVQGWTLSKGTY

SEQ ID NO: 137605 - protein, 40 aa, Heterodera glycines
  Coding regions on vcDNA: vcDNA=SeqID_64028; Strand=+; Position=1-6,36- 152
MNGWRQLKFGCAWDIEAQKCMPNEETVKALARGEKAKQRK

SEQ ID NO: 137606 - protein, 319 aa, Heterodera glycines
  Coding regions on vcDNA: vcDNA=SeqID_64029; Strand=+; Position=1 -203,250-670,721-1010,1063-1108
MISHRFDFYVDEHFKTRKWTLAFIGIQSKNGENGTKEMEIVNFGHKALPIPQIQMPRKVIGFQWINISFIDQNAIAFLRHFRPLFTACPINLTIITHNARTLEFILPNIWPLFGKNIHGMDLSATFFRHLRKFAPSILNDCPSLRFVNAYYYGFFTGFPADDSAAASDGQALAKWLFTPLQSNVPKMLECGLDMGDGNWSSNIEQFKAAFANASSPVNFIVVMCFIPTSFADSVVPFDLTNELTREQLALKGTNFNNCFLLIRSPIARDANKWAEWEKEAIGWKFIDQCNKIEIQIYDEEQIGDGLLDANPGPSDQQQK

SEQ ID NO: 137607 - protein, 45 aa, Heterodera glycines; identical to SEQ ID NO: 124527
  Coding regions on vcDNA: vcDNA=SeqID_64030; Strand=+; Position=1-138

SEQ ID NO: 137608 - protein, 101 aa, Heterodera glycines
  Coding regions on vcDNA: vcDNA=SeqID_64031; Strand=+; Position=1-306
MEVKYGNVDKNLKYGKLKTINIRMIPILKITDEQKSYGHSHLKLYETPLYELLSTHFWCHVKEWMDDKMMKMTEKRDEAEGKGGQRKEKGRRIIASGTFPW

SEQ ID NO: 137609 - protein, 80 aa, Heterodera glycines
  Coding regions on vcDNA: vcDNA=SeqID_64032; Strand=+; Position=1 -32,102-312
MNYDLFTFCPIYHPLLNRKAKASLAIIKKFVTNSSAVSPHEGMAQPLDNDGRPFSERIRQEKQDKEAYFKQLASAWGDKA

SEQ ID NO: 137610 - protein, 51 aa, Heterodera glycines
  Coding regions on vcDNA: vcDNA=SeqID_64033; Strand=+; Position=1 -67,584-672
MLIVSSFEFRMLLARNTKLLSTGKLKIHTYAEKLKYVKRSEEMKLRKSNDE

SEQ ID NO: 137611 - protein, 70 aa, Heterodera glycines
  Coding regions on vcDNA: vcDNA=SeqID_64034; Strand=+; Position=1 -78,222-356
MARRILNPDFSYGFRRRIFLVFAGTGIIQMDFATGPTKKFCEVCRSWIDLFEDKIQVEKLMSKPECFELK

SEQ ID NO: 137612 - protein, 51 aa, Heterodera glycines
  Coding regions on vcDNA: vcDNA=SeqID_64035; Strand=-; Position=1 -57,423-521
MAARDLQCVQCQQFMHNWGREGNWRGQLITLLGNYGVENGRNADGVLLRHF

SEQ ID NO: 137613 - protein, 94 aa, Heterodera glycines
  Coding regions on vcDNA: vcDNA=SeqID_64036; Strand=-; Position=1 -96,135-248,293-367
MPKQNEIVLKYSFLDLTWFLDIEAVFCAISKTKKCLVVKTIFHISLHNFVSSARIETGIRPLERAARALQKSELILQCGPNFRPPATAPCFSQF

SEQ ID NO: 137614 - protein, 272 aa, Heterodera glycines
  Coding regions on vcDNA: vcDNA=SeqID_64037; Strand=-; Position=1-817
  Homolog annotation: Hit_ID=XP_345024.1; Match level="QueryCoverage =85%, HitCoverage=88%, E-value=2e-20, Identity=29%"; Hit description =similar to SPAC23A1.17 [Rattus norvegicus]
ISITGTQPNSISITGTQPTSISITGTQSTNISITGTQPNSIPITGTKPTSISITGTQPTSISITGTQFSAFQSLGLNPPAFQSLGLNPPAFQSLGLNPPAFQSLGLNPPAFQSLGLNPTAFQSLGLSPPAFQSLGLNPTAFQSLGLNSAFQSLVLNPPAFQSLVLNPPAFQSLVLNPPTFQSLVLNPTALQSLVLNPTALQSLVLNSPAFQSLGLNPPSLQSLVLNPPALQSLVLNPPSLQSLVLKPPSLQSLVLNPSSLQSLLLTPAFQSL

SEQ ID NO: 137615 - protein, 16 aa, Heterodera glycines
  Coding regions on vcDNA: vcDNA=SeqID_64038; Strand=+; Position=1-48
MMTLLFVKPTLVMVEN

SEQ ID NO: 137616 - protein, 91 aa, Heterodera glycines
  Coding regions on vcDNA: vcDNA=SeqID_64039; Strand=-; Position=1 -141,209-343
MGFLRSLITNRTFILTNFESRTRIRTKSRKFKIFKIHFYDCTGNHLNLRPHEWLCVRENATPEEINENYRKFVRVVHPDKNNQCSDKLFMV

SEQ ID NO: 137617 - protein, 29 aa, Heterodera glycines
  Coding regions on vcDNA: vcDNA=SeqID_64040; Strand=+; Position=1-88
FKPIYSQNTFFFCCQNEHGTLFLLSHHLQ

SEQ ID NO: 137618 - protein, 214 aa, Heterodera glycines
  Coding regions on vcDNA: vcDNA=SeqID_64041; Strand=+; Position=1 -81,175-293,881-969,1412-1638,1758-1888
  Homolog annotation: Hit_ID=XP_326902.1; Match level="QueryCoverage =56%, HitCoverage=17%, E-value=4e-13, Identity=40%"; Hit description =hypothetical protein [Neurospora crassa] emb|CAE76135.1| related to B cell antigen receptor Ig beta assoc
MNDDQFSLEEEEGKEQQEDRKTPTKDVSDGHLKAILERIGELEKQQQQQTKGEGNLTKMKFLGFSLELWSNFQRWKMIRRTFWKKSVKWRSRQRKSWVIKIGFAVKQQTKLDETIQLEKGTFAYESDGDIWINGEGKGTNAQYSYGVGDTVGIGVNSATRQIIFTKNGLRLDTSDLVDPSFADGSFYPFVTLVTSGDQIEANFGPNFKFDLATL

SEQ ID NO: 137619 - protein, 63 aa, Heterodera glycines
  Coding regions on vcDNA: vcDNA=SeqID_64042; Strand=-; Position=1 -95,364-460
MATFNGEKRESVAKDEKKGKTKKEVQMTVAKGKFLGKGVTIYTFLTARFFQKLFGKKRVQRCR

SEQ ID NO: 137620 - protein, 78 aa, Heterodera glycines
  Coding regions on vcDNA: vcDNA=SeqID_64043; Strand=-; Position=1 -44,110-302
MFGGFCGIFVGPFKRKITLSPTVETRNPSLCNATNCLASAFFVETFVLMTTTIITAIIITTIALNDKHGCNGCKKEFR

SEQ ID NO: 137621 - protein, 59 aa, Heterodera glycines
  Coding regions on vcDNA: vcDNA=SeqID_64044; Strand=-; Position=1 -111,346-415
VPISARPFTIRPPLLRIRPPITLRPNRNVCQPSQYSSRVCRLDLAPIMQIMAFPGMMSK

SEQ ID NO: 137622 - protein, 95 aa, Heterodera glycines
  Coding regions on vcDNA: vcDNA=SeqID_64045; Strand=+; Position=1 -141,186-332
  Homolog annotation: Hit_ID=NP_740880.1; Match level="QueryCoverage =96%, HitCoverage=33%, E-value=6e-13, Identity=42%"; Hit description =quaking related 5 (33.2 kD) (1H379C) [Caenorhabditis elegans] gb|AAM81088.1| Hypothetical protein E02D9.1
EMLSSGDPQYAHYGGPLHVKVETTAPPAVAYQRVAGVLAVLAELLQPVKDTHIEGITTEPNPNLNALEGGGDSDGGGDSNGAEGNGEEAGGPSKA

SEQ ID NO: 137623 - protein, 65 aa, Heterodera glycines
  Coding regions on vcDNA: vcDNA=SeqID_64046; Strand=+; Position=1-212
KIFPYILVISFCFWWGAWNSGIMRTRPIWQVKQRLLTSQKVRCRDETNQHCLPRGTRHGPPKEWI

SEQ ID NO: 137624 - protein, 76 aa, Heterodera glycines
  Coding regions on vcDNA: vcDNA=SeqID_64047; Strand=-; Position=1 -32,105-303
MKMNKRILKKIWICNDILMDIFPHFDRAQLASKWHFFRLVSMFWWTNISMAKANCQFGDQSELKGWEQKQNYVSLN

SEQ ID NO: 137625 - protein, 122 aa, Heterodera glycines
  Coding regions on vcDNA: vcDNA=SeqID_64048; Strand=-; Position=1 -84,336-383,486-721
LIAKTATELTEIVTEKMDRIYVKLEQQQSLLSATIDEKMAKHEVSLLIATDQRIVHFLLLPFLLIAAVCLTLLLIKAIVDQFLKQKFEQNNDTTDGEEEKRTEEKEETEENGKGGEKGRRGE

SEQ ID NO: 137626 - protein, 80 aa, Heterodera glycines
  Coding regions on vcDNA: vcDNA=SeqID_64049; Strand=+; Position=1-243
MAQNNQIILQIVVVVVPIALDAEVLLALALAAARAAAEIVAVPLTECLTLADVELYATDDRGTIDSATLDKSKDYNRLNV

SEQ ID NO: 137627 - protein, 218 aa, Heterodera glycines
  Coding regions on vcDNA: vcDNA=SeqID_64050; Strand=+; Position=1 -63,146-250,755-994,1144-1281,1397-1507
MKKIDEIANNLRLRTKRAAFQSPKPRSADRKVRRQSVRRPPTNVRRQRAANISSKLQRPLPPLFHNDDEAQKAVVGKRLVTDNAAKSGTSAANPKRVKTTLDDLLMDVEMRAEQDGTQTTQQIASDQTDQQQQNYTLVNVCSTSTTKLCEVQDGVQTTQQIVGDKTDQQQQQQQNNMVIEKPVVHAVIDGDDEDSENVPSLISIGTQTWPKKKISCSF

SEQ ID NO: 137628 - protein, 306 aa, Heterodera glycines
  Coding regions on vcDNA: vcDNA=SeqID_64051; Strand=-; Position=1 -141,207-471,522-1036
MDSELSSKVQQQAQMCRFLRSHVSDLKNLSLNYSARLELLEKWAGNEQYSPYPSNTHSPVSPAVLHETLEIIQQQSRQHEQLANRVLEKGNTELAVVQVALSSLKRAMTPSLNTDQTSSSSSSVKRRRLMSEEQNEAASLAMAAFTHLQNHIAEKCQILQSRVQKLEDGGAERMEVQVDKMRREMEQNLRQEMMEREQRLDEKWSVLLLKEREKTQQIATQASEVIGNLLENGEKEGKENNQKGKKLIVSERCLWCLGNENMVTFGAKECLHVFSCPKCSIPIIASDEPKCLICFQNISELEYMKN

SEQ ID NO: 137629 - protein, 236 aa, Heterodera glycines
  Coding regions on vcDNA: vcDNA=SeqID_64052; Strand=+; Position=1-711
  Homolog annotation: Hit_ID=NP_996064.1; Match level="QueryCoverage =92%, HitCoverage=84%, E-value=2e-24, Identity=32%"; Hit description =CG33265-PA [Drosophila melanogaster] gb|AAS65018.1| CG33265-PA [Drosophila melanogaster]
MKISIIDLVFFGMLFAFLGNGASTFPLNSAVMEVEKDEADNSTTVEAEDNSTTADDVTEDADNSTTVEAEDNSTTADDVTEDADNSTTVEVVTEDADNSTTVEAVTEDADNSTTADDVTEDADSSTTLEDVTEDADNSTTVEAVTEDADNSTTAKDVTEDSDNSTTVETVTEDADNSTTAEDVTEDADNSTTAVLDCATENADNSTKEEIQEATMEAKTEDADNSTTVEIGNPDDE

SEQ ID NO: 137630 - protein, 253 aa, Heterodera glycines
  Coding regions on vcDNA: vcDNA=SeqID_64053; Strand=-; Position=1 -84,160-378,589-1047
  Homolog annotation: Hit_ID=AAG27458.1; Match level="QueryCoverage =96%, HitCoverage=41%, E-value=4e-14, Identity=22%"; Hit description =latent nuclear antigen [Human herpesvirus 8]
MASSGIDIPPPPPPPELAPPEEKKMMLQPDNTGTTDQENVQQQQSVEPSMPCLHVVSDETIIDADVPMEIDDEDDDDNDDDDEDGDGVNDDDADRPYSPSQFYAQAIPPPPPPLQLKTNNEETNSKDEYLDEEEEDEITEEECVEEKLDETKQKVVGHRQKKWTKVKREENESKKVEQQKLMMEEGKNGDEHGQEKEKEDEGQENEGAEEDKVEQQREQQRQNSPVPSEATRKADEEKGIQQVQNHHHHQYQQ

SEQ ID NO: 137631 - protein, 93 aa, Heterodera glycines
  Coding regions on vcDNA: vcDNA=SeqID_64054; Strand=-; Position=1 -227,924-978
  Homolog annotation: Hit_ID=CAE59922.1; Match level="QueryCoverage =73%, HitCoverage=7%, E-value=7e-14, Identity=47%"; Hit description =Hypothetical protein CBG03408 [Caenorhabditis briggsae]
MAFFNPIPSPSQDAVSKLLKCTALFPCEHSNRVPEGKSSHQLLLCGIFRGGIDVLCRVRLVMDPSDQTVSMNMVVRTRYPDPVRNLGPGPGKP

SEQ ID NO: 137632 - protein, 165 aa, Heterodera glycines
  Coding regions on vcDNA: vcDNA=SeqID_64055; Strand=-; Position=1 -110,605-744,985-1066,1103-1206
  Homolog annotation: Hit_ID=NP_501854.1; Match level="QueryCoverage =97%, HitCoverage=16%, E-value=3e-47, Identity=61%"; Hit description =coatomer protein (96.3 kD) (4K919) [Caenorhabditis elegans] emb|CAA93095.1| Hypothetical protein T14G10.5
CQAIERYMKQAIVDKTASVSSAALVSSLHLMRKSPEVVRRWANEVQEAVSAENHMVQFHALSLLVQIRANDRLAILKMVQKFSKSGLRSPLALCQLVRVAARLIAAEAEESRSAFTFIESCLRNKHEMVVSRSAFTFIESCLRNKHEMVVYEAASAIVRLPRISS

SEQ ID NO: 137633 - protein, 126 aa, Heterodera glycines
  Coding regions on vcDNA: vcDNA=SeqID_64056; Strand=-; Position=1 -78,828-1060,1702-1770
  Homolog annotation: Hit_ID=NP_501854.1; Match level="QueryCoverage =99%, HitCoverage=14%, E-value=3e-43, Identity=65%"; Hit description =coatomer protein (96.3 kD) (4K919) [Caenorhabditis elegans] emb|CAA93095.1| Hypothetical protein T14G10.5
RRDKKDDESAAGNPYDHLDKATVVQETRAFNETPVNARKCRPILCKLLYLLQHGETIGKTEATDTFFAITKLWQAKDMTLRMLVYLSIKELCQMSSDVIIVTSRLTLDMTGREDVYRAPAIRALCR

SEQ ID NO: 137634 - protein, 67 aa, Heterodera glycines
  Coding regions on vcDNA: vcDNA=SeqID_64057; Strand=+; Position=1 -89,147-261
MPNWGTIQWKDKKTDKLSKVNFMLDGDSIGPLSPPKTDQMNEKSQPEMNPGLSRQRKKVNELLRNEK

SEQ ID NO: 137635 - protein, 16 aa, Heterodera glycines
  Coding regions on vcDNA: vcDNA=SeqID_64058; Strand=-; Position=1-49
EAIPEGFGLPINLGAS

SEQ ID NO: 137636 - protein, 95 aa, Heterodera glycines
  Coding regions on vcDNA: vcDNA=SeqID_64059; Strand=+; Position=1-661
LFEYPKRTLEKIDFFVFGAVPPNRCAQIYGETESFGSSFPIACTLILRWIFAPHKCLSTPNGHLKKSIFLFSGQSPRTDAPRFMGRPNPSGIASL

SEQ ID NO: 137637 - protein, 158 aa, Heterodera glycines
  Coding regions on vcDNA: vcDNA=SeqID_64060; Strand=+; Position=1-475
  Homolog annotation: Hit_ID=XP_508093.1; Match level="QueryCoverage =100%, HitCoverage=24%, E-value=4e-36, Identity=46%"; Hit description= PREDICTED: carboxypeptidase X (M14 family), member 2 [Pan troglodytes]
DNHNNGGTDNHNNGGTDNHNNGGTDNHNNGGTDNHNNGGTDNHNNGGTDNHNNGGTDNHNNGGTDNHNNGGTDNHNNGGTDNHNNGGTDNHNNGGTDNHNNGGTDNHNNGGTDNLYNGGTDNHNNGGTDNHNNGGTDNHNNGGTDNHNNGGTDNHNNG

SEQ ID NO: 137638 - protein, 59 aa, Heterodera glycines
  Coding regions on vcDNA: vcDNA=SeqID_64061; Strand=-; Position=1 -76,143-243
MPTNNMFFIGLFSFFIMLLTIFDAHVRSDHVGTNVWQKDDPSADQMPIKKHQKHNERKQ

SEQ ID NO: 137639 - protein, 151 aa, Heterodera glycines
  misc_feature (26)..(26): Xaa can be any naturally occurring amino acid
  misc_feature (59)..(59): Xaa can be any naturally occurring amino acid
  Coding regions on vcDNA: vcDNA=SeqID_64062; Strand=+; Position=1-463
  Homolog annotation: Hit_ID=NP_671477.1; Match level="QueryCoverage =88%, HitCoverage=46%, E-value=2e-27, Identity=56%"; Hit description =rRNA promoter binding protein [Rattus norvegicus] gb|AAK21974.1| rRNA promoter binding protein [Rattus no
KSRLFHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 137640 - protein, 52 aa, Heterodera glycines
  Coding regions on vcDNA: vcDNA=SeqID_64063; Strand=+; Position=1 -81,301-378
MRKLEICSRSVPKNDITIFASNLQKIMHEIIQQMMNFSLFIKIITKNMHCPA

SEQ ID NO: 137641 - protein, 1444 aa, Heterodera glycines
  Coding regions on vcDNA: vcDNA=SeqID_64064; Strand=+; Position=1 -636,789-1416,2710-5559,6549-6770
  Homolog annotation: Hit_ID=EAL50744.1; Match level="QueryCoverage =29%, HitCoverage=45%, E-value=6e-10, Identity=24%"; Hit description =regulator of nonsense transcripts 1, putative [Entamoeba histolytica HM-1:IMSS]
KVDEFIQGGSVVIHPVPATAVEDRLFCFRCNVPSIIADEDSPRGRIMAVLLGRPAMEGIRMEKESVDDSTDSWMEEEGPLHPAILALNSRQRVTARLMLGGGLVQQQAPPGTGKTKVAAAIIKAMMDSNPGFRIVVMACANIPVAKLVQEAEGTCAEKDLDGARAIALFSGFARCKYTDQIKDVQRHTLPNKVNSEEFVKQLSPNVQKQVKERFALDESTQAQWAVVVHLVARMPKLKALLLTGDRHQLGVHLQELPDIFHSGYGLESVILQAEASVGTNYTFLTKMYRSHPFLAKLISYASYELHNEQLIPARSAEERSLITGSGFLMPVQECPVGLINAFSSFRVDPKSDSLTDDHQTEVASFLVQALLEHFGNAFSSRIIVLCMYTYQTSEIERKLKHCGVRALTVDAYQAQECDIPKHSNHEVSDQIDDNALTSDARSSSVESPAGTIYESFEALSIDSSKVASSPEGYTNVGAEIVIEGTESNENPEGSGYDEVRNEGSSVTFKAMEVTLDQVDAEGFANNGFDDEEPEACPPAKDVSKSSLLYLVSQAGDGYVIACKKSPKSKPNWPFFMNIEDKLIESAPGFQRKLEVGDFVAVSSFEWNQKLRYLAQHRQDATQSCKFWFNENTQLLPKQADDTGVVQLMYMNIGRKQITGVVYWIKRKIQSVPSSFVHANIACCGLAVSARINRRHLDGINPEDLKLGSLVTVVVANIPQDSLVSMGYILPDASPYKLGTERRAETPEFFGAIASVRPHLLEWPNLNANMTPKVYPCSAELTKHHVVAMEHVVGAALQIEMEREVDMMIEACFEGRARKFDGADCLIVFGSRSKKEVNELAKVWEPESQVKVFKELDEKHFALGVVKDVEVLHAEYEKLELHIVIFLNNIQERKNVDIARKVDEFIQGGSVVIHPVPATAVEDRLFCFRCNVPSIIADEDSPRGRIMAVLLGRPAMEGIRMEKQSVDDSTDSWMEEEGPLHPAILALNSRQRVTARLMLGGGLVQQQAPPGTGKTKVAAAIIKAMMDSNPGFRIVVMACANIPVAKLVQEAEGTCAGNDLDGARAIALFSGFARCKYTDQIKDVQRHTLPNKVNSEEFVKQLSPNVQKQVKEYLAHCEKNPRLAPERAIGKVFNSCMAPKIVFSTAAMAANLLHGEGNITDADVLLFDESTQAQWAVVVHLVARMPKLKALLLTGDRHQLGVHLQELPDIFHSGYGLESVILQAEASIGTNYTFLTKMYRSHPFLAKLISYASYELHNEQLIPARSAEERSLITGSDFLLPVQECPVGLINAFSSFRVDPKSDSLTDDHQTEVASFLVQALLEHFGNAFSSRIIVLCMYTYQTSEIERKLKHCGVRALTVDAYQAQECDIPKHSNHEVSDQIDDNALTSDARSSSVESPAGTIYESFEALSIDSSKVASSPEGYTNVGAEIVIEGTESNENPEGS

SEQ ID NO: 137642 - protein, 59 aa, Heterodera glycines
  Coding regions on vcDNA: vcDNA=SeqID_64065; Strand=-; Position=1 -149,282-312
MSEDSCMIIGTGKKGIFEPSMKNAWIHTEWDPYIFEYAIRINLYKDVTNAKYININKST

SEQ ID NO: 137643 - protein, 131 aa, Heterodera glycines
  Coding regions on vcDNA: vcDNA=SeqID_64066; Strand=-; Position=1 -153,211-252,312-406
  Homolog annotation: Hit_ID=AAN32888.1; Match level="QueryCoverage =100%, HitCoverage=28%, E-value=2e-40, Identity=71%"; Hit description= annexin 4C10 [Heterodera glycines]
MLQNGLTILLLISVVIGHSLAKLGPTIKHNPHFKTVQTAHHLHDAIAKKHKAEVTQVICSISNEQAEVTQVICSISNEQRQALALEFKKQFGTDLIAMLRQALALEFKKQFGTDLIAMLKKEFKSDFEELI

SEQ ID NO: 137644 - protein, 18 aa, Heterodera glycines
  Coding regions on vcDNA: vcDNA=SeqID_64067; Strand=+; Position=1-56
YREAIPEGFGLPINLGAS

SEQ ID NO: 137645 - protein, 52 aa, Heterodera glycines
  Coding regions on vcDNA: vcDNA=SeqID_64068; Strand=+; Position=1-170
STGYREAIPEGFGLPINLGASVRGDCPENKKIDFFKCPSGESNNYGEQKSNA

SEQ ID NO: 137646 - protein, 21 aa, Heterodera glycines
  Coding regions on vcDNA: vcDNA=SeqID_64069; Strand=-; Position=1 -54,580-591
MRTRPIWQVKQRLLTSQKKGF

SEQ ID NO: 137647 - protein, 95 aa, Heterodera glycines
  Coding regions on vcDNA: vcDNA=SeqID_64070; Strand=+; Position=1 -117,281-490,657-1008
LFEYPKRTLEKIDFFLFGAVPPNRCAQIYGETESFRNSFPIACTLILRWIFAPHNCLSTPNGHLKKSIFLFSGQSPRTDAPRFMGRPNPSGVASL

SEQ ID NO: 137648 - protein, 74 aa, Heterodera glycines
  Coding regions on vcDNA: vcDNA=SeqID_64071; Strand=+; Position=1 -165,402-461
MLIAYIPKRIHLNLNVVGAALRQRMPFSAAVLDPHDQLKDSDKPMSEQMNPSFFKVLYVTFPLRRDDGSYGLNL

SEQ ID NO: 137649 - protein, 60 aa, Heterodera glycines
  Coding regions on vcDNA: vcDNA=SeqID_64072; Strand=+; Position=1 -30,254-406
  Homolog annotation: Hit_ID=NP_502267.1; Match level="QueryCoverage =81%, HitCoverage=9%, E-value=2e-14, Identity=73%"; Hit description =glutamate dehydrogenase (58.8 kD) (4M719) [Caenorhabditis elegans] emb|CAA98074.1| Hypothetical protein ZK
MSVTPTTIFWGLEYTMNRSAKQIIATTNKYNLGLDLRTAAYANAIEKIYQTYETSGFTFA

SEQ ID NO: 137650 - protein, 248 aa, Heterodera glycines
  Coding regions on vcDNA: vcDNA=SeqID_64073; Strand=-; Position=1 -132,181-247,406-509,746-968,1202-1320,1627-1728
  Homolog annotation: Hit_ID=NP_502269.1; Match level="QueryCoverage =82%, HitCoverage=70%, E-value=3e-78, Identity=57%"; Hit description =zinc-containing alcohol dehydrogenase superfamily (40.2 kD) (4M724) [Caenorhabditis elegans] emb|CAA98080
MAQSQNGGVKNRRISLGSPKDLKEVHFFEEDEVPDVPLNGARVKVCYAGVCLTDKEISNTKQVICSCYEVSGVIDEFGPNATPVEYNLKVGDKVIVWPTEEARPVVEAIASTKGCCNILIVGAGGLGLWILTLAKHFLTAGQENRIKLIVADSKEERLCLAERNGADFVVHWDDSEFEEYLIMRTKDVATNGLHIVFDFVTSPRTVARSLKCLSEVLKQLSMSEVEGRAILEVFNPDTEVKKAEEEQK

SEQ ID NO: 137651 - protein, 255 aa, Heterodera glycines
  Coding regions on vcDNA: vcDNA=SeqID_64074; Strand=+; Position=1 -15,264-452,738-995,1428-1733
  Homolog annotation: Hit_ID=NP_524120.1; Match level="QueryCoverage =40%, HitCoverage=24%, E-value=9e-16, Identity=39%"; Hit description =CG9712-PA [Drosophila melanogaster] gb|AAF49406.2| CG9712-PA [Drosophila melanogaster] gb|AAG29564.1| tum
MRPPNFDHDLTSLIRRAKMKFESRAKEDLLNALNNFTDLQPDVVNFTFPDGVPRWCLSFSGTIPIQYKVITIEFQEKCPVYSVSNNSKNTGHSNNPYPHSGSMTNLPYPNSALPYPTADPPSHIMPQPSSYTPMPQPGVLRVNQQMDIFVFIVSDKKEELESALKVVDSNGTTDNGVAFNEEQAIDAQTPVHRQILKCHVQDSAIDDTIYHLGQALHQGAVNLQTYLKYVRQLSKQQFQHRLLMYKCRDRSRLTI

SEQ ID NO: 137652 - protein, 16 aa, Heterodera glycines
  Coding regions on vcDNA: vcDNA=SeqID_64075; Strand=-; Position=1-49
EAIPEGFGLPINLGAS

SEQ ID NO: 137653 - protein, 84 aa, Heterodera glycines
  Coding regions on vcDNA: vcDNA=SeqID_64076; Strand=+; Position=1 -190,242-306
MHTFATQPTTHNWMHFVRFVSCPAPGLASVLALSISAPPFCRPLTFSRTCSTVSAPSTNAFWPSTNNIFDVCLPYVFVIIMNDG

SEQ ID NO: 137654 - protein, 68 aa, Heterodera glycines
  Coding regions on vcDNA: vcDNA=SeqID_64077; Strand=-; Position=1-360
AVLVRFITAPNLLASQQSLLNLPDRTGAHDSTVPSTPPKAKRYNQNIRKNFLKIFFSIFLFDTKASEC

SEQ ID NO: 137655 - protein, 158 aa, Heterodera glycines
  Coding regions on vcDNA: vcDNA=SeqID_64078; Strand=-; Position=1 -119,345-465,666-898
  Homolog annotation: Hit_ID=CAE64964.1; Match level="QueryCoverage =100%, HitCoverage=4%, E-value=1e-39, Identity=47%"; Hit description =Hypothetical protein CBG09798 [Caenorhabditis briggsae]
SSWSDGLLINFTIGTHRGNEPIDRCELWKQLISSLHRSNGSIGNGRLSVASDVGLLDPCAKPAPPGEQCNGAVCKQSLGEVCIGGELCGCPTSQKRASADDQCRLVESFTIPLWVLRRGVHNLVFNSTFANPIDQLNKEYVRQFSTGVAQCYPHTALR

SEQ ID NO: 137656 - protein, 141 aa, Heterodera glycines
  Coding regions on vcDNA: vcDNA=SeqID_64079; Strand=+; Position=1 -147,375-653
MFVDALPASIVSLNLTSNRLVRLTNRICRLQQLGTLRLDHNLFEELPEDLCLINSLCHLSLVGLNRLQFLPPSLCVVKFTAPRFILLDISGNEHAPFITGHGTAHNQHSVHNAATTSSTVVSVTAPPALCEFAAAAVLNNK

SEQ ID NO: 137657 - protein, 444 aa, Heterodera glycines
  Coding regions on vcDNA: vcDNA=SeqID_64080; Strand=-; Position=1 -63,106-372,859-1092,1145-1302,1350-1459,1511-1708,1759-1892,1945 -2035,2083-2160
  Homolog annotation: Hit_ID=NP_506383.1; Match level="QueryCoverage =42%, HitCoverage=18%, E-value=4e-33, Identity=43%"; Hit description =RNA helicase (5O149) [Caenorhabditis elegans] emb|CAB03153.1| Hypothetical protein F58G11.2 [Caenorhabdit
MGRLIFRMTELLEHIQRLIRTKELSSIFPTLSHFSSRPLSTCRRGEFCVIATALTQHRMCRKQMELPPMKANISFPSPISLCHLEALLCRVSLPSLGEGREECAADWEEGVKMVVWAMPGQMPKTTDAEERITVTVGAVVAEAKETAENVSGAAEAEEDDPNLAKDRRITVSEDHPQQMAETNAFHGMPRSSRPRHIYKKRPIECLYEEDCLVSERYVDIRDEDEDLVVSGDNVEKFTAYETWKDFDLEPKLLDNINRCKYVVPRKIQSYTFPLIRDGFDVKAHAETSSGKSAAFFLPIIDKIMKLKKEGTFKSRRDCPYALILSPTRELAIQVYEQGRKLCNGCDVSISLAYGETVRHENIRNISIDGCDILVGTPGRTCDFFQSKNLMFDLLKVFVLDEADKLLDESFILDMRVLGSISMGTAHFGAGLFGAVANNFFPDQP

SEQ ID NO: 137658 - protein, 263 aa, Heterodera glycines
  Coding regions on vcDNA: vcDNA=SeqID_64081; Strand=+; Position=1 -54,392-1036,1319-1411
MYGQPGAGAAVYSSFQQQHAEVVDQQCYQQQSAASVGYGPSMPGASASVPLEQQQQASQKGAVTSSAAKPLPQQHFVPPPPSFYTAGNRSSNAAAAALLGVVPSPPMLPPSVGGSAVVGPPPPTAYATQQQQSINAVTSSSAKLLPQQPPQPFYAAGNYSSKAAAASMFGVMPRPPMLCPWGGGSAVIGPPLPAAYAAQQQQPIDPMPSSSSWNFGQQQQYQFAADLSHQHHKMAGPTSSTADLNPTLFVPTAKVLDPELVSK

SEQ ID NO: 137659 - protein, 66 aa, Heterodera glycines
  Coding regions on vcDNA: vcDNA=SeqID_64082; Strand=-; Position=1 -21,74-162,277-364
  Homolog annotation: Hit_ID=AAD39095.1; Match level="QueryCoverage =100%, HitCoverage=23%, E-value=9e-28, Identity=87%"; Hit description= galectin GAL-1 [Teladorsagia circumcincta] gb|AAC47546.1| galectin [Teladorsagia circumcincta]
MAAESQYPIPYRSKLTEPFEPGQTLIVKGKTAEDSVRFTINLHHTSADFSGNDVPLHISVRFDEGK

SEQ ID NO: 137660 - protein, 129 aa, Heterodera glycines
  Coding regions on vcDNA: vcDNA=SeqID_64083; Strand=-; Position=1 -237,582-734
  Homolog annotation: Hit_ID=NP_494848.3; Match level="QueryCoverage =90%, HitCoverage=22%, E-value=3e-15, Identity=35%"; Hit description =AMP-dependent synthetase and ligase family member (55.7 kD) (2F35) [Caenorhabditis elegans] gb|AAC46810.4
MLFQRQKLPKICATLFPKCQIRRSSNFVELAGFTASTDSKQYAAKKLLLLKNGSSRSYNDVNVAAGRFAALLNKKYGIQKGDTVLCRTSKTVDALALYLAVLRLGAIYVPLNPTYTKRETEHFVNVKIC

SEQ ID NO: 137661 - protein, 188 aa, Heterodera glycines
  Coding regions on vcDNA: vcDNA=SeqID_64084; Strand=+; Position=1 -124,177-619
MAKRTLLRKRQTKNARHTRENKREERKAQTAKAMKARWAKKTSPEPNPNAGTPQQDEAGPSTSAVPAEELMEPPPPAPVPTPEMDKEILEFGFSLPSTSVTPIGDLVPFSTTPTAPMDTGETTPPPLAIDERSERIEQLEKQLKDRDDTIKFLREQVRNREALISDLRRQLDEHMVPPMAPPTTSKSE

SEQ ID NO: 137662 - protein, 45 aa, Heterodera glycines
  Coding regions on vcDNA: vcDNA=SeqID_64085; Strand=-; Position=1-161
TRRPETELLYQKRFVCVAKWSVRRSPKGGSQVRFPVHTIDVFQLF

SEQ ID NO: 137663 - protein, 132 aa, Heterodera glycines
  Coding regions on vcDNA: vcDNA=SeqID_64086; Strand=+; Position=1 -227,1243-1414
MPVLHFLHNAVPALFLLVRLALSPERRPLVPRLLCAIVRAPLRSLLWRPVAAQLLVSALSARVYVHNRAGALYLCRLEFGNIEWDPWALFLAPLLALAQAVHILLLKQAQLAFFAALGMPNGNNVPILWANN

SEQ ID NO: 137664 - protein, 18 aa, Heterodera glycines
  Coding regions on vcDNA: vcDNA=SeqID_64087; Strand=+; Position=1-56
YREAIPEGFGLPINLGAS

SEQ ID NO: 137665 - protein, 83 aa, Heterodera glycines
  Coding regions on vcDNA: vcDNA=SeqID_64088; Strand=-; Position=1 -180,572-642
TTLGSGFPSDLGGLGTGTGTTFVQPHNYQFGTATSGSFHSSDDSLSVSMDCAMFAPEELKVSVVGNQIVVEGKHGEKQDSLGS

SEQ ID NO: 137666 - protein, 38 aa, Heterodera glycines
  Coding regions on vcDNA: vcDNA=SeqID_64089; Strand=+; Position=1 -13,318-421
MNMISSIGNQSAKSVWHFRSRAKARDFPSQFSNRQSVA

SEQ ID NO: 137667 - protein, 80 aa, Heterodera glycines
  Coding regions on vcDNA: vcDNA=SeqID_64090; Strand=-; Position=1 -210,653-686
  Homolog annotation: Hit_ID=CAE66567.1; Match level="QueryCoverage =96%, HitCoverage=74%, E-value=8e-31, Identity=61%"; Hit description =Hypothetical protein CBG11882 [Caenorhabditis briggsae]
EKDCAAGDDEPGREVCGDRICPVGEFQCSNHNCTRPFQLCDGQDDCGDGSDEKDCDKPCDDWMFKVFVGGSRLPKQFIFN

SEQ ID NO: 137668 - protein, 19 aa, Heterodera glycines
  Coding regions on vcDNA: vcDNA=SeqID_64091; Strand=-; Position=1-58
MLNRVWRNDKEFAIKTQEN

SEQ ID NO: 137669 - protein, 90 aa, Heterodera glycines
  Coding regions on vcDNA: vcDNA=SeqID_64092; Strand=+; Position=1 -220,300-352
MAYFAPFPPICLFHLIFIFQLLGPVFCANVYLKKQYGENEFRIESWGKTNCSLNGIDIVQLGIGRPCEEWPDFATIFCDGKILEVIIKNY

SEQ ID NO: 137670 - protein, 47 aa, Heterodera glycines
  Coding regions on vcDNA: vcDNA=SeqID_64093; Strand=-; Position=1 -54,613-702
MSGSLSVGSPKSRTTCEKGVFGVAGHESDIHFNQIRTPNPYPIKKRE

SEQ ID NO: 137671 - protein, 66 aa, Heterodera glycines
  Coding regions on vcDNA: vcDNA=SeqID_64094; Strand=+; Position=1 -104,343-439
MSGSPKSGPQMSGSQVANPQKSGSRQVSQSISHFILQTAEHVISEYLNDVLPEKPEAPKMQKKNVL

SEQ ID NO: 137672 - protein, 392 aa, Heterodera glycines
  Coding regions on vcDNA: vcDNA=SeqID_64095; Strand=-; Position=1 -426,543-1041,1086-1340
  Homolog annotation: Hit_ID=NP_498959.1; Match level="QueryCoverage =68%, HitCoverage=12%, E-value=5e-37, Identity=34%"; Hit description =zn-finger, CCHC type and RNA-directed DNA polymerase  and Integrase, catalytic domain containing protein
ADNKELCPIGKIMTTNVKIFDQPAISMMDGGAQVSLIKAEFLKNILESQKLEGTNLKIWPKTRNVVDINGKRVECYGIIVLPVVRRGCEAVEIMFHITDAPVGHPILFGTNALGLLGFKIFDAPNGELVEFECVDNKSDSVQIAAVEEVKEIAKADDCLEDAWLYHSVEMEKCLFEDEFKAEIGQLDEDKHNKLGSLLHVFANISAFNDSDLTQIEVVKHHIDTDRSFPIKNRMRPVPYAYREKVAAMIQDYLGRGIIRPSLSPWASPIVIVPKKDGTLRFCVDYRGLNSVTRKDCFPLPNIERTLLMLWQIKMPEESVEKTAFVTEFGLHEFTVMPFGLCNAVATFQRFMSQLFGQMMNDFVFVYIDDVLVASESFEQHLKHLKLVFEQIR

SEQ ID NO: 137673 - protein, 63 aa, Heterodera glycines
  Coding regions on vcDNA: vcDNA=SeqID_64096; Strand=+; Position=1 -104,377-462
MPVSGPVWHFQNDRFPGPASQKPVKPDFSKKTPDRVNDVQIRIDELNLQFVYRLGVMADKHWE

SEQ ID NO: 137674 - protein, 20 aa, Heterodera glycines
  Coding regions on vcDNA: vcDNA=SeqID_64097; Strand=+; Position=1 -38,170-194
MFKCTILMIENGIFGVFNTF

SEQ ID NO: 137675 - protein, 180 aa, Heterodera glycines
  misc_feature (1)..(1): Xaa can be any naturally occurring amino acid
  Coding regions on vcDNA: vcDNA=SeqID_64098; Strand=+; Position=1 -101,372-463,521-654,696-821
  Homolog annotation: Hit_ID=AAM12049.1; Match level="QueryCoverage =97%, HitCoverage=29%, E-value=3e-34, Identity=46%"; Hit description =phosphatidylinositol 4-kinase type-II beta [Homo sapiens]
XRRNTDRGNDNCLICYTPPQQKQKKEMATREKGWEDVEMPQVKVAAIDNGLAFPFKHPDQWRAYPFQWPFQWAKLSMAQIPFSEETIHKMLPVLEKSEFLRELGNDLRNIFTTDKGFDEKTFNKQLSVLYGQIFNLRETDKGFDEKTFNKQLSVLYGQIFNLREALRERKTPAQLAQVGL

SEQ ID NO: 137676 - protein, 90 aa, Heterodera glycines
  Coding regions on vcDNA: vcDNA=SeqID_64099; Strand=-; Position=1-821
IIFIQKIFFWVFGAVPLNRCAQIYGETESFGNSFPIVCTLILRWIFAPHKCLSTPNGHLKKSIFLFSGQSPRTDAPRFMGRPNPSGIASL

SEQ ID NO: 137677 - protein, 43 aa, Heterodera glycines
  Coding regions on vcDNA: vcDNA=SeqID_64100; Strand=-; Position=1 -50,638-719
MSLGQDCMIMIMDGNFICERYLTIMNQLTYNRAVLRGKKTEID

SEQ ID NO: 137678 - protein, 153 aa, Heterodera glycines
  Coding regions on vcDNA: vcDNA=SeqID_64101; Strand=+; Position=1 -153,268-500,1209-1284
MLVFFIFYFVAFAYPFRHNFVSDRTDESNEGLKGSGPALRLRCGEKMPDNRVEFGQLSPPSDWPWAISVRSECLNKRSNRTEVLSTCSGVLIGSKHVLTAAHCLLTTINSYLRCKGNEVAGEFEFPGTTFMSQHYDNDIAILEAIINLICIFL

SEQ ID NO: 137679 - protein, 88 aa, Heterodera glycines
  Coding regions on vcDNA: vcDNA=SeqID_64102; Strand=+; Position=1 -129,180-317
MIVNNTFLWQLRGTPEDRLCANTEENGTSLVWLLANPTCVTINRVSCAQPLIVLGLTERPEGASSANELFINNEDEWLEILDYFMQLY

SEQ ID NO: 137680 - protein, 43 aa, Heterodera glycines
  Coding regions on vcDNA: vcDNA=SeqID_64103; Strand=+; Position=1 -125,315-321
MFVHCFSDWLMTHRCSSVCVHGKVGAVQLAVAVVDSVGQATRV

SEQ ID NO: 137681 - protein, 136 aa, Heterodera glycines
  Coding regions on vcDNA: vcDNA=SeqID_64104; Strand=-; Position=1 -303,824-929
TRAHYRRWRLDGAGFGPISAFFTAIIDKICCCGTFILKKNSQNGIGAEFPQLKFAFSPSGAVLLENVNGCGPNSSANSSSSSGRNGGTTSACSEVSTTELPASSSGDTALLGQQNQPPPPPAALLQLYHEHKRMNS

SEQ ID NO: 137682 - protein, 30 aa, Heterodera glycines
  Coding regions on vcDNA: vcDNA=SeqID_64105; Strand=+; Position=1-90
MSLMRSYQLCYHASEVPYYVIAKRPIESSK

SEQ ID NO: 137683 - protein, 87 aa, Heterodera glycines
  Coding regions on vcDNA: vcDNA=SeqID_64106; Strand=+; Position=1-264
KFFDSGDYNMNKNKPIPPPIGQNLTAANTPKLAVPIETEPEKKMEESAPIIVSQLLPMMRPLAGSISGCSMDGGESDDEGGQLQVYC

SEQ ID NO: 137684 - protein, 125 aa, Heterodera glycines
  Coding regions on vcDNA: vcDNA=SeqID_64107; Strand=-; Position=1 -201,245-421
  Homolog annotation: Hit_ID=NP_493596.1; Match level="QueryCoverage =53%, HitCoverage=3%, E-value=3e-11, Identity=60%"; Hit description =UNCoordinated locomotion UNC-54, encodes major bodywall muscle myosin heavy chain MHC B (MYO-4), MYOsin he
MQEQLANLNLNKYKQMQRLLEDAEERAELAENSLYKIRTKSRSSASLRGIVGFDLRPSASSAAVLRSSSASIFASQYSQPNNYDNHSLGGGTKEENPFNPNGNLMSKSIHEEEEEEEEEEDNEVE

SEQ ID NO: 137685 - protein, 91 aa, Heterodera glycines
  Coding regions on vcDNA: vcDNA=SeqID_64108; Strand=-; Position=1 -113,176-291,424-468
  Homolog annotation: Hit_ID=AAF20016.1; Match level="QueryCoverage =100%, HitCoverage=15%, E-value=3e-14, Identity=43%"; Hit description= asparaginase [Dirofilaria immitis] sp|Q9U518|ASPG_DIRIM L -asparaginase (L-asparagine amidohydrolase) (DiA
DANDENALLCAVRSRNLVVISMVRQAGGQLVVPRPRIGVELCLSAGTGGLDALKAWHAAGANLSTPDYEGRTALHIAASRGFDELCFWLCE

SEQ ID NO: 137686 - protein, 92 aa, Heterodera glycines
  Coding regions on vcDNA: vcDNA=SeqID_64109; Strand=+; Position=1 -170,454-561
  Homolog annotation: Hit_ID=AAC72366.2; Match level="QueryCoverage =76%, HitCoverage=6%, E-value=3e-27, Identity=78%"; Hit description =guanylyl cyclase [Heterodera glycines]
KNCQKKELLWTAPEHLRQNNRAGTVEGDVYSFAIICTELVNRETVWNGVEREQDIDEILYRLKRTNVPLPHRPQSSRNEEMCDHQRLERGSC

SEQ ID NO: 137687 - protein, 102 aa, Heterodera glycines
  misc_feature (3)..(3): Xaa can be any naturally occurring amino acid
  Coding regions on vcDNA: vcDNA=SeqID_64110; Strand=+; Position=1 -50,768-1031
  Homolog annotation: Hit_ID=AAH75177.1; Match level="QueryCoverage =80%, HitCoverage=20%, E-value=2e-22, Identity=60%"; Hit description =LOC398349 protein [Xenopus laevis]
GTXEAGTGLDFSSEPGNKFSWTLNDFEIGKPLGKGKFGTVYLARERETKYLTALKVLFKKDMDKHGVSHQMKREIEIQYHLRLVAVAGSYRLRFHFLSPQLI

SEQ ID NO: 137688 - protein, 449 aa, Heterodera glycines
  Coding regions on vcDNA: vcDNA=SeqID_64111; Strand=-; Position=1 -131,174-288,380-521,640-832,880-1097,1147-1397,1443-1742
MKQLITENPKQQPSQLRAQIRTNVNDEVFELLGTNEALDQMTNRAKNKFVGKVNCGDPLQIQIPAGLLKKDDESVLIYDSRELLSMLKQNRRWSLDGTFRSAPKPWTQVFVIGCYVNNRMVVTAQALLPVMSDFEIGMLKAMRHVFPSCERSGCSFHMAQAVFRKARSMGIFNLLNEDDNEAPVQRKSVHKTFRSVLSLALIPPLYVRRAFSTIVSAAPLGVQGWLAYFAKTYIGTTQFEIDRGAEAFEPHADVGHFLLRRTRSTTPFSISQASIMTGSGPIQFGLHSPQPSTPTIPLSEESSLQLIPRWEQDIVCPPRFPISFWNVYTRAQMAIERTNNGMEAAHGQFARELNHHPSLSDFIAAFIKDIDKQLDIGRAEQLQKSRKRPQRYIIKEQNVVRILDEADFESEEGLTNSLHLLGLVMQGFAEGLHVRGNSESGEETEADEN

SEQ ID NO: 137689 - protein, 228 aa, Heterodera glycines
  Coding regions on vcDNA: vcDNA=SeqID_64112; Strand=-; Position=1 -222,267-590,632-771
  Homolog annotation: Hit_ID=NP_003581.1; Match level="QueryCoverage =100%, HitCoverage=26%, E-value=6e-50, Identity=47%"; Hit description= cullin 3 [Homo sapiens] gb|AAH39598.1| Cullin 3 [Homo sapiens] gb|AAC36304.1| cullin 3 [Homo sapiens] sp
MLIALGLDNRAYYEHQFEDLFLRETADFYRRASQKFLAENSACVYVHKVNESLIEEVQRSERYLDKITETKIIHVLNEELITKNMTTIVEMDNSGLVYMLLNDRIDGFTFQYKSVYFLLLDLRCLYELLKRVESGPKTMTNTMSRFLRAKGTAVVNDNTQQQPQGETVEPIGGVSNPIIFIQSLIGLKEQFDRFLLEAFNNDREFKQCIQSDFEHFLNISPKAPEYLS

SEQ ID NO: 137690 - protein, 31 aa, Heterodera glycines
  Coding regions on vcDNA: vcDNA=SeqID_64113; Strand=-; Position=1-93
MGSKNPPQNYSTGYREAIPEGFGLSINLGAS

SEQ ID NO: 137691 - protein, 239 aa, Heterodera glycines
  Coding regions on vcDNA: vcDNA=SeqID_64114; Strand=-; Position=1 -58,161-298,339-456,546-644,691-893
  Homolog annotation: Hit_ID=NP_509805.2; Match level="QueryCoverage =85%, HitCoverage=8%, E-value=1e-34, Identity=42%"; Hit description =phospholipase C, putative effector of Ras (212.9 kD) (plc-1) [Caenorhabditis elegans] emb|CAB60298.3| Hypo
SVLCDFRLDAACANVVWQRIFYGRDVREKEMIAVAKASANLQVVEAAAINRAQTSFSPRPPGAGPITLDEGFLNTSYIKITLDEGFLNTSYIKAIELVDSYDLDIEAIYRRHSVEEMSVPVECVPVECWTINFGCSINDNEFLYFLAPQQIAHYWMNVFSKVIKRLQDQMRNPNVFSKVIKRLQDQMRNPDRRVLWLKRLYLHLWTEQEHQRGEVSSSSGGSSAGGIAGRNWEGGGWPL

SEQ ID NO: 137692 - protein, 32 aa, Heterodera glycines
  Coding regions on vcDNA: vcDNA=SeqID_64115; Strand=+; Position=1 -4,284-378
MPEIFYLLRNYLWIHPFGFQGVQEVLVVIKRR

SEQ ID NO: 137693 - protein, 576 aa, Heterodera glycines
  misc_feature (573)..(573): Xaa can be any naturally occurring amino acid
  Coding regions on vcDNA: vcDNA=SeqID_64116; Strand=-; Position=1-1749
  Homolog annotation: Hit_ID=NP_510671.1; Match level="QueryCoverage =98%, HitCoverage=59%, E-value=2e-93, Identity=34%"; Hit description =predicted CDS, endonuclease/exonuclease/phosphatase family and RNA -directed DNA polymerase (XR69) [Caenor
KFQEKQEKKFLKTPEIYINILEKIFSVGKYHPSLITQIITDDKTKADIFANHFSESFQNLSEYPKPPPIISVNQPSISDVHFNVLDVLEILTHLPNKNNTSPDDLSFNFLKRFHLILTRPLTDLFKLSLKSGKLPKIWKTSIILPLFKNGDKNLASNFRPISITCSCCRIFERILAKRITEFLLEKISDQQFGFLRKRSTTLQLISTLEDWYNAILLNKKIDCIYLDIIKAFDKVPHELLIYKIEKIGIKGNLLNWLKDFLTNRTFKVRINQQFSKEFPIKSGVPQGSVLGPILFLIFINDLSPVIPDGISLKLFADDTKIYFCYDTESQRKKLDEALHCVSQWAKIWGLQFSPEKSASLYLGKDNFKIPYKFNGKTIKETQTIRDLGILIDNKLTFKSHISAILQKAYLRSRTLFQKMKSKSSKTWIKIYKSYIRPLLEYSSENWNPHIKKEIIRLEKFQKFFTRKVFLKCHLPVLPYSDRLKYLYISSLENRRKYLDLITAFKIIKQETHHPLKLYNISQRRNSPFPRLITNLKLLKLNIFTNRTTKNLQEKQNNRPFINKLNSKLQDQTXKTV

SEQ ID NO: 137694 - protein, 82 aa, Heterodera glycines
  Coding regions on vcDNA: vcDNA=SeqID_64117; Strand=+; Position=1 -117,205-336
  Homolog annotation: Hit_ID=NP_508729.2; Match level="QueryCoverage =82%, HitCoverage=13%, E-value=2e-10, Identity=47%"; Hit description =putative endoplasmic reticulum protein, with at least 6 transmembrane domains, of eukaryotic origin (63.8
MMFIWLLLLPSFLFLLRLSHANLLIPGIMTERVELAPKSSALNGTEVEIRVKCEEDVEIEFDVEFAIRSSPCAKEFIVDKMR

SEQ ID NO: 137695 - protein, 230 aa, Heterodera glycines
  Coding regions on vcDNA: vcDNA=SeqID_64118; Strand=-; Position=1-693
MKRPMDSTATPPSTKTTRISADALAGQIDSLSAAVNALLVQDDISQAVKLQFGVLLTTLHTCQHVIDGLNNNANNNSAEEQERRRSLVIIGMPENPSARPSERVREDQKVVSGILDELGVEAVPTTTYRMGRPDVHRASPRLVKVVLPASVHQHIALGGWKKERTRLRSLPNWGRLLIRPSLSREQLQAEYEQRQAKRNGMANHPPRANNASAISNQLHELGQKMQQNFR

SEQ ID NO: 137696 - protein, 95 aa, Heterodera glycines
  Coding regions on vcDNA: vcDNA=SeqID_64119; Strand=-; Position=1-704
LFEYPKRTLEKIDFFVFGAVPPNRCAQIYGETESFGNSFPIACTLILRWIFTPHNCLSTPNGHLKKSIFLFSGQSPRADAPRFMGRPNPSGIASL

SEQ ID NO: 137697 - protein, 159 aa, Heterodera glycines
  Coding regions on vcDNA: vcDNA=SeqID_64120; Strand=-; Position=1-477
MHLKLCLLFCLILFLITLTDQIGSENKKLEQKTFDEIFGEKWEEKRNEEQKKREIIGKFNKIKEKIKQKGRKYPRKEWSKIEGKIAKKLGTNRQYIYKWIKELGLNQKTNKCYKSKTDEQKFEIVQKFAEITNEFKQKGRKYSRKEWQQNYAEICKKIR

SEQ ID NO: 137698 - protein, 101 aa, Heterodera glycines
  Coding regions on vcDNA: vcDNA=SeqID_64121; Strand=-; Position=1-306
MPQQQQQLYHQQQQHHVLSLPSSATAGGRAVQQHHHRRSAASPAVVYQQPQQQQQHQQHYHHNQQRSTAANMMMSSGPANMNISVREFLSNNNAASRGGDR

SEQ ID NO: 137699 - protein, 270 aa, Heterodera glycines
  Coding regions on vcDNA: vcDNA=SeqID_64122; Strand=-; Position=1 -88,184-753,797-951
MERLRSFLAELKAKELDSRTVYEAIVPLKAFCDDTFLYEKFKGTGEKSSTEKQMVLLIGTLVHEIEQRIKTVQQLFRLDPQKYFFDGKKAKNSAQLWTVIKEVAFTLNIDSIENLWAFLNKLFYTLLNLLAHLEGFDFFDGMSKSDTFEIEKLQLMQQIVVRKYAFLIIEDEKYRTKWDELGNEQKAKKLFKIIGTKFDPIHFEHLKREWAKMEQQIKIDSELYAQNLVTKDWHNRQIMPMFAKLSQQITTEAYKMNELTATKKVSLKIK

SEQ ID NO: 137700 - protein, 371 aa, Heterodera glycines
  Coding regions on vcDNA: vcDNA=SeqID_64123; Strand=-; Position=1 -275,636-931,997-1113,1170-1597
MRDELLEQHTLRMIRLNRSENAFSEFLKNSVAEEKAAVYRLNRFYMDKDRNTGQELSLNIFHKYAELQRMCRNGNINALINQSGILDNVLELFTIHKAKILPKSDEQEILDEAFTITENGMDSVPDLNSVHAINTSMQHLFTLGAIKGKLGGIGQPDDWWHAVIPFLASTHNETLKELLVQNDEFRAKLKTIYIDRERLERMIPKDSQMFEQLIIESMAKKGTKNLTDYENAESFNIMQLYEKLILGDEDNGETKDNLTLSVFCFYFEILLENLLAKLRPLKAKENAKLKRMAIEVEVENAKLKQILSKLSGKDGKLAKVCYLESFTLWAAQNEALANENETKQLTSSEMVDNLWELEKVKRIKKMNSINN

SEQ ID NO: 137701 - protein, 136 aa, Heterodera glycines
  Coding regions on vcDNA: vcDNA=SeqID_64124; Strand=-; Position=1 -188,238-460
MGKQLENGDKMDKTSKKHIEKFVDDRKMLHYSAISFLLLTNSKEEKGEIKIGRNNAKGTAYKWKMSEYFDESKFNVETEFAYKMRTLRSKNLMKNNEKILSIKNEIAKLIGENLVEELEFQHPIIMSIGNKSLSEN

SEQ ID NO: 137702 - protein, 135 aa, Heterodera glycines
  Coding regions on vcDNA: vcDNA=SeqID_64125; Strand=-; Position=1 -85,129-451
MMVLLENSFCLLFLTIFLSVCSLKGAKKTFGIDQIDCFYANFFGLSFETEKKCDKNFEEISLTKIEEIIYFNEMNELLKAVKTKENLDAEHKKLSEKTLEQFLNIENLYQNSTQIVKSCEYWKFFLNIRSVFGMF

SEQ ID NO: 137703 - protein, 46 aa, Heterodera glycines
  Coding regions on vcDNA: vcDNA=SeqID_64126; Strand=-; Position=1 -88,158-210
MFEQGIALEVIERTVNVPTVELKCRFARLWMEILCNTYFSWIPQML

SEQ ID NO: 137704 - protein, 95 aa, Heterodera glycines
  Coding regions on vcDNA: vcDNA=SeqID_64127; Strand=+; Position=1-697
LFEYPKRTLEKIDFFVFGAVPPSRCAQIYGETESFGNSFPIACTLILRWIFAPHNCLSTPNGHLKKSIFLFSGQSPRTDAPRFMGRPNPSGIASL

SEQ ID NO: 137705 - protein, 86 aa, Heterodera glycines
  Coding regions on vcDNA: vcDNA=SeqID_64128; Strand=+; Position=1 -94,425-589
MAIQMFSSCSLITFAILLFSMLIEARFLDKRTDNCFYGMRHRNIPSGGLVAKMTKWNTFNMKKGDRMNEHDCRGSFAGCQTYSCID

SEQ ID NO: 137706 - protein, 237 aa, Heterodera glycines
  Coding regions on vcDNA: vcDNA=SeqID_64129; Strand=-; Position=1 -234,277-753
MEIIIILLRITNADKFCLFYALVASKLYLEEHRNIFNRFMKNIVRQRDSAIELLHNCGIDINEYSYGVEQLPNVQKYWDEIYPGKYRVVAFEKSADPRKSIRVLWKGPMGRENVVPLFLENGHWDGLKNFVCFFNRGRKFCIDCECFYDKDVKHAFDCRARCYYCNRVGGMPCEKESGVKIECTKCRRYFYNWECYNYHQGHQTCNLWKRCVICDKTYLFNPKKEHECGETYCQLCS

SEQ ID NO: 137707 - protein, 86 aa, Heterodera glycines; identical to SEQ ID NO: 130750
  Coding regions on vcDNA: vcDNA=SeqID_64130; Strand=-; Position=1-664

SEQ ID NO: 137708 - protein, 62 aa, Heterodera glycines
  Coding regions on vcDNA: vcDNA=SeqID_64131; Strand=-; Position=1-189
CVDVGSIVLCASYLDIPPEPISSSSDEKSNGKRKKQKGQTKKEGPKIVTDVHEFGCIPWRMF

SEQ ID NO: 137709 - protein, 119 aa, Heterodera glycines
  Coding regions on vcDNA: vcDNA=SeqID_64132; Strand=+; Position=1 -33,77-205,266-392
  Homolog annotation: Hit_ID=CAE66160.1; Match level="QueryCoverage =100%, HitCoverage=66%, E-value=7e-38, Identity=63%"; Hit description= Hypothetical protein CBG11394 [Caenorhabditis briggsae]
GYVGIKFCPECNNMLYPREDKQNRNNMLYPREDKQNRQLMYVCRNCEHSEPADNPCIYVNKLTHEVDELTQIVADVIELTQIVADVIHDPTLPKTEEHPCPKCKNAESVFFQAQSRRAE

SEQ ID NO: 137710 - protein, 88 aa, Heterodera glycines; identical to SEQ ID NO: 124691
  Coding regions on vcDNA: vcDNA=SeqID_64133; Strand=-; Position=1 -96,135-305

SEQ ID NO: 137711 - protein, 88 aa, Heterodera glycines; identical to SEQ ID NO: 133373
  Coding regions on vcDNA: vcDNA=SeqID_64134; Strand=-; Position=1 -96,135-305

SEQ ID NO: 137712 - protein, 169 aa, Heterodera glycines
  Coding regions on vcDNA: vcDNA=SeqID_64135; Strand=+; Position=1 -275,408-642
MNRSLVKCQIWHNFQKSFKVWPCFEPAKWQEKRCGGCTALGNCDFDQGQPGETSDDAEKQQPQKAINNNTSADSNRNGASAWWPCLCAPAIRICVRVDDNLPETVGSPPLAADNSSDPSPSSADPPLLERVPKIWELKKAEVKRMETPEQKEAREEAYGLRVMRKRTDN

SEQ ID NO: 137713 - protein, 417 aa, Heterodera glycines
  Coding regions on vcDNA: vcDNA=SeqID_64136; Strand=+; Position=1 -130,280-416,492-573,622-655,704-750,841-934,1039-1085,1233-1300,1515- 1593,1678-1713,2043-2196,2673-2879
  Homolog annotation: Hit_ID=CAE66660.1; Match level="QueryCoverage =93%, HitCoverage=44%, E-value=1e-107, Identity=52%"; Hit description= Hypothetical protein CBG11997 [Caenorhabditis briggsae]
LKGVYDPIAIRSKAVENLVFAVSQMSEYEQSQMGYSKREFITKCSFNGRECSVEEDFSLYVDPTYGNCFTFNAHPDKNVLSERAGPNYGLRFLRFQVFVNVSDYLPTTEAAGVRITVHNPEEQPFPDTHGTVHNPEEQPFPDTHGFSAPTGFVSSFGIFSAPTGFVSSFGIRLKCVNRLPSCVNRLPSPYGECVEQGKTDEYIYRDKEYSTEGCGCQRSCIQRMLVRKCGCGDPRFPRYLNFSNCPVGDPRLRECLRREMHSAARSATQPDCVCRQPCREQVFSITYEQVFSITYSCARWPSSDLALHGECDPSLSGAQCLQFHREQSAIVEVYFEQLNYESLQESEAYGMPNLLSDFGGQLGLWMGVSVITIMEVGILISELLVLFFAKNGHLAESIVEHCRTDRVPSGDGPMLPS

SEQ ID NO: 137714 - protein, 113 aa, Heterodera glycines
  Coding regions on vcDNA: vcDNA=SeqID_64137; Strand=+; Position=1 -84,534-791
MDRVVPVSAFGNPALGEFYKVMPSSGLRLEIRHEDYKQQLGDIKQTYWIAEVKEANPIFDYFYDSFYVQPSNFAGQQNKGRSKEQQKKNCAKLAFRCLQLASNNLDNAVSLSL

SEQ ID NO: 137715 - protein, 40 aa, Heterodera glycines
  Coding regions on vcDNA: vcDNA=SeqID_64138; Strand=-; Position=1-120
GSMKLLKYTPKLFGLFKKELKIFKNFIHLPFDRKSIRVPS

SEQ ID NO: 137716 - protein, 23 aa, Heterodera glycines
  Coding regions on vcDNA: vcDNA=SeqID_64139; Strand=-; Position=1-70
TFSLIIYYFAKLIHKYFLERALK

SEQ ID NO: 137717 - protein, 222 aa, Heterodera glycines
  Coding regions on vcDNA: vcDNA=SeqID_64140; Strand=-; Position=1 -126,330-479,534-648,1040-1317
MIDDIFTDKNGQFEAPVGKETFNSIKNCKRAVYIGFYTDKAWLTQKLYSLAQNTLDAKNSSIKKIYAKVETNDCLRFSKKLKTKEEFMNEFKVSFDQKTIYINNAEEKAEIKSNKYFNEETYRISREYFAEKSSSEEASSSAASSTKQKWKQLGKMVKSLPLLGGKDNDKKKFEQYKKKPHVFDIYKKDSRGCEDTVGCCNVRMGFGWNTKGVERIFFFRFS

SEQ ID NO: 137718 - protein, 45 aa, Heterodera glycines
  Coding regions on vcDNA: vcDNA=SeqID_64141; Strand=-; Position=1 -127,347-357
MKIRPKIRTFLRNKNIKKPCINQIKINSNENVNRYRTPNKKYVAN

SEQ ID NO: 137719 - protein, 53 aa, Heterodera glycines
  Coding regions on vcDNA: vcDNA=SeqID_64142; Strand=+; Position=1-160
MVQYVKGNAQLNADIVNSDSSKNCPLGEPTFWEKNFLGKKKSFKGCHNFRCLD

SEQ ID NO: 137720 - protein, 96 aa, Heterodera glycines
  Coding regions on vcDNA: vcDNA=SeqID_64143; Strand=+; Position=1 -142,304-452
MASVGQFVVLRAAGAVRFDQSDPVEENGPQERVTEQRTAVRMGRGQKEFAGIGHAPKQKCWANPPDDGPTPEQIVRPPTISHQEYQKIQTFETPKN

SEQ ID NO: 137721 - protein, 91 aa, Heterodera glycines
  Coding regions on vcDNA: vcDNA=SeqID_64144; Strand=-; Position=1 -102,242-412
MHGCFVTTVPHYLMGMPHDLRYFLSDNDHRPWDHCAERLLQPFYDHKGNTVFFSLYNSKNQCVDSVVLMDEVNSRDQFEEVERHQLSFMEQ

SEQ ID NO: 137722 - protein, 350 aa, Heterodera glycines
  Coding regions on vcDNA: vcDNA=SeqID_64145; Strand=-; Position=1 -252,310-413,970-1080,1311-1350,1411-1588,1820-1905,2145-2341,2476 -2560
  Homolog annotation: Hit_ID=CAE66434.1; Match level="QueryCoverage =74%, HitCoverage=82%, E-value=3e-39, Identity=37%"; Hit description =Hypothetical protein CBG11705 [Caenorhabditis briggsae]
MLIHSLVSCPFSPGRCRVNNFTDTDYSSVPLGFSIPRVNCEGVLNKSECQFEKCSLGVDGPRCTETGNGFVFDRSIVTYSAIERWEFVCDRQYLKAMIQSSYYIGQMMGSLIFGFLGDRVVPESPRWLVSQKRYVEADQILRNAARINKRELPDKWPVVSMLYYGMSMKTDFLGGDMYMTFIFGGLVEIPALFLMYFLIDRIGRKPIIAGGFTIAALCMISNLLLGEKVNTMVAVAQFLTGKASSTVTYATLYTITPIIYPFAILGICAAAVVIIFLPETTGMKFLETIDEVEGWTKNHEEMQPLSSQSLQGTKSASGEIKTDMELLKDFNIREIDRLPVSRVPSWARCP

SEQ ID NO: 137723 - protein, 66 aa, Heterodera glycines
  Coding regions on vcDNA: vcDNA=SeqID_64146; Strand=+; Position=1 -45,365-520
MPRNTEHRCDGVQSGIMQSAAIVNPPAMIGFRPMRSIRKYIKKRAGISTNPPKMNVMYMSPPRKSV

SEQ ID NO: 137724 - protein, 369 aa, Heterodera glycines
  Coding regions on vcDNA: vcDNA=SeqID_64147; Strand=-; Position=1 -464,510-774,835-1020,1636-1827
  Homolog annotation: Hit_ID=CAE72000.1; Match level="QueryCoverage =71%, HitCoverage=42%, E-value=3e-36, Identity=36%"; Hit description =Hypothetical protein CBG19077 [Caenorhabditis briggsae]
MVCEPNGIEFKEEGSESESCCSSIVQVYNSGSCGSKKWTVEALYESCRMKVRMTGSGLMSECTLMIPLENGLILTISLVDAEIISKRKEPDGTYRFYVHYVDCNRRLDEWVAEDRIDLMSVRIPQRVKKSASQQAIAQSLDQSFDQNFAISDAQSSRSSTPEKVIEMFRTPTRSLTGSRKRKHLGHTIEYVDANSTSSECCPSVTTNGLPNSTAPSGITEQLPSVFHFPLFKFPVCVVPCQRPVGHSEDALTRIRNVEKVQLGRNIIQPWYFSPYPKEMTHLPCIYLCEFCLTYLKSQSALARHVLSYRSYWFQTILETMLKIVSQQGRPIPSQGEDGEEEEDTQVSLSIMDLCELTSIRKEDVLSTLQ

SEQ ID NO: 137725 - protein, 199 aa, Heterodera glycines
  Coding regions on vcDNA: vcDNA=SeqID_64148; Strand=-; Position=1 -101,150-219,304-406,736-842,899-1117
  Homolog annotation: Hit_ID=AAU84944.1; Match level="QueryCoverage =77%, HitCoverage=60%, E-value=1e-19, Identity=33%"; Hit description =putative purine-rich binding protein-alpha [Toxoptera citricida]
MPSSSGSEKGNGRNGVRGEEEVKGGKEIASKTLNIQSKRFYLDVKQNDRGRFVKLAEVAMNGRKNRLFMSMRICKNIKELLGKFEGHVPASEEEAELPHSQMIRTDGKSFFFDPGHNSRGDFLKITELKSFMGVRNSVVLSIRAIPQFTQVLSKLYDDFQELRAVEEVNVNNVLKKEPPKEAITDSNEESPKKETKSTD

SEQ ID NO: 137726 - protein, 108 aa, Heterodera glycines
  Coding regions on vcDNA: vcDNA=SeqID_64149; Strand=-; Position=1 -87,754-993
MVKCHPDKLAKKVQSLDAPKGAYKTLILEYHLDGSINARLILTVPELRELYESVKSQQSVLIEGQKTIQPLEKSIDQTTMRIWEDMECGRNQFLGLLDKLVKVFVCSE

SEQ ID NO: 137727 - protein, 457 aa, Heterodera glycines
  Coding regions on vcDNA: vcDNA=SeqID_64150; Strand=-; Position=1 -86,129-385,476-855,901-1163,1205-1592
  Homolog annotation: Hit_ID=CAE69279.1; Match level="QueryCoverage =97%, HitCoverage=38%, E-value=9e-94, Identity=44%"; Hit description =Hypothetical protein CBG15333 [Caenorhabditis briggsae]
MLQQYQLDEGNMNLLTSIASSQKEAGNQKHKIEVVKKLRCVSGEKLKNIRATSKQLNHIETDSSSCEEDFSGNGEQQQPGKSIERMPKLTHQIETCLLAGNNARTAQNLPIDKNEQRYEAASKQNKQHAKGQLQCSNALSRIKGRQIIVPRDENIEKKRRQLPINAEEQPIVEAINEYPVVIICGETGSGKTTQIPQFLYEAGYTSNGHLIGVTEPRRIAAISMASRVGHELDNEKLASYQIRHEGNRSEETKILFMTDGVLLKELQTDFTLSRYSVVVIDEAHERSIYSDVLIGLLSRICALRMKRGYPLKLIIMSATLKLQDFLRQRLFSISQPKVVSVQARQFPVTIYFERRTPTNYLEATFKKVCKIHEEYPAGGILAFVTGQREVTHLVKLLENKYTKISASKLLRKEKMKKCRKKETKEEEEEGLLLDNDEFGTSDMDLEDEAWQNTFFWV

SEQ ID NO: 137728 - protein, 209 aa, Heterodera glycines
  Coding regions on vcDNA: vcDNA=SeqID_64151; Strand=-; Position=1 -185,235-411,1054-1119,1182-1294,1341-1431
  Homolog annotation: Hit_ID=NP_651341.1; Match level="QueryCoverage =80%, HitCoverage=18%, E-value=1e-26, Identity=42%"; Hit description =CG11847-PA [Drosophila melanogaster] gb|AAF56406.1| CG11847-PA [Drosophila melanogaster]
HLPPSEAGAQLVERALVEASRISEEIKRRPFGGFIAYEEVKRAVTNGDAKAEGRPAIQSYKEYYPYDFVQFRSTDNEQQLKVLEFDTFSEAVDKFYSSIETQKAEQRILGAEKEAEKKVQMKTKKMSTIRARKSYWFEKFHWFISSDRFLVLAGRDAHQNELLVKRYMRSCDIYVHAEIQGAASVVIRNRDRSGAEPPPRTLNEAVIHS

SEQ ID NO: 137729 - protein, 61 aa, Heterodera glycines
  Coding regions on vcDNA: vcDNA=SeqID_64152; Strand=+; Position=1 -93,137-229
MHQRNPLSYAQQLSMSTNDHPAISGVDFPRVAFSSSWGGRTGNSALILAVDGDLLVHELLL

SEQ ID NO: 137730 - protein, 263 aa, Heterodera glycines
  Coding regions on vcDNA: vcDNA=SeqID_64153; Strand=+; Position=1 -156,487-701,914-1090,1139-1205,1312-1488
MSSANSSSATASTSGPTNKRQRMRSECNVSNASVQKQNLGNNRYSMTFQLIMPYEPETQRHHRILQLPALSQTGTSQRIFPICQIIYNNSNSVLAVVRPREEPGVSWRKGGFVMLSNSPAIALRTSEQNNLFEGHCSRVLSFGVTVDPNTAKKDTQRMALAEDVGDMASLLDSNGKYRCNTYGLCFEPIDNEICLGSSNRILIDMVLAPADRDVTCLLFATARSFYQEQQHSVGSCPKIVTKCTVNLRPIEFNLSEEVNVLSD

SEQ ID NO: 137731 - protein, 118 aa, Heterodera glycines
  Coding regions on vcDNA: vcDNA=SeqID_64154; Strand=-; Position=1 -125,168-374
  Homolog annotation: Hit_ID=NP_497411.2; Match level="QueryCoverage =86%, HitCoverage=10%, E-value=7e-25, Identity=56%"; Hit description =putative protein, with 2 coiled coil-4 domains, of ancient origin (105.0 kD) (3C558) [Caenorhabditis eleg
MKTKFATFDLCAALHDLRAFVGMRVVNVYDINSKTYLIKLQRPNEKAFILPNEKAFILFESGIRIHSTTYDWPKSTIPSGFSMKFRKHINTRRLTAVSQVGFGTDNQSRFTVLQVGVD

SEQ ID NO: 137732 - protein, 43 aa, Heterodera glycines
  Coding regions on vcDNA: vcDNA=SeqID_64155; Strand=-; Position=1 -54,226-303
MVFCVPKTVERQLPMGPLNTSATGDRKYKEQDSMTYHLFLNSP

SEQ ID NO: 137733 - protein, 75 aa, Heterodera glycines
  Coding regions on vcDNA: vcDNA=SeqID_64156; Strand=-; Position=1 -182,263-307
SECVICGSNSFPLGVRLRDCTHLSCVQCFVAYAEELLSRMSLKWHPQVGYTVGCPFYGCTAVVTDVHTLYLLGKP

SEQ ID NO: 137734 - protein, 197 aa, Heterodera glycines
  Coding regions on vcDNA: vcDNA=SeqID_64157; Strand=+; Position=1 -173,509-683,1284-1529
KSLPLRCSEEMNGSPTNFSKNEKGFEPMAEVQLLKDDDQLVVEERCSALWNEIKDAGNAFLAQLQSESDQLDEQVQKLAQKSETLAANAQLRLCSVWTALEELKRKKQRIAGEMGENGGVIRLPFNLALICFPIATDFHHHRPQIGALRLINSFRKWLKQKEAQQSQVKQRIAHSHDSESSLRELEQEQQERNIIQR

SEQ ID NO: 137735 - protein, 81 aa, Heterodera glycines
  Coding regions on vcDNA: vcDNA=SeqID_64158; Strand=+; Position=1-245
FVYSIRYLFPMLSSHHRESLLLQYGHSQVLYSDEFCKLTDEILIIKKFFFGTLRPKVVLLKDIRVVYFDEQKNQQKKYAHR

SEQ ID NO: 137736 - protein, 16 aa, Heterodera glycines
  Coding regions on vcDNA: vcDNA=SeqID_64159; Strand=-; Position=1-49
EATPEGFGLPINLGAS

SEQ ID NO: 137737 - protein, 239 aa, Heterodera glycines
  Coding regions on vcDNA: vcDNA=SeqID_64160; Strand=+; Position=1 -219,496-622,946-1319
MTQTWMHPDETKAQRFKGNGRLFVTPEKMEKIFFEMCERFWSSENYHEQKANCLDFVFNFVNTLCEGNAPKKTLWPDNFIEFDKFMSRKYERSSFNLFDPTFPQSALDRKPIKLPVIIDTNCLLKYHKLEILIKNTNCNSNKNEDNKEENEVANCSNFVLLHTTGHFDKPIKEEEDFENPILIHTLPEKTVQNGKNIAIQFILKAYTCKMKSSKNGQTRTLVTELRLMDETVSRIQYIL

SEQ ID NO: 137738 - protein, 19 aa, Heterodera glycines
  Coding regions on vcDNA: vcDNA=SeqID_64161; Strand=-; Position=1 -49,436-446
MKLDGIGSQNEWLSMFTDS

SEQ ID NO: 137739 - protein, 304 aa, Heterodera glycines
  Coding regions on vcDNA: vcDNA=SeqID_64162; Strand=+; Position=1 -78,665-1000,1090-1212,1452-1829
MRANVYIGSAEFRELPTDERMKYQLKKTKKCGRIWTDEKKRIRREHFVARIAKEIGVNFIGNYLINKANAVEGREGRLVASPSLPKVNAQPNRRNELERVARVLVKNGIRVFYDRWDRESIERNLLGWVQNAVTKATKIVLFYDSRAEQLLLVPCAGQNGDLFDRVFCALHQHLDLKKTREYEKMKVIGNPKEMREEKPNERTHLLSEFEDEHMAKNNGGGQFGTKETVTAPTAEGGKGEEGTEASSNCNTTTTQWGTTGMSSDCNTTTAAAAQLEWHNEAEEQRTKNQLAKGKEEGDSGVIVP

SEQ ID NO: 137740 - protein, 43 aa, Heterodera glycines
  Coding regions on vcDNA: vcDNA=SeqID_64163; Strand=+; Position=1 -79,186-237
CCRVVQAVLRAVGPALTFEAGMSRTFFGTFVVTCQANISPHSN

SEQ ID NO: 137741 - protein, 16 aa, Heterodera glycines
  Coding regions on vcDNA: vcDNA=SeqID_64164; Strand=-; Position=1-49
EAIPEGFGLPINLGAS

SEQ ID NO: 137742 - protein, 24 aa, Heterodera glycines
  Coding regions on vcDNA: vcDNA=SeqID_64165; Strand=+; Position=1-73
SKWGIEPRRKIMKVESLTTTPHVH

SEQ ID NO: 137743 - protein, 18 aa, Heterodera glycines
  Coding regions on vcDNA: vcDNA=SeqID_64166; Strand=+; Position=1-56
YREAIPEGFGLPINLGAS

SEQ ID NO: 137744 - protein, 49 aa, Heterodera glycines
  Coding regions on vcDNA: vcDNA=SeqID_64167; Strand=+; Position=1-149
KAGTLLSLRRHFSQNHPLRYLLRLILLFDKFSKPFVVFPWFLNDELCFP

SEQ ID NO: 137745 - protein, 114 aa, Heterodera glycines
  Coding regions on vcDNA: vcDNA=SeqID_64168; Strand=-; Position=1 -182,420-584
TVFALIIPHGGLFFNPLVYWGIIGDWGIMIEGLFFKRLLDWGINGDWGINGDWGIIRANTYFMPFIFVYLFFVAFPPIDDKRYLCKKIRTKMANFYIILFNLIIEFFVDRPSTN

SEQ ID NO: 137746 - protein, 37 aa, Heterodera glycines
  Coding regions on vcDNA: vcDNA=SeqID_64169; Strand=-; Position=1 -57,415-471
MDRARQVASDAWAVPAANRRPETVLAGASCGKIMKIL

SEQ ID NO: 137747 - protein, 80 aa, Heterodera glycines
  Coding regions on vcDNA: vcDNA=SeqID_64170; Strand=+; Position=1 -111,340-471
MHMPCSHLEPPPHSTAGEQAEFGGTVTTIQGNTVSRTVLLEKFLFEAKNEKWHHINMEISSVAFLSPFPQIGSDWTDHLS

SEQ ID NO: 137748 - protein, 57 aa, Heterodera glycines
  Coding regions on vcDNA: vcDNA=SeqID_64171; Strand=-; Position=1 -40,1377-1510
MPILTAMFCRGARAVQPGGECLYSSQCHAVYPGMLCSLSRCRCPNNQAPFFATINCL

SEQ ID NO: 137749 - protein, 362 aa, Heterodera glycines
  Coding regions on vcDNA: vcDNA=SeqID_64172; Strand=-; Position=1 -81,130-831,878-1183
MFCSFSKTPFHIIIHFFLIHISNAISSGDDKMLIAFVRNDQKIQISEYSMEKYEIHFGILYYMRKNWKCVKIAKEFDENERTECQKYRKYLDILYEYLCREYAGIPTVKPKFVFKNEIEFDGLIEIEGPIIYAVNCLAKISQFYFHKYSAVMMYKRKLNKLFTYHFEPKLLNEHRLNYNVKLVNEKPKVPINEMILQLAIDTAYGCQTNESVDGIFRQNFNEILGEMFKKAEQRAKREDNYGIFVTYDIIVRSIFDDYFVWTDDAIFTEFVKGQETNFEKFYRMLKEYYSNSVKSKEFYLQQYGAFFGLMYLMRKNWQCAKVGEDLKEKCQKYKKYLHILYEYFFRISAEGFCFPFNDHLIN

SEQ ID NO: 137750 - protein, 175 aa, Heterodera glycines
  Coding regions on vcDNA: vcDNA=SeqID_64173; Strand=+; Position=1 -204,255-578
  Homolog annotation: Hit_ID=CAE64794.1; Match level="QueryCoverage =64%, HitCoverage=37%, E-value=6e-22, Identity=50%"; Hit description =Hypothetical protein CBG09587 [Caenorhabditis briggsae]
MVRFAGLRGTTFILLDGTELPLVGLGTYGLLTQNDVDVAVDTALLSGYRLFDTANYYQNELELGNAFKKLLPKHNLKREDVFIVTKANIRSPKVEENAIAMVEHSLQSLQTEYNYILEFDLDLDLALQAHISRLFCSNTNFCQKKIQAWFFFLNLSYPEFCAVNPDSTWDPVQAF

SEQ ID NO: 137751 - protein, 639 aa, Heterodera glycines
  Coding regions on vcDNA: vcDNA=SeqID_64174; Strand=+; Position=1 -27,84-138,198-266,324-398,446-518,571-658,795-825,883-1040,1110 -1178,1290-1390,1442-1594,1719-1858,1915-2020,2184-2245,2327 -2485,2557-2714
  Homolog annotation: Hit_ID=AAD02835.1; Match level="QueryCoverage =98%, HitCoverage=75%, E-value=0.0, Identity=59%"; Hit description =acetylcholinesterase precursor [Meloidogyne incognita]
VLFWYGGGFWSGTASLDVYDGKILSSFWSGTASLDVYDGKILSSEEEEDVIVVTVNYRVTVFGFLYLGRQEAPGNMGLWDQLLALKWVHQEAPGNMGLWDQLLALKWVHQNIESFGGEPALVTLFGESAGAASFGGEPALVTLFGESAGAASINMHMLSPRSQPFFARAIIQSGSLSPRSQPFFARAIIQSGSATAPWAVENKQVALHRAVILYDYMKCGGAKEKMSQYMKCGGAKEKMSQLAPEAWNLDAVLECLLKASSERLRDAEWSPVMEFADFPWVPVIDGDLLEQSVSSSLKQGNFKRTQLLVGSNKDEAIYFIVYQLADIFPPSEFFSKKEFITTREEFITTRELWLKSISNLLPRQILKSSLSLQAIVQQYEPDGELPVEWWQWVDSLDKMLGDLLFTCNVNEFALAHAEHGAPTFYYVFSHRASQQTWPEWMGVLHGYEINFVLHGYEINFIFGEPYNRKQFNYTREERELSSRFMRYWANFARTGDPNRNADGSYTDTWPTYNTKGMEYTWPTYNTKGMEYMNLTVESDYSLRGARRIGTGPRRKQCKFWKQLMPKLLLLSADLGESFIRWKQHMERDLGESFIRWKQHMERWEQEYMADWEAAMNRWSRFQSYRDRDIAESIDQQGTC

SEQ ID NO: 137752 - protein, 44 aa, Heterodera glycines
  Coding regions on vcDNA: vcDNA=SeqID_64175; Strand=-; Position=1-132
MGTMEVKKLAKKSYRYLANGQRAEEKAQIIVQVVADVQQMQEVQ

SEQ ID NO: 137753 - protein, 139 aa, Heterodera glycines
  Coding regions on vcDNA: vcDNA=SeqID_64176; Strand=-; Position=1-420
MDWVIKKALLQLPNENDGANGQQLATRTDIFGELVALDERMFVGQPRKSVAALVVQQQSDENLWQIGKRKNERIKIKKRYRKTNDPNEQAYCNIDDMVQAVEVASESDHAVVDQRVVQLTANVQPDQCGHHQLISDNFS

SEQ ID NO: 137754 - protein, 35 aa, Heterodera glycines
  Coding regions on vcDNA: vcDNA=SeqID_64177; Strand=+; Position=1-105
MMRQMSIRRGPFVFGRVPLTFTFQSEVARRVVGEP

SEQ ID NO: 137755 - protein, 103 aa, Heterodera glycines
  Coding regions on vcDNA: vcDNA=SeqID_64178; Strand=+; Position=1 -96,147-360
MALFVNGHSKLEQNDSRALALGTLLVLVERWSRPFARKHKGKTKCRVFDQTFGQFGRTHRPQFTFADQCHLRIGRPRRKTYDYQSDWTETAGIPTENGKKGNE

SEQ ID NO: 137756 - protein, 93 aa, Heterodera glycines
  Coding regions on vcDNA: vcDNA=SeqID_64179; Strand=+; Position=1 -135,865-966,1291-1335
MAKRHRTEKKEGEETEEREEKENKEKGKEKETENEQEMRELGQMEKQTVTDANNPGEQKEASQSDAKALGEKQQNCYDEKTKANAEKQYEVGI

SEQ ID NO: 137757 - protein, 164 aa, Heterodera glycines
  Coding regions on vcDNA: vcDNA=SeqID_64180; Strand=+; Position=1 -76,819-1145,1377-1465
MSAISNSNFAQCFSGLRPDQSSSIGVPSGILTTEEFVGVYQFYCHPNFQWLHPLKFPRHGRISDRHHATLVLDIEKFSEFAQEIVGSERSSEAAFVSGMPWKIRATIKMAKQSTGKCLDIYLWCCAASVEEEGGAESISKIIGPGIPHFLGTGIFLSPISSGPG

SEQ ID NO: 137758 - protein, 45 aa, Heterodera glycines; identical to SEQ ID NO: 124527
  Coding regions on vcDNA: vcDNA=SeqID_64181; Strand=+; Position=1-138

SEQ ID NO: 137759 - protein, 83 aa, Heterodera glycines
  Coding regions on vcDNA: vcDNA=SeqID_64182; Strand=-; Position=1-250
MAKALALSKTHFWRHMMPGWECFSDRINSRDQLGFQSTGEMDHFCLKWKDMAWAAYVNVLSWECQNGIGGLTSSIALKPINER

SEQ ID NO: 137760 - protein, 55 aa, Heterodera glycines
  Coding regions on vcDNA: vcDNA=SeqID_64183; Strand=+; Position=1 -108,295-354
MAPKVISRRVIIEGTVIVISELANFYAFCANFKFEKKKMIAIVQQYIKEIHTFYM

SEQ ID NO: 137761 - protein, 96 aa, Heterodera glycines
  Coding regions on vcDNA: vcDNA=SeqID_64184; Strand=+; Position=1 -197,803-896
MDFRIPNPGLWARKNFKQDEGEQRIKPVGGRLGKKVDGGMCRALKRLCTSWRMEVIGDELLSVMDHENKAFSLTPKRRAKDVATKAKNTGAEKQRG

SEQ ID NO: 137762 - protein, 63 aa, Heterodera glycines; identical to SEQ ID NO: 130392
  Coding regions on vcDNA: vcDNA=SeqID_64185; Strand=+; Position=1 -97,316-410

SEQ ID NO: 137763 - protein, 36 aa, Heterodera glycines
  Coding regions on vcDNA: vcDNA=SeqID_64186; Strand=-; Position=1 -65,532-577
MAFHSTSKQCAKDARMLDEHGWLLDVNPGPSDQQQK

SEQ ID NO: 137764 - protein, 129 aa, Heterodera glycines
  Coding regions on vcDNA: vcDNA=SeqID_64187; Strand=-; Position=1 -278,525-638
  Homolog annotation: Hit_ID=AAM98012.1; Match level="QueryCoverage =85%, HitCoverage=16%, E-value=4e-34, Identity=61%"; Hit description =G-protein-linked acetylcholine receptor protein 2, isoform c [Caenorhabditis elegans]
IILPHLMVVLSINLIPPFYHHISPINFYFLQFFPQGSQSRSENRARKALRTITVILGTFILFWTPFYVLATVYGFCERCSSSAGFQALYTISYLLCYMNSPINPFCYAMANQQVKLIILILFNDNIRGG

SEQ ID NO: 137765 - protein, 98 aa, Heterodera glycines
  Coding regions on vcDNA: vcDNA=SeqID_64188; Strand=-; Position=1 -12,92-376
MSQEINEFIEPYSIKQSKRAEIGDFNGQIQKLIEEWVQNIPIANTDDSNFSKKLFFKSSFIRKSAKSKNPKERLLFDELRIGRVRLGFDLCGARPNKH

SEQ ID NO: 137766 - protein, 89 aa, Heterodera glycines
  Coding regions on vcDNA: vcDNA=SeqID_64189; Strand=+; Position=1 -257,389-402
HKLYEHGLTNSDNHERIHLIIHVLLVDAVFDRLARDLCRKTAFEVQFRNWAALAKQMEFQKEEIRSFVCNPLNNVNCLLTGGGGLGCPG

SEQ ID NO: 137767 - protein, 264 aa, Heterodera glycines
  Coding regions on vcDNA: vcDNA=SeqID_64190; Strand=+; Position=1-795
  Homolog annotation: Hit_ID=AAH44265.1; Match level="QueryCoverage =99%, HitCoverage=68%, E-value=3e-30, Identity=28%"; Hit description =B52-prov protein [Xenopus laevis]
MKSDRAKSNNGMKSDRAKSNYGTKSDRTKPNNGMKSDRAKSNNGMKSDRAKSNYGVKSDRTKPNNGMKSDRTKPNNGMKSDRAKSNNGMKSDRAKPNNGIKSDRTKPNNGMKSDRTKPNNGMKSDRAKSNNGMKSDRTKPNNGMKSDRAKSNNGMKSDRAKSNYGVKSDRAKSNNGTKSDRTKPNNGMKSDRAKSNNGMKSDRTKSNNGMKSDRAKSNNGMKSDRAKSNYGMKSDRTKPNNGMKSDRAKSNNGMKSDRTKPTNG

SEQ ID NO: 137768 - protein, 20 aa, Heterodera glycines
  Coding regions on vcDNA: vcDNA=SeqID_64191; Strand=-; Position=1 -37,479-504
MDLLLFVRIGVRAKVTLCKG

SEQ ID NO: 137769 - protein, 131 aa, Heterodera glycines
  Coding regions on vcDNA: vcDNA=SeqID_64192; Strand=-; Position=1 -67,447-541,587-727,773-864
  Homolog annotation: Hit_ID=NP_505704.1; Match level="QueryCoverage =68%, HitCoverage=32%, E-value=9e-15, Identity=50%"; Hit description =short-chain reductase family member (5L26) [Caenorhabditis elegans] emb|CAA98264.1| Hypothetical protein
MGNIKLVLLMLLNSFLFAQSEDRSSSGIGRDAAIEFAKEGANVVIHGRDKERLKETEALIIKEANVSNEKVLKVYGDIEKVETTTAIFDKTIKKFKQIDILVNNAGTVMLKGTKEQFDLNNLDYLYNVGLR

SEQ ID NO: 137770 - protein, 23 aa, Heterodera glycines
  Coding regions on vcDNA: vcDNA=SeqID_64193; Strand=-; Position=1 -41,462-492
MKYFAEIFDYLKKKKIKHGFKFD

SEQ ID NO: 137771 - protein, 97 aa, Heterodera glycines
  Coding regions on vcDNA: vcDNA=SeqID_64194; Strand=+; Position=1-291
MHMHIILCPSDRILEFIFRNIWPMIATNIHGLQLSKRSFRRLRQLAPSFLNDCPSLHFVSYYDDLFTEFPANDNATASDRQAVAKWLFTPLQNDVPK

SEQ ID NO: 137772 - protein, 59 aa, Heterodera glycines
  Coding regions on vcDNA: vcDNA=SeqID_64195; Strand=-; Position=1 -62,444-561
MSFFLRTNFNILSIKNAFSACTEYRQAFQTGFPFVFKRFSNANQAIPMHNGLPLGTTQC

SEQ ID NO: 137773 - protein, 92 aa, Heterodera glycines
  Coding regions on vcDNA: vcDNA=SeqID_64196; Strand=-; Position=1 -72,134-219,501-621
MAFRAGAGTGRELAQRPDQYLDILTNFDCCWSTPDEVHAIAEQLDEFVHHEIRGPYAGPGSEPSDCLRHCLLVFRVLDWHIGALCTFGQAKM

SEQ ID NO: 137774 - protein, 746 aa, Heterodera glycines
  Coding regions on vcDNA: vcDNA=SeqID_64197; Strand=+; Position=1 -56,98-431,476-676,899-1077,1121-1373,1831-1996,2037-2107,2149 -2330,2389-2497,2544-2724,2780-2928,2971-3075,3125-3376
  Homolog annotation: Hit_ID=NP_492796.1; Match level="QueryCoverage =99%, HitCoverage=85%, E-value=0.0, Identity=54%"; Hit description =mitochondrial ATP-dependent protease Lon (108.2 kD) (1L254) [Caenorhabditis elegans] gb|AAB97538.1| Hypothe
MVCDLKNPYVGIFVKRDDANTSDAVNSIDELYPVGTFGNVVELNRVHPKRLEMFVSAHRRIRLLEKLDTLDNEQVGRTQRRKKRVQPQQLTPNREEGANGTEEPQGEKPLLYARIENVVEPVFKPDDWMKATIDTIIMTIREIASYSPLFQQQIINLLIPKQNVTEDPIALCDLVGTIVETSTATTQDLQDLMEKTDLKAIKRELGIEKEDKQAVLEKMEERLANLKVPEYAMKVIKEEQAKLSFLDPHSSEFSISRNYLDWLTSVPWGKTSEENMDVHKARQILEEDHYGMKDVKERILEFIAVGILKQQTNGKILCFHGPPGVGKTSIAKSIARALNREYYRFSVGGMTDVAEIKGHRRTYVGAMPGKLIQCLKKVQTENPLVLIDEVDKIGREGYHGDPSSALLEVLDPEQNANFLDHFLDVPVDLSKVLFICTANVTDTIPGPLKDRMEMIEVAGYVAEEKLEIARKYLVPKCREKCALPDEKLVIKDDAIDSLIKSYCRESGVRNLEKHIEKIFRKSAYQLVSGEGAQTQILPIVVENSNLKKYVGREKFTSDRLYPTTPVGVVMGLAWTAMGGSALYVEATLARRLGTPSTDVQQVTDEKSHQKTVTGNLEVTGHLGDVMKESMRTAYTVAKNVLLRKDPQNEFLEKAYIHLHLPEGAVPKDGPSAGCTVVSALMSLALDRPVAQQTAMTGEVSLTGKILPVGGIKEKIIAAKRAGVGRIILPSENRKDFEDLADFIKKD

SEQ ID NO: 137775 - protein, 194 aa, Heterodera glycines
  Coding regions on vcDNA: vcDNA=SeqID_64198; Strand=-; Position=1 -286,523-821
MKMKCAKNANTTEEILRKNSKNKEKEKIREKKGQDEEEQIYKEITEIYRQNSETDELMELYEENEKWIRQSQNKKAKKKEKATKKGAKNGKEKEKNLLDDLVVKETFENVLLKKLDGKNIEITKNIILFVRAIETKLKFIKREEKRTENDQILDKFDEKWDSFMQSASIRSEELQFVHDKLYFIHEDIDQIAFE

SEQ ID NO: 137776 - protein, 104 aa, Heterodera glycines
  Coding regions on vcDNA: vcDNA=SeqID_64199; Strand=+; Position=1 -138,184-360
MLVIFPIDISFAIIYPIHNVLVILIRAYRSAFTKADFVSYCYWANTPLFLHSLVTVLLYIRFINRSSKITKRRNFVKRNLNEVGKTHFKFLEEQWNRKSAFSTD

SEQ ID NO: 137777 - protein, 73 aa, Heterodera glycines
  Coding regions on vcDNA: vcDNA=SeqID_64200; Strand=+; Position=1-219
  Homolog annotation: Hit_ID=NP_706904.1; Match level="QueryCoverage =100%, HitCoverage=11%, E-value=1e-33, Identity=100%"; Hit description=hypothetical protein SF0983 [Shigella flexneri 2a str. 301] gb|AAN42611.1| orf, conserved hypothetical
QIVNVDNQLNELTFREAEISQLYKKDHPTYRALLEKRQTLEQERKRLNKRVSAMPSTQQEVLRLSRDVEAGRA

SEQ ID NO: 137778 - protein, 73 aa, Heterodera glycines
  Coding regions on vcDNA: vcDNA=SeqID_64201; Strand=-; Position=1-409
GCKSRISRQKAKCETPKNANNAKGEMRKAKPRPIPAAHPSVTVFTSFGQFFGFVVLSLGSDANALLDWHSVSQ

SEQ ID NO: 137779 - protein, 156 aa, Heterodera glycines
  Coding regions on vcDNA: vcDNA=SeqID_64202; Strand=+; Position=1 -327,431-576
GRANLSGVASSANSALFGIGTAAVRPSSSSTASSTSTPTQSTTAQRRPIVLSAKASPSPPPPPPLLNIKSGGRTAQRVAVTTKEKQKTKQREEREHNETEDEIFLGGEVSLNGPTKFVENAIVKPKVPPKPDKNALIGVGQQQQKKRKEEVGGDRE

SEQ ID NO: 137780 - protein, 179 aa, Heterodera glycines
  Coding regions on vcDNA: vcDNA=SeqID_64203; Strand=+; Position=1 -49,134-356,656-738,890-975,1031-1128
  Homolog annotation: Hit_ID=CAE70680.1; Match level="QueryCoverage =99%, HitCoverage=60%, E-value=1e-62, Identity=49%"; Hit description =Hypothetical protein CBG17397 [Caenorhabditis briggsae]
MWLSPNGTIRNILGGTVFREPIICKNIPRVVPGWKKEIVIGRHAFGDQYKATDIVVPKGSKFEINIIKSDGQVERHSVFNFADTGGIIMGMEYKSKFEALGIYYEHRLIDDMVAQMLKTVLMCPDGKTIEAEAAHGTVTRHFREHQKGNPTSTNPVASIFAWTRGLEHRGVLDGNDALV

SEQ ID NO: 137781 - protein, 126 aa, Heterodera glycines
  Coding regions on vcDNA: vcDNA=SeqID_64204; Strand=+; Position=1 -37,365-652,1100-1155
MPGQTPAGPASVALHECSVFLLCLERLYEEATRLALRHVGLACAKECARRLDADSAAADAFAPIGHLASFHGPVDEEDFGESGDAGVQKMEQQQQQVQEMRKRVWMEIALWSSEPAIVVRCAVAFC

SEQ ID NO: 137782 - protein, 24 aa, Heterodera glycines
  Coding regions on vcDNA: vcDNA=SeqID_64205; Strand=-; Position=1 -52,295-317
MEKACKIWRDYIDFSALELLELAS

SEQ ID NO: 137783 - protein, 57 aa, Heterodera glycines
  Coding regions on vcDNA: vcDNA=SeqID_64206; Strand=+; Position=1 -160,446-459
MRPFLGVRRIISVYRTISGLRPFDCVQRTLTVPIEGKAPKRCTAEEAVRDIESGPMD

SEQ ID NO: 137784 - protein, 49 aa, Heterodera glycines
  Coding regions on vcDNA: vcDNA=SeqID_64207; Strand=-; Position=1-147
MTYYLDEDTPKRSNNDLYSCIRLDMNFTKCDQNDPGATIKISDANTNEW

SEQ ID NO: 137785 - protein, 291 aa, Heterodera glycines
  Coding regions on vcDNA: vcDNA=SeqID_64208; Strand=+; Position=1 -138,388-431,528-632,842-1014,1371-1467,1870-2072,3007-3063,3139-3180
  Homolog annotation: Hit_ID=NP_492127.1; Match level="QueryCoverage =100%, HitCoverage=87%, E-value=1e-124, Identity=33%"; Hit description=EGF motif related, Low-density lipoprotein Receptor Related (lrp-1) [Caenorhabditis elegans] emb|CAA981
CDGDNDCGDNSDETNDQCKVAVCEPPLRFRCAHSRLCLNILQLCNGFNDCGEHDFSDEHLSMCSSFSMCSSFSEYGDCSTDEFKCSNGKCINATLACDRKDDCGDATDEIGCAKNNGKSCHSKGDNGGCKHLCTDVQDGYYCHCRDGFRPDPANPFDCVDIDECQGNNTCTQQCLNTKGSYLCKCVDDYTSGVVIGAMAGKDCRANGEPALVMVAANNKVMQLNLVGARGRVNAAAESADVQADIAAVEFDPRREQMFWIDAYQKKVFRSALPKGNQSHEGQKLQIHLMTM

SEQ ID NO: 137786 - protein, 143 aa, Heterodera glycines
  Coding regions on vcDNA: vcDNA=SeqID_64209; Strand=-; Position=1 -186,430-675
MAIKYGPKIAKYGHKMAKIAKYGHKWQKCQNMDINFSKLSAKFLQIYWLKLHMRYISKFFDSKFWRKNDFLKNFSGFGLKKANLAAGGRSNRGFFEKCQNMDIKYGPKCQNMEKYGNMDINREIWKNMENMDIEILPRSFKPS

SEQ ID NO: 137787 - protein, 85 aa, Heterodera glycines
  Coding regions on vcDNA: vcDNA=SeqID_64210; Strand=+; Position=1 -150,559-666
  Homolog annotation: Hit_ID=NP_492127.1; Match level="QueryCoverage =51%, HitCoverage=0%, E-value=5e-09, Identity=54%"; Hit description =EGF motif related, Low-density lipoprotein Receptor Related (lrp-1) [Caenorhabditis elegans] emb|CAA98124.
MLQAESACARAQCTHLCAELPASGFRCMCPDNVTQFDDGSCGTVRIEELPANRESEELSNDNKNFLIWLIRKKVVSNGAEKAGAR

SEQ ID NO: 137788 - protein, 33 aa, Heterodera glycines
  Coding regions on vcDNA: vcDNA=SeqID_64211; Strand=+; Position=1-123
PITFFPLLGNNCTYFFTKNDQILAVLRQKTCKN

SEQ ID NO: 137789 - protein, 38 aa, Heterodera glycines
  Coding regions on vcDNA: vcDNA=SeqID_64212; Strand=+; Position=1 -68,360-408
MVAFAPPPAHANAVTLRANFAKSLIQEISFLKSEFLGA

SEQ ID NO: 137790 - protein, 16 aa, Heterodera glycines
  Coding regions on vcDNA: vcDNA=SeqID_64213; Strand=-; Position=1-49
EAIPEGFGLPINLGAS

SEQ ID NO: 137791 - protein, 54 aa, Heterodera glycines
  misc_feature (50)..(50): Xaa can be any naturally occurring amino acid
  Coding regions on vcDNA: vcDNA=SeqID_64214; Strand=-; Position=1-165
RNSFPIACTLILRWIFAPHNCLSTPNGHSKNRFICVFGAVPPNRCAQIYXETRS

SEQ ID NO: 137792 - protein, 47 aa, Heterodera glycines
  Coding regions on vcDNA: vcDNA=SeqID_64215; Strand=-; Position=1 -520,766-1081
LCFFFHLFQSASALRFCVLTLLFFPFIPIDHVNSFSIHLVTYFMKLY

SEQ ID NO: 137793 - protein, 45 aa, Heterodera glycines; identical to SEQ ID NO: 132754
  Coding regions on vcDNA: vcDNA=SeqID_64216; Strand=+; Position=1-398

SEQ ID NO: 137794 - protein, 17 aa, Heterodera glycines
  Coding regions on vcDNA: vcDNA=SeqID_64217; Strand=+; Position=1 -3,193-243
MGFLNDQTLFDLHVNFC

SEQ ID NO: 137795 - protein, 83 aa, Heterodera glycines
  Coding regions on vcDNA: vcDNA=SeqID_64218; Strand=-; Position=1 -136,194-309
MHYSASSIYLMRPEEHRFTNADSPYFRTNSSFLGIGMDKSVRIVENGLKQGDGAGAKAAMVVQVQKVSILMYLNFISLLDNYF

SEQ ID NO: 137796 - protein, 47 aa, Heterodera glycines
  Coding regions on vcDNA: vcDNA=SeqID_64219; Strand=+; Position=1 -83,899-959
MSTFWRLALVQKRLSDYFNAICEFNGKKADDNAIGTMRPQQLSAASA

SEQ ID NO: 137797 - protein, 192 aa, Heterodera glycines
  misc_feature (94)..(94): Xaa can be any naturally occurring amino acid
  misc_feature (138)..(138): Xaa can be any naturally occurring amino acid
  misc_feature (156)..(156): Xaa can be any naturally occurring amino acid
  Coding regions on vcDNA: vcDNA=SeqID_64220; Strand=-; Position=1 -190,234-417,478-643,694-729
  Homolog annotation: Hit_ID=CAE74275.1; Match level="QueryCoverage =100%, HitCoverage=48%, E-value=1e-29, Identity=39%"; Hit description= Hypothetical protein CBG21967 [Caenorhabditis briggsae]
LVEVSLFVLLVSPYLSKLPNSTVVLLDHAIHFNPGGLAQMEHRFGCIFDQNLYETFKRQMNPRNTCDPFLLSSFVPRPLLFVFVLLRLLPISVXLFLFAAPQNALSISLAKCILCVKPTIRYKKNAKSTPSKSFHRNXSHNSSTKTTFGVKENVPXLSPLPCGTQIPPKPPPLGYMDHRRNYNNAAFFAVSG

SEQ ID NO: 137798 - protein, 38 aa, Heterodera glycines
  Coding regions on vcDNA: vcDNA=SeqID_64221; Strand=+; Position=1 -97,571-590
MKLCLFKIIFAFYLLPYACLSLESLESLFDSEEWLVKK

SEQ ID NO: 137799 - protein, 161 aa, Heterodera glycines
  Coding regions on vcDNA: vcDNA=SeqID_64222; Strand=-; Position=1-484
AKSPCPSPSSPNSDFCPSFAMRRYAFIRSFYPILRFFADAYFLLADALFALYNAFQPIDQIGWASADPLLFIPANKAAEMIRRGSTDLGELMDVLRFAAKTDRCAVTRTIGVGNGRFGEEKCGGICHRSGFYVSIAPFLHGGFECADRTTLAKRAERSSEK

SEQ ID NO: 137800 - protein, 150 aa, Heterodera glycines
  Coding regions on vcDNA: vcDNA=SeqID_64223; Strand=-; Position=1 -233,878-948,996-1144
MRQDLIFHYYQAKANCNWPNNSAKQYSQELPKYLRGYHNIGKREAAQIGALILRAQTKDGKEPPLAHIQHILQQLIPNYFHITMEKGNRLLFETTLGHKMDDLLTSYIQAMIARRECITTKCQNERNAKSGNVLPYVPLLAFGDDRREFA

SEQ ID NO: 137801 - protein, 45 aa, Heterodera glycines
  Coding regions on vcDNA: vcDNA=SeqID_64224; Strand=+; Position=1 -60,107-184
MLKCPAWLVDLKRNIFTTRTLSLIRHGQTDGQGIQPEKAEAEMIN

SEQ ID NO: 137802 - protein, 123 aa, Heterodera glycines
  Coding regions on vcDNA: vcDNA=SeqID_64225; Strand=+; Position=1 -263,554-662
MANNNHCPPNVSVENDGGWTLAVRTKHGCRRRRVFSAKTTTKCGANLDGPSTNAFNEDGTEGGEVQAAVEELTLQMERLVCRMPHTFLVRQCTISSFLSWLCGRKEGNSALSDCLPIFPASLV

SEQ ID NO: 137803 - protein, 25 aa, Heterodera glycines
  Coding regions on vcDNA: vcDNA=SeqID_64226; Strand=+; Position=1 -15,250-312
MKNIKNLLNLNKVNASSSLFFIDKK

SEQ ID NO: 137804 - protein, 115 aa, Heterodera glycines
  Coding regions on vcDNA: vcDNA=SeqID_64227; Strand=-; Position=1 -171,360-535
  Homolog annotation: Hit_ID=CAE65896.1; Match level="QueryCoverage =30%, HitCoverage=5%, E-value=6e-10, Identity=82%"; Hit description =Hypothetical protein CBG11063 [Caenorhabditis briggsae]
GDERVGEGKEETVQEGGRKGLSFKVVADKNGNTVVYNDRDVPIGTGSVRKVGERSYESDHFAVGQPAVQSPEPKGRQWHDEADLVRPLLYPSLWLKLRVIQARLFRHVHRCHFAT

SEQ ID NO: 137805 - protein, 67 aa, Heterodera glycines
  Coding regions on vcDNA: vcDNA=SeqID_64228; Strand=-; Position=1 -96,151-258
MIKSILHDTGPLQKHKLVKKILETYKLNSKKHVNSRVKKTLRTYVGNGELAVAAGRYSVAASGGGDK

SEQ ID NO: 137806 - protein, 53 aa, Heterodera glycines
  Coding regions on vcDNA: vcDNA=SeqID_64229; Strand=-; Position=1 -66,628-723
MKETPQNRSTFMRDQQFMDRLTVDVFIATKTDPHNRTRFQKRPTKRLSSIKKS

SEQ ID NO: 137807 - protein, 181 aa, Heterodera glycines
  Coding regions on vcDNA: vcDNA=SeqID_64230; Strand=+; Position=1 -190,231-302,345-628
MSVNLYCKGITDPVVIPIRPKEQISADTILNEFIKLQQSYSEINLLDQEISVIFTTYSTPAGSGRKSNKLMEKNDLSRIRISNADSFGLFYALELTRHYQLINNGITYKKYLCIINNPKKQKTIVRDLMNEADINQKEKSYGLDHIKLIQNFWDQKYSKIYRIVAFDDVRIFSKKLSLFVF

SEQ ID NO: 137808 - protein, 71 aa, Heterodera glycines
  Coding regions on vcDNA: vcDNA=SeqID_64231; Strand=-; Position=1 -189,254-280
MSSPPPLSEKSQQPLATGNDGTAAATTTAQQASPLKSGGGGVKDSPKLGKKRRTSATTTAPTVNFGSIIAN

SEQ ID NO: 137809 - protein, 74 aa, Heterodera glycines
  Coding regions on vcDNA: vcDNA=SeqID_64232; Strand=-; Position=1 -54,93-263
MKNKVLVPQKPSNWNHKQPSPSFANVKIGNKIQCMAKNICDLFVSLILSLNELPKICSFFKECNVEASKAYETL

SEQ ID NO: 137810 - protein, 26 aa, Heterodera glycines
  Coding regions on vcDNA: vcDNA=SeqID_64233; Strand=+; Position=1 -20,631-691
MVPVWRWCTRRSKSSLRTRRRSMPFW

SEQ ID NO: 137811 - protein, 27 aa, Heterodera glycines
  Coding regions on vcDNA: vcDNA=SeqID_64234; Strand=-; Position=1-83
FKSHREAGQFQNFVPHFTAESPSTLNG

SEQ ID NO: 137812 - protein, 35 aa, Heterodera glycines
  Coding regions on vcDNA: vcDNA=SeqID_64235; Strand=-; Position=1 -61,170-216
MPKYGCQIWKYGKKSEIWKIFPGSLCNIYFDIDFI

SEQ ID NO: 137813 - protein, 72 aa, Heterodera glycines
  Coding regions on vcDNA: vcDNA=SeqID_64236; Strand=-; Position=1 -84,532-666
MDPIQARPSNYDDSELISLIQFHSIDIILLTLLAAADLCTSLGIFVLGLMRKALYEQVMETSPIPMRNGEQK

SEQ ID NO: 137814 - protein, 22 aa, Heterodera glycines
  Coding regions on vcDNA: vcDNA=SeqID_64237; Strand=+; Position=1-70
ITGSSIIAVLFLSFDASQIWSL

SEQ ID NO: 137815 - protein, 171 aa, Heterodera glycines
  Coding regions on vcDNA: vcDNA=SeqID_64238; Strand=+; Position=1-516
MDLDALRRRIVTLEQEMRENGGTRSGLPMPTTFDGTTDLQDYLKSFNLIATAHNWTPARFVQVLPLFLRGSARATYENIEPDIKDNWRSLIDAMADKLKQMSPSLTARQKLAQRKQLTGESLEEFAQAIRNLVLRAYPDNSLEMDFGNLVLGALENDVKQANEVRLRQFRS

SEQ ID NO: 137816 - protein, 163 aa, Heterodera glycines
  Coding regions on vcDNA: vcDNA=SeqID_64239; Strand=+; Position=1 -236,973-1029,1082-1280
  Homolog annotation: Hit_ID=NP_510513.1; Match level="QueryCoverage =88%, HitCoverage=58%, E-value=2e-16, Identity=59%"; Hit description =putative protein, with at least 5 transmembrane domains (XP730) [Caenorhabditis elegans] pir||T20628 hypo
AEEDSADASAEDEDTTTPQLFIAEILQIHLYKPSEFLKNLIQETLLSLAQNGSLLGLTNLLVLVLVVINRSVDWSKTVNDSSPFRRRETLFQTLVLSLIAFFLSLFSQSFIEMYVMVVNDRREIAWWASVYQLSRIAAFIDPLFNPVLVAVRTPIIRRRVNYH

SEQ ID NO: 137817 - protein, 188 aa, Heterodera glycines
  Coding regions on vcDNA: vcDNA=SeqID_64240; Strand=-; Position=1-566
MLSPTFTVRGSIHVDNFGVLLDPDGKLGNHLSLVRVGQLIIAQARLCLVPERQSPLWFIVNVICEEKEEEYVKEEEADVGDEQSHAYDLMSEDNQNKENETEIGGEPDDEFDVIDGGFGGGWKKTEKKRVEAELKREEKSCVEESLDASIGESSISSSESIRSATENLPMSDGIALFIQIRSYEWILA

SEQ ID NO: 137818 - protein, 220 aa, Heterodera glycines
  Coding regions on vcDNA: vcDNA=SeqID_64241; Strand=+; Position=1 -91,138-269,334-696
  Homolog annotation: Hit_ID=NP_497599.2; Match level="QueryCoverage =97%, HitCoverage=48%, E-value=3e-52, Identity=36%"; Hit description =myotactin, LEThal LET-805 (479.6 kD) (let-805C) [Caenorhabditis elegans] gb|AAK21414.2| Lethal protein 80
AGTVHGFGPEIWARFRTDPFKVPSVLNAPIVIPEGAHTLHVEWQGVVIPEGAHTLHVEWQGVHDAHGRVAGYIVEIRTSDAPQWTEMGGVVRHEPSRRTYKVRHEPSRRTYKTRLDGLEPDTLYFVRIKVVDHRQRVSDASPEAQGRTGCAPPTLPPTNVELTSPVDCHVRVSWQPPSKESWLCSAIRYRIEYKNGTQPAREAEVPSKIRSHYYKRSCLI

SEQ ID NO: 137819 - protein, 44 aa, Heterodera glycines
  Coding regions on vcDNA: vcDNA=SeqID_64242; Strand=-; Position=1-132
DRAQIELARKAKLRVDALFKDVLDKRYDAVVLPGGQPGSDNLAA

SEQ ID NO: 137820 - protein, 30 aa, Heterodera glycines
  Coding regions on vcDNA: vcDNA=SeqID_64243; Strand=-; Position=1-92
DYFSKHLVDWGIIGDCGINRDWAIIRAIYG

SEQ ID NO: 137821 - protein, 92 aa, Heterodera glycines
  Coding regions on vcDNA: vcDNA=SeqID_64244; Strand=-; Position=1 -138,219-359
MALTLPLYFFDGIRRLLPPRVSSSPSTSDQYRLASHIIAHCSIFDQVRWRRVSKAFKQAIDARINKYTRIDVRCYPGLSQLSEEGTRGRGFG

SEQ ID NO: 137822 - protein, 22 aa, Heterodera glycines
  Coding regions on vcDNA: vcDNA=SeqID_64245; Strand=-; Position=1 -9,289-348
MLTKRPTTSYMEATRDKIDYNN

SEQ ID NO: 137823 - protein, 32 aa, Heterodera glycines
  Coding regions on vcDNA: vcDNA=SeqID_64246; Strand=+; Position=1 -87,691-702
MHIANAKVQFAICMRVHAHVCACVNERVSICT

SEQ ID NO: 137824 - protein, 234 aa, Heterodera glycines
  Coding regions on vcDNA: vcDNA=SeqID_64247; Strand=-; Position=1 -233,280-436,680-736,781-1038
  Homolog annotation: Hit_ID=XP_395616.1; Match level="QueryCoverage =72%, HitCoverage=49%, E-value=2e-19, Identity=34%"; Hit description =similar to ENSANGP00000021998 [Apis mellifera]
MQKGDKDWQPSLGSILELQFLSTNNGGLGVPIEGITSPYFYLRKAGSYFTAHTENSDLYSVNLLCPSSGTDNVGITIWYSIPAADFLKFKNLLSTFFVKEFTNDPEYLRNKSILVNPNIIRENRIRCIRTRAGEGIITLPGSVHFGFSTGLNCAVAYNVGPPSWIPYGIDSKPCSGVYKYAFIEAFELAKLYVLKCEDGDTARAAELWNTKYKNILNYGHGFDPIYPNCRPTIT

SEQ ID NO: 137825 - protein, 91 aa, Heterodera glycines
  Coding regions on vcDNA: vcDNA=SeqID_64248; Strand=-; Position=1 -145,192-322
MELPQQAKFVTMERNPEYVAPFSKGDKIGVFHNKRENCLSYFLNGDLLGQNKQFIADSSGLWPAVTLRHPGDRVEFRVDSELGQMPGGLWK

SEQ ID NO: 137826 - protein, 16 aa, Heterodera glycines
  Coding regions on vcDNA: vcDNA=SeqID_64249; Strand=-; Position=1-49
EAIPEGFGLPINLGAS

SEQ ID NO: 137827 - protein, 113 aa, Heterodera glycines
  Coding regions on vcDNA: vcDNA=SeqID_64250; Strand=+; Position=1-342
MDLVESGLLADSLREEGVQRAELKRKAKVALDLIDAGLTGDALHEEGQRWKKAKTALSVLGNMLLADSLPEKKTAELPLPPAEKIESLPLPPLEKMKTPPLPPADKMPSPLPP

SEQ ID NO: 137828 - protein, 53 aa, Heterodera glycines
  Coding regions on vcDNA: vcDNA=SeqID_64251; Strand=-; Position=1-209
LFSFSTKLNILGIIRKHSKNAISLQIFQNFYLYTKKSEPKKVRITGVLSSFWP

SEQ ID NO: 137829 - protein, 30 aa, Heterodera glycines; identical to SEQ ID NO: 126607
  Coding regions on vcDNA: vcDNA=SeqID_64252; Strand=+; Position=1-91

SEQ ID NO: 137830 - protein, 224 aa, Heterodera glycines
  Coding regions on vcDNA: vcDNA=SeqID_64253; Strand=+; Position=1 -178,230-423,641-845,1462-1559
  Homolog annotation: Hit_ID=AAL78224.1; Match level="QueryCoverage =14%, HitCoverage=14%, E-value=9e-11, Identity=100%"; Hit description= hypothetical protein Hgg-30 [Heterodera glycines]
MRMQNPAGLMGTMYAPASGGFFLPQAIQNQRAAPFMQTPNLSGAQMRGAVPRWNNMGGFNHPMQGYMMGPAGGGQFGGANQIARGGPRSGGGGGMRQYGGQPRQQQNRMPGMGGGHQQQGMRYQGQPRGMQQQQQAQQPQIAYSSYPQQQSRGGMAPQMGGGGGGGVKADHAITATHQEPLNTHDAYRGCHHFVAWRRGNVAFARGRSSNSALPGHGSEGGAVG

SEQ ID NO: 137831 - protein, 101 aa, Heterodera glycines
  Coding regions on vcDNA: vcDNA=SeqID_64254; Strand=-; Position=1 -150,206-355,929-936
  Homolog annotation: Hit_ID=EAA59983.1; Match level="QueryCoverage =91%, HitCoverage=29%, E-value=3e-15, Identity=44%"; Hit description =hypothetical protein AN3775.2 [Aspergillus nidulans FGSC A4] ref|XP _407912.1| hypothetical protein AN3775.
QFFPLLLTAEAGHLDVCRVLVEKGAALDQQEFFGKTPLICASGAGRLDVVAFLVDMGTAVNKTDGGGYNPLMYAVENGHTEVARLLLEKGADKEQIGADAL

SEQ ID NO: 137832 - protein, 234 aa, Heterodera glycines
  Coding regions on vcDNA: vcDNA=SeqID_64255; Strand=-; Position=1 -195,358-538,946-1272
MVFARFWDGNDFSVFPHLWYNAGRDGQIEEIGHIFNGNGAEVANLSSGDVVGAKGGRIFGGNDAAWKFWCRKYRTYIDCEGGDMELKRHLQEDEREQVGQTLVDGPPPSEAQHRHALRHAPPPPNPPGGGGSGGSNNKVSSTPAKLRSTNGNNNKRPRPPLLELESDDDDAVVIENAMQTRDAIGRAMPRHEVPRKRTVLEEEENGNGGGEQQRILRPPPIRFGFLLLPKLRHC

SEQ ID NO: 137833 - protein, 629 aa, Heterodera glycines
  Coding regions on vcDNA: vcDNA=SeqID_64256; Strand=+; Position=1 -85,1145-2960
  Homolog annotation: Hit_ID=NP_500640.1; Match level="QueryCoverage =98%, HitCoverage=67%, E-value=1e-108, Identity=35%"; Hit description= reverse transcriptase family member (4F533) [Caenorhabditis elegans] gb|AAK39265.1| Hypothetical protein
PPPLKADAQWTWRRRRRQCRNDDSVAPLGGGVGLIITHSGIISSKNSTALGPDNISAAQIRHLGPIAIEYMANLFNLSISSGIIPQMWKNAKVIPIPKPGKDHTNPANFRPISLLSPIAKILERLLLPSLNTHLPPAPHQHGFRHGFSTVTALHSIYRFITDGLNRKQPVERTVAVALDLSKAFDTVDHRLLISNIEHLNNNTPCYKRWLANYLGGRQAQVTFRDTTSPLHTIRMGVPQGSVLSPTLFNFYTANFPSPPPGILVTYADDITILARATQINSASDQINSFLPRVISWLNDRKLILSTSKSSSTIFTTSSHEHRIDPHIHANDCPIPVLRNPKILGITFDPQVTFNAHVSTLRTKLQKRNNILRALAGTTWGQCKEVLSTTYKAIGRSLLNYAAPIWSPQLADSHWSTLQRCQNSALRTTTGCVTMTSSEHLHSETSILPAKDHNFLLSQQFLLACRAPTHPSFDVSPSSISPNEMDPRAFGHIIDSTLSDTRGEILPAQKLLHTRMVATTIRSSTNRILGKPPPPIDNSETSLPRVARSRLAQLRAGFSPLINSYNAKINPHITNSCPACNATPHDTIHLFNCTANPTNLTTQTLWTHPRLAATFLKLMPVIPFTQQGVG

SEQ ID NO: 137834 - protein, 160 aa, Heterodera glycines
  Coding regions on vcDNA: vcDNA=SeqID_64257; Strand=-; Position=1 -61,305-508,1113-1208,1253-1371
  Homolog annotation: Hit_ID=XP_414291.1; Match level="QueryCoverage =39%, HitCoverage=10%, E-value=4e-09, Identity=41%"; Hit description =PREDICTED: similar to RNA-binding protein 5 (RNA binding motif protein 5) (Putative tumor suppressor LUCA
MRHTTGQGRSICIGRQGFDDALLIRELPASADDLSVRHAVVRFTDVEPLNVRLAASRLFAFIQMGSLFDAEMAHHKLQRTCLYIDNCADVQIIDQTTHNQSSSSSTANSVNTPFGILPICSEPDPAKFQYEHSSGYFYDPATGFYHDPKTEFYYSAKSRS

SEQ ID NO: 137835 - protein, 87 aa, Heterodera glycines
  Coding regions on vcDNA: vcDNA=SeqID_64258; Strand=-; Position=1 -58,257-460
MFKAGLKLAFLLFAALFPSVPALRCVSSIALTYINNMTGGVMIVDLSKPVECAFGCARGTCSMNFGGELNSHFGLRIVRTLGDDGDY

SEQ ID NO: 137836 - protein, 25 aa, Heterodera glycines
  Coding regions on vcDNA: vcDNA=SeqID_64259; Strand=-; Position=1-75
TCTCGVVVKLSTFHNFSPGFNSPLG

SEQ ID NO: 137837 - protein, 20 aa, Heterodera glycines
  Coding regions on vcDNA: vcDNA=SeqID_64260; Strand=-; Position=1-59
RRGTTVIRRGTTVIKRGTKV

SEQ ID NO: 137838 - protein, 81 aa, Heterodera glycines
  Coding regions on vcDNA: vcDNA=SeqID_64261; Strand=+; Position=1 -53,449-641
MSSNEEEESGGSNDDQFSSPISPVSPIQPMSTDWSNAIDAQEMGAGGVGGGISSGSLHESLHELSRWKIFGKKIDASLHTL

SEQ ID NO: 137839 - protein, 79 aa, Heterodera glycines
  Coding regions on vcDNA: vcDNA=SeqID_64262; Strand=+; Position=1 -186,330-383
MAIKYGPKIAKYGHKIAKISKYGHKWQKRQNMDINFSKLSVKFLQIYWLKLHMRYISKFFDSRKINNKSEIFAFLLILT

SEQ ID NO: 137840 - protein, 50 aa, Heterodera glycines; identical to SEQ ID NO: 135818
  Coding regions on vcDNA: vcDNA=SeqID_64263; Strand=-; Position=1-154

SEQ ID NO: 137841 - protein, 85 aa, Heterodera glycines
  Coding regions on vcDNA: vcDNA=SeqID_64264; Strand=-; Position=1 -109,461-609
MWHTHVRHADVFGLGIYLTTREIVLTKNGTPFGLFEFTAAITVPFPIDHLQQQQQQLFPFVSLLSPADQIEANFGPNFLFTNTQK

SEQ ID NO: 137842 - protein, 27 aa, Heterodera glycines
  Coding regions on vcDNA: vcDNA=SeqID_64265; Strand=+; Position=1-81
QGGFMGSARVLPLAQMAALRLHFWRRR

SEQ ID NO: 137843 - protein, 168 aa, Heterodera glycines
  Coding regions on vcDNA: vcDNA=SeqID_64266; Strand=-; Position=1 -126,337-540,628-705,920-1018
  Homolog annotation: Hit_ID=NP_714132.1; Match level="QueryCoverage =97%, HitCoverage=61%, E-value=2e-12, Identity=29%"; Hit description =Huntingtin interacting protein E-like protein [Leptospira interrogans serovar Lai str. 56601] gb|AAN51150
MFMTWTNDEKYSGKTMFMDDDDLLKEVLNNYEIINAPSVTEGHIKELNAIARRRIYGGGIYRTGLVGVGDYTAIDAAAVPSAMKELVETINQPKDPLENIKMAISAHLELLKIHPFDDGNGRTSRLLLNVLLFKKGHKPILFKPVDEDKYVSCIKVYTLETPENKFGI

SEQ ID NO: 137844 - protein, 162 aa, Heterodera glycines
  Coding regions on vcDNA: vcDNA=SeqID_64267; Strand=-; Position=1 -153,317-652
  Homolog annotation: Hit_ID=NP_492258.1; Match level="QueryCoverage =42%, HitCoverage=6%, E-value=5e-20, Identity=70%"; Hit description =probable electrogenic sodium bicarbonate cotransporter protein NBC (124.6 kD) (1I874) [Caenorhabditis eleg
MPDFHLRRREDKEKRQSQPGQPFDIDLNENQGTIRAVKTEAHLHIPMSSGNVIKIPLAAIQEPSRNIDIKQMRSDMCASGICGPFLKGHFRTFAKSPPPAQSHFISSRSTHSLTNVLCFGYCVKLFFWGHLLSIGKCRWLLLLVNLTQCFLTSLTNLAWLFY

SEQ ID NO: 137845 - protein, 144 aa, Heterodera glycines
  Coding regions on vcDNA: vcDNA=SeqID_64268; Strand=+; Position=1-518
ALPQAKPSGAYVSCFSNASTLVPRQGVPIHELIGLVNHGNTPLTRIPTPPPTLGSASPVLSSPQHLCLRPHLHKSINSPNFFNTQTSCMFIHFDSCQSLEKLRPRQRWHPSSSHHRSMPSTSASKHLNPDGRAPHSEIASFFQP

SEQ ID NO: 137846 - protein, 190 aa, Heterodera glycines
  Coding regions on vcDNA: vcDNA=SeqID_64269; Strand=-; Position=1 -176,288-405,553-714,792-907
  Homolog annotation: Hit_ID=XP_308493.1; Match level="QueryCoverage =100%, HitCoverage=20%, E-value=5e-40, Identity=42%"; Hit description= ENSANGP00000022800 [Anopheles gambiae]
HQKISGQLREKDDVNLKLMSERIRSTQAQKKMRDEKELLDQNIQSLENQLATKLLHCQRIRDQNNETLRKKGIEFSQLATDLRLRLDRLDIQFTELRESVIKKASSYEANANKIKRLEEEKSSLKRKLDRAKRMEKYENVDELLQEENRILKESLTCPSCKVNRKNAILDKCHHVFCFECIRLRYDNRRR

SEQ ID NO: 137847 - protein, 87 aa, Heterodera glycines
  Coding regions on vcDNA: vcDNA=SeqID_64270; Strand=+; Position=1 -60,840-959,1033-1113
MDSCESVGTTDAEGAEQKQNIVELKDSIVGSLIELRDIDKCVEKIMTSKESMNEEDEVNQINWSCWDDAISCFHITWEYSILYSLKR

SEQ ID NO: 137848 - protein, 152 aa, Heterodera glycines
  Coding regions on vcDNA: vcDNA=SeqID_64271; Strand=-; Position=1 -105,148-375,427-554
RGRGGRGIAPSQTENGTTHLQNDGLGVISEANLNEGTIIDFSDSQPSQQPPIVNVPTRGILRNCNGIDAASDVQKANGTATNEGEHQLPIADQPVPFGGASVPRVASVTGLLNTHNLVVSTSTKQQHQSSTSECGDFATQIGHLRLDDRFQW

SEQ ID NO: 137849 - protein, 127 aa, Heterodera glycines
  Coding regions on vcDNA: vcDNA=SeqID_64272; Strand=+; Position=1 -249,661-795
MAPNNKKPPTPTKKTSRASSSQFAASCGTDGFDDCPPSLASSSLRAIGLSFVRAKLRWRRLDEFRLECRRAVIGWAFINESLKFSYFSGKACSNISGGRKSGHSTSRLQGKSTKFGLGPFAVQSTHI

SEQ ID NO: 137850 - protein, 28 aa, Heterodera glycines
  Coding regions on vcDNA: vcDNA=SeqID_64273; Strand=-; Position=1-86
ISSNYLSGQHNTAKIQYIHIAISDQKRT

SEQ ID NO: 137851 - protein, 184 aa, Heterodera glycines
  Coding regions on vcDNA: vcDNA=SeqID_64274; Strand=-; Position=1 -278,339-615
MTTPSIRLIATSKAPAATGYRWKQWTTIVKAQFFCFLQPGSARQQPDAVRERPDRDDIRKDGCGAGWSARRGEAGDDQHRGDSDVRRLVLQARYQLQHHGDQHERLPGCQRNVQELLHPGHVPCAQLLPGGQVAEECTRHDRCGGGCCGPVSRSAEERTDEQQMYIRVLYIDVIMYSILLYYCV

SEQ ID NO: 137852 - protein, 150 aa, Heterodera glycines
  Coding regions on vcDNA: vcDNA=SeqID_64275; Strand=+; Position=1 -108,161-328,384-561
  Homolog annotation: Hit_ID=1NQ3; Match level="QueryCoverage=82%, HitCoverage=89%, E-value=9e-20, Identity=46%"; Hit description=Chain F, Crystal Structure Of The Mammalian Tumor Associated Antigen Uk114 pdb|1NQ3|E Chain E, Crystal Structure
EQTTNVLISETTILQMAAPSIRLITTSKAPPATGHSQAVLLNNQTLYISGQTGIAAGSTNVVPGGARAEAKQAMTNIGEILTYAGSSFKHGADQLQHHGGRMSDFQAVNETIKNFFTEDTYPARSFFQVVKLPKSAYVMIDVVAIVQGQS

SEQ ID NO: 137853 - protein, 73 aa, Heterodera glycines
  Coding regions on vcDNA: vcDNA=SeqID_64276; Strand=+; Position=1-222
MCRLCRLDSVVAHLLKDNLEWTFPEAIEHEMDSNNQITLASLAAAENQNFSAQNSKIFLGGTIGGDTLSLSMN

SEQ ID NO: 137854 - protein, 147 aa, Heterodera glycines
  Coding regions on vcDNA: vcDNA=SeqID_64277; Strand=+; Position=1 -258,390-500,542-615
  Homolog annotation: Hit_ID=CAE73564.1; Match level="QueryCoverage =82%, HitCoverage=13%, E-value=2e-24, Identity=48%"; Hit description =Hypothetical protein CBG21034 [Caenorhabditis briggsae]
MSCSILADSKKILVLLNFQLVQCTLSESQTFNWLTVNSYQLHPTTPVLKCRLSQALEQIQPAMAVGVQPANLHKFNSIFKRTIANWFVQSSAVDFLHLLLVCMRWLCREYEIPARYVISIHDEVRYLVPEKDKYRCALALSLSNMYV

SEQ ID NO: 137855 - protein, 24 aa, Heterodera glycines
  Coding regions on vcDNA: vcDNA=SeqID_64278; Strand=+; Position=1-76
ITGVSIIAVLFLVFLMPSQNLVRF

SEQ ID NO: 137856 - protein, 129 aa, Heterodera glycines
  Coding regions on vcDNA: vcDNA=SeqID_64279; Strand=+; Position=1 -30,461-656,699-839
  Homolog annotation: Hit_ID=NP_689647.1; Match level="QueryCoverage =92%, HitCoverage=14%, E-value=4e-26, Identity=48%"; Hit description =CWF19-like 2, cell cycle control [Homo sapiens] dbj|BAB71307.1| unnamed protein product [Homo sapiens]
NFHKFQPLYFKKAIMESEKEWSNNQKLIDLAKTSKANVRGTIPKGFPYFTVNFGLQPGFAHVVEDERKFPFNFAQEIIGGMLEIIGGMLDLPHSHWRKPKKQSFDQIMERRNKLKKNWTKYDWTEIVRR

SEQ ID NO: 137857 - protein, 125 aa, Heterodera glycines
  Coding regions on vcDNA: vcDNA=SeqID_64280; Strand=+; Position=1 -89,816-1104
MWQQHPEFQPNSESGSAKEFSSCLVKCITTIMNDKTDYYGSAASRPRTLLLAFSYGTTGTQFFDIPNTGTQPSGISTLGLNPSAFQTLGLSPPAFQTLGLNPPAFQTLGLNTPAFQTLRLNPPPF

SEQ ID NO: 137858 - protein, 74 aa, Heterodera glycines
  Coding regions on vcDNA: vcDNA=SeqID_64281; Strand=+; Position=1-225
MPLFSHRIGQRRVPCVRHVQQQMRSSEWAATATGPWRVRLGQQTFAVRNQRDGVVEATLCQKGKFIQKKEKPFY

SEQ ID NO: 137859 - protein, 84 aa, Heterodera glycines
  Coding regions on vcDNA: vcDNA=SeqID_64282; Strand=+; Position=1-255
MNAREWCQESGPLGTPPANFKEFFICMFTPEPRSPQQKFLEISQPKAMLAKCSNSKLENINENSFGLQSVIVPKVCKNPCKTHF

SEQ ID NO: 137860 - protein, 137 aa, Heterodera glycines
  Coding regions on vcDNA: vcDNA=SeqID_64283; Strand=-; Position=1 -127,1039-1133,1590-1778
SYWATRMGPEYDVIVVDVRPDERVLEDGGLGIEWQGTVDICDEHINFVMPSEQSLPLAYPILASLMSIDQHFIKAKSELRLADLAASVADDDEDDGSGARPLSPGGTAARRRCRASSAAGANRWLRSRSLENLSGFA

SEQ ID NO: 137861 - protein, 251 aa, Heterodera glycines
  Coding regions on vcDNA: vcDNA=SeqID_64284; Strand=+; Position=1 -481,753-1027
  Homolog annotation: Hit_ID=AAC95573.1; Match level="QueryCoverage =91%, HitCoverage=29%, E-value=1e-10, Identity=21%"; Hit description =orf 48 [Ateline herpesvirus 3] pir||T42963 hypothetical protein 48 - ateline herpesvirus 3 (strain 73) ref
MVAQQQKPRRKRSRSEDMHKEEPEDDDEEDEEEEATARKRKRSEEAVDEAPQRSSDGGDEEKQQRSSNNHNIHRHKREQHHHREATARSNSGGKTATTKTPPAAQEKRKMKPPRKHADNGGGDDAVKEENAATDDVMRSGAAAAADEAEAAHGLEEVDSVGKQFDWEGGEEEEEDVELGFDLVENDHLDHGNDDGDDETVVVAVVMQNDDEADNGGGDQSVAEHEQQQNGHDQQLQVFLGTCKKWVFDIFG

SEQ ID NO: 137862 - protein, 68 aa, Heterodera glycines
  Coding regions on vcDNA: vcDNA=SeqID_64285; Strand=-; Position=1-207
ILYLTKALAYETEGLCTIAILFHRGFLYLEVIPEKWLSLFLINFIHIQMLSSMIERAVRNRPFIFEGI

SEQ ID NO: 137863 - protein, 92 aa, Heterodera glycines; identical to SEQ ID NO: 127421
  Coding regions on vcDNA: vcDNA=SeqID_64286; Strand=-; Position=1-304

SEQ ID NO: 137864 - protein, 85 aa, Heterodera glycines
  Coding regions on vcDNA: vcDNA=SeqID_64287; Strand=-; Position=1 -42,208-423
MTLACDTISYVPSYFVLFLPKALTKMGISGTPSINARQFQAAVRVPNGLLKLGQPFVGPGQIEQRLGLHKIVLVTVGQVDLLNGL

SEQ ID NO: 137865 - protein, 251 aa, Heterodera glycines
  Coding regions on vcDNA: vcDNA=SeqID_64288; Strand=-; Position=1 -264,313-375,429-527,602-931
MPTLQAEQHPPPLSPQTNNVQQQQPTVPSPLNERQQSVQPTQGEHPQIRANATLQTNMVQAQQQQQQSHQFLALDHDNDDQLLNQIFLDLTTSAEMQPIALDNNNNNNMNPQISSSASSSRRRNNANAGRGRGRGGGTRRRANARQQPQSERIQSSQPQTVQILSPSVVQHGQGLTREQCDSILPNLEVNEAMVRNDERCVICQMGFDLGSLNATELPCKHLYHLSCARDWLMHQNRCAICMRRFVLDSDA

SEQ ID NO: 137866 - protein, 127 aa, Heterodera glycines
  Coding regions on vcDNA: vcDNA=SeqID_64289; Strand=-; Position=1-384
MSQMLPFVQSPFFNSMPMPHQFPHLPFLNQFAHPIMGPFPHPVFVHTSSPSPFPLPPGITFSNRQQIERIATHVHGQNIAQQQQQQIVPRTNEGIAGVGPWQEEFYQDGTTTNDFLDFNRQIGSYIP

SEQ ID NO: 137867 - protein, 315 aa, Heterodera glycines
  Coding regions on vcDNA: vcDNA=SeqID_64290; Strand=-; Position=1 -85,366-473,1002-1187,1411-1511,1558-1872,1926-1992,2041-2125
  Homolog annotation: Hit_ID=CAE74079.1; Match level="QueryCoverage =77%, HitCoverage=19%, E-value=2e-18, Identity=27%"; Hit description =Hypothetical protein CBG21734 [Caenorhabditis briggsae]
MPTNFGELRERICEEIGYGNGTMKLIHKGKYIIAPMDRRLAEHKLKDGDRIFAIGVVATPKPALDFNMSCGVCGGKIWLKWANQCEKCDLVCHTNCLEGAQSKECQSTDQYTFDDDTFIKLASDEIALTLKSVQEYSRRRTVQKGQSAENENSTSDIGWTNPPVLQNRLFRLGRKGLLEWYPLRKCSRWICSTLSRDLAQNRNLVISNLNRVKLFAFIIKCELIGLSFPTGNAYNPQVVCEAKVKGQRLFDWCETEERKKRINGQIDLVQAEIEAVTRLRRSLPNKSGVDFERIEHRLQALAFIMMLYCYALNVL

SEQ ID NO: 137868 - protein, 43 aa, Heterodera glycines
  Coding regions on vcDNA: vcDNA=SeqID_64291; Strand=+; Position=1 -45,200-283
MQLSVLSFAFVALFLTSALIEFTEANAPKQNNGTDTNAEKEEN

SEQ ID NO: 137869 - protein, 120 aa, Heterodera glycines
  Coding regions on vcDNA: vcDNA=SeqID_64292; Strand=-; Position=1 -70,343-564,1921-1991
MSSPARQVSRPELIKYFWSHRHCVLLLEFKLYRAFFVASTNGTDPGTFKNDFIRSDFAVLHNAPTAYNIEFFRIDMAIAREELLASSDIYFFQSCPERFDNLPFSAPPDQMLKTAKFGHF

SEQ ID NO: 137870 - protein, 120 aa, Heterodera glycines
  Coding regions on vcDNA: vcDNA=SeqID_64293; Strand=-; Position=1-362
MPMNDDNKNNAQMNDKGKAPQQFLQNPQQVQYAQQQSQLQPAQYPQQQQIMPQQVFLPSEQLQQFPWLYGMPGLNRITLKHNANEAVKPSPAEQLSSFLAEQQRQQQATSQLHRQNLHSR

SEQ ID NO: 137871 - protein, 142 aa, Heterodera glycines
  Coding regions on vcDNA: vcDNA=SeqID_64294; Strand=+; Position=1 -246,330-512
MESVSSSLKSTEGQTQQQRKEIANSSVRPTEGQQSVRYFRRIRICSTSSDSSDEIFNSFERQDNSVINVKNTKQLNMIKSPEKNKKGKSREIIVRQRSLSPRSDITILNTSNKTSVSKAPAGKHKESDDARNARKIFVGGFN

SEQ ID NO: 137872 - protein, 33 aa, Heterodera glycines
  Coding regions on vcDNA: vcDNA=SeqID_64295; Strand=-; Position=1-99
SGRALRARLFNFVGNIRPLRGLRTGASRPFFNF

SEQ ID NO: 137873 - protein, 40 aa, Heterodera glycines
  Coding regions on vcDNA: vcDNA=SeqID_64296; Strand=+; Position=1 -5,305-422
MSTEYRQAFQTEFPSVFKRILNVNRVIPLHNGPQLGTTQW

SEQ ID NO: 137874 - protein, 76 aa, Heterodera glycines
  Coding regions on vcDNA: vcDNA=SeqID_64297; Strand=-; Position=1-3,46- 173,520-619
MFYLAFKDVHPSWSLIGIAGIYAVIIVIGAILNLSVILITIKTNTEYRQAFQTEFPFVFRRISNVTQVIPLQNTRS

SEQ ID NO: 137875 - protein, 49 aa, Heterodera glycines
  Coding regions on vcDNA: vcDNA=SeqID_64298; Strand=-; Position=1-527
LNLKKCQRLLFLKFFEILTFSLIIYYFAKLIHKYFFRTCSETHQMLIKS

SEQ ID NO: 137876 - protein, 111 aa, Heterodera glycines
  Coding regions on vcDNA: vcDNA=SeqID_64299; Strand=+; Position=1-336
MAEQWEEERAEKQRLTKKLRRASEWAKGEANKRNYRTNGNFKVIKAELLQRETEEQLEVQRKAKERLETEHNALLRLEKRRTLREETESVGMALIRDKLAAKEREVSAQVI

SEQ ID NO: 137877 - protein, 66 aa, Heterodera glycines
  Coding regions on vcDNA: vcDNA=SeqID_64300; Strand=-; Position=1 -60,642-782
MPKMRHTMPKLHHKSASTDTKYGGKWRKKESQRKINQIFAEGLTKHLCVGWPKRQECAQSLGLPAH

SEQ ID NO: 137878 - protein, 68 aa, Heterodera glycines
  Coding regions on vcDNA: vcDNA=SeqID_64301; Strand=-; Position=1 -121,200-285
MDDTEFRIFGVGIPISEKFMSYGIPISEIFLDLGMPSLVYGSRKELDPRAVGDKWALANWASAHVFPI

SEQ ID NO: 137879 - protein, 47 aa, Heterodera glycines
  Coding regions on vcDNA: vcDNA=SeqID_64302; Strand=+; Position=1 -92,839-887
PQRHAGDHIELIFYEMPVNVKGFAFVARFFQKIDGIFNRIVNETRAL

SEQ ID NO: 137880 - protein, 34 aa, Heterodera glycines
  Coding regions on vcDNA: vcDNA=SeqID_64303; Strand=+; Position=1-104
LPIPSTIAFIHPIMNAKIIRVPKIACDLRLTKNG

SEQ ID NO: 137881 - protein, 117 aa, Heterodera glycines
  Coding regions on vcDNA: vcDNA=SeqID_64304; Strand=-; Position=1 -129,337-558
  Homolog annotation: Hit_ID=NP_492258.1; Match level="QueryCoverage =100%, HitCoverage=9%, E-value=4e-40, Identity=69%"; Hit description =probable electrogenic sodium bicarbonate cotransporter protein NBC (124.6 kD) (1I874) [Caenorhabditis ele
MENLASGAICGVMYHLFSGQPLTIIGSTGPVLVFETIVFDMCTKLSFLNFAPSDQGLSLNYLSFRFWVHVWTALILFVMVATDASSLVSYITRFTEESFAMLIAVIFVYEACMKLFK

SEQ ID NO: 137882 - protein, 107 aa, Heterodera glycines
  Coding regions on vcDNA: vcDNA=SeqID_64305; Strand=+; Position=1-416
EIVLIPYPFKKHTVSLTYTFCFPNFAFWNSVFSSHSLHFSSHSLVVRWECHFLLLRRLCHRQRRRRFLAIRRSLLSHHFYSSQPLSTVLFVPEFSLNSMHNYYFVFI

SEQ ID NO: 137883 - protein, 235 aa, Heterodera glycines
  Coding regions on vcDNA: vcDNA=SeqID_64306; Strand=-; Position=1 -180,560-685,751-930,1236-1400
  Homolog annotation: Hit_ID=NP_492258.1; Match level="QueryCoverage =98%, HitCoverage=19%, E-value=5e-70, Identity=58%"; Hit description =probable electrogenic sodium bicarbonate cotransporter protein NBC (124.6 kD) (1I874) [Caenorhabditis ele
VRHSATTNGGSSQGSFLSAVRSISDIGRTFSHGKNLQGRCTDSDSPTKRQTSGNQLELPKVGSLPKDMQKENSQSSDFFARNMHFMKKLPPGAEASNVLVGEVDFLTHHVTAFVRLKKAQVDFLTHHVTAFVRLKKAQLLGDLTEVPVPTRFLFLLLGPSGHAAQFKEIGRAIATLMSDEIFHEVAYKAKQRSDLLDGVDEFLDAVTVLPPGEWDPNIRIEPPSSIPNQQSRVQV

SEQ ID NO: 137884 - protein, 79 aa, Heterodera glycines
  Coding regions on vcDNA: vcDNA=SeqID_64307; Strand=-; Position=1 -70,954-1123
MNNSQNNGDKMSSAAPSTMSAAEASGSASKVAITGPAAPVEEPQPAAGQTQPTTSADTLANIHQTDKEIAADRRESLWM

SEQ ID NO: 137885 - protein, 75 aa, Heterodera glycines
  Coding regions on vcDNA: vcDNA=SeqID_64308; Strand=-; Position=1-228
MYFDHEMRREKEQRKGKKGQRTNETFDGKLNCGWTQFHFVVPFGVKFGKKAQTEEKDTTQRSAEKERTIDGRKVN

SEQ ID NO: 137886 - protein, 138 aa, Heterodera glycines
  Coding regions on vcDNA: vcDNA=SeqID_64309; Strand=-; Position=1 -101,148-463
  Homolog annotation: Hit_ID=NP_505666.1; Match level="QueryCoverage =73%, HitCoverage=10%, E-value=1e-13, Identity=37%"; Hit description =udp-glucuronosyltransferase family member (5K853) [Caenorhabditis elegans] emb|CAA94866.1| Hypothetical p
MAEYRGFARILTKSDLLSVDRIKEEIGIMLNDKKYKANALRLSKLHRQKPNPPEEQLIRWTDFVLENGPLKELIPESAELGMVEYFCLDIALICLIIAFAILWLCRRLFGALLAPWKRESARQKNDKKKVSERVIKED

SEQ ID NO: 137887 - protein, 57 aa, Heterodera glycines
  Coding regions on vcDNA: vcDNA=SeqID_64310; Strand=-; Position=1 -167,372-378
MSVCRAVHMCPHLRVPSAGIPAEANGGGQKAKECFVERKFQTDVWVVVNENDRGWGH

SEQ ID NO: 137888 - protein, 83 aa, Heterodera glycines
  Coding regions on vcDNA: vcDNA=SeqID_64311; Strand=+; Position=1-661
IFFVFGAVPPNRCAQIYGETESFGNSFPIACTLILRWIFAPHNCLSTPNGHLKKSIFLFSGQSPRTDAPRFMGRPNPSGIASL

SEQ ID NO: 137889 - protein, 283 aa, Heterodera glycines
  Coding regions on vcDNA: vcDNA=SeqID_64312; Strand=-; Position=1 -147,248-567,677-924,971-1107
  Homolog annotation: Hit_ID=AAO73002.1; Match level="QueryCoverage =54%, HitCoverage=46%, E-value=1e-20, Identity=36%"; Hit description =cathepsin B [Fasciola gigantica]
YSDQLYKHYAAASQYEYARHYYTPFNQYPQPQPPQYFNPEHMQKLYREAYTEYDKRELENALRGYLQYIALAYAQPMSVFPRHYDLRDKFPQCAAWIGLARDQGKCGACWAVATAAARDDRACIFLTLRNYLVFTKNPNLYSSTMDLISCTKEADGCNGGTPQLAWKYLEKYGYLTGAPVVNGTGCKPYVFPPLKSDPEKERKAPECTEHCQAGWKRMAMDKLSGRILPPSNETRYRTVIKTNHWGMDDFEGQLKCQERRMDECYGKMLEGSERGIMAEARHH

SEQ ID NO: 137890 - protein, 67 aa, Heterodera glycines
  Coding regions on vcDNA: vcDNA=SeqID_64313; Strand=+; Position=1-204
MFDEGKMRGNGDERPKRHQMKHTQWQEKRTNGGKADKWKKSGQMEEMRKSGQMEEKRTNGSSEKRMR

SEQ ID NO: 137891 - protein, 329 aa, Heterodera glycines
  Coding regions on vcDNA: vcDNA=SeqID_64314; Strand=+; Position=1-992
  Homolog annotation: Hit_ID=AAP30765.1; Match level="QueryCoverage =71%, HitCoverage=48%, E-value=1e-130, Identity=97%"; Hit description= putative gland protein G15A10 [Heterodera glycines]
LANSLRQQRTEDNHISINGQIYSVDGPNVNVGVEGHDLSVNGRVYQNRATEQYLEIIQDKNIRNVIVSVPLSLFSRENITVGQTRHIHAECDGNLYIDQSADDCIRILCVDVKKDAAAKNFGSTSGGFNFGSTSVFYNFSVRGTLHIHNSSLECANIECDASLNVTHSPIERNAQMKCGGSLSIDESPMGNIRLNCDGSLRIEKSKMESSQIDVGGSIGIVKSPMGSIGIDCGGSLRIEKSKMEIGNLDCGGSLTIVESPAQNLQLDCGGSLNMKESPMKNVGINCGGSATIKKSKMESGRINCGGSFSIDRTPTGSVRINYGGSRINL

SEQ ID NO: 137892 - protein, 137 aa, Heterodera glycines
  Coding regions on vcDNA: vcDNA=SeqID_64315; Strand=-; Position=1-412
MFDDRINEEDAKDNDDEIMVTSAENDGITTTAAATCSSSSQTGTDRKSREVQAAIQDQQQTGNTNRSREVHAVQYQLQQQQQQTAVNAERSREVQAVQYQLQQQQQQTAGNAGRGREVQAAQHLHDQHKHNHRVQPP

SEQ ID NO: 137893 - protein, 75 aa, Heterodera glycines
  Coding regions on vcDNA: vcDNA=SeqID_64316; Strand=-; Position=1-225
PGLKCPAQAKNFFYFREKIEIFPKKIPVDRARKTMFWKWSPFLWEKSLKNPKIQKPENRFLALARKIFKIFEILK

SEQ ID NO: 137894 - protein, 63 aa, Heterodera glycines
  Coding regions on vcDNA: vcDNA=SeqID_64317; Strand=-; Position=1-506
FLADLKPSIACRFSAQQSTNRVFDSLQKIIHYPKVFLQPLIANLISCRFKAIHCLPVLGTAKH

SEQ ID NO: 137895 - protein, 43 aa, Heterodera glycines
  Coding regions on vcDNA: vcDNA=SeqID_64318; Strand=-; Position=1 -60,143-214
MYKHRLFESSAIYSRVRAPWKLKIIKEYLSSKFPYAFKYNTYI

SEQ ID NO: 137896 - protein, 19 aa, Heterodera glycines
  Coding regions on vcDNA: vcDNA=SeqID_64319; Strand=-; Position=1-58
KNSNFNLYQVKIIQNYLVF

SEQ ID NO: 137897 - protein, 35 aa, Heterodera glycines
  Coding regions on vcDNA: vcDNA=SeqID_64320; Strand=+; Position=1 -63,113-157
MSAKIIRVPKIACDLSLAKNGRFQFLLQSPLYIPL

SEQ ID NO: 137898 - protein, 172 aa, Heterodera glycines
  Coding regions on vcDNA: vcDNA=SeqID_64321; Strand=-; Position=1 -66,144-254,780-896,949-1104
  Homolog annotation: Hit_ID=S16366; Match level="QueryCoverage=98%, HitCoverage=84%, E-value=6e-56, Identity=45%"; Hit description =collagen alpha 2(IV) chain precursor - pig roundworm sp|P27393|CA24 _ASCSU Collagen alpha 2(IV) chain precursor
QGLPGPSGPPGPPSAGPSGSVGDLGFPGDLGFPGPPGPPGPAALTQHKGTIVGPEGHPGAKGEKGEPGDTGPRGYPGQAGIPGQPGLPGMKGEKGLPGPAGPRGKEGRPGQPGPPGFKGDGKEGRPGQPGPPGFKGDRGVDGIPGVPGQLGQKGDQGFPGRDGARQINKELI

SEQ ID NO: 137899 - protein, 113 aa, Heterodera glycines
  Coding regions on vcDNA: vcDNA=SeqID_64322; Strand=-; Position=1 -147,783-880,922-1017
  Homolog annotation: Hit_ID=AAA64312.1; Match level="QueryCoverage =87%, HitCoverage=84%, E-value=2e-26, Identity=49%"; Hit description =alpha2(IV) collagen
ANSSVISRHGERQQGNGDNNGKTTMPKSAKAAADQADGANASQLCIMACSMGPPGPQGPPGLAGTRGFPGPEGLQGPKGLKGAQGPPGPFGVKGDRGPVGTPGFPGNDGNPGH

SEQ ID NO: 137900 - protein, 222 aa, Heterodera glycines
  Coding regions on vcDNA: vcDNA=SeqID_64323; Strand=-; Position=1 -61,120-278,528-581,639-704,760-1088
  Homolog annotation: Hit_ID=AAO33476.1; Match level="QueryCoverage =83%, HitCoverage=97%, E-value=3e-82, Identity=75%"; Hit description =gland-specific protein g6e07 [Heterodera glycines]
MRTILFMAMVCLVMAVLMEMANSKAVKKDNKKGKNNFKNLLKYSLKGAVAASPAKGKASPKGGKSPAKGKAAKAKKVQAAKKAPGKDKKSLVKPIVLKAPVPPHKMHPMIESEAVPPPAHARSLATVPYSTPGAADRNSLPSYTSAGTNLDMADDNDDYQNYYYGTEDSSREFDASAEEEDELYEEEVGAMSGQTDDYGIGSGQDEYGHQPVDVPPKSVMLD

SEQ ID NO: 137901 - protein, 22 aa, Heterodera glycines
  Coding regions on vcDNA: vcDNA=SeqID_64324; Strand=+; Position=1-69
KLIRSAPNFAGTLKGREITYFK

SEQ ID NO: 137902 - protein, 38 aa, Heterodera glycines
  Coding regions on vcDNA: vcDNA=SeqID_64325; Strand=-; Position=1-239
FKIFRNSDFFINYLFFAKLIHKYFFRKCSETHKTLFTG

SEQ ID NO: 137903 - protein, 76 aa, Heterodera glycines
  Coding regions on vcDNA: vcDNA=SeqID_64326; Strand=-; Position=1 -413,584-693
NTGYREAIPEGFGLPINLGASVRGDCPENKKIDFFKCPFGVLKQLWGAKIQGKNKVVVYRSYSRRIRTPYKSGRIG

SEQ ID NO: 137904 - protein, 31 aa, Heterodera glycines
  Coding regions on vcDNA: vcDNA=SeqID_64327; Strand=+; Position=1-93
MGSKNPTQNYSTGYREAIPEGFGLPINLGAS

SEQ ID NO: 137905 - protein, 49 aa, Heterodera glycines
  Coding regions on vcDNA: vcDNA=SeqID_64328; Strand=-; Position=1-147
MTPINWQTLEVNTEGPQNFQRSEIGVDKQRQHNAREDEKFDAESVLVFI

SEQ ID NO: 137906 - protein, 184 aa, Heterodera glycines
  Coding regions on vcDNA: vcDNA=SeqID_64329; Strand=+; Position=1 -190,232-346,390-447,495-570
  Homolog annotation: Hit_ID=NP_498282.1; Match level="QueryCoverage =100%, HitCoverage=68%, E-value=3e-47, Identity=54%"; Hit description= kdel receptor (24.7 kD) (3G997) [Caenorhabditis elegans] gb|AAA62292.1| Hypothetical protein C28H8.4 [Ca
VLFIGSLFATCYFMFVKFRATYNKDEDTFRVELLVLPCIVLALFVNADFTALEVLWTFSIYLEAVAILPQLFMLQKRGEAETIVAILPQLFMLQKRGEAETITAHYLFLLGIYRALYIFNWVYRYYTEVYRYYTEAFYDPIVIVSGIVQTVLYADFFYLVQTVLYADFFYLYVTRVVKDGAKLE

SEQ ID NO: 137907 - protein, 382 aa, Heterodera glycines
  misc_feature (7)..(7): Xaa can be any naturally occurring amino acid
  Coding regions on vcDNA: vcDNA=SeqID_64330; Strand=-; Position=1 -46,2450-2584,2632-2793,2837-3001,3060-3103,3149-3226,3272-3360,3420 -3537
  Homolog annotation: Hit_ID=CAE75458.1; Match level="QueryCoverage =95%, HitCoverage=41%, E-value=3e-88, Identity=50%"; Hit description =Hypothetical protein CBG23453 [Caenorhabditis briggsae]
QKYRCGXSEEAGHFSTRADELEGGESSDMDGVEDKEEEQYTPLEKRNRRVSALFILVVMLGYTAGGACLMQLWERWSFYTAGGACLMQLWERWSFVDAFYFCFVTVTTIGFGDIVPQNVTFLPATLAYIVIGLIITTMCILIITTMCIDLVGSAYIQDIHLYGRALGSSFLTIGGKVIHLGEVFSYVAFLQKNYGLTPDQLDRLAQLPELTPDQLDRLAQLPEEYLLDCLINGRQPDLNWIGGRPFIPEYLLDCLINGRQPDLNWIGGRPFIPPDIYYFKWIEQPRTLSFTSERQLASPDIYYFKWIEQPRTLSFTSERQLASSESLDLNTSLCSTARTLTPRNTSLCSTARTLTPREYYQRVLVHYCRQMQTEAVAKTPAI

SEQ ID NO: 137908 - protein, 95 aa, Heterodera glycines; identical to SEQ ID NO: 125597
  Coding regions on vcDNA: vcDNA=SeqID_64331; Strand=-; Position=1-659

SEQ ID NO: 137909 - protein, 21 aa, Heterodera glycines
  Coding regions on vcDNA: vcDNA=SeqID_64332; Strand=+; Position=1 -54,580-591
MRTRPIWQVKQRLLTSQKKGF

SEQ ID NO: 137910 - protein, 18 aa, Heterodera glycines
  Coding regions on vcDNA: vcDNA=SeqID_64333; Strand=-; Position=1-56
FLNRPKSLGLYFNKFHRT

SEQ ID NO: 137911 - protein, 20 aa, Heterodera glycines
  Coding regions on vcDNA: vcDNA=SeqID_64334; Strand=+; Position=1-60
MTTSHLTNGMNGSALSLNRR

SEQ ID NO: 137912 - protein, 88 aa, Heterodera glycines
  Coding regions on vcDNA: vcDNA=SeqID_64335; Strand=+; Position=1 -138,1338-1466
MLRRLRRRYPLFAHLLLRQLVKRKFAKLDRNLSKSDDNWHMTYFANRVLKNGTPQLFNLETCCLIVNQFDEQRCGYIGLAKFPALWDA

SEQ ID NO: 137913 - protein, 28 aa, Heterodera glycines
  Coding regions on vcDNA: vcDNA=SeqID_64336; Strand=+; Position=1-86
MEVVGILLTFQNIWVFKYDSSAVCSNHI

SEQ ID NO: 137914 - protein, 428 aa, Heterodera glycines
  Coding regions on vcDNA: vcDNA=SeqID_64337; Strand=+; Position=1 -165,215-517,563-632,938-1216,1503-1693,1836-2114
MSGLKRFRIVSSPKKRMVDDFPTNLKHLRDVILFGFSGLFYVRARVADLQFSLYKACPLKRNGMLCKKKLDEELYCASCDHRANKATRNLYMRLELRDCENPEISQTATVFSAVAEHYLNLKVEQFAKMVEEQPGQLEALLKSKIEQTVAVKLSIKFKAKGELETLDWVAVSVQQENRETTTAEPTMKREQSTAAGILSLLSAAAHNDNTAAASASDSNAKRLRRHSWDFKTMAHFEEERAKAEEDRQKKEKQPQQPAPCLSKNSIMCTEWNGLTDPILLPIRPPEQNTAEVLMAELDKLGQSDGDEDVHGGGISKRSLLLSDPIEVVVTCIAPPVATSRRQPLTEADDDHQRDSVTAEIARRVITRKNFCAGYEALNSLVSNRERMNATVTELMQAAEIPADQESYEMEHIDQIQQFWVGCWCLNEC

SEQ ID NO: 137915 - protein, 18 aa, Heterodera glycines
  Coding regions on vcDNA: vcDNA=SeqID_64338; Strand=-; Position=1 -39,549-566
MPDLTATNISKSKVQLYL

SEQ ID NO: 137916 - protein, 73 aa, Heterodera glycines
  Coding regions on vcDNA: vcDNA=SeqID_64339; Strand=-; Position=1 -75,470-616
MWSAARCIWWAAPWRLPWRRGTYAWKEFVESGEKDRVQEVVERRLHESGWAKRVESMCEEYIAKKVAKVNKAA

SEQ ID NO: 137917 - protein, 23 aa, Heterodera glycines
  Coding regions on vcDNA: vcDNA=SeqID_64340; Strand=+; Position=1-71
CIKKKVWGGEKEGRRKEEENVVV

SEQ ID NO: 137918 - protein, 118 aa, Heterodera glycines
  Coding regions on vcDNA: vcDNA=SeqID_64341; Strand=+; Position=1 -115,165-406
MSKIETVKLKSDIEEIKYFLPFCPNVNLHKRTCTVVTFGVGHTVKAEKELLKIYPECHLIAADPSDEINANLTQSIGGTFVHGPIGAETANQQPVISWGGRLNFMEMLFFNIFALHYQ

SEQ ID NO: 137919 - protein, 1016 aa, Heterodera glycines
  Coding regions on vcDNA: vcDNA=SeqID_64342; Strand=+; Position=1 -186,501-1496,1548-2618,2674-3468
  Homolog annotation: Hit_ID=NP_507780.1; Match level="QueryCoverage =37%, HitCoverage=23%, E-value=6e-27, Identity=25%"; Hit description =predicted CDS, DNA polymerase type B, organellar and viral family member (5T899) [Caenorhabditis elegans]
MGRSTRKTTTTIWSFRQLQLDGDDDDRGAAGGGRVPAARASAPLARRRRTARTAPLWSWLRGTGRGRRRTTTKAEAGDNDDDDDGEVVDDFFTVVGVWERAGSRSRATQTETIQVRFHNWERARRPDLLLARCIARLMARVLDGRAEPLRVGLSVQPPGWDNCFHVPMRPPQQNSAHALAAALETFAKQYDELDLFSADVCFKVSAVWALPGELVLRIPHPCPSTKFDPSPHRLAARVEGACAEDEQRARGTVRCQSFVPVVNGAGGDRWCMARAIVLGLAQRRICVLERRNVVHFRAFCLAQRGEAGAPEARRLLEDAAVPLDRPTYGAAEAQRVQRWLDASLGAHQVRLVIFARELAYRVAWKGARPARFNLCLVVQDGHYGYIQCPEQLFHARQYCVDCEQPVDRRTHPQGCRALCPQCLRFGWGRPCAREPGRAPSRCADCLFVFENADCFEAHRRRVDPPPPGWQHDRRRGRPHRPMCEERRVCARCRQVVWTRHGAHACALNNNVGRQQAAQQQQQCDRCFGIHDAQWTPHFIQPKRAQCQLIANDAERPAAPAEGLEDDNDDDDDDDNDGDADDVNDNDDGGDAEQNRQRRRRRTLRFLFWDVECAQVADENEEGDEGVPARMLKHVPLLVCAEVICERCVAAGVDLEREPDRRAPGCCCGGAAWRDGQHRRWLMRAREDAFSDDDDDDNADADGGRRWRRPNPRRLRFFHDAATGRSPMAQFADFVLHDGPVNVRTVMLAHNGGRYDVHLLMEELQRRGVRPRRLVATGLRVYTLELGGRNQRSVVAKDSLNFFGCALSKLPAMFGLDGVPDKQFFPYNYIRAENMDVAHVGLPPAADYDPDRMRPAERDAFQRWYAAEQQRRPNRLFVLRRELLRYCANDVRILRRACLRFRHVVGELSGGVEPFLAASTIAGLALAIYRQQHLPRDLMVHTPEGGFLRGRRASAASRHFFALLERLHPQWRGRLRTARWSIGEACVEDDGYRLDALLYRPVPLRPLVIEFNGCFFP

SEQ ID NO: 137920 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_64343; Strand=-; Position=1-987
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 137921 - protein, 235 aa, Heterodera glycines
  misc_feature (32)..(32): Xaa can be any naturally occurring amino acid
  misc_feature (150)..(150): Xaa can be any naturally occurring amino acid
  misc_feature (177)..(177): Xaa can be any naturally occurring amino acid
  misc_feature (208)..(208): Xaa can be any naturally occurring amino acid
  Coding regions on vcDNA: vcDNA=SeqID_64344; Strand=+; Position=1-718
  Homolog annotation: Hit_ID=AAL31950.1; Match level="QueryCoverage =95%, HitCoverage=50%, E-value=4e-37, Identity=49%"; Hit description =CDH1-D [Gallus gallus]
WAASTSHLERPVPISGRGHLVVPTLAQQDSRXVVNRNHLGNDPAAGSPTATLLRLLPVQATAIKSSSLHTDRSRNTNRPRISRNGSVPGSDGRCVQRAGTYSERVDDSPYKGIPRSRTIIAMSDPNPRQIFTGLPTPFRGRTSTLILPVXRACSRTSGHHRPVIAQFRAAEHRKSLXEVVPTEAMSQLFSARVSLVIGINQTNRSTNXERPCTTIHRIMKKLSICQSLRCPGRVS

SEQ ID NO: 137922 - protein, 51 aa, Heterodera glycines
  Coding regions on vcDNA: vcDNA=SeqID_64345; Strand=-; Position=1-153
HQIFLTEARDRTQIGVPAKAASNRCHDDQQQYQQTLPANSPQVDEKWAQAE

SEQ ID NO: 137923 - protein, 20 aa, Heterodera glycines
  Coding regions on vcDNA: vcDNA=SeqID_64346; Strand=+; Position=1-61
MCDEEVAALVVDNGSGMCKA

SEQ ID NO: 137924 - protein, 86 aa, Heterodera glycines
  Coding regions on vcDNA: vcDNA=SeqID_64347; Strand=-; Position=1 -48,367-579
  Homolog annotation: Hit_ID=AAL58476.1; Match level="QueryCoverage =70%, HitCoverage=12%, E-value=1e-09, Identity=45%"; Hit description =glutathione synthetase [Pichia angusta]
MLITNFNSTNCKRNLFNYLVWPSRDEAVFDDVVMELGVYGFMLGNRVDGTVPYFDQPGHLVRTKLASSNEGGVSVGTGAFDSVYLY

SEQ ID NO: 137925 - protein, 62 aa, Heterodera glycines
  Coding regions on vcDNA: vcDNA=SeqID_64348; Strand=+; Position=1 -104,153-324
  Homolog annotation: Hit_ID=NP_740993.1; Match level="QueryCoverage =100%, HitCoverage=14%, E-value=1e-21, Identity=82%"; Hit description= DeHydrogenase, Short chain (dhs-6C) [Caenorhabditis elegans] gb|AAK68187.1| Dehydrogenases, short chain
MLNTGKFLGKTFVITGASRGIGKEIALKLAKDGANIVICAKTTQDNPKLPGTIYSAAEEIEK

SEQ ID NO: 137926 - protein, 152 aa, Heterodera glycines
  Coding regions on vcDNA: vcDNA=SeqID_64349; Strand=-; Position=1 -255,384-587
MVINWDPFILFISPTILVDLTIDSVHSGELLPDGIDDFDGPNATPTAGQALSKWLHTPRNDGQPKRLICHGFTLGFSKWVIDLKEPTEIVPFELVNERTSEILKLEKGEVDGWVFPWIMKRCQIGGPAVQWEDENLDNLNDVHFMLQADCIG

SEQ ID NO: 137927 - protein, 234 aa, Heterodera glycines
  Coding regions on vcDNA: vcDNA=SeqID_64350; Strand=+; Position=1-705
MGARKTDNTKRLAIDNSYNILGEKLANIGRLMDENEDDGNNTDCSISRQLFQICLTLLQQVQSQQSELFTLKQRQIADEAVQDHERRRSVVVMGLLESQKQKPSERVAADRTAISGVLDELGIESPITVYRMGSTDQAKTGQNRPRLMKVIFGCSKHQRQTLTQWNKLRAQISQKPGMSNIKIRPSLSQEELKARRVLQEECSRKRKEDGGEWVVYADKVMLRSDIATFKNNTN

SEQ ID NO: 137928 - protein, 58 aa, Heterodera glycines
  Coding regions on vcDNA: vcDNA=SeqID_64351; Strand=-; Position=1-177
CLVNIRSLYNKIDEIALNLVNKNIDIFLLTETWTKEENPILFSPWILENYNFVFCHRK

SEQ ID NO: 137929 - protein, 155 aa, Heterodera glycines
  Coding regions on vcDNA: vcDNA=SeqID_64352; Strand=+; Position=1-468
MQLNCKHFEFSEIENDLTDANNRIVDAFSKMEQSFDDAQRQEMQKDGWTFLRQFQYDQLCTDQCDHFYLNHPIFICNLFEFYFSPLKDAQLPEGFRHSIDEFSQMPKETREAMLWKRIERISRNIPDVNRPIMAIIKELIGGYAQKIVQIYEGNR

SEQ ID NO: 137930 - protein, 82 aa, Heterodera glycines
  Coding regions on vcDNA: vcDNA=SeqID_64353; Strand=-; Position=1 -108,178-315
MNVPDSFAVGHRPRRFCSPCIIRFNSIETRPRTLAMIQRCPQINSLSTVVPKVNGYGGSHTPNWAYCYHNSSPPYRNSYYDM

SEQ ID NO: 137931 - protein, 46 aa, Heterodera glycines
  Coding regions on vcDNA: vcDNA=SeqID_64354; Strand=+; Position=1 -62,112-190
MNLICFSFFFVVLVTNVIGEGLAEDKWKKCELNGNRMIRMGKDVKK

SEQ ID NO: 137932 - protein, 185 aa, Heterodera glycines
  Coding regions on vcDNA: vcDNA=SeqID_64355; Strand=+; Position=1 -153,294-419,588-866
MSSSSAKLAEFQNALPFGVFLNDFDGAALGIVAFEIHCAIGTNDVNTCKTMATEEKSRKLTTRGIRTSTTTRATPPKTKLKIVTPFKTETPRVPNLFTPRDSTVKHFGTNCVQIDFPAEIAQFSLNVSAALFGIACKQYLRKYKIGQLPKNYDEKMEIKDKMEACGKVPTETNCKKLKKWKLKLN

SEQ ID NO: 137933 - protein, 290 aa, Heterodera glycines
  Coding regions on vcDNA: vcDNA=SeqID_64356; Strand=+; Position=1 -114,164-268,341-426,635-714,797-867,1028-1151,1196-1351,1934-2070
MGRTKASKFSTRKTDTAVDLGLDILRNGNVFQLSVPMLSNTVAHEFLHALALWHEQDRDDANKYIKWNPTPRNQKEPAKTENYGFPYDFHSILHYEAVKTRGKLQKRRKQMPKGRISQPKELQAMPLPDGNCQTDRANEIEADWQIRTLKPKPQDGKKVIIKLKWLHEKVLTCDDPCGTYRVEIKYRKDKRARGAFICCSAQIEEDETKNWIEAGAPGEDILISAYPNQTNFEQLTELFELTYETEARRRDEKLLGLLEGQKQRPNSHWRFSMLELRRSRHHKSARQNSD

SEQ ID NO: 137934 - protein, 27 aa, Heterodera glycines
  Coding regions on vcDNA: vcDNA=SeqID_64357; Strand=-; Position=1 -54,149-178
MANSSKICDRSGPYQGVGSCSYVYDSP

SEQ ID NO: 137935 - protein, 24 aa, Heterodera glycines
  Coding regions on vcDNA: vcDNA=SeqID_64358; Strand=+; Position=1 -45,288-317
MAVFGFHLVLTMIAAEGFPSDWWQ

SEQ ID NO: 137936 - protein, 44 aa, Heterodera glycines
  Coding regions on vcDNA: vcDNA=SeqID_64359; Strand=-; Position=1-186
RYKCSLKDIYLRYLIVRLASVISGTKQIWVRERAAAEAAAILYD

SEQ ID NO: 137937 - protein, 84 aa, Heterodera glycines
  Coding regions on vcDNA: vcDNA=SeqID_64360; Strand=-; Position=1 -174,307-387
MTQNENILHLDYNRLKTSKSIRLQRMKILAGQQLNEKGNNWDQLLIHALFDYNIAIHTKKALKAWKIVRKEIEKGQDKFKKEND

SEQ ID NO: 137938 - protein, 41 aa, Heterodera glycines
  Coding regions on vcDNA: vcDNA=SeqID_64361; Strand=-; Position=1-126
RSSASDHFHTTRSEQHHDLSVLVLEKIIKIGLFNSTKVATG

SEQ ID NO: 137939 - protein, 61 aa, Heterodera glycines
  Coding regions on vcDNA: vcDNA=SeqID_64362; Strand=-; Position=1-434
VFNNENEIIGKKNKLFICCFCHFSSLFRPLFMNSLSVKICTLIIINLPFVKSCSFHCCSRL

SEQ ID NO: 137940 - protein, 112 aa, Heterodera glycines
  Coding regions on vcDNA: vcDNA=SeqID_64363; Strand=+; Position=1 -106,147-287,591-682
  Homolog annotation: Hit_ID=AAL89665.1; Match level="QueryCoverage =73%, HitCoverage=17%, E-value=1e-34, Identity=80%"; Hit description =histone deacetylase [Takifugu rubripes]
MEKIIGAYQPSVIVLQCGADSLTGDRLGCFNLTLKGHGKCVEYMKKFDLPVLMLGGGGYTIRNVARCWTYETAVALDTEISNAPEPDAMVMDEEAQLDEANPDERIPGKKEK

SEQ ID NO: 137941 - protein, 1341 aa, Heterodera glycines
  Coding regions on vcDNA: vcDNA=SeqID_64364; Strand=+; Position=1-4026
  Homolog annotation: Hit_ID=S60004; Match level="QueryCoverage=91%, HitCoverage=87%, E-value=1e-115, Identity=29%"; Hit description =hypothetical protein - common roundworm retrotransposon R4 (fragment) gb|AAA97394.1| reverse transcriptase co
MALFRARSDKTPTHAGIPAPDEVREGGCGQNRTNPAAPRGKAAAIQRQNGITIPIKACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDEIEIALAEVSRSSPFEEREPFDLGATERITRKRLRNAVRDVVPPRKRRVPSTPSRKEQDLVPEVDGPAPTDVLTHPPTESEPEPMLDPLSLVQLVRPQLGRAMGWAAEEMELGNVVMDVELKREFNREVRRVGRTPPDQMYKRGAGPPLPQKREPERVALLEQLIAARVERGINRGLDWFLELNVAVFAATRVLSRRERVETLADRLHINDSATLSEVSRRRAKAERKLRCAREQPWMSRRIRKLGVRVERLKQLADLVRQRIAGRGNRSSYEGPRRRFRLRPSLRSVTEAPVNPPLNGNEVYTFWHSLWAQSLRANTDDCQLRKFKNQLSAARHTDLTSVGTSSLVQMFSAALRKMKKGKAPGPDGIRAAWWGVFRRIAPYVATWVVRVIRGAEPVANWICNGLTVLLPKSSDNADPSNYRPITCLNTCYKLFTAVIAQITASYVDVLGGLPRQQVALRKGVWGTSVSLMIDALTVADARKAKRPLGVCWFDFKKAFDSVPHNLIRWILRVIGLPPVILSVIVSVMDQWATRLKIGGKVMPKTIPVRTGVFQGDTLSPLLFCLSVWPISFALDQFPQYQFRCANHLQQGFSVGHVFYMDDLKCYCPDREVLTAVIQQVQKSASALGLTIHYKKSAWLDQDGGKSGKAVLGVPVLVGTYKYLGMHERFMIVSKDSLESVRGKFMGRLKTLWTSKLTFGQAMLGTKSICMPVVRYVLQNLFLPKSEFNQTRLVLREWDRQIRDLLDECNIRQVFRSKTELYVSREEGGWGLPSMEDALEEEVVTKLAILVARQETEPLFRVCEALERKRCPTPLSLGLQILKDWGVGVELQGRTLLLNGNTVGPSQATRKLTGELVLRREAERLSRWRSKVKPGCGMTGGAWRDVPGIDVHLSNRWLVKGALSPTVVSNSLAIRANTVILRGSGGGYTKGTLLRCRGCGNTGETRRHIVSACSLGRQKGAASRRHDNVCRILVRAICHKLNIEPPNSANFPHVVVLEGSGAKMWIDFPFVVPHKIRHTRPDIVVLFEWNGVRRLSVIEVAVSDVANMQTQHIRKSHRYGTNSTEPFVAGVTPTYRNDCLAAQLRAKFKAQQVDVIPIIVGTTGETLDGEFGRIRKGLPMLTKLQMPRLWSEIQRAVILGSYRILVEHLALPKGGA

SEQ ID NO: 137942 - protein, 182 aa, Heterodera glycines
  misc_feature (12)..(12): Xaa can be any naturally occurring amino acid
  misc_feature (50)..(50): Xaa can be any naturally occurring amino acid
  misc_feature (108)..(108): Xaa can be any naturally occurring amino acid
  Coding regions on vcDNA: vcDNA=SeqID_64365; Strand=+; Position=1-832
  Homolog annotation: Hit_ID=T02995; Match level="QueryCoverage=78%, HitCoverage=28%, E-value=1e-27, Identity=49%"; Hit description =unspecific monooxygenase (EC 1.14.14.1) - common tobacco dbj|BAA10929.1| cytochrome P450 like_TBP [Nicotiana t
PTRHLATLRESXTPAVYPRLIKFPWLNIQSTGQKSDTVNVHKDHPSPLFXLDSRIPRVRASSKLVVQRQPNAPQAALTTSPRTIPERTARSHGQKPPVSRNSPADPTXSQFFSRSYESNLPTSLTYIILSTRGCSPWRPAADIGTIRQEIQIASLAFSRAVWSARDTTGTAVLYGRNIPISG

SEQ ID NO: 137943 - protein, 180 aa, Heterodera glycines
  misc_feature (55)..(55): Xaa can be any naturally occurring amino acid
  misc_feature (88)..(88): Xaa can be any naturally occurring amino acid
  Coding regions on vcDNA: vcDNA=SeqID_64366; Strand=-; Position=1 -87,1421-1885
  Homolog annotation: Hit_ID=NP_671477.1; Match level="QueryCoverage =92%, HitCoverage=57%, E-value=2e-31, Identity=52%"; Hit description =rRNA promoter binding protein [Rattus norvegicus] gb|AAK21974.1| rRNA promoter binding protein [Rattus no
LTTGGRGRFGFGRTLPLGPHQGLVSRRGGKSRLFHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 137944 - protein, 159 aa, Heterodera glycines
  Coding regions on vcDNA: vcDNA=SeqID_64367; Strand=-; Position=1-477
NQSSPLLMPRSTRAAMSCSSRATRSGSRFCGSGGPAPRLYIWSGGVLPTRLTSRLNSLFSSTSITTFPSSISSAAHPIARPNCGLTSWTSESGSSIGSGSDSVGGCVNTSVGAGPSTSGTKSCSLREGVDGTLRFRGGTTSRTALRSRLRVILSVAPKS

SEQ ID NO: 137945 - protein, 78 aa, Heterodera glycines
  misc_feature (72)..(72): Xaa can be any naturally occurring amino acid
  Coding regions on vcDNA: vcDNA=SeqID_64368; Strand=+; Position=1-384
  Homolog annotation: Hit_ID=BAD26579.1; Match level="QueryCoverage =94%, HitCoverage=92%, E-value=5e-24, Identity=75%"; Hit description =cytochrome P450 like_TBP [Citrullus lanatus]
MDTLSGALPFYRLSKESMKVVVFHWRLAAPTYATPLMILHKVRLESSSTGSSFPAKFAKPVPLAVVSLDSRXGQWESR

SEQ ID NO: 137946 - protein, 80 aa, Heterodera glycines
  misc_feature (74)..(74): Xaa can be any naturally occurring amino acid
  Coding regions on vcDNA: vcDNA=SeqID_64369; Strand=-; Position=1-240
  Homolog annotation: Hit_ID=BAD26579.1; Match level="QueryCoverage =92%, HitCoverage=92%, E-value=1e-23, Identity=75%"; Hit description =cytochrome P450 like_TBP [Citrullus lanatus]
TKMDTLSGALPFYRLSKESMKVVVFHWRLAAPTYATPLMILHKVRLESSSTGSSFPAKFAKPVPLAVVSLDSRXGQWESR

SEQ ID NO: 137947 - protein, 20 aa, Heterodera glycines
  Coding regions on vcDNA: vcDNA=SeqID_64370; Strand=-; Position=1 -10,196-248
MCQAGHKNKLLGRLMVERQI

SEQ ID NO: 137948 - protein, 280 aa, Heterodera glycines
  Coding regions on vcDNA: vcDNA=SeqID_64371; Strand=-; Position=1 -235,329-500,626-1060
  Homolog annotation: Hit_ID=NP_502797.1; Match level="QueryCoverage =50%, HitCoverage=40%, E-value=5e-21, Identity=37%"; Hit description =HASI (4P602) [Caenorhabditis elegans] emb|CAB16520.1| Hypothetical protein Y57G11C.19 [Caenorhabditis ele
PNVAPYLGLNNQSKLQETDEPRKIIIPGKRLEEKTPDPESDNDTINELTPEPQTTSTLKTPIPIKTIIHPTLLNGLFRDVLLYLAGKKDETPRGAKFLKDRLLKDPTVKDMVDKSKVMWGRGRKKAIKSIKTPGIAKKIDPKITTDDVNKFLEKQRTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKMKKYFEEKFIIKNVMYSPDLHAGV

SEQ ID NO: 137949 - protein, 32 aa, Heterodera glycines
  Coding regions on vcDNA: vcDNA=SeqID_64372; Strand=-; Position=1 -53,469-514
MWGIESRYISEDALATEWQFDQDDKNGRMEEK

SEQ ID NO: 137950 - protein, 88 aa, Heterodera glycines
  Coding regions on vcDNA: vcDNA=SeqID_64373; Strand=+; Position=1 -192,365-439
MCDPWHCGVGAQHSPVSIACDGAETERMLGVPKDGELFLSRMKPEETLVEVRSDCAVQICCLTWGIFTMIPGVKRKNRDTVAKFSTYT

SEQ ID NO: 137951 - protein, 172 aa, Heterodera glycines
  Coding regions on vcDNA: vcDNA=SeqID_64374; Strand=-; Position=1 -169,540-678,984-1194
  Homolog annotation: Hit_ID=NP_496067.1; Match level="QueryCoverage =97%, HitCoverage=35%, E-value=7e-12, Identity=26%"; Hit description =poly polymerase   family member (2J898) [Caenorhabditis elegans] emb|CAA87419.1| Hypothetical protein T15
MIELNFFGIDVDLALVLIPNIEAIPDEPLDATDVKSMMEIMAFSLNPHEGMLKSLSGNYIYGNFVGFFNGAALSILAAKIILWYPNGSVPFMFEKLMFILMNRKWPMPIQLTEELENNGFESMSWNSSDKSTALLMPIITPSCLTQNASQSVNKSTFRIIQNTIRESNNNTF

SEQ ID NO: 137952 - protein, 581 aa, Heterodera glycines
  Coding regions on vcDNA: vcDNA=SeqID_64375; Strand=-; Position=1 -400,736-971,1362-1967,2847-3130,3512-3733
FDANEEAKERLINFIQFELIEDFMTILYSTDQKDFDEKNKKLKDKLEREEDEKKQREADLADQNMEQLIGEEERVKKLGQQMAARQTEKRKRRLESEQKRKLERQRRRLLVPSSHGTIIDQCNDEALFDTPSRYDESPNLSPSRHSDSPSWNSSENMLFSPLRHKVSNSLKISTSNSPRNWSNSVQSPVSNEKWQNRILADEFRTELSNLPKFISDEFLHFAYAQFLTNPTEMQRRILDIGIFVNEILHRTKIVAKINKILAIKRANEEERFKFKQLNEMDTSLFLEERLNETKILAIKTEGDFEKFAHLLYGILKRIIFEMEGKKIDIKLDEEDEEMKMVRKQLHRNKLAQAIEIGTPHGPKSVKSIWQSMDKKLQGKMLAQITGTSKQNLADRFIEYYLNGWRALGEQQRIDRKLYKEYEGKFMDKCKTNLGTNFPQNTQQIYFKSSEEEKHEEFVNFLNLFYFKLIKKNVIMKLVNLLRENGFHEAQPTESISALNTLKSLISAWSNDNARVLETGSQLLGARTTNADIDIICVMRQTLVTQKEEMDTFFGKNYCNLNERICDDNSLYCLLCKALSLN

SEQ ID NO: 137953 - protein, 77 aa, Heterodera glycines
  Coding regions on vcDNA: vcDNA=SeqID_64376; Strand=+; Position=1-234
MKDEEEYQNNRVRPFEIDQTRGIADRPRLKKYIENDSAIRQLVIAYDAKEEKNDDDLIRHIHALQYRVGMKGFEGWD

SEQ ID NO: 137954 - protein, 166 aa, Heterodera glycines
  Coding regions on vcDNA: vcDNA=SeqID_64377; Strand=+; Position=1 -246,383-566,646-716
MDRNSTKYKDAVVATGALGIGVAIATTQFGLLVGSAATNLLLDCLISTKNAGKDAINRGLSVEQSIEKRIYAAIEATQEIAKRKHFGTAACCGGPRVGAEGARHVSRVAYRSPNQLKDQRTHRGTAAAADVCPHRAVVEVHCPRGLRQAAPGMDVQQSEPIVDIGR

SEQ ID NO: 137955 - protein, 452 aa, Heterodera glycines
  Coding regions on vcDNA: vcDNA=SeqID_64378; Strand=-; Position=1-1356
  Homolog annotation: Hit_ID=XP_320889.1; Match level="QueryCoverage =86%, HitCoverage=49%, E-value=7e-32, Identity=24%"; Hit description =ENSANGP00000012033 [Anopheles gambiae] ref|XP_313651.1| ENSANGP00000013044 [Anopheles gambiae] ref|XP_314
MLADQQKMVQDQSQQIAQLIAIRQNAPNAAAQPNQGANSVPILPDISPFEPTDDKSRISEWIERFKFALDCTAPTADDEVKVKCLMNKLSESAFSEYSRSVLPSSVTDFSFKVTTEKLEKLFAKAQSIFIDRYECLKAVRGEGEQFRQFINRHRKLLTDFKFDELTKEQFNCLMLLMALKAPNEAALRQRILTKLSADGANISYDGVVEDLISFQSTISEAKAIEATSSSRPVNSIRQNSKPNNSTNKYVKESPKPNNLPNKFKERTNTEATTICWRCGFGVHRPDECRYKTSKCRKCEFVGHLDKQCERVQEWRKRQNAKKKGNNRVGHLRIGMTTHAVNSISLLKTAVLFNKKPVEFHLDTGSDIVVIDQLTHEYVGRPPIEKCNEIGKAFDGTKISFIGKGFGTFKFGKIEVEQTFYVAKAGSLNLLSCKMMDLFGLLDELKLRISNPT

SEQ ID NO: 137956 - protein, 47 aa, Heterodera glycines
  Coding regions on vcDNA: vcDNA=SeqID_64379; Strand=+; Position=1 -68,181-256
MKFYLLIFVPIREFSGYLMPISCRAGPGPKHGQLSTTEYRGPGFDQF

SEQ ID NO: 137957 - protein, 27 aa, Heterodera glycines
  Coding regions on vcDNA: vcDNA=SeqID_64380; Strand=+; Position=1 -68,387-402
MKFYLLIFVPIREFSGYLMPISCLIIK

SEQ ID NO: 137958 - protein, 52 aa, Heterodera glycines
  Coding regions on vcDNA: vcDNA=SeqID_64381; Strand=-; Position=1 -118,555-595
MTNTRKESKAMNGHGRTQKSKGRPTGEEKKQGQAIDQQKSCLPLNILFSIYY

SEQ ID NO: 137959 - protein, 38 aa, Heterodera glycines; identical to SEQ ID NO: 129423
  Coding regions on vcDNA: vcDNA=SeqID_64382; Strand=-; Position=1-327

SEQ ID NO: 137960 - protein, 386 aa, Heterodera glycines
  Coding regions on vcDNA: vcDNA=SeqID_64383; Strand=+; Position=1 -22,757-882,938-1053,1104-1230,2603-3372
  Homolog annotation: Hit_ID=NP_504186.1; Match level="QueryCoverage =44%, HitCoverage=20%, E-value=3e-11, Identity=26%"; Hit description =vglm uuk m polyprotein like family member (5E780) [Caenorhabditis elegans] gb|AAB63927.1| Hypothetical pr
MTPDENYGEHLAMASAGKKHTFLLGHKRFSSRTYMEEHAVSAASAWEVHGEVYEAVRLVKENFTEQSTRWMCFACQRTDHTFHRCPNKAILDEFKKFVHEFPQDQQKFRLVLSDKIAMDGKMLCELVPGFGRVLKWHNISISTIGVSQAPAPLLNADFLIEGRNVALVREKITDSFHCTDLKAAQAFNCTLGIDACTGCLPDHTDGTVSCHCRVANLEGLMEDPQRRLPLSFRHYELRNHGRRIFAITGYSPVQMNIQMDSLQMSLEMHQSLCTITPKHISGCYKCATGAQFSYSCHTDIGQTLADIQCEDGSHFTSKCGPNITDHTVVLPFQHAEISTTCQVMCLAGRTKFSLVGQLHYIPLRQQSEFGARVSESLEEASNSRLG

SEQ ID NO: 137961 - protein, 63 aa, Heterodera glycines
  Coding regions on vcDNA: vcDNA=SeqID_64384; Strand=+; Position=1 -132,416-475
SLSRTSSPSRFYEKLTRGASIGGGGGGDLRTLKPLPSTMSYDLKNIMRMTEIKTDIGFARAFV

SEQ ID NO: 137962 - protein, 65 aa, Heterodera glycines
  Coding regions on vcDNA: vcDNA=SeqID_64385; Strand=+; Position=1 -55,854-996
MGATSSSAEVAQATTSSSSFSVSSGGAFGACRRIASAFAASAAAFAESTAARADAGARIAGAENG

SEQ ID NO: 137963 - protein, 68 aa, Heterodera glycines
  Coding regions on vcDNA: vcDNA=SeqID_64386; Strand=-; Position=1-312
SELIFPVLFLLSHCFFCCLCARFAFRSSLESSFFFSSFSALLLFPMILLFFVPQHTARTSCCLCYFCR

SEQ ID NO: 137964 - protein, 97 aa, Heterodera glycines
  Coding regions on vcDNA: vcDNA=SeqID_64387; Strand=-; Position=1 -66,308-392,517-656
KSQLNADGHEICYDELLGNAIDGSYTYNPIQSIYDNEDMAKFTPTKNYEIDYLRSLPPLVTNGLFPLLKYAEHLLKLTHPEVIEGIKRPHHLVKEFR

SEQ ID NO: 137965 - protein, 49 aa, Heterodera glycines
  Coding regions on vcDNA: vcDNA=SeqID_64388; Strand=-; Position=1-147
MGRTRQVPQTWVIKPKKEVQWGRMTPRMKGIFDAVRTLCDPSLTLPMQQ

SEQ ID NO: 137966 - protein, 24 aa, Heterodera glycines
  Coding regions on vcDNA: vcDNA=SeqID_64389; Strand=+; Position=1-80
RTLSTAVRQRSSKIYSMPQILWAG

SEQ ID NO: 137967 - protein, 42 aa, Heterodera glycines; identical to SEQ ID NO: 128558
  Coding regions on vcDNA: vcDNA=SeqID_64390; Strand=+; Position=1-126

SEQ ID NO: 137968 - protein, 204 aa, Heterodera glycines
  Coding regions on vcDNA: vcDNA=SeqID_64391; Strand=-; Position=1 -321,496-787
  Homolog annotation: Hit_ID=CAE72291.1; Match level="QueryCoverage =91%, HitCoverage=11%, E-value=2e-64, Identity=66%"; Hit description =Hypothetical protein CBG19421 [Caenorhabditis briggsae]
ANYSLSDIVLQPYDAFTKIHTVKLQHILYNERNGIRSGQISHLVEGYLTKYGLPLEHAAHNQCTVLAKFGSLNERTIASFTDALENVLFHYPKKRETAPTYKYDEVQINCYDECEASVDIDDNVSDQRARVRLFCLAFLRGTSFLEIGLNDRRREGKEVVRRKDILPMYTERWIRFEAPEFHETVDKGVWGGGPGEAESRHATD

SEQ ID NO: 137969 - protein, 71 aa, Heterodera glycines
  Coding regions on vcDNA: vcDNA=SeqID_64392; Strand=+; Position=1 -117,197-292
MVNRGWVPNENIESELKKGKQLRESELKDLNAVVRSAEKGSPFVKNDPEKGIWAFKDLEEMARQSDAVPII

SEQ ID NO: 137970 - protein, 134 aa, Heterodera glycines
  Coding regions on vcDNA: vcDNA=SeqID_64393; Strand=-; Position=1 -29,644-821,862-1057
MPGSMDKYHQTTPLLLKCFVKRFPHIKQPSPKLLAFMRNVLRFADWIRDEEISAEIWSLIVEKLLHIDVALCFEREEEEQQPTNSNRLKQKKLDNETASEETTNPMREKLNTLVEFILNYLGDAEASKVTLIKE

SEQ ID NO: 137971 - protein, 244 aa, Heterodera glycines
  Coding regions on vcDNA: vcDNA=SeqID_64394; Strand=-; Position=1 -51,96-134,256-298,367-441,488-566,634-665,717-753,811-998
  Homolog annotation: Hit_ID=AAW30673.1; Match level="QueryCoverage =75%, HitCoverage=25%, E-value=8e-43, Identity=56%"; Hit description =Twik family of potassium channels protein 17, isoform f [Caenorhabditis elegans] ref|NP_741843.1| putative
SFIHGLFFSFNTITTIGLGNIRVQSWYLLGNIRVQSWYLLLVILYVIIGLAVITASSLDLCSSTLKKTFTKLHYFGRKIRGKTQLKSHFSRDMREAMKIISAKIRGKTQLKSHFSRDMREAMKIISAMKKIRGSKERITLEDLGSKERITLEDLKRFLKRFLEVQEHLLRQPYVPYDVHIFKWQPYVPYDVHIFKWIEDAVGIPFSYDKSPDWHFPLNASKASPPPSVQYMQYCFNNEESVSLG

SEQ ID NO: 137972 - protein, 225 aa, Heterodera glycines
  Coding regions on vcDNA: vcDNA=SeqID_64395; Strand=-; Position=1 -166,369-463,596-641,789-988,1139-1255,1397-1448
  Homolog annotation: Hit_ID=CAE70250.1; Match level="QueryCoverage =71%, HitCoverage=48%, E-value=4e-29, Identity=43%"; Hit description =Hypothetical protein CBG16742 [Caenorhabditis briggsae]
MEKSGGDSELEGGSRTELAQSDKGILLALALVLVDGIMVLALANDCWHGRIGIGIETPSLAPIRGVKWNDEFRRRYDEFEEGMSGEQSSGEHETVLQKTMKVIGLNILLFTYISLGAIVFIFLEADNELEQRRSKLSQILHIYELIMKETVAICRSAGATSLSALNGSMVERRMRPLLSVLSRTHEYDERFTAEAQMWSDSEHTLATKWTFAASSLYALTVITST

SEQ ID NO: 137973 - protein, 30 aa, Heterodera glycines; identical to SEQ ID NO: 126607
  Coding regions on vcDNA: vcDNA=SeqID_64396; Strand=+; Position=1-92

SEQ ID NO: 137974 - protein, 43 aa, Heterodera glycines
  Coding regions on vcDNA: vcDNA=SeqID_64397; Strand=-; Position=1-505
VVVKNFWVRNYFLKSVKHPISALLCRASAGNGWLSICKKLDWQ

SEQ ID NO: 137975 - protein, 116 aa, Heterodera glycines
  Coding regions on vcDNA: vcDNA=SeqID_64398; Strand=+; Position=1-349
  Homolog annotation: Hit_ID=CAE66832.1; Match level="QueryCoverage =93%, HitCoverage=48%, E-value=5e-15, Identity=37%"; Hit description =Hypothetical protein CBG12202 [Caenorhabditis briggsae]
MEKIWSTIEKGETSKTEKKNLTKETSEEVKSDERIDEEKSDQKIEEEKSKQKMEEPKSEGEKSDQKIEKENSDQKIEEEKSKQKMEEPKSDQKIEKENSDQKIEEEKSKQKMEEPK

SEQ ID NO: 137976 - protein, 104 aa, Heterodera glycines
  Coding regions on vcDNA: vcDNA=SeqID_64399; Strand=-; Position=1-315
MRKTFFIDGITEKGAAFVPAYGRLRQPFNINVAAHFYARHRVKLHHPYIPCIVERFECGENRNYPMELLEIVKEGQQPIGQWLGNLFKERDDIAAARQPCRTKL

SEQ ID NO: 137977 - protein, 87 aa, Heterodera glycines
  misc_feature (86)..(86): Xaa can be any naturally occurring amino acid
  Coding regions on vcDNA: vcDNA=SeqID_64400; Strand=-; Position=1-264
EKNDFFVFGAVPPNRCAQIYGETESFRNSFPIACTLILRWIFAPHNCLSTPNGHLKKSIFLFSGQSPRTDAPRFMGRPNPSGIASXI

SEQ ID NO: 137978 - protein, 80 aa, Heterodera glycines
  Coding regions on vcDNA: vcDNA=SeqID_64401; Strand=+; Position=1 -134,422-530
MNCVALSRKSITFFCELLSPPLPVKLDDLVKRKRQIGDQMAKVQKIEKIKPAQKVWDQKDLNLQKKKLNFLHLSLLVTGG

SEQ ID NO: 137979 - protein, 67 aa, Heterodera glycines
  Coding regions on vcDNA: vcDNA=SeqID_64402; Strand=-; Position=1-204
PLDDDQHYKTFPYNKATQREAVRLINEARRKSSSQVRKSSKPTANKMDTLLESNKFIVDEENEEKEE

SEQ ID NO: 137980 - protein, 115 aa, Heterodera glycines
  Coding regions on vcDNA: vcDNA=SeqID_64403; Strand=-; Position=1 -121,866-1092
  Homolog annotation: Hit_ID=NP_510622.2; Match level="QueryCoverage =71%, HitCoverage=17%, E-value=2e-18, Identity=56%"; Hit description =Na/H eXchanger (nhx-1) [Caenorhabditis elegans] emb|CAB09132.2| Hypothetical protein B0395.1 [Caenorhabdi
MSDNFTDEVQSSSIFPSLLNTSQVPSESFNNSSVQNVHLAGLTLYAFNSFFHGNPSPIALFLFATLISAVDPVAVICVFEEIHVNQLLYICVFGESLLNDAVTIVRIRPFFSFIL

SEQ ID NO: 137981 - protein, 103 aa, Heterodera glycines
  Coding regions on vcDNA: vcDNA=SeqID_64404; Strand=-; Position=1-314
  Homolog annotation: Hit_ID=EAK89729.1; Match level="QueryCoverage =93%, HitCoverage=33%, E-value=4e-11, Identity=31%"; Hit description =uncharacterized glycine-rich low complexity protein [Cryptosporidium parvum]
FQSLGLNPPTFRSTGLNPPAFQSLGLNPPTFQSTGLNPPAFQSLGLNPPTFQSPGLNPPVFQSLGLNPPTFQSTGLNPPAFQSLGLNPPAFQSTGLNPPAFNH

SEQ ID NO: 137982 - protein, 50 aa, Heterodera glycines
  Coding regions on vcDNA: vcDNA=SeqID_64405; Strand=-; Position=1 -139,398-411
MDTVDQSRAIDNLPPRATGDQWQCTAQFGKTGVSMSNALFLPPLVKEFFS

SEQ ID NO: 137983 - protein, 328 aa, Heterodera glycines
  Coding regions on vcDNA: vcDNA=SeqID_64406; Strand=-; Position=1 -98,152-298,418-514,616-752,806-909,985-1117,1169-1347
  Homolog annotation: Hit_ID=NP_493755.1; Match level="QueryCoverage =97%, HitCoverage=51%, E-value=3e-61, Identity=44%"; Hit description =endoplasmic reticulum membrane protein family member with at least 5 transmembrane coiled coil domains of
RSLIIHFYSLVNFLSPSLFSYINSGTGIENLTSLPNMINLTSLPNMIQNIGGQDQQLWMDFIMEASGVVENAEKIEAVRKERYEREIRTKEGTPLYFTKQNIRSTIGEMEKGKIEVFEQLHKLMGSEQIKDMNRTGFALLSKQQLDLLYGPNSEFHDEKVLKRFLALNRSVLKRFLALNRSTIQQHIERDIHSLAQIKSFKITRKFILVSWAWPSNFILVSWAWPSNPIICLQTFLDRSPIILSPIIFSPLILAPAVLGPVILSPWAFVPVILSPWAFVPVILSPRLLDPLILSPPILSPVILVRLLLHRPPILRVPQSPLALHPIIL

SEQ ID NO: 137984 - protein, 109 aa, Heterodera glycines
  Coding regions on vcDNA: vcDNA=SeqID_64407; Strand=+; Position=1 -28,377-678
  Homolog annotation: Hit_ID=NP_638970.1; Match level="QueryCoverage =68%, HitCoverage=22%, E-value=5e-17, Identity=45%"; Hit description =arabinogalactan endo-1,4-beta-galactosidase [Xanthomonas campestris pv. campestris str. ATCC 33913] gb|AA
MVIRLPISPAALFVRPQYSHFLKAELCHFNRYGKKVVVAEIGLSWNEPSASKSMLDDMFKRVKALGNNGIGIFYWEPQASPGWNHYQWGALDNSGKFTAAMESFKTTEE

SEQ ID NO: 137985 - protein, 40 aa, Heterodera glycines
  Coding regions on vcDNA: vcDNA=SeqID_64408; Strand=+; Position=1 -44,570-648
MQTARKGADQANSLLIYGCFSTGHKSQNKAIFAHLQKTAS

SEQ ID NO: 137986 - protein, 128 aa, Heterodera glycines
  Coding regions on vcDNA: vcDNA=SeqID_64409; Strand=+; Position=1-387
MAQLNSELIRANCEDSGFIDEIELRLISGALQFVHPNSPIPFERIPLHKIKHIISFENGRGAVNVLLVENFAYSSDHKLGLVSKCHLFETQRGDDDRGVAMVEEFCQGFKQKFGEILEKLSAEQQQKQ

SEQ ID NO: 137987 - protein, 228 aa, Heterodera glycines
  Coding regions on vcDNA: vcDNA=SeqID_64410; Strand=-; Position=1 -305,372-559,688-880
MPSLEGICRRHGNGRRRPSEGTLFSSICSRGQSRQFSQLLFFGLIGLMPLSLADSVPLAMRIKVRFCGFGLSLGLRPHCSDFTLSFPASPQCAKNGITSESGEFIGIAFHLFVFRQGTDTSKLEKFMFKMGVFALLFVFPSLIASACDLHQLSVLIQWLPHTVGSAGSDDGIDRGDGLGVMDVVAENTELVEEGIALWKDSGQRHREEKGRNRHENGGNGKRATGDGQ

SEQ ID NO: 137988 - protein, 55 aa, Heterodera glycines
  Coding regions on vcDNA: vcDNA=SeqID_64411; Strand=-; Position=1 -30,340-477
MDMDYSVDVKMEVHPAREPPPVKYEDTEDEAQVDKDDEPVSTDDYTEGTDSETED

SEQ ID NO: 137989 - protein, 95 aa, Heterodera glycines; identical to SEQ ID NO: 129573
  Coding regions on vcDNA: vcDNA=SeqID_64412; Strand=-; Position=1-821

SEQ ID NO: 137990 - protein, 16 aa, Heterodera glycines
  Coding regions on vcDNA: vcDNA=SeqID_64413; Strand=-; Position=1-49
EAIPEGFGLPINLGAS

SEQ ID NO: 137991 - protein, 53 aa, Heterodera glycines
  Coding regions on vcDNA: vcDNA=SeqID_64414; Strand=-; Position=1-293
LFFEKFFVFFSAGTASDNVFYLFRKINFFFLLIYFNYISSLHFLINIFKLSPY

SEQ ID NO: 137992 - protein, 46 aa, Heterodera glycines
  Coding regions on vcDNA: vcDNA=SeqID_64415; Strand=-; Position=1-356
INKKHCQRQCLPKKRQKNFRKKAKKIENLNKFTSEKRKKAYNTFDS

SEQ ID NO: 137993 - protein, 76 aa, Heterodera glycines
  Coding regions on vcDNA: vcDNA=SeqID_64416; Strand=-; Position=1-349
GIEGVVSFFPFSLVNLFKFSIFLAFFENFFVFFSAGTASDNVFYLFRKINFFFLLIYFNYISSLNFLINIFKLSPY

SEQ ID NO: 137994 - protein, 147 aa, Heterodera glycines
  Coding regions on vcDNA: vcDNA=SeqID_64417; Strand=-; Position=1 -114,459-573,1383-1506,1609-1698
MECALFSTGRDQTNLRGWTATAAETIRQEATAWHPKQWVRLFHMPKFCGLLKSALPEQNQRNCVAAAHEIPLSSSQVAHGADAPPLLFEPLLQMCKSNMNQEVELLSKLSAAASQPAVKKETTTIHRLEFTLITAYFKLFDPTPTSA

SEQ ID NO: 137995 - protein, 282 aa, Heterodera glycines
  Coding regions on vcDNA: vcDNA=SeqID_64418; Strand=-; Position=1 -58,536-614,909-1225,1361-1518,1566-1711,1758-1847
  Homolog annotation: Hit_ID=CAE58677.1; Match level="QueryCoverage =91%, HitCoverage=26%, E-value=4e-34, Identity=32%"; Hit description =Hypothetical protein CBG01851 [Caenorhabditis briggsae]
MSIRALKRRSVRSSTFFEKDLAVLLEFCGQQPADVVSWRDFEASAGSFNGWSKIGEGAFGEVFKGPLDGVCIVLKVFCFNVLPLFQVFFKVIPFAVNEDQCLKLVNGDHLKPAKFVFNELFITNELSKLSEAGNDFVTPSFTQLRMSKVVKGCLPSKLLKAWDDFKKAKPELVENDRPDIYAHEDLHFAIIGLSYGGKDLEKYTIKNGRECYSIFHQVALSLAIAEDVLEFEHRDLHAGNILVEQCPVDEKIRYLYRGEQIDVVSNGVRASIIDFSISHLEK

SEQ ID NO: 137996 - protein, 94 aa, Heterodera glycines
  Coding regions on vcDNA: vcDNA=SeqID_64419; Strand=-; Position=1 -86,373-486,594-677
FRMIPPFRIDLVNKEKSYSPPTGLALKRKDSELFSRPCTFLEDTRFYLLSKRQPIPAALRRNGLTSKAIDAIVKDLFGKAKSGEAKSPSPMDHK

SEQ ID NO: 137997 - protein, 51 aa, Heterodera glycines
  Coding regions on vcDNA: vcDNA=SeqID_64420; Strand=+; Position=1-154
MGSNGNPEEDLINLTDKLKKKLAKHGEDEEEEAKLKRRKSKKGIFDRTIQK

SEQ ID NO: 137998 - protein, 29 aa, Heterodera glycines
  Coding regions on vcDNA: vcDNA=SeqID_64421; Strand=+; Position=1-86
ESDSVDLQCFRHFLEPQFHRKYFPDRLSS

SEQ ID NO: 137999 - protein, 17 aa, Heterodera glycines
  Coding regions on vcDNA: vcDNA=SeqID_64422; Strand=-; Position=1-68
HKHLFDLFYHIHNLIKI

SEQ ID NO: 138000 - protein, 21 aa, Heterodera glycines
  Coding regions on vcDNA: vcDNA=SeqID_64423; Strand=+; Position=1-64
VTGVSIIAVLFLVFLMPLQNL

SEQ ID NO: 138001 - protein, 57 aa, Heterodera glycines
  Coding regions on vcDNA: vcDNA=SeqID_64424; Strand=-; Position=1-173
MNRDRHFEKKPGSVPGFCVGSGSDFLDKNPSPGNQGSSNLDSGLDLDFLKFVLKSQT

SEQ ID NO: 138002 - protein, 28 aa, Heterodera glycines
  Coding regions on vcDNA: vcDNA=SeqID_64425; Strand=-; Position=1-85
MHAKFVQIVAIACQWPEATLTDLNILKY

SEQ ID NO: 138003 - protein, 67 aa, Heterodera glycines
  Coding regions on vcDNA: vcDNA=SeqID_64426; Strand=+; Position=1 -145,351-409
MAHSAKQKMVKRSAYANLGPFFVEFYGGNHFIKQFIWQLFRGHFMSLGATFNNVEGRTKESNQNQID

SEQ ID NO: 138004 - protein, 143 aa, Heterodera glycines
  Coding regions on vcDNA: vcDNA=SeqID_64427; Strand=-; Position=1 -5,591-1017
  Homolog annotation: Hit_ID=CAE66832.1; Match level="QueryCoverage =92%, HitCoverage=60%, E-value=9e-20, Identity=37%"; Hit description =Hypothetical protein CBG12202 [Caenorhabditis briggsae]
MLEWKRKRNKKWKEKRERNRKRERKWKEEKREERQELKEVQKEEEKVEKKVEEKMEEEQKVEEKKAENEKWEEKEEDEQRMEEKEEQKVEGKEGDEQRMEEKEEQKVEGKEGEDSGAVEADEDFILKDFHDECTEEFILKSSN

SEQ ID NO: 138005 - protein, 95 aa, Heterodera glycines
  Coding regions on vcDNA: vcDNA=SeqID_64428; Strand=+; Position=1 -145,525-667
MAHSAKQKMVKRSAYANLGPFFVEFYGGNHFIKQFIWQLFRGHFMSLGDAFLTYVLSLLILKWKDALTIDNTVFLVEREEKRIKRETVKGCAINA

SEQ ID NO: 138006 - protein, 174 aa, Heterodera glycines
  Coding regions on vcDNA: vcDNA=SeqID_64429; Strand=-; Position=1 -450,802-876
  Homolog annotation: Hit_ID=CAE60395.1; Match level="QueryCoverage =81%, HitCoverage=67%, E-value=1e-14, Identity=34%"; Hit description =Hypothetical protein CBG03997 [Caenorhabditis briggsae]
MEEPKSEGEKSDQKIEKENSDQKIEEEKSKQKMEEPKSEGEKSDQKIEKENSDQKIEEEKSKQKMEEPKSEGEKSDQKIEKEKVDELGNSESIDESVNKSGEEASNVSQKTEYDIQSEEMDEKWNKIERKRTESQRKRQSQRQKQLISAKICVKMSRLFKNIKMKFCITCSQMP

SEQ ID NO: 138007 - protein, 40 aa, Heterodera glycines
  Coding regions on vcDNA: vcDNA=SeqID_64430; Strand=-; Position=1 -105,184-201
MPSNVRQRIVVLSLAWHCPKFVFRSSLFRISPTMLCLPAC

SEQ ID NO: 138008 - protein, 19 aa, Heterodera glycines
  Coding regions on vcDNA: vcDNA=SeqID_64431; Strand=+; Position=1 -39,293-313
MEKACKIWRDYIDNTGVAS

SEQ ID NO: 138009 - protein, 92 aa, Heterodera glycines
  misc_feature (89)..(89): Xaa can be any naturally occurring amino acid
  Coding regions on vcDNA: vcDNA=SeqID_64432; Strand=+; Position=1-575
FLSKKIFFWVFGAVPLNRCAQIYGETESFGNSFPIACTLILRWIFAPHNCLSTPNGHLKKSIFLFSGQSPRADAPRFMGRPNPSGIASXIAL

SEQ ID NO: 138010 - protein, 219 aa, Heterodera glycines
  Coding regions on vcDNA: vcDNA=SeqID_64433; Strand=-; Position=1 -147,303-474,1164-1278,1444-1669
MSGSALCPWAVNDLVRDGSDRTAKAMGCGGTNGEQNVRDCVKRAELEDLMDAIQKLDLIRLDLAMTRFNPRVDGEFVPSANLSLLIRTAPPKPTIMGFTPHEALFLTEYAFTLGVPLLGNFELDEDDRRVRAEMVHAYGSFVKNGVPNMLNGERDWPPLGTDRGQPVRLVHIKRPNTVAETGPMDVAQKETFWRRLSTLKGYTEVAGFPKEMAQLATEF

SEQ ID NO: 138011 - protein, 56 aa, Heterodera glycines
  Coding regions on vcDNA: vcDNA=SeqID_64434; Strand=+; Position=1 -113,838-895
MLQRLFVGKNFTCLPLFTSHRSYPGSNFTFPIDWYENKNPTFNNWSRKSAWVRLKK

SEQ ID NO: 138012 - protein, 25 aa, Heterodera glycines
  Coding regions on vcDNA: vcDNA=SeqID_64435; Strand=+; Position=1-77
MPVVVLRGVDDAYPPQKKAFAMLRW

SEQ ID NO: 138013 - protein, 177 aa, Heterodera glycines
  Coding regions on vcDNA: vcDNA=SeqID_64436; Strand=+; Position=1 -6,492-1019
MASEATQNLKTQICIKIFKTENVCGVSVPDDIETNLVEFVFDIGIMPLQNNVFNSEKGQQSGKTTRDDDYIFEVPTDHDHGNAMRSSRTVPITVYEAHKLNGKPIVINLGKIDPYGQFLNRRLFVERKNDLGRNYHALLYAIATKNGETEEKKVFVGFAQLVRANGETSTSEQRQVN

SEQ ID NO: 138014 - protein, 22 aa, Heterodera glycines
  Coding regions on vcDNA: vcDNA=SeqID_64437; Strand=-; Position=1-67
MVINSKISEKECNFLGSDKPFL

SEQ ID NO: 138015 - protein, 53 aa, Heterodera glycines
  Coding regions on vcDNA: vcDNA=SeqID_64438; Strand=-; Position=1 -46,434-549
MRHVSVELTPPNGRIRDFHMPTRLLSLDPVDFYPTLQAWIRQEDAFRSELGPS

SEQ ID NO: 138016 - protein, 59 aa, Heterodera glycines
  Coding regions on vcDNA: vcDNA=SeqID_64439; Strand=+; Position=1 -51,83-209
KKGGGKRVGKKVSPSSSSHIHELIHKNKKKMFLRPSSASQAKSSPTHTVIRHAHTIGST

SEQ ID NO: 138017 - protein, 165 aa, Heterodera glycines
  Coding regions on vcDNA: vcDNA=SeqID_64440; Strand=-; Position=1 -137,184-542
MQKLFFPLVNLYKDNCLQLMHEKLKNQQLDTWAQLKNAILKEKEAREQKMNELMSQKTNKSSTKIIQKLSRKSIKNHSKKQLETNLEKGSESIESGQLPSFYGTEQKMLRPKERVNKNIYKVLDVDQTLIVQGIDYHYFYRFDANAISCRHCPYRRPAQKNLKPT

SEQ ID NO: 138018 - protein, 31 aa, Heterodera glycines
  Coding regions on vcDNA: vcDNA=SeqID_64441; Strand=-; Position=1 -29,841-907
MPTVFNRSIRSYSILLTYVWSRGRLDQFPSK

SEQ ID NO: 138019 - protein, 155 aa, Heterodera glycines
  Coding regions on vcDNA: vcDNA=SeqID_64442; Strand=+; Position=1 -150,193-316,601-762,925-956
MNGSKSDETRAKITADVVEQKIKVVDKEKQQINENLYFAGISTKKTAEENAELKRQPFATEQRVLKLDVRKLFINLKGAKKRIISTIMKNGERTLDEIERVEKGHQIGHGTTKVGKRIAHFQVGSRIGTTKIRIQGTTHEDGNRTREKNDDWVIE

SEQ ID NO: 138020 - protein, 276 aa, Heterodera glycines
  Coding regions on vcDNA: vcDNA=SeqID_64443; Strand=+; Position=1 -88,501-849,1042-1154,1316-1596
MTNSSLKNVLTFANFMDDLFLDYKKNDKMDSVTNEAPYPRDGYCEKQKRTVFNVTFVKWAAELAHFHGKSSEEEYPNFKLVSKELFRYEFVGFDGFFYFDQLLGQQIANKFKNEFFSPQNPMANVVKNQILQLTLSLAARILLCVIIFPFQIIQIGDGQHLWTQFLSPTQNWVEYDTEQQQYIDNFKFILKLSEFKLTYYEMFNVVDTIMNRENEKNGRSQTSPARALYTFIKLHFASLLPPPSLALSLANGALRTNQPGSGAFRFMIFNENIRIN

SEQ ID NO: 138021 - protein, 426 aa, Heterodera glycines
  Coding regions on vcDNA: vcDNA=SeqID_64444; Strand=+; Position=1-1281
MNKISLLKLASEIFGIKSEQVAKTNKDDWKKFQQLENEVKILEERGARIYSTMNGKRKPHINNKNWVLSMDKPDDVIFGGTKSIKELNSQILKIEKLPWSQAGPGIVVDGKFYPLMSLEIGGIIDQFDIFNEFWKGIERANKTPKNPENLDQNSEEEKINISENSVKKSVENSETIQFEIIGETNEIEFETMCQIFKEERNVHGKDSVKRGDGLLNLKVKGSQPQVRKMSLKGIIKWTILAIFILFGHVKGMDNTKKLDESIIDELSDDGAIEEKDEKSQMHMSILNCPPTTSNAPQIQAEIGTLIQTQISAMAENWLRSAFQQGPMNEATNKKGNGGQKMGKKRAFPFSQSTAESGESWRKVGKTGASQWQRTHELTTAAADAVEALAEHLRDYNVAVSILLVTIAAGLAEMNNHYKGNFKGNRK

SEQ ID NO: 138022 - protein, 39 aa, Heterodera glycines
  Coding regions on vcDNA: vcDNA=SeqID_64445; Strand=-; Position=1 -105,157-171
MFYAPSKFGFYHAFIASLSVIIVSELGDKTWFIAAPKIQ

SEQ ID NO: 138023 - protein, 25 aa, Heterodera glycines
  Coding regions on vcDNA: vcDNA=SeqID_64446; Strand=+; Position=1-77
MGQALSEPITTKNSASCSNDRYFVG

SEQ ID NO: 138024 - protein, 100 aa, Heterodera glycines
  Coding regions on vcDNA: vcDNA=SeqID_64447; Strand=-; Position=1 -12,158-448
  Homolog annotation: Hit_ID=XP_318550.1; Match level="QueryCoverage =92%, HitCoverage=9%, E-value=4e-15, Identity=44%"; Hit description =ENSANGP00000020240 [Anopheles gambiae]
MKRRRWAIILLGYDFNIEYKSTSEFGHADVLYRLIAKTPLPDDERIVASISTAGSFVLNAIEKGLPIVNEDLIRAADQDQTIQKVKKFVKTQWPNNPPGK

SEQ ID NO: 138025 - protein, 79 aa, Heterodera glycines
  Coding regions on vcDNA: vcDNA=SeqID_64448; Strand=+; Position=1-238
TLEEEKSMGRHNHQATDAHIGFTFFENDIEKAKRKSFISRPEASFSKNKKKIYNTKGGGNLPTLKVSFGSPMVTWVPLL

SEQ ID NO: 138026 - protein, 92 aa, Heterodera glycines; identical to SEQ ID NO: 127421
  Coding regions on vcDNA: vcDNA=SeqID_64449; Strand=+; Position=1-304

SEQ ID NO: 138027 - protein, 56 aa, Heterodera glycines
  Coding regions on vcDNA: vcDNA=SeqID_64450; Strand=-; Position=1-277
SRAGPGILGKTGTGTCRDLRSRDRDRDLDFCSGPGPGTGTNREFLKIQKIKKKIKF

SEQ ID NO: 138028 - protein, 24 aa, Heterodera glycines
  Coding regions on vcDNA: vcDNA=SeqID_64451; Strand=-; Position=1-80
RTLSTAVRQRSSKIYSMQQILWAG

SEQ ID NO: 138029 - protein, 128 aa, Heterodera glycines; identical to SEQ ID NO: 125618
  Coding regions on vcDNA: vcDNA=SeqID_64452; Strand=+; Position=1-387

SEQ ID NO: 138030 - protein, 105 aa, Heterodera glycines
  Coding regions on vcDNA: vcDNA=SeqID_64453; Strand=+; Position=1 -213,281-385
  Homolog annotation: Hit_ID=NP_728531.1; Match level="QueryCoverage =85%, HitCoverage=6%, E-value=4e-27, Identity=55%"; Hit description =CG17090-PB, isoform B [Drosophila melanogaster] ref|NP_612038.2| CG17090-PA, isoform A [Drosophila melanog
MASYWRLKSIEEYELEMSTKSKETRRYVFNCLDDIGQVHLPSDLDDIDRMCERSDRLEFVDILKQMLSMDQDRRLTPTRGLQHKFVKMTHMIEMGRTKYCQVMNG

SEQ ID NO: 138031 - protein, 32 aa, Heterodera glycines
  Coding regions on vcDNA: vcDNA=SeqID_64454; Strand=+; Position=1-99
QLPRLTPTKNAHIQKSDEFKVNSIIYDKMVGI

SEQ ID NO: 138032 - protein, 212 aa, Heterodera glycines
  Coding regions on vcDNA: vcDNA=SeqID_64455; Strand=-; Position=1 -172,262-393,536-660,705-804,1629-1738
  Homolog annotation: Hit_ID=NP_508151.1; Match level="QueryCoverage =70%, HitCoverage=51%, E-value=2e-48, Identity=53%"; Hit description =vesicular integral-membrane protein (38.2 kD) (XB387) [Caenorhabditis elegans] gb|AAD50512.1| Intracellul
MFTIRKTSLLRLCLFASLITHPFSVLSDPTADAIDGISVAEMRGFLKREHTFVKPYQYADSDLPFWDIIGNAILTPQYIRLTSDLQSLSGGLWNKMACSIFNGMAIWYVQDPDTLGPVFGSKDYFRGLGIFIDTYSNHNGPHQHSHPYISAMVSNGSLHYDHDVDGTHTQLGGEHNDNHDVLSIRMFEQEFARVEKPFESANRDSVEPFAEK

SEQ ID NO: 138033 - protein, 73 aa, Heterodera glycines
  Coding regions on vcDNA: vcDNA=SeqID_64456; Strand=+; Position=1 -30,274-465
MAKLRNLCWSWFGFYTDNDTQTIVPMEQTELYKQVIHSSLTHRSMNQSEYETQLNRSKTDQKSIDLLFRIALD

SEQ ID NO: 138034 - protein, 48 aa, Heterodera glycines
  Coding regions on vcDNA: vcDNA=SeqID_64457; Strand=+; Position=1-145
  Homolog annotation: Hit_ID=EAL27993.1; Match level="QueryCoverage =97%, HitCoverage=25%, E-value=3e-11, Identity=70%"; Hit description =GA20349-PA [Drosophila pseudoobscura]
MVMLTVLKKARRKEQEMRVLILGLDNSGKTTFLKRISGEEIGEIAPTF

SEQ ID NO: 138035 - protein, 87 aa, Heterodera glycines; identical to SEQ ID NO: 129152
  Coding regions on vcDNA: vcDNA=SeqID_64458; Strand=-; Position=1-659

SEQ ID NO: 138036 - protein, 118 aa, Heterodera glycines
  Coding regions on vcDNA: vcDNA=SeqID_64459; Strand=+; Position=1 -91,749-1013
MEETIWHSIYENNGERKNENLLANKKRKTKRIVTGQFDSGQSDRGGQSDRDGQLDNGQSERDGQSDRDGQLDNGQSNRDGQSDRGGPIGQRWTIGQWTNPTEMDNRTEMDNWTMDNSD

SEQ ID NO: 138037 - protein, 54 aa, Heterodera glycines
  Coding regions on vcDNA: vcDNA=SeqID_64460; Strand=+; Position=1 -59,910-1015
MRAKFATIETGKKETMTFFKTPGPSQLSKTYSDRNQESGKTLTRPGLVSASRRQ

SEQ ID NO: 138038 - protein, 72 aa, Heterodera glycines
  Coding regions on vcDNA: vcDNA=SeqID_64461; Strand=+; Position=1 -45,2421-2498,2741-2836
MPKMDEKGNYWKICTTISQWPANADADAKLAACCQNMAAVKLMIEINIEYNAIISKNEENPSDGTTSSNLLD

SEQ ID NO: 138039 - protein, 64 aa, Heterodera glycines
  Coding regions on vcDNA: vcDNA=SeqID_64462; Strand=+; Position=1 -52,153-295
MFQKEATENANGKIGAKTSAEKDGPVLLTDVDAEAFKVMLRFIYSDDLSELNGQNATEVLYAGE

SEQ ID NO: 138040 - protein, 105 aa, Heterodera glycines
  Coding regions on vcDNA: vcDNA=SeqID_64463; Strand=-; Position=1 -33,479-587,646-783,944-972
  Homolog annotation: Hit_ID=CAE66281.1; Match level="QueryCoverage =98%, HitCoverage=17%, E-value=3e-28, Identity=59%"; Hit description =Hypothetical protein CBG11527 [Caenorhabditis briggsae]
DFHEHRQQRMDHDMYGLRPAHRFFQQHPAVNDCLANLLASGRITITDDISDDISTIGEHSICVKDGREFSADVIILCTGYNFGFPFIRPAELIPIRKQFLNLHFL

SEQ ID NO: 138041 - protein, 111 aa, Heterodera glycines
  Coding regions on vcDNA: vcDNA=SeqID_64464; Strand=+; Position=1 -125,198-254,323-427
  Homolog annotation: Hit_ID=CAE71449.1; Match level="QueryCoverage =100%, HitCoverage=24%, E-value=4e-31, Identity=63%"; Hit description= Hypothetical protein CBG18361 [Caenorhabditis briggsae]
SLKQRLSDAGVDFKEDLEKLRELKILVDFDEQGYLLQIFSKPCQDRPTLFLEIIQRHNHQGFGAGNFKALFESIEAGFGAGNFKALFESIEAEQNERGNLFYKDVAVGGEK

SEQ ID NO: 138042 - protein, 176 aa, Heterodera glycines
  Coding regions on vcDNA: vcDNA=SeqID_64465; Strand=+; Position=1 -135,329-571,621-773
MAEGKHSVNDKNGTSVLQKSDTRTDCIDLRCDGPIDQCTEMLAGKHIRHLLGESVPSDQLLLVPNASVALELFVRCCCSPGGDFLWLAFLHPPTDVVLCPIPFADEFLSEEFRSNSSIDFVTVNFPWNSSLLNCAELQQTTEGLGKVGRVIGPLADQPNQRTKIIERRRNKMRETL

SEQ ID NO: 138043 - protein, 97 aa, Heterodera glycines
  misc_feature (92)..(92): Xaa can be any naturally occurring amino acid
  Coding regions on vcDNA: vcDNA=SeqID_64466; Strand=+; Position=1 -111,153-251,952-996
  Homolog annotation: Hit_ID=AAC72366.2; Match level="QueryCoverage =98%, HitCoverage=7%, E-value=3e-30, Identity=76%"; Hit description =guanylyl cyclase [Heterodera glycines]
AKEIAELSFAFLRTVSNFRVDHLPSERVNLRIGFHSGPAVAGVVGLTMPRYPAVAGVVGLTMPRYCLFGDSVNTASRMESNGKAKKRIPNSXANCFS

SEQ ID NO: 138044 - protein, 77 aa, Heterodera glycines
  Coding regions on vcDNA: vcDNA=SeqID_64467; Strand=+; Position=1-234
MACTTESNGISYSMFKTAYCLYVFQMTNAQEDSPGFELIKEGCTAVNIRFTEAVPNEGVTLIAYGEADGLILIDRNR

SEQ ID NO: 138045 - protein, 122 aa, Heterodera glycines
  Coding regions on vcDNA: vcDNA=SeqID_64468; Strand=-; Position=1 -104,146-242,283-450
MTVTSNTEFRLIECVPILEEVAREFGCITPLPNLGSHRDYRVSGCMMIRTLTSLNRLYIFDAEDCIEVKGFLRQEDGTSQKVVNEYYEKYDGLNGFAEFIRNWAFTFFCFHAFDDDDTSDED

SEQ ID NO: 138046 - protein, 108 aa, Heterodera glycines
  Coding regions on vcDNA: vcDNA=SeqID_64469; Strand=-; Position=1-327
MDEELNKKEEPFTLAECCTAFDLVAVMFDCKIPVPYEEEQKRYVFEHQDKPRFIYISEEGDQIEFKGIVKQFGYVLSVETIYFDKEKGIDEFYNFLRNNVMCFFSVDS

SEQ ID NO: 138047 - protein, 151 aa, Heterodera glycines
  Coding regions on vcDNA: vcDNA=SeqID_64470; Strand=-; Position=1 -235,446-609,1166-1222
  Homolog annotation: Hit_ID=NP_493616.1; Match level="QueryCoverage =76%, HitCoverage=7%, E-value=2e-12, Identity=34%"; Hit description =polymerase epsilon (1P598) [Caenorhabditis elegans] emb|CAB04263.1| Hypothetical protein F33H2.5 [Caenorha
MADFAAVSVQIDAVLLSALIERPLRTELPHICHLSDVGAMFPNIILTNLIEEVCMACIHNVPEAKCKCPLQWVWRGEIGFCRNAFKRLHDTEEVQQQRRMTATTTICHRKNPSLYVDTDEPTFRYKYKQMRRKANRASEGLSNDIKKVGFG

SEQ ID NO: 138048 - protein, 59 aa, Heterodera glycines
  misc_feature (43)..(43): Xaa can be any naturally occurring amino acid
  Coding regions on vcDNA: vcDNA=SeqID_64471; Strand=-; Position=1-219
GMCLGFAFRISPFALFAFFGVSHFAFRFLARNATFTPLRIGLXSHKIFQNFTYKLANFQ

SEQ ID NO: 138049 - protein, 25 aa, Heterodera glycines
  Coding regions on vcDNA: vcDNA=SeqID_64472; Strand=+; Position=1-77
MVTAGQLQDLCSRIPRLADKHQNHK

SEQ ID NO: 138050 - protein, 104 aa, Heterodera glycines
  Coding regions on vcDNA: vcDNA=SeqID_64473; Strand=+; Position=1 -118,168-289,598-670
MLHFPLNFFQPKTVSPPKFKPIGELSDYQQQINGSKGMQEFSNIRLATPPPQPSPMLHNVPLPPAISVNDMMVDRNYIAKGVSSPKFKPIGELSDYQQQINGSQ

SEQ ID NO: 138051 - protein, 44 aa, Heterodera glycines; identical to SEQ ID NO: 126591
  Coding regions on vcDNA: vcDNA=SeqID_64474; Strand=+; Position=1 -45,128-217

SEQ ID NO: 138052 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_64475; Strand=-; Position=1-935
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 138053 - protein, 202 aa, Heterodera glycines
  Coding regions on vcDNA: vcDNA=SeqID_64476; Strand=-; Position=1 -194,3309-3587,3638-3771
MKIALGKEERRKRKRGKGKIRSKEGEKEEEKDENSIGEGGETEEKERKRKNSTEGGGENEAEKRDWICNDVWMDIFPSFDHPQLGLKLALLSPRFDALVDKHFDGKSELTIWRQIKIRKDKGPGPKLFVLFNDKFVEFPLPDDRPLPSKIRFKRLYIEYIDHSVIAFLRSNHQIFDKRGIDLQLWIPLSYTTDGQRIWDILT

SEQ ID NO: 138054 - protein, 45 aa, Heterodera glycines; identical to SEQ ID NO: 124527
  Coding regions on vcDNA: vcDNA=SeqID_64477; Strand=+; Position=1-138

SEQ ID NO: 138055 - protein, 135 aa, Heterodera glycines
  Coding regions on vcDNA: vcDNA=SeqID_64478; Strand=-; Position=1-679
VFGAVLPNRCAQIYGETESFRNSFPIACTLILRWIFAPHNCLSTPNGHLKKSIFFVFGAVPPNRCAQIYGETESFGSSFPIACTLILRWIFAPHNCLSTPNGHLKKSIFLFSGQSPRTDAPRFMGRPNPSGIASL

SEQ ID NO: 138056 - protein, 19 aa, Heterodera glycines
  Coding regions on vcDNA: vcDNA=SeqID_64479; Strand=-; Position=1 -35,132-156
MTMNGSDNRVERIRNVQKI

SEQ ID NO: 138057 - protein, 113 aa, Heterodera glycines
  Coding regions on vcDNA: vcDNA=SeqID_64480; Strand=+; Position=1-544
LIKNKSSFWSIAIANASSPKFHRRCHSPSVSPPPPPVLLFLCSSADLTPSPPFGPQLFLISAILCLFLLLSASSSAVILQLLLSVFCLRFRPFYNCIILSIEQLWHYFLLLVC

SEQ ID NO: 138058 - protein, 397 aa, Heterodera glycines
  misc_feature (7)..(7): Xaa can be any naturally occurring amino acid
  misc_feature (374)..(374): Xaa can be any naturally occurring amino acid
  misc_feature (393)..(393): Xaa can be any naturally occurring amino acid
  Coding regions on vcDNA: vcDNA=SeqID_64481; Strand=+; Position=1 -216,258-401,452-527,577-645,705-758,842-920,971-1019,1261-1530
  Homolog annotation: Hit_ID=CAE63282.1; Match level="QueryCoverage =95%, HitCoverage=73%, E-value=1e-51, Identity=34%"; Hit description =Hypothetical protein CBG07661 [Caenorhabditis briggsae]
HQKKIKXNAQQTFSQMLLPLFGSEYGTKDRRFVYCLFALSFFANFCIYAPWAFKKIIYQASNDLIDVEYLILRCPLVILRCPLVICDRKDTPWFRIYEWVREFLTRLLPFVLIAYFNVNILITYRTNKKDRLSLSSQSFHRKAVVEKRTNKKDRLSLSSQSFHRKAVVEKSEKEEKRLFTVLFAITVIFFLCTISEKEEKRLFTVLFAITVIFFLCTIPAAPVTIFISDRQSQSLPFQAPVTIFISDRQSQSLPFQIFRSASNLLEITKFALNFYLYCLINPDIRRVCLRVLIRRVCLRVLKCNGWTSAEGTTDQCQSPIGYTERQTNHSNHSSGQRMASRTTPRRSSARNTTDSHRTTICSNKDSSHWHAQLXTERMEKKMKKENEGICTFXGAII

SEQ ID NO: 138059 - protein, 290 aa, Heterodera glycines
  Coding regions on vcDNA: vcDNA=SeqID_64482; Strand=+; Position=1 -88,138-228,1055-1151,1196-1377,1422-1515,2439-2496,2550-2614
  Homolog annotation: Hit_ID=NP_507519.1; Match level="QueryCoverage =100%, HitCoverage=65%, E-value=4e-71, Identity=51%"; Hit description= predicted CDS, antiporter (5S473) [Caenorhabditis elegans] emb|CAC14416.2| Hypothetical protein Y59A8B.2
MLPYMASYMRNFTDPSVKIEHLIWVPTFQGCFPLAMVIGGFLSQRVGCFPLAMVIGGFLSQRVGPRLAAAIGCYTMCLGVLLSSWTIRHSYYGFLFTYGLMFGLGQGIAYVIAVSCVINWAPKMVGLGSGIVAAYVIAVSCVINWAPKMVGLGSGIVAAGFGISSSIFAPIQTRIVNPNNVAANKDGYFNDQHLLSRVPGLFVTLSRVPGLFVTLATAYFFMQCIGLLFICDPPDETFGETFIEDDFFLAFAFSLGSVANAIARVGWGLSVANAIARVGWGLLTDRTSFQ

SEQ ID NO: 138060 - protein, 49 aa, Heterodera glycines; identical to SEQ ID NO: 130195
  Coding regions on vcDNA: vcDNA=SeqID_64483; Strand=+; Position=1 -110,199-238

SEQ ID NO: 138061 - protein, 38 aa, Heterodera glycines
  misc_feature (13)..(13): Xaa can be any naturally occurring amino acid
  Coding regions on vcDNA: vcDNA=SeqID_64484; Strand=-; Position=1-288
IFYRFLNISDFFXAYQNFIEPGSFYSLSNRPKFFLQLN

SEQ ID NO: 138062 - protein, 73 aa, Heterodera glycines
  Coding regions on vcDNA: vcDNA=SeqID_64485; Strand=-; Position=1 -123,187-285
MGTAQCAHPCTSVPVLSPADPAVQRNSLALRSYPGPQSLFPQLKQQENVQAALTLRVIHHESCSRILAWRLFD

SEQ ID NO: 138063 - protein, 379 aa, Heterodera glycines
  Coding regions on vcDNA: vcDNA=SeqID_64486; Strand=+; Position=1-1137
MSASTSQAPTPLPTTSHASVAGPWQRGGSVKSRNSLKLLKRKIFGGTGSKNRENGGCDVAETTISVLFLIKLCRNQFEFQLLQFIKSFLIKTAPTDENIVWTAPSSPQIGRTFNGVTGMPRRRNSARLRELQRLLRAYHEQRRSEWTSTPSSPRIHQRQQMPMKEAPSPVGYHDQNFDHHGTNYPVHIPVAKLSYCRGELGPERPLILQSHSVDQQQQQNLPGPNVLRRKINLSELELALLNGANTSCPSSLFTNSSQTASSLQQPLPTSATVVVHTQPPGHATAEQAATTVVEEKHAYRATNFQHEQQHQQIISLSKHLQYQGATTVTSTTHFSSAVGSPQKQQMDFLIKKANYQPPIDLPLISPSPYEQIISYVAPP

SEQ ID NO: 138064 - protein, 328 aa, Heterodera glycines
  Coding regions on vcDNA: vcDNA=SeqID_64487; Strand=+; Position=1 -494,551-718,1025-1349
  Homolog annotation: Hit_ID=NP_500204.1; Match level="QueryCoverage =25%, HitCoverage=8%, E-value=7e-12, Identity=45%"; Hit description =CaDHerin family member (cdh-10) [Caenorhabditis elegans] pir||T33135 hypothetical protein C45G7.5 - Caenor
MASEKPNNKQKKKKKRRNKSDQMPKTHHGIVGQYAEIQNQQISGNQMASSPKLAKPQQQQNAKTYPKSGSSNILSLGFNQLVQRHFQQSQLPPKQQQQQQQNAVVEPMLKSARSEPRLTARANRREHWLLMSRPEIPGSSFLSPTPSIAALEHLDRVRDRISETKYVTAVFESRGGLGPVLSDVQAELEHWLGDTSLLLAIACEVHWSVPERFRSRQLEIELKQCLHAVLRVNNRRVLSLNDNDNDEETAAVTAKVSPADSPFLMPRHGPRHRSFSTHSLNNRSIGGGSGGRPFPIALARSKTEESCIRDAELDAFQGLECFTDEAPP

SEQ ID NO: 138065 - protein, 377 aa, Heterodera glycines
  Coding regions on vcDNA: vcDNA=SeqID_64488; Strand=+; Position=1 -114,169-230,348-600,685-956,1015-1103,1270-1350,1404-1569,2042-2137
LFIKNDYFIGRPWLVGKIQAIDEDLLPCNRIFYTVLPKKSDIIKVQTKHHKSALIKKPPLFSTFKPNSTHLAIISRHGIPENFRSILHLQIVPNPSNIAEHHHLPQQMPLGIIRANNSHSLLEHQFLRQQIPIEFDGMALGNGHYNSLPNKVNSSVTYPKLSFDSIKFLPYGQSDQHQKIGTFDVIRQLVGIDSANAKLRFNPAFVEAFENGLYKFGISVQDAIGNKAIVYRNIHLLDDKFRLRFRFNESLHTIGANLTTFIGKLEKRLQGDYRIMPSLPIRDEENPGQNFVMCFHLWSPTNNGSGDAIVEFAESERLLSTNVQNSKANEQLHSLYSEYKVINIESCAAADSSTSSVLLNSDSFGSSMVQPNAKAVL

SEQ ID NO: 138066 - protein, 39 aa, Heterodera glycines
  Coding regions on vcDNA: vcDNA=SeqID_64489; Strand=+; Position=1-3,61- 177
MLHTTPPDNPYSVYAKSNNKLTPSSMFAMPEFIHPKTLR

SEQ ID NO: 138067 - protein, 182 aa, Heterodera glycines
  Coding regions on vcDNA: vcDNA=SeqID_64490; Strand=+; Position=1 -111,580-1017
MICFHSLLSLLMLFIAMLLLTMQNRAVDSFLLSHRNLLVPFASTKMAMANNVAKLDTTNNNNIGVRRRHHFVSLFMMKALPKSGDGDDDERQIGAKNVLFQNDGNHLLLQPSANDGAIAPQRVHSRRKRLHMLSTLRRVGTPRRSTELLKRLVVEHQQQKQRHVPLKRILSFDLLWMFKRDF

SEQ ID NO: 138068 - protein, 18 aa, Heterodera glycines
  Coding regions on vcDNA: vcDNA=SeqID_64491; Strand=+; Position=1-56
YREAIPEGFGLPINLGAS

SEQ ID NO: 138069 - protein, 70 aa, Heterodera glycines
  Coding regions on vcDNA: vcDNA=SeqID_64492; Strand=+; Position=1 -136,351-427
MSLQIGIPVLGNRLRTIPSLSLVNGFERINWMNEMSKNGRNERKNVRKCFILNSSLGYYVRHYFGVSSLF

SEQ ID NO: 138070 - protein, 41 aa, Heterodera glycines
  Coding regions on vcDNA: vcDNA=SeqID_64493; Strand=+; Position=1-462
NFLKYKPKLFGLFKKELKIFKNFIHLPFDRKSIREPYLTFN

SEQ ID NO: 138071 - protein, 348 aa, Heterodera glycines
  Coding regions on vcDNA: vcDNA=SeqID_64494; Strand=-; Position=1 -117,170-348,393-598,891-1121,2337-2383,2429-2553,2607-2748
MHNLSFELRSEDVLKGHDWHCRDSETEVFDRIVKQIQVKRRVDVEEHFRQIVVYKRKRAEEEETDEAEEREEGEKGQRHGEGARGQELTLEQILDPSDQPTTTTAAPSPRSSLLTSSPDVISYSMLQPFLPDRTDQQRNTVAAEPVQTKVLINAGGRKVYNLGVEFSKYRQKRRGQIPDPSERPLQGYSLPNLLKELALLTYELKSLRTMMTVGVGDGERGEGEEKPTTESIEWTEQREQLLGNLNAARHVRLALLGSVQGNFSIPSAPSLSRQFNENELPFSLSVTPSASRMQIETKGDARLLLGVRVLVEKRRRSRREPSDAEPVTLDLVQLRTQTNFIQQTVTIK

SEQ ID NO: 138072 - protein, 19 aa, Heterodera glycines
  Coding regions on vcDNA: vcDNA=SeqID_64495; Strand=+; Position=1-59
SVEQRPESLILEFQLSDNL

SEQ ID NO: 138073 - protein, 241 aa, Heterodera glycines
  misc_feature (17)..(17): Xaa can be any naturally occurring amino acid
  Coding regions on vcDNA: vcDNA=SeqID_64496; Strand=-; Position=1 -81,136-206,296-395,449-528,577-637,688-890
  Homolog annotation: Hit_ID=CAE60538.1; Match level="QueryCoverage =92%, HitCoverage=52%, E-value=2e-63, Identity=60%"; Hit description =Hypothetical protein CBG04165 [Caenorhabditis briggsae]
AKGQNAKSLSQLIKKSXGRKMVAAGYALYGSATMVVLLYGSATMVVLSTPGRVDGFTLDPSIGEFILTNPAMRVPKKGKIYSINEGYAKKWSKGITEYIRITEYIRSRKFPEEGKSAYGQRYVGSMVADVHRTLLYGGIFMYPATTDVADVHRTLLYGGIFMYPATTDAPNGKLAPNGKLRLLYECNPMAFVMENAGGKAHSGKCPILDIQPKSIHQRAPIFLGSKEDVEELLEYIRKHDQ

SEQ ID NO: 138074 - protein, 29 aa, Heterodera glycines
  Coding regions on vcDNA: vcDNA=SeqID_64497; Strand=+; Position=1-91
TRAEIYVQGSLLLAIEASVRHWGQHFMCR

SEQ ID NO: 138075 - protein, 214 aa, Heterodera glycines
  Coding regions on vcDNA: vcDNA=SeqID_64498; Strand=+; Position=1 -81,138-304,364-433,480-624,694-753
  Homolog annotation: Hit_ID=CAE65791.1; Match level="QueryCoverage =97%, HitCoverage=43%, E-value=4e-37, Identity=43%"; Hit description =Hypothetical protein CBG10895 [Caenorhabditis briggsae]
TQYFGTILIGFPPQQFQVLFDTGSSNLWVPCKGCNDWVPCKGCNDSACSTHRQFSCHNSVGCQMAGQNFDIVYGTGSASGVLLQDIVCVRINVNLCTNTTQKFGCSVNLCTNTTQKFGCSMSEPGDVFSNAAFDGILGMAWNSINAAFDGILGMAWNSISTDAAVQPLAQIFENEDCDEKVFAFWLVAKESNRAKAKGGQMTLCTDKSRYKVRT

SEQ ID NO: 138076 - protein, 172 aa, Heterodera glycines
  misc_feature (3)..(3): Xaa can be any naturally occurring amino acid
  Coding regions on vcDNA: vcDNA=SeqID_64499; Strand=-; Position=1 -59,171-242,292-419,525-568,633-776
  Homolog annotation: Hit_ID=XP_392652.1; Match level="QueryCoverage =98%, HitCoverage=10%, E-value=2e-45, Identity=56%"; Hit description =similar to CG4032-PA [Apis mellifera]
SLXVRVLYNKSGEWCEVHSQYGQIGWVPSLYIAPANSLDKHSWYHGKVTRAEAEQLLGSWYHGKVTRAEAEQLLGSGINGSFLVRESETNPGQFSISLRHEGRVYHYRISFDANFRLFILFITESAKFKSLGELVHHHSMSASGLICSSSYFLFCHFLKRHFNVSGEPDEWE

SEQ ID NO: 138077 - protein, 64 aa, Heterodera glycines
  misc_feature (11)..(11): Xaa can be any naturally occurring amino acid
  Coding regions on vcDNA: vcDNA=SeqID_64500; Strand=+; Position=1 -169,231-262
VAERGMSLGVXSEIIEEKAVTGAGQRKVATKSERISGRRRKMPEKRRKRGTNTRKNGNGHLHLK

SEQ ID NO: 138078 - protein, 181 aa, Heterodera glycines
  Coding regions on vcDNA: vcDNA=SeqID_64501; Strand=+; Position=1 -96,135-252,468-628,667-837
MPKQNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQERMERKNSYFWDFFRNQN

SEQ ID NO: 138079 - protein, 231 aa, Heterodera glycines
  Coding regions on vcDNA: vcDNA=SeqID_64502; Strand=-; Position=1 -230,287-752
MTEAKNEKQSVVMPPFTLSTGTTTAASVSSIEEDDADEYGMLDEYMANVEKQRKIAPIGSEANHLGNGSKKRPNTLKLSCPKPISVINNGNIPNGLSAAYEPISPGEILRDDQQNFGNNNNDDRKKGSMTDTGDVPYQFNVDKFISDILPQPTAQQQSLLYNSDLSSNNRFFTPLAQQPLTADSPLFTPIVPSIDHYGVKDPWYYGKVNDISSAHPLQQPLMDSTNPWAYP

SEQ ID NO: 138080 - protein, 42 aa, Heterodera glycines
  Coding regions on vcDNA: vcDNA=SeqID_64503; Strand=-; Position=1 -44,185-269
MIRKAPQTLRGKLPGKCSETHQILFTSYFRHSDAFSIKKGDE

SEQ ID NO: 138081 - protein, 80 aa, Heterodera glycines
  Coding regions on vcDNA: vcDNA=SeqID_64504; Strand=-; Position=1-323
FLPGGTQFFTLTTPALFFLNYFLHLITQRSRLIRSSPNFAGKLLRTLQMLINFLRIFCLEEHSSSHLPHQHYFFLIIFCI

SEQ ID NO: 138082 - protein, 400 aa, Heterodera glycines
  Coding regions on vcDNA: vcDNA=SeqID_64505; Strand=+; Position=1-1203
  Homolog annotation: Hit_ID=NP_912739.1; Match level="QueryCoverage =57%, HitCoverage=19%, E-value=4e-21, Identity=31%"; Hit description =unnamed protein product [Oryza sativa (japonica cultivar-group)]
MNFRGATEAYAIVHSLPFAKLSHQVVKLSIHMPNQQPIVYRAFQLVSKAQQIQQGELPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKMESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGLKGPSYQ

SEQ ID NO: 138083 - protein, 1427 aa, Heterodera glycines
  Coding regions on vcDNA: vcDNA=SeqID_64506; Strand=-; Position=1-4284
  Homolog annotation: Hit_ID=NP_913627.1; Match level="QueryCoverage =99%, HitCoverage=92%, E-value=1e-116, Identity=27%"; Hit description= putative helicase [Oryza sativa (japonica cultivar-group)]
MSRYNNLLQFASVSAGNKPSPAGGPMAVILNGEFHRRISSMQAGTTQIPGFGQLYILDPVEAMEQRRKNPTFTGEKITNDEEFVQGHQLNEATLEILEQVIQENHPAASAYKQAREQLQELLKQQRTEELRFFRMTLLDERSAPGGMKDPKLHPHQIITPSTGEGMFAIHADPTGAPAPKGIWVENKQGQLNEIAPFSPWTDSLTYPLIKPKGDDGYKFGIPYAKPAQRKRKSDNSDDMFDTEAMSDDDMCETESIAFSDTGSETSTQSVTSRYDKSKRFVSLRDYCKYHLAIRDENLEWQYHHILSCGGGLGQRWVLDQASKIDWQIATFLRRPDMDLRVSTPKNLLQYLVNQYNKQQARQNPNAQQKSVDDIGSVVRLSERNVNSLQYWKKMYEDCNTIFARCHDAKKARLFITFTNNREWPEFKENIYKNGQMFTDRFDMWMRVWSSKIAVFHQELYEKSFFGTILGSGESMEFQGRGGPHAHIVAQTDLDVVPEVIQEYIWAHIPPLPDKDDDSPIAQMHREVRDYMHMQLHRCSDSWCGPRDPNFGRCKKGFPAPYSKCTILHPDRPALYYRPSPTDGGAKIEVNGLIYDNSQVVPYNPYILLRYRVHHNVLFAYGNKANIKYALKYPFKGPGHCYVECKEESGSKIGIDEPAQYAKMNFRGATEAFAVVHSMQFAKLSHHVVQLSIHLPNQQPVVYRAFQLVSKAEEIQRGELPETPCSAYWKQWQNEWQHVPSLKDMLFEKVPEQFRWAKDRWVLYKRKPTKRPPIGRVVPVPPTDRERFALYALMRHFPGDPDHLKLVNGQQYNTFTEAALQHGLLEDDQIWHKTLGEAALHRWPDQMRWLFVSILVFGQPSNALELWNKYKDQMYNPQGITSAAIRQAREQQALADIDWRLHFFNLSCVHCGLPDPPNSKAKNINLAIEEYFYGDDGLNMPPGQPKQRPQQNTPPPLNSDQQKVFDAVVRAIQSDPKDQTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIEVIDRVCKEMAIPQHKDLLFGGKTVIFSGDFKQSLPVVPHEGLTAQVTACFQTSPLFCQFTTMKLTINQRLGQGQQAYLQMCRQIGLGETGEYFWIPPQFLVKSREELIDFVYPDFQKLLGNDKELLNRLILAPHIDTCDEINEIMMANVPGQVREYLSTDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGLKYERLQFPIKPAFAMTILKGQGQTISTVGIDLERDVFSHGQLYTAFSRATDGSNVRVYAPRRETDAQDRVKVLNIVATKMLNLQ

SEQ ID NO: 138084 - protein, 943 aa, Heterodera glycines
  Coding regions on vcDNA: vcDNA=SeqID_64507; Strand=-; Position=1-2830
  Homolog annotation: Hit_ID=NP_921817.1; Match level="QueryCoverage =31%, HitCoverage=18%, E-value=2e-21, Identity=27%"; Hit description =hypothetical protein [Oryza sativa (japonica cultivar-group)] gb|AAP54104.1| hypothetical protein [Oryza
MPSKQHAKRKKEQERYQRQMEQSVSPGRSPVPDGSADENGVASHPGTTTPNISALQLSTPASSIGSKRRGRPPKAGAESIMTSQHSVSSADTQVTLATQNVESSPSSKKWKVGEVDRSMSAIGAIASTPVSRQKSRGGRPTKKRGGPGRGQTNYSMSNGSSMNHGSEDTTLLVVLPALPENMNFSTVSINFATSRNFACKIWKWAAIGLYERDGETALAPSSGPRYIETCWNDLTQFLNDGFAATYLAYLATISQRKVVVVDPMVWSNGLDRVMPYKNMTFGYDPNVPAEVILLPVHFPGHWALIVHDVQFGTHFADSLPTPYGRLDPQLTDKIKKIICDILPSTVLTGILNAENLTVQHDGNSCGYFVCLYAESWLMNNRTFVLPSLFINYEKKRILWHINELYGSDNVPYHPREGVPTPCPIVYRHTDEAQSTSKAAESMEVDDKNDIMIIEPQTSGQAANAILTQAQVDGENQVDTLGLVSESCVPQEPIAQADDAIFVRPKTPPRRSTRIGRRQSTSISRSPSPAPRRSSSANAVEKVTAFTKRCYLVHKGWCCAAAAAKHFPEYSDSGKLGEKKCAHCGALLFPHEDSSHCCRQGRVVLPKLNPHPKELEELIVCDKQPRQGKEFVRNMSRYNNLLQFASVSAGNKPCPAGGPMAVILNGEFHRRISSMQAGTTQIPGFGQLYILDPVEAMEQRRKNPTFTGEKITNDKEFVQGHQLNDETLEILEQMIQENHPAASAYKQAREQLQELLRQQRTEELRFFRMTLLNERSAPGGMKDPKLHPHQIITPSTGEGMFAIHADPTGAPAPKGIWVENKQGQLNEIAPFSPWTDSLTYPLIKPKGDDGYQIGIPYAKPAQKKRRSDQCVDQMFDTDAMSDDGCCETESIAASDAESVESTESLIDRIDKTRKFISLRDYCKYHLAIRDENLEWQYHHILSCG

SEQ ID NO: 138085 - protein, 35 aa, Heterodera glycines
  Coding regions on vcDNA: vcDNA=SeqID_64508; Strand=-; Position=1-157
FGLENSVLHSFTLLRYRLLVCHFLASLIIKSQIVE

SEQ ID NO: 138086 - protein, 192 aa, Heterodera glycines
  Coding regions on vcDNA: vcDNA=SeqID_64509; Strand=-; Position=1 -113,452-588,1918-2084,2445-2589,2835-2851
MGSDEWCTERNWRQFCAISWLEQLNTLDLSQTNLSICRFVCNDISDGYFPHFGTFSTRTQIGTDFAPFYALVDKHFDGESGLSPHKQQRLDGNFPFFDHAQLGLKLALLSPVSISWWTNILMKKQNDCGPQIERTNLNVLVFSDVWMGIFPLFDRPQLGLKLALISPRFDVLVDKHFDGQTRIFSNFESFSF

SEQ ID NO: 138087 - protein, 32 aa, Heterodera glycines
  Coding regions on vcDNA: vcDNA=SeqID_64510; Strand=-; Position=1 -42,311-367
MYRENARISNSTKNLTNEREVEFGLLKKFRKK

SEQ ID NO: 138088 - protein, 165 aa, Heterodera glycines
  Coding regions on vcDNA: vcDNA=SeqID_64511; Strand=+; Position=1 -171,515-842
FTSPAEKKKKFSSADHCLISSAKIGENQQQSLGSSFETTFGEEQKKKMNDRILKRKIWICSDVLMDILPFFDHFKLGLKLALISDRFDILVDTHFDGKSELTIWRPITIRKGPEPDLFDCGSNSVPFPSPDDSPLQLFVKGKSEGFPLPHRPLPSKMHFKCLQIK

SEQ ID NO: 138089 - protein, 45 aa, Heterodera glycines
  Coding regions on vcDNA: vcDNA=SeqID_64512; Strand=-; Position=1 -49,227-315
MDTAVLVISNPENLRKGEANSQCDKSRDFFFNEFPCLNQNHISAC

SEQ ID NO: 138090 - protein, 124 aa, Heterodera glycines
  Coding regions on vcDNA: vcDNA=SeqID_64513; Strand=+; Position=1 -45,235-500,569-632
MVLDSELVEMDAGSVAFLRATTLAAYTVQFSLADTTPIVPFELVNERTQEKLTLMYIIIEHADYNGWQLKRCPISEKAADQWEDEILDDLNGVSIDLHEHFDIGQLSPPPATATEEEEEADQSN

SEQ ID NO: 138091 - protein, 217 aa, Heterodera glycines
  Coding regions on vcDNA: vcDNA=SeqID_64514; Strand=+; Position=1 -384,451-720
MRLPWLSAPAASFEANVQPIWDVFAREIWPIFAPNIRHLLLTVRDHLDNLRRCTSPTILTDLINLNSICSFCLRPDGIADFDGPNLNAGQALAKWLHIPRTDGQPKRLRFCKDLEEQHNFDWVNSFKEAFLRATTLAAAYIVQFPLAPTTPIVPFELVNERTQEKLTLMNVIRIGSVNGWQLKRCPISEKAALQWEFHILDDLNNLSIYLHNHNQIG

SEQ ID NO: 138092 - protein, 39 aa, Heterodera glycines
  Coding regions on vcDNA: vcDNA=SeqID_64515; Strand=+; Position=1 -108,324-335
MGFPKAGQDPGAGFCWVPPVRFLKENDGKANFEEENLDL

SEQ ID NO: 138093 - protein, 96 aa, Heterodera glycines
  Coding regions on vcDNA: vcDNA=SeqID_64516; Strand=+; Position=1-291
MFPNKRKCSFNPDWEKQYTFVKRSRKGNGFFYCAFCQKDINVESMGVSAIKSHTENKEHKQIKEERRKSTTIENFVRSKSTLNSIDLQVATAEGHF

SEQ ID NO: 138094 - protein, 59 aa, Heterodera glycines
  Coding regions on vcDNA: vcDNA=SeqID_64517; Strand=-; Position=1 -92,454-541
MKAKSQGIEQKVHEFLSDCPCIFNHLLMKKWCVVSFNLCPYDFGNRMQVHNNGKCTKYA

SEQ ID NO: 138095 - protein, 62 aa, Heterodera glycines
  Coding regions on vcDNA: vcDNA=SeqID_64518; Strand=-; Position=1 -84,860-964
MRMNTGTAYNAKWSLRRADSWSMSAWHNVKKLSKATEKMEKKKRTKKKRESAKKEKLNWKWK

SEQ ID NO: 138096 - protein, 71 aa, Heterodera glycines
  Coding regions on vcDNA: vcDNA=SeqID_64519; Strand=-; Position=1 -87,624-712,804-843
MPTGWKCADKATPNFGSAASEQKLQGFFRVSSFGGTDEQQQQQFQCGGKGSTRGREAAEKGSETHQILFTC

SEQ ID NO: 138097 - protein, 132 aa, Heterodera glycines
  Coding regions on vcDNA: vcDNA=SeqID_64520; Strand=+; Position=1 -259,307-446
MSSIIWQIGLFNKLPNGKAECVECKANQLQKFEFERSHGSLKSLIVHLFSKIHANSTYAEKYRQLEKTSNKDESQKKLSTFFPCSSSTLAVMDKKVVNFLVSTNTSFKVVNHPTFQSLLAPQHIKVRYSLVY

SEQ ID NO: 138098 - protein, 430 aa, Heterodera glycines
  Coding regions on vcDNA: vcDNA=SeqID_64521; Strand=+; Position=1 -168,346-591,635-839,884-1016,1062-1303,1343-1641
  Homolog annotation: Hit_ID=AAL93203.1; Match level="QueryCoverage =92%, HitCoverage=60%, E-value=2e-33, Identity=27%"; Hit description =transposase [Bactrocera dorsalis]
MNSKSVNRFHSRRMRGVGQQTISYGQHKNVNLLKLHFSLTAHGITQNWTMKNHVLAAFSQTIVDENGLTTQILAYENVSCGAHLLNLVVQKSIKSERIADLLKQCRKVVAHFKHSNKALGMLKDIQIFLDLPDHSLLQEVSVRWNSALGMISRLFEQREALYQYAFENRNFEMTLTNEEWGLIEEMISLLQPIEDASKMLVKAPLSAQIPIALTLHGKLYTAKLINKDIDVVRCSLVNELEKYFFALREKRVHCLSTFLDLRFKDKFLLEGRNIFLAKISSWLKEELDDFILPLVNECDEIALAPSPKKQKLSLFDDLNDIASTSNKENAGNPSQNSSDLDDELNKYLASGCVNSREDPLTAWRQMAPKFPILSKIARKFLTAPATSVPSEATFKVARDVYDYRRSQLKPETAEMLIFLNKALPNINYRY

SEQ ID NO: 138099 - protein, 31 aa, Heterodera glycines
  Coding regions on vcDNA: vcDNA=SeqID_64522; Strand=+; Position=1-96
EPQYELECLNSSNNVKDRGRGPGELGDGEQP

SEQ ID NO: 138100 - protein, 58 aa, Heterodera glycines
  Coding regions on vcDNA: vcDNA=SeqID_64523; Strand=+; Position=1 -84,319-411
MAKAIKMLFHFIRIYFHHLFFAIITVIYLNGTLNPQKFERIFFILTVSEFDGCHTLWP

SEQ ID NO: 138101 - protein, 24 aa, Heterodera glycines
  Coding regions on vcDNA: vcDNA=SeqID_64524; Strand=+; Position=1-76
VTGVSIIAVLFLVFLMPLQNLVRF

SEQ ID NO: 138102 - protein, 36 aa, Heterodera glycines
  Coding regions on vcDNA: vcDNA=SeqID_64525; Strand=+; Position=1-173
NESLIIQNINYHLDFFSPKSNIDGLYSQTKKANAFR

SEQ ID NO: 138103 - protein, 114 aa, Heterodera glycines
  Coding regions on vcDNA: vcDNA=SeqID_64526; Strand=-; Position=1-345
MTREYSDSYILEYVSAGPKQYALKLKRKKDGVIWYKTKIRGFTLNKDNRVDYEEFKSMVLSYTEGVKKVFRYPEKIGPTRDSRMLSRDVKKEYSPVQKKGIIDDDYNVLPFGYY

SEQ ID NO: 138104 - protein, 63 aa, Heterodera glycines
  Coding regions on vcDNA: vcDNA=SeqID_64527; Strand=-; Position=1 -185,227-233
MTVDLYCGTLSDPVIIPGRPPGQITADVVFNEFMRRQQSYRDVNLLEERISMKMTTFSLPLRR

SEQ ID NO: 138105 - protein, 122 aa, Heterodera glycines
  Coding regions on vcDNA: vcDNA=SeqID_64528; Strand=+; Position=1 -128,197-316,368-487
  Homolog annotation: Hit_ID=CAE75473.1; Match level="QueryCoverage =96%, HitCoverage=23%, E-value=3e-24, Identity=44%"; Hit description =Hypothetical protein CBG23475 [Caenorhabditis briggsae]
MQKLPSAVTALLRNGFISTSMKQSTVDSLIWSMTKAKRQRLQVKNGFLSHFYDISQVITGSLTMGLLGGSDKEFQELCAYFKEQVCAFVVDIFNPDKVRFTTVEHLTEDVKKLLMYRIGLIK

SEQ ID NO: 138106 - protein, 21 aa, Heterodera glycines
  Coding regions on vcDNA: vcDNA=SeqID_64529; Strand=-; Position=1-65
MIEPIGKANLRKACAVRDTRS

SEQ ID NO: 138107 - protein, 177 aa, Heterodera glycines
  Coding regions on vcDNA: vcDNA=SeqID_64530; Strand=+; Position=1 -135,384-533,577-727,807-902
KQSDEYKALVNLRDSMQKNHESIMKAISFAQEMIGMERKLDDYTNNVRIPIKNLFVHMRKFWDPSTDKSPEAVEIFSKACYTTELANTPLGILNVYIHTHTVEGCKMGLKPNQISLLSKFVPLLQKIRMKLGDQMDKDDFNTRVPVKEFFFLVLTSWFMEIDTKVARMVLGKIKKLI

SEQ ID NO: 138108 - protein, 93 aa, Heterodera glycines
  Coding regions on vcDNA: vcDNA=SeqID_64531; Strand=+; Position=1 -132,611-760
MVGSFCANVTFKKNPTEIFWFQREILLTAVPIMDHVQNYVENEMEKTFPKIEIGLVKSKIDQMSIDQPVKENATIFKAMVEIFNELNKYGNRR

SEQ ID NO: 138109 - protein, 81 aa, Heterodera glycines
  Coding regions on vcDNA: vcDNA=SeqID_64532; Strand=+; Position=1-272
NIDKVALLLELFERRHLPLTNEDFFHNLAILRDFGPTGKCAVRASPFYYPLANYTDTCTASYYFSGSFIHACESYIVYFFV

SEQ ID NO: 138110 - protein, 172 aa, Heterodera glycines
  Coding regions on vcDNA: vcDNA=SeqID_64533; Strand=+; Position=1 -63,423-557,630-950
  Homolog annotation: Hit_ID=ZP_00293154.1; Match level="QueryCoverage =84%, HitCoverage=45%, E-value=6e-20, Identity=40%"; Hit description =COG0414: Panthothenate synthetase [Thermobifida fusca]
MFGEEKQPLNHKDEEDGIGIKSGRIGRILEGVTRPQYHDGMLLHTVKLYNIVQPNLAFFGKKDAQQKVLIFSNAFYITVLKLFAIQQMTVVMNFPVRVVPVETERDPHGLALSSRNQYLSAEERRRALCLYNMLVAARNAATNGAGLASVAAQAQQMLTQAEKHDGIKQVFI

SEQ ID NO: 138111 - protein, 106 aa, Heterodera glycines
  Coding regions on vcDNA: vcDNA=SeqID_64534; Strand=-; Position=1 -137,195-294,474-557
MVDKGEGDSRYQELKDGIYHGYQPLRARKTFTYTYTPEFVPGALNIAVARDLDSIPSGPKDDGAHYQMVTAHKVNRAPKPEDPYAWLQPQAPKQQQQQQEEVTEEA

SEQ ID NO: 138112 - protein, 251 aa, Heterodera glycines
  Coding regions on vcDNA: vcDNA=SeqID_64535; Strand=-; Position=1 -74,130-600,672-879
MTSKRNGTLQKGGPSTKKWDFRAIGNNFTEEMENYKLIDERSTICEKFGFTKNITEFRINSDVRRPDEAMRDAIDTMIKAAFKTTEERMKRKVRMFGVAITGAGLASPVWLPYRAYPQNNADVIMQEINKLGQSGDGDENKKTLLLSEPIMMKITCVTVPSGEGPRNVHKFDFGFKEHQRIRISNVDKICLFYALVASKLYLEVHRNIFNRFMNNIMRQREAAVELLRNCGIDINEYSYGVEHLPNVQNYW

SEQ ID NO: 138113 - protein, 49 aa, Heterodera glycines
  Coding regions on vcDNA: vcDNA=SeqID_64536; Strand=+; Position=1 -93,1141-1197
MFTPKFASLMFTGSCYYVNIRVERYRYRYWPTISVQLYQKRMESRRYIE

SEQ ID NO: 138114 - protein, 25 aa, Heterodera glycines
  Coding regions on vcDNA: vcDNA=SeqID_64537; Strand=-; Position=1-75
TCTCGVVVKLSTFHNFSPGFNSPLG

SEQ ID NO: 138115 - protein, 41 aa, Heterodera glycines
  Coding regions on vcDNA: vcDNA=SeqID_64538; Strand=+; Position=1 -25,634-734
MGRKEDNFAAMDPFWSELPARIIGTCCMASEEPKYRGDDGG

SEQ ID NO: 138116 - protein, 62 aa, Heterodera glycines
  Coding regions on vcDNA: vcDNA=SeqID_64539; Strand=+; Position=1 -8,337-517
MGHNLSGLAKFGRRFNAHKEKCAALIKQQQSSPSTELKLELRQEFMDYSKEGSFLIDYLRDH

SEQ ID NO: 138117 - protein, 16 aa, Heterodera glycines
  Coding regions on vcDNA: vcDNA=SeqID_64540; Strand=+; Position=1 -13,622-659
MEGYVSKNPKIVAKNG

SEQ ID NO: 138118 - protein, 50 aa, Heterodera glycines
  Coding regions on vcDNA: vcDNA=SeqID_64541; Strand=-; Position=1-153
SFRPSQNFCLVIYFVYFHFYLQQCPIFWCPFFHWCPIFGVQFSGVQFTGS

SEQ ID NO: 138119 - protein, 101 aa, Heterodera glycines
  Coding regions on vcDNA: vcDNA=SeqID_64542; Strand=-; Position=1-304
  Homolog annotation: Hit_ID=XP_345184.1; Match level="QueryCoverage =98%, HitCoverage=49%, E-value=2e-12, Identity=44%"; Hit description =similar to CG14852-PA [Rattus norvegicus]
MRRGATVIRRGATVIRRGATVIRRGATVIRRGATVIRRGATVIRRGATVIRRGATVIRRGATVIRRGATVIRRGATVIRRGATVIRRGATVIRRGATVIRR

SEQ ID NO: 138120 - protein, 68 aa, Heterodera glycines; identical to SEQ ID NO: 127362
  Coding regions on vcDNA: vcDNA=SeqID_64543; Strand=-; Position=1-400

SEQ ID NO: 138121 - protein, 49 aa, Heterodera glycines
  Coding regions on vcDNA: vcDNA=SeqID_64544; Strand=-; Position=1 -81,543-611
MTFFRLAFFAKLFANIRILFKKNFNLIGVFPFSASLCCPGVHPNVGDTA

SEQ ID NO: 138122 - protein, 23 aa, Heterodera glycines
  Coding regions on vcDNA: vcDNA=SeqID_64545; Strand=-; Position=1 -36,548-583
MALKNFIKMSEWRNIWLSNHIKS

SEQ ID NO: 138123 - protein, 93 aa, Heterodera glycines
  Coding regions on vcDNA: vcDNA=SeqID_64546; Strand=+; Position=1-282
MPIQRGRGLAEERFTKQYMNTELKMFSELLNENQLEAIKQINANKTYTMSANSMRAQVKKLKRIALTNCTEKGSDQDQTPNSNKKSKIQNFQI

SEQ ID NO: 138124 - protein, 149 aa, Heterodera glycines
  Coding regions on vcDNA: vcDNA=SeqID_64547; Strand=-; Position=1-661
LFEYPKRTLEKIDFFVFGAVPPNRCAQIYGETESFRNSFPIACTLILRWIFAPHNCLSTPNGHLKKSIFLFSGQSPRTDAPRFMGRPNPSGIASLVCTLILRWIFAPHNCLSTPNGHLKKSIFLFSGQSPRTDAPRFMGRPNPSAVASL

SEQ ID NO: 138125 - protein, 199 aa, Heterodera glycines
  Coding regions on vcDNA: vcDNA=SeqID_64548; Strand=-; Position=1 -119,149-300,372-700
MAQSKWKLSIPVGNRCQFRRQTKSTDLNASRSRKIGKIQNYIDQNVIKFLLRFHQLFTSCPIHLIINVTDDRILEFILRKIWPVFGNKLRAVRVLSFHNNAMPFGGQAVAKWLFTRLPDNGPKVLSCCLLDDANLKSTIGVIKAVLTNRAAKNMHEKWPKYAHKYANKIVKYASNMHRNCKICIKYAQKNLKIRGANLF

SEQ ID NO: 138126 - protein, 115 aa, Heterodera glycines
  Coding regions on vcDNA: vcDNA=SeqID_64549; Strand=-; Position=1 -98,592-841
MPSNNSSAIERSKIRKKKNEGEMNEPYAVADERFSSKRLIFFCLCMNTDSLRSPSILPFPSSSPCFLRQDAVKLHLGWCKSIDILTLTSQCVHYFEFALATLERLMGFVQRRMNA

SEQ ID NO: 138127 - protein, 375 aa, Heterodera glycines
  Coding regions on vcDNA: vcDNA=SeqID_64550; Strand=+; Position=1 -11,533-808,858-1290,1348-1682,1742-1814
  Homolog annotation: Hit_ID=AAL78214.1; Match level="QueryCoverage =41%, HitCoverage=78%, E-value=1e-11, Identity=30%"; Hit description =putative esophageal gland cell protein Hgg-20 [Heterodera glycines]
MNRRWICNDVWMDILPHFDHAQLGLKMALISPRFDALVDKHFDGKTELIIWKWIVIRKDNGPKSKLSVWVDGKFVGFPMPDRPLPIKIRFKKLQINYIDHSVLTFLRSNKQIWDRSGIKLEVFVYSFDTDVQPTWDVFVRQIWPIFAKSIRHLGFRNGDHLDNFRRRTSPTILTDLDQLYSIDSGALFPDGIADDGPNGNAGQALTKWLHTPTKDGQPKRLRCNGYLDLMNLEWVNNFKETFRRATTSVSYHIQLFFHAEPKPLESFELVNEVTNEKLTLKMSKKYNGSVYNWLLQRCPIGETATAPVKWKNRENSDANFNYIIRFDPWHDNNSGANLNSVRFNLCANSCIGPLSPPTEEEKEEDEADQSNKNVV

SEQ ID NO: 138128 - protein, 110 aa, Heterodera glycines
  Coding regions on vcDNA: vcDNA=SeqID_64551; Strand=+; Position=1 -127,536-739
MHESFVAKFRVIRPQANLITLDGDNNNDIILHEEADEDEAIAQPCTSSAGQQPRPIGGGTADELQQEAEDNESVLLNGAESPTPGAGTLGYEILAEDSKTPAPFYEMMSE

SEQ ID NO: 138129 - protein, 68 aa, Heterodera glycines; identical to SEQ ID NO: 127362
  Coding regions on vcDNA: vcDNA=SeqID_64552; Strand=-; Position=1-383

SEQ ID NO: 138130 - protein, 99 aa, Heterodera glycines
  Coding regions on vcDNA: vcDNA=SeqID_64553; Strand=-; Position=1-594
MFEYPKRTLEKIFFFVFGAVPPNRCAQIYGETESFGNSFPIACTLILRGVFAPHNCLSTPHGHLKKSIFFFSGQSPRTDAPRFMGRPNPSGVNSLYPVL

SEQ ID NO: 138131 - protein, 35 aa, Heterodera glycines
  Coding regions on vcDNA: vcDNA=SeqID_64554; Strand=-; Position=1-105
MQLLEIIVSEKTSKEALAVAAKLGLDQKKLIVVVK

SEQ ID NO: 138132 - protein, 108 aa, Heterodera glycines
  Coding regions on vcDNA: vcDNA=SeqID_64555; Strand=+; Position=1 -29,71-224,266-340,381-449
MVNVVVPVGININYTKNSLFIKMDLEDKSGVIYGINCYEPTVNKIIGYNGEEINVFEQEQNWLAITDAFDKVLYEAAHFFRLFLKTDGAINATDFERTITNSFDYLSV

SEQ ID NO: 138133 - protein, 84 aa, Heterodera glycines
  Coding regions on vcDNA: vcDNA=SeqID_64556; Strand=+; Position=1 -51,94-297
MEMLSILLNYFKNNFKKESFIWYDNKQELKNRLKCQDSNYNLAIHLDTSYPYEEFLDVGGKDFLFTFLFYEKNVRCCCGNVIGT

SEQ ID NO: 138134 - protein, 45 aa, Heterodera glycines; identical to SEQ ID NO: 134303
  Coding regions on vcDNA: vcDNA=SeqID_64557; Strand=+; Position=1 -124,223-236

SEQ ID NO: 138135 - protein, 111 aa, Heterodera glycines
  Coding regions on vcDNA: vcDNA=SeqID_64558; Strand=+; Position=1 -207,321-449
MPFSDFAGRAMQNDFLRSNGPSFLSDYADLWLLALDMLPMAHQTAEEQREQLKMELFISRSSNCSMEAWPNYLIKFNSLKFVQPSDSVGASDPKMPFDDSVCKLNPIGRKT

SEQ ID NO: 138136 - protein, 19 aa, Heterodera glycines
  Coding regions on vcDNA: vcDNA=SeqID_64559; Strand=+; Position=1-61
NDHQFNLFRNTDGNKVIIH

SEQ ID NO: 138137 - protein, 47 aa, Heterodera glycines
  Coding regions on vcDNA: vcDNA=SeqID_64560; Strand=-; Position=1-317
PEKMPTLVVFKIFRNSDFFITYLFFAKLIHKYFFRKCSETHKTLFTG

SEQ ID NO: 138138 - protein, 71 aa, Heterodera glycines
  misc_feature (55)..(55): Xaa can be any naturally occurring amino acid
  misc_feature (61)..(61): Xaa can be any naturally occurring amino acid
  Coding regions on vcDNA: vcDNA=SeqID_64561; Strand=-; Position=1-324
FLKLHYFIFLAKLIHKYFFTNCSETHQILFTSYFRHSDAFTIKKEMNKKSKNFYXLFKHAXNFRLNFFFIN

SEQ ID NO: 138139 - protein, 90 aa, Heterodera glycines
  Coding regions on vcDNA: vcDNA=SeqID_64562; Strand=-; Position=1-655
KTTILITDTVAQHPLPQCTLRFVNGSKQLMSLFGFFFKQFSVIAHQLLGVQQRRHLHPMQLFTGSLNLFLFFFYLFSEWSYNNFSQQFCI

SEQ ID NO: 138140 - protein, 121 aa, Heterodera glycines
  Coding regions on vcDNA: vcDNA=SeqID_64563; Strand=+; Position=1-366
MSMQQNQGSDDALPMWAVPDFDEMGQMPQRQKQKKIPTLKEFRNQWKERRLLWEREEAEKKDPKTWKKRTDEMKKICEERLEQSKGAGGSNKRQEPDTYTWNWDELLRQEREYLDGGLWGK

SEQ ID NO: 138141 - protein, 347 aa, Heterodera glycines
  Coding regions on vcDNA: vcDNA=SeqID_64564; Strand=-; Position=1 -871,985-1157
MKILLIFLLLCALIFKKAINQIEAGKITQEKSFAEIFGQTWDDGAEEENICQNDQIIHGEIADQNNQLGQNVRQFDQNFDENVEVKEEESEEMSTDYDELGQLPMPTKNGQSCDRFSNETNKNKREIVEKFHKIKEKFKQEKKKYYSGKEWHKIERKIAQKSGVNYEKIYEWKREFGMMIHKNSEDEKRQILKRFDQIYDKLKMKLNGKLDGKRMKCKKIIAKHLGIEINSIYKWKRQLKNGKTDEKIENRKRKIVEKYLKTKSEFMQMGKHPDKEWKEFRAKIKQMFGVERKVLTICEKMEKMKKYYQMKKHNPKLTDRQIAAELGISTRALCKYKSDLMRDETKF

SEQ ID NO: 138142 - protein, 102 aa, Heterodera glycines
  Coding regions on vcDNA: vcDNA=SeqID_64565; Strand=+; Position=1 -105,149-350
MYSFRFFLFVFLFIHFRFIGTAQIVNGQQLDSNSEQLQSNQTYSVTNVDRMSNAFHSPTDNQTTSLLGDETLKPSDNEANCTTTENGCELNDGKYCTDCKTI

SEQ ID NO: 138143 - protein, 328 aa, Heterodera glycines
  Coding regions on vcDNA: vcDNA=SeqID_64566; Strand=+; Position=1-984
  Homolog annotation: Hit_ID=NP_920205.1; Match level="QueryCoverage =91%, HitCoverage=20%, E-value=2e-29, Identity=32%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWTDQMRWLF

SEQ ID NO: 138144 - protein, 16 aa, Heterodera glycines
  Coding regions on vcDNA: vcDNA=SeqID_64567; Strand=-; Position=1-49
EAIPEGFGLPINLGAS

SEQ ID NO: 138145 - protein, 79 aa, Heterodera glycines
  Coding regions on vcDNA: vcDNA=SeqID_64568; Strand=-; Position=1 -112,183-259,368-399
  Homolog annotation: Hit_ID=NP_741442.1; Match level="QueryCoverage =100%, HitCoverage=4%, E-value=2e-26, Identity=84%"; Hit description =voltage-gated Calcium Channel Alpha subunit, putative L-type calcium channel alpha 1 subunit, EGg Laying
AFNCWDILVVAVSLVSFVLKSDAISVVKILRVLRVLRPLRAINPLRAINRAKGLKHVVQCVIVAVKTIGNIMLVTFMLQ

SEQ ID NO: 138146 - protein, 75 aa, Heterodera glycines
  Coding regions on vcDNA: vcDNA=SeqID_64569; Strand=+; Position=1-361
YEKSQLMQTLHDASLVKSLLKNAQISCRRCENSRLLQGYNTINNINHAYQNDQNYHTMLILIISSIFSLNFSKIM

SEQ ID NO: 138147 - protein, 45 aa, Heterodera glycines; identical to SEQ ID NO: 124527
  Coding regions on vcDNA: vcDNA=SeqID_64570; Strand=-; Position=1-138

SEQ ID NO: 138148 - protein, 226 aa, Heterodera glycines
  Coding regions on vcDNA: vcDNA=SeqID_64571; Strand=-; Position=1 -62,316-462,725-871,1134-1458
MKFAHSLAFTSGSQISEQLAGEFCLSRLSHDEAILCYSYSSVLVNSSNELENMKFAHSLAFTSGSQISDHEFCLSRLSHDEAILCYIYSSVLVNSSNELENMKFAHSLAFTSGSQISEHEFCLSRLSHDEAILCYIYSSVLVNSSNELENMKFAHSLAFTSGSQISEQLAGSVLALSRIFCYFLEELFRSFRMVYAFFLLLQYLRRYARPIEYPPIQILMVGFYNF

SEQ ID NO: 138149 - protein, 87 aa, Heterodera glycines
  Coding regions on vcDNA: vcDNA=SeqID_64572; Strand=+; Position=1 -169,252-346
MGRKTMTLTAVVLMVKSANITHSEFGSRTEQAFHLSFNVSFLLLGPAKSYKMIPSPSSADNFFQIARCSDKIVMYHFGCWNPQNLTN

SEQ ID NO: 138150 - protein, 55 aa, Heterodera glycines
  Coding regions on vcDNA: vcDNA=SeqID_64573; Strand=-; Position=1-167
QAGIEVIELATAETEPTIPSLFADDLAIVINGTALLTRPKSNNNKKTPVVSRTNE

SEQ ID NO: 138151 - protein, 42 aa, Heterodera glycines
  Coding regions on vcDNA: vcDNA=SeqID_64574; Strand=+; Position=1-195
LSLGKGICTYAKIPLLLLITVSAFSLFIGDFDFQLQIKSKQQ

SEQ ID NO: 138152 - protein, 98 aa, Heterodera glycines
  Coding regions on vcDNA: vcDNA=SeqID_64575; Strand=+; Position=1-297
MLPLPRELEENRNRTKPLNSPPPAKRNKRDESPPVFDENGNELGSPPSYNGDKEDEEEEGIISESPPHYEGIETVTFDFPHHTMKIMNVLLRIHRLVM

SEQ ID NO: 138153 - protein, 18 aa, Heterodera glycines
  Coding regions on vcDNA: vcDNA=SeqID_64576; Strand=+; Position=1-56
YREAIPEGFGLPINLGAS

SEQ ID NO: 138154 - protein, 55 aa, Heterodera glycines
  Coding regions on vcDNA: vcDNA=SeqID_64577; Strand=-; Position=1-167
MLDTVVLCGNTVDVQGDSLFSWLFAQKREPNGPSADHRQLAAQQWAWIEQQMRRS

SEQ ID NO: 138155 - protein, 38 aa, Heterodera glycines
  Coding regions on vcDNA: vcDNA=SeqID_64578; Strand=+; Position=1 -52,508-572
MAAAEPCREILTVTDFDSAEQIKHGQLIEKITIVQTFI

SEQ ID NO: 138156 - protein, 196 aa, Heterodera glycines
  Coding regions on vcDNA: vcDNA=SeqID_64579; Strand=+; Position=1 -311,366-645
  Homolog annotation: Hit_ID=CAE63230.1; Match level="QueryCoverage =89%, HitCoverage=35%, E-value=5e-41, Identity=47%"; Hit description =Hypothetical protein CBG07591 [Caenorhabditis briggsae]
MHNRFGVLSDVKAGIVSLSQKIVGPCALIQGALPRILRDTPQSFFDNTKALLAKNSEIVYDILCQVPGLKPLRPQGAMYMMVGFDEEMYGDETGFLQRLIAEESVYCLPGSAFSLPNWFRLVLAFPEETTREACERIAAFCTRHMRPCRKQLALWGSQLDEEDGRGSEGAERTAAEESTSGEEEEDGQRQSERSAE

SEQ ID NO: 138157 - protein, 52 aa, Heterodera glycines
  Coding regions on vcDNA: vcDNA=SeqID_64580; Strand=+; Position=1-158
MAHFGAPQIREQMLKGIGDDLQKVLDIFGNGSDDDDASIQLLLRYIVEKVSW

SEQ ID NO: 138158 - protein, 139 aa, Heterodera glycines
  Coding regions on vcDNA: vcDNA=SeqID_64581; Strand=-; Position=1 -35,262-369,415-691
MEIVSSKIEGQWPTKDSHSQSYKDYFAEQSQSSTSARPPDDDFVIRAWSVYEDLRNGQRDAYGSVIRQPIAPRRAFQLVIDQIREGSSDLGDRQMEWDITDPRNDEEQGLHMCETLLRERMEEDEKEEKEKKEKKYLEF

SEQ ID NO: 138159 - protein, 729 aa, Heterodera glycines
  Coding regions on vcDNA: vcDNA=SeqID_64582; Strand=+; Position=1 -227,273-673,719-1061,1108-1679,1724-1915,2105-2235,2287-2610
  Homolog annotation: Hit_ID=NP_001004509.1; Match level="QueryCoverage= 99%, HitCoverage=51%, E-value=2e-76, Identity=29%"; Hit description =si:busm1-180o5.3 [Danio rerio] emb|CAD60788.1| novel protein similar to DNA polymerases [Danio rerio]
MPCSLAALIPSYGLDVEDKPFFPHLANRPENYGREIRPTPDDYLANGMMPGKRRQFDEWYAAHHHEPFMLDEALASYCTNDVKILMAALVAFRREFFEISRRQEYMDGIDDRENHDGIDVLRECMTIAGACMRHFRTNHLPNDHLAIVPERGYDNAQNQSLLALRFFHWYSEEYGVDVQTAHSAGGEKRIGPYSVDGWIEAEGRAIEVHGCTWHGCKKCYPIDNMLLPNGKTAGQVRERDAKRMEYIWARVNRVDVYWECKITSMLERSKAMRKSFANYVDDGPLVIREAFTGGRTGPLKLLRKAGPGEKISYYDFTSLYPYINFTTRYPVGHPKVHVLNQQVEWISAADNPFPLALLKVWVVPPRQIDVAVLPVKVDDRLCFPLCISCAKEYPTGGVDNDYHCQHTDQQRGWVSTCTSIELNAALDEGYRVTRVFRVLEYEQSDDKLFRPYIAEFMAQKIQASGFDSSIRGDAEKEEQFVRECAEQFGINIDPTKMVVNKGKRSLAKLCLNNLWGRFSLRNFGLCQTLITDDPVTLAEYLDNKSIEVTSIDQLDEAHILITYLHKKDWIDEHACSNIDTDSLILVHPEERCPLKTGPHLGQFTDEYPDHDIVEFCSGGAKQYGLCLRRKGAGADAKKEYVLKVSGLTLNYDVINNQGMRYETFKEEVVRYATTGDYEPIIVTYPNFLRPNIREGGRVVSMPLQKCYRPYVGKGIIGSDFNVKNFGHTL

SEQ ID NO: 138160 - protein, 137 aa, Heterodera glycines
  Coding regions on vcDNA: vcDNA=SeqID_64583; Strand=+; Position=1-414
MRLAEDIEGLEMRTRKLEEGAAATTEAQMETMRQQMEQKFRQNLLEAEQRIDHKWATMLSKEQQRTQRIAAQSAAVIGQLMNKRLAEGGEEKENTRETEEKKLIISDRCNWCLEKGQCYLELGDADMCLAVHRALLR

SEQ ID NO: 138161 - protein, 103 aa, Heterodera glycines
  Coding regions on vcDNA: vcDNA=SeqID_64584; Strand=-; Position=1-312
MKEKEEEEKKRREGKEKETEKKKEEMKQKDETETKRSLSVGTTKDDEISIVDSEERERDAFENSPKPTNERMAFWESTLNNEAKKDLREDKEKALKTQAKLLS

SEQ ID NO: 138162 - protein, 150 aa, Heterodera glycines
  Coding regions on vcDNA: vcDNA=SeqID_64585; Strand=+; Position=1-453
MMGSKWSVREFRRAVAEQVRCMRSAESALASMKDPEVRTDHRTERGQTGRGGKAGREPFQRAFTGQPTNPCETQRNTKRGAVRDERPFRQTIDHTCQRERELRRELAPRRIKRTNCHNGDMELFTMPKKWTSTKQMPRLSDSSGAEEETH

SEQ ID NO: 138163 - protein, 86 aa, Heterodera glycines
  Coding regions on vcDNA: vcDNA=SeqID_64586; Strand=+; Position=1-258
  Homolog annotation: Hit_ID=CAE74432.1; Match level="QueryCoverage =100%, HitCoverage=17%, E-value=1e-23, Identity=63%"; Hit description= Hypothetical protein CBG22165 [Caenorhabditis briggsae]
MDYAIFVVEQVKKGQKIEILRSLPKKSDVKASNQTFNRAKLMNVGFVEASRLYDWQCFVFHDVDLLPEDDRNLYSCPEHPRHMSVA

SEQ ID NO: 138164 - protein, 61 aa, Heterodera glycines
  Coding regions on vcDNA: vcDNA=SeqID_64587; Strand=-; Position=1-197
VILQQIHIIINQLSNSVLMGTDVLQRQTFVHIVHRHHFFVFRGYCRPNPLPFPGGTDAGRG

SEQ ID NO: 138165 - protein, 145 aa, Heterodera glycines
  Coding regions on vcDNA: vcDNA=SeqID_64588; Strand=-; Position=1-438
MHFLIFVFVFLFIIISTGKTLSVNNLCEKNGKIRPTFAEIFGQKWDNEKMEENENESVQNTNYNQNYQNELIDQNDQFDDQQKRGIIHRFHAIKEGIKKKGKYSAKIWNKFEQKIGVKLGINGLKIYKWKKELKLKKNKRNLKHY

SEQ ID NO: 138166 - protein, 398 aa, Heterodera glycines
  misc_feature (21)..(21): Xaa can be any naturally occurring amino acid
  Coding regions on vcDNA: vcDNA=SeqID_64589; Strand=+; Position=1 -243,685-836,1018-1081,1657-1718,1785-1920,2203-2296,2727-2905,3331 -3560,3720-3742
  Homolog annotation: Hit_ID=NP_997868.1; Match level="QueryCoverage =97%, HitCoverage=39%, E-value=1e-87, Identity=44%"; Hit description =oxygen regulated protein (150kD) [Danio rerio] gb|AAH47807.1| Oxygen regulated protein (150kD) [Danio rer
IAHTNCNRAKFCTIFAYFPFXISANSAMAIDLGSEYMKMALIKPGVPMETVLNRESQRKTPMALTIRDGERFLGDTAQKKALGMPRHTFAFFLDLVGKQMDDPIVQAFQAEFPHLTLKAHPARGTVQFETDSAGDLSVECALGMVLSNARHEVEAYAGQTVRDAVITVPSYFGLIERALIERAAVEAAAKIADLNLLQLIGSGTAAGLNYGVFRHKEITEQPQRLLIYDVGSSKTLATIVQFRLVNNDTEAAPPQVETLGVGYNRTLGGRQLTLRLRDHLVRAFKQQHPSTSNTVEQNLRAMAKLMKEAERVKQILSANTDHYAHVESVFEDRDFRVKVTRDELEAMFQDFEQFHMEPITDALRMAQLTVDIGRVVLMGAGTRMPRLQTVLLGRNGKK

SEQ ID NO: 138167 - protein, 133 aa, Heterodera glycines
  Coding regions on vcDNA: vcDNA=SeqID_64590; Strand=+; Position=1 -276,534-659
  Homolog annotation: Hit_ID=CAE66717.1; Match level="QueryCoverage =49%, HitCoverage=28%, E-value=3e-10, Identity=50%"; Hit description =Hypothetical protein CBG12063 [Caenorhabditis briggsae]
MDGCSYAVYLVPTNFFHFPSKKHTKYIGLRGHLPRIWFFDQNLFKYTKWVLDSDHRPQNLLENVFTSVTLANFQISELDSYMYQSVGSQGIKFYADAIGLPLFQRKISGRPKCVESNTYVQDEEDVVEELYHL

SEQ ID NO: 138168 - protein, 129 aa, Heterodera glycines
  Coding regions on vcDNA: vcDNA=SeqID_64591; Strand=+; Position=1 -86,135-439
YIDKVNLSAVPIVEFNFMISDNFLTINNVSPNPKGFYKEFFEESKLGSFLEEYVGLWLLAADIMPNLRQKLTKLIFMVPDKCRLIRDERHPQNCATFDQMAFEKKHRSVRQINPLVNNFKNIYNLFIFK

SEQ ID NO: 138169 - protein, 130 aa, Heterodera glycines
  Coding regions on vcDNA: vcDNA=SeqID_64592; Strand=+; Position=1 -253,973-1112
MKFLCHGRVSDWNIAKGNRATFPMEIEKLSEFARVKVGSKRYSDVVQIKGFQLKIKAQVKMNEQNPAKCLGIYLCCAASEDAEKGTSKIRGSNNPSVDNPSVEDNPSVMDNLSVDNPSVDNSSENFFFEQ

SEQ ID NO: 138170 - protein, 39 aa, Heterodera glycines
  Coding regions on vcDNA: vcDNA=SeqID_64593; Strand=-; Position=1 -33,1587-1673
MGCIKAIVEGILPAKNVAEYFGSTTAQRIFILSFALIFH

SEQ ID NO: 138171 - protein, 90 aa, Heterodera glycines
  Coding regions on vcDNA: vcDNA=SeqID_64594; Strand=+; Position=1-438
NRNYAQKASQTILALPIPSTIAFIHPIMSAKIIRVPKIACDLSLAKNGVSKNRNYAQKASQTILALPIPSTIAFIHPIMSAKIIRVPKIA

SEQ ID NO: 138172 - protein, 96 aa, Heterodera glycines
  Coding regions on vcDNA: vcDNA=SeqID_64595; Strand=+; Position=1-374
NRNYAQKASQTILALPIPSTIAFIHPIMNAKIIRVPKIACDLSLAKNGVSKNRNYAQKAFQTILALTIPSTIAFIHPIMSAKIIRVPKIACDLSLA

SEQ ID NO: 138173 - protein, 15 aa, Heterodera glycines
  Coding regions on vcDNA: vcDNA=SeqID_64596; Strand=-; Position=1-47
EATPEGFGLHKSGRI

SEQ ID NO: 138174 - protein, 259 aa, Heterodera glycines
  Coding regions on vcDNA: vcDNA=SeqID_64597; Strand=+; Position=1-780
MVEMGTEIQTSRNELKAFQEEVDKAKNITLEHVEKNDLKKAKKSADVAKGIARQAKTKYTSTLEGYNDKSEKGFSGIVNRLNEALGEHIKRKDIENIQVSEAEKGPQKRERLANEDVQFQYDSIDQKFIVYLSAAVSHIDLSKHLAYVLGFKNTRLFHAEEANYMPDLTGGVRQLYIYAPNLIENTIIGNQMAPLLRIVNVVDDPGSISEVIYSTEYFHRLQSKRISEITIEIHTPFGEFVKFHWGSCILTLHFKKSIF

SEQ ID NO: 138175 - protein, 333 aa, Heterodera glycines
  Coding regions on vcDNA: vcDNA=SeqID_64598; Strand=-; Position=1 -66,125-310,358-449,534-672,764-946,995-1229
  Homolog annotation: Hit_ID=CAE64130.1; Match level="QueryCoverage =90%, HitCoverage=29%, E-value=5e-65, Identity=44%"; Hit description =Hypothetical protein CBG08746 [Caenorhabditis briggsae]
SFLPLSSFVSLHNLMVLVFHSRNSSIGQTFALGGTFENSSIGQTFALGGTFEFISEAPFLPGPPLPGGPKGCAFLIEPNDDGTGVILSPTYPGVYPSNLQCLFLLRGLAHQRIRNLQCLFLLRGLAHQRIRLFFRDFDVYFGGEHCPYDSLTIYDGASTSDPIIRKLCGLQQRLELFSFGHELLLEFNTTEPPPPPLPPFSFHIEYQFSDKFVAISRLIGAKPSVRHLRGSECDVRVCSGHESVHFVHSPNFPDLYFPDLYPPNTTCTYILDGLQGDQNLEKVILRFESFVVGQSAPSPIVERSAIPSADWSHINSMPGHRLAQSLPAKCSSS

SEQ ID NO: 138176 - protein, 24 aa, Heterodera glycines
  Coding regions on vcDNA: vcDNA=SeqID_64599; Strand=+; Position=1-74
YTFETIGQDKKRMKLMPHETRNWL

SEQ ID NO: 138177 - protein, 50 aa, Heterodera glycines
  Coding regions on vcDNA: vcDNA=SeqID_64600; Strand=+; Position=1 -11,60-91,329-438
MNKIYILIFNGICIVFFLLFGLCVICNCVVRRVTFHHETEEKKKKPTVSR

SEQ ID NO: 138178 - protein, 56 aa, Heterodera glycines
  Coding regions on vcDNA: vcDNA=SeqID_64601; Strand=-; Position=1-226
IMSHPIWQIGLFKRIKEDSVDCLECKQKNVINFSSSSFFGLKIYLNTLLYFERLFY

SEQ ID NO: 138179 - protein, 141 aa, Heterodera glycines
  Coding regions on vcDNA: vcDNA=SeqID_64602; Strand=+; Position=1 -206,267-363,1114-1233
MLRNNNPKNVNNAKPQQTLHLNKNVESRSTVIEALSMIEVEDRRLPLLQYEQEMMIDTFIDDVLFITAKGLGLERIFFNHLHLYSVPSFTVLVLNTTPDDEQKFVQTVIQLNNTQRKVQANLRDIIGTCVRELKQCTKGVD

SEQ ID NO: 138180 - protein, 134 aa, Heterodera glycines
  Coding regions on vcDNA: vcDNA=SeqID_64603; Strand=+; Position=1 -64,369-450,736-859,1005-1139
MKCQHCGYQFCWVCSKTWSPHDSKSKEAALVLQEALEKLLEGRKTLKYTVGEFFHNHINTFSYVFSFCHIDEKNDEFHNAQSVLEKSVKALKELCQKFEAEKRALIDLCDEKTVKEMIAEKGPTENETGTSAGL

SEQ ID NO: 138181 - protein, 64 aa, Heterodera glycines
  Coding regions on vcDNA: vcDNA=SeqID_64604; Strand=-; Position=1-195
LLRALKTRKLETLISAYKSYIRPQLEYATEIWNPLKKNIRKIEAVQKIFYKKSLQKMWACSHAV

SEQ ID NO: 138182 - protein, 73 aa, Heterodera glycines
  Coding regions on vcDNA: vcDNA=SeqID_64605; Strand=-; Position=1 -45,1235-1411
MARGAEKAKKKSIFELRRIAAPGEHLRICVDSGGCSGFEYKLTLDKRLDEAEDEVIKASEGAIVVVDKVSCKF

SEQ ID NO: 138183 - protein, 71 aa, Heterodera glycines
  Coding regions on vcDNA: vcDNA=SeqID_64606; Strand=+; Position=1 -86,473-602
MNRNKEMGKLTQRCKKKVQKSRKGEIIEKLSGEMAQNLLIIKANMNKLFLGPSNDIDDEEKDDENNDNEAK

SEQ ID NO: 138184 - protein, 66 aa, Heterodera glycines
  Coding regions on vcDNA: vcDNA=SeqID_64607; Strand=+; Position=1 -96,495-599
TKKVVHHVKAIVHKTSSSAIHRAFVYQAHGNVMANWTVTMEVMSPERPVRRCTAHAPLVISGATMD

SEQ ID NO: 138185 - protein, 50 aa, Heterodera glycines
  Coding regions on vcDNA: vcDNA=SeqID_64608; Strand=+; Position=1 -58,298-389
MTLLGANTLALFFLTLALSSPMLITYSFVCLYAMFGAWVFYSIESPHEDR

SEQ ID NO: 138186 - protein, 121 aa, Heterodera glycines; identical to SEQ ID NO: 128908
  Coding regions on vcDNA: vcDNA=SeqID_64609; Strand=+; Position=1 -184,211-352
  Homolog annotation: Hit_ID=EAK91016.1; Match level="QueryCoverage =91%, HitCoverage=90%, E-value=2e-26, Identity=62%"; Hit description =hypothetical protein CaO19.6835 [Candida albicans SC5314]

SEQ ID NO: 138187 - protein, 73 aa, Heterodera glycines
  Coding regions on vcDNA: vcDNA=SeqID_64610; Strand=-; Position=1 -124,177-272
MVSTRNKTGKFMKLSNSGTEARRKRKEWRREHAKKAGSTPKTLKQTEAETTADGEGTSTQAAEKGPSKRTPDL

SEQ ID NO: 138188 - protein, 60 aa, Heterodera glycines
  Coding regions on vcDNA: vcDNA=SeqID_64611; Strand=+; Position=1 -139,265-308
MPQCPPGMCADALQFDSLKLEFRRTKKVQKSEIGMPTHLWCAHLLIDKKNLNGFFSLERL

SEQ ID NO: 138189 - protein, 224 aa, Heterodera glycines
  Coding regions on vcDNA: vcDNA=SeqID_64612; Strand=+; Position=1-675
  Homolog annotation: Hit_ID=NP_502797.1; Match level="QueryCoverage =79%, HitCoverage=50%, E-value=4e-26, Identity=35%"; Hit description =HASI (4P602) [Caenorhabditis elegans] emb|CAB16520.1| Hypothetical protein Y57G11C.19 [Caenorhabditis ele
MDGPTKETVTEQNHPDGTDNQEGISPEKMELINNTLDKLYNDPSSPAAFAGVTALWKEARKKLKHLRKRDVEHYLEGHRTYTLMRPRRVRFPRAKTVAAGFMTDVQVDLADFQALSRHNRGHRYLLVAVDVLSKRLFVVPLKNKRADEMLEAFKQLIDKMPMVPHRIFSDKGTEFKNRLLKEFFEEQEIAKHEPVHSSVKASVAERAIRNGSRNGTDISRKRRH

SEQ ID NO: 138190 - protein, 85 aa, Heterodera glycines
  Coding regions on vcDNA: vcDNA=SeqID_64613; Strand=+; Position=1-258
MMTWQSEGQFNGMFTVHTEQESRCCPRWCLSCCWCSVVVVPVGCCRRRRLLLAMFERVEKVDQLGHFGDERSVKKFCQLAFFNPF

SEQ ID NO: 138191 - protein, 16 aa, Heterodera glycines
  Coding regions on vcDNA: vcDNA=SeqID_64614; Strand=+; Position=1-49
EAIPEGFGLPINLGAS

SEQ ID NO: 138192 - protein, 222 aa, Heterodera glycines
  Coding regions on vcDNA: vcDNA=SeqID_64615; Strand=-; Position=1 -96,147-345,396-508,559-694,751-875
MPTFLIEFGTDQWKSAIREKGDEKSICEEFKTSNGIGTILNDIEPENANGTLAKIIHFVPPSKDTKMFAFFQIERPKFSKFITNRTKLLPYQNDPNNTKRATPCDYYGADCVPIKNLLLKIEALANCGKKESENNAAFKKPDWAPLPPEMPWKKPSETMLCGGDMLCDKQRLREQYNRLREICGLKPEKVASQRLKRQYQPKEKWTESPIKIAFNKSARNNF

SEQ ID NO: 138193 - protein, 102 aa, Heterodera glycines
  Coding regions on vcDNA: vcDNA=SeqID_64616; Strand=+; Position=1 -276,626-658
MSDEIGNILSHYKCQPQQQSSTADCGGSTVSARLMPADGQPPEVPSSPVVPLALAAAPIDNSFQPKHLTAVANLDDLSGDEEGNLVRNLSATFLYENNYKHF

SEQ ID NO: 138194 - protein, 141 aa, Heterodera glycines
  Coding regions on vcDNA: vcDNA=SeqID_64617; Strand=+; Position=1 -190,463-500,1359-1427,2135-2176,2832-2915
  Homolog annotation: Hit_ID=NP_506049.1; Match level="QueryCoverage =70%, HitCoverage=25%, E-value=1e-23, Identity=42%"; Hit description =asparaginase/glutaminase and ankyrin (5M636) [Caenorhabditis elegans] emb|CAB02791.1| Hypothetical protei
RLAEMHAERETNNALQPAPAAAAQQQLAAAGRRRLSTVCEDGTHLHGKPVALHDSRVLVLYTGGTIGMRACHDGGALVEYEPLLDSSDMTFDDWIRIAKDIRKSYSAYDGFVVIPVAEVRSDGRENMIGALIVAGNLDIPE

SEQ ID NO: 138195 - protein, 40 aa, Heterodera glycines
  Coding regions on vcDNA: vcDNA=SeqID_64618; Strand=+; Position=1 -107,1113-1128
MSPFFAVANFGLSLCKNRCAEMLLCYAFSLLCPLNRKKKN

SEQ ID NO: 138196 - protein, 75 aa, Heterodera glycines
  Coding regions on vcDNA: vcDNA=SeqID_64619; Strand=+; Position=1 -54,534-707
MCFQPLYSPDEFKDIEEQLCLSESHEIVAEVKEIQTLLPGAEEAEEKCMEYGGEEQFGTELECHGQCRLGLIRVG

SEQ ID NO: 138197 - protein, 90 aa, Heterodera glycines
  Coding regions on vcDNA: vcDNA=SeqID_64620; Strand=-; Position=1 -35,139-376
MLNSKSYSLLKKTNPPRCYVVIRARYFEKSLDLDLDSMFDLDFLDKNPGKYRFRKNPGLDPGPCRALVVIKKPIKKGAIINNWCPDEKKC

SEQ ID NO: 138198 - protein, 47 aa, Heterodera glycines
  Coding regions on vcDNA: vcDNA=SeqID_64621; Strand=+; Position=1-141
MAPKFLPPELLFEIVAFMPARGAVPNAFTSCWLLHSLLLQRVTKWKQ

SEQ ID NO: 138199 - protein, 186 aa, Heterodera glycines
  Coding regions on vcDNA: vcDNA=SeqID_64622; Strand=-; Position=1 -328,390-619
  Homolog annotation: Hit_ID=ZP_00289916.1; Match level="QueryCoverage =87%, HitCoverage=13%, E-value=6e-10, Identity=31%"; Hit description =hypothetical protein Mmc102001633 [Magnetococcus sp. MC-1]
MNFQALVKAFAATNATHLSETELEKELDRELDQSVPLILEEIAKTEGAKAAGEPTTELETLVGEGLEQLEENNRTKTKEQQQKQGEGGGEKSGKCKEEEGEKTTRAKTQDGNETEEPFVGVGLEITKVGQGITKTNTEAEEKTETTAETHPETETHPEEKTETTAETHAEIETHPEVETQPEENTT

SEQ ID NO: 138200 - protein, 132 aa, Heterodera glycines
  Coding regions on vcDNA: vcDNA=SeqID_64623; Strand=+; Position=1 -349,540-589
  Homolog annotation: Hit_ID=NP_501772.1; Match level="QueryCoverage =64%, HitCoverage=13%, E-value=1e-09, Identity=39%"; Hit description =nucleoporin 54, Nuclear Pore complex Protein NPP-1 (66.0 kD) (npp-1) [Caenorhabditis elegans] emb|CAA9428
MTTIPEVIVRAREYQGRGLLSALDFYNELFQKTNELKQQLNCERVVPLVEIDKAELDNYLRKPPAGFVGFEELWTQAVLENPDPENLVPYPIQGFEQLLQRKKMQLATVSSLHQGIVYCAFWLHKHFLNALG

SEQ ID NO: 138201 - protein, 87 aa, Heterodera glycines
  Coding regions on vcDNA: vcDNA=SeqID_64624; Strand=-; Position=1-735
IIFIQKIFFWVFGAVPLNRCAQIYGETESFRNSFTIACTLILRRIFAPHNCLSTPNGHLKKSIYFCFRGSPPEPMRPDLWGDRILRE

SEQ ID NO: 138202 - protein, 270 aa, Heterodera glycines
  Coding regions on vcDNA: vcDNA=SeqID_64625; Strand=+; Position=1 -219,443-564,1172-1643
LDAYLDSCAITKPDRAPEHDYQYTWSCEPLRFESIKSDELTWHSEWRWMNLDALRNTENEFLDDQGRIHLWARDGFKEFLTQNFEIRDPEVDADMFGRMLDIVMTQDQYDPDGGVKHYGEWTRRSFVPIFLPMSTNSPNSAKDPSALGTGAWATSVLVVLRLFHVTTAGSVGECFRPSQTFICPSVIIRHARAQSLPLTRQAFALCPGQLLTMAKRVTTTIHPFTIRQRRPPFLHSNKRPEPQTLPLIVGHPLILRVFFLDAKKVKSNVQ

SEQ ID NO: 138203 - protein, 30 aa, Heterodera glycines; identical to SEQ ID NO: 126607
  Coding regions on vcDNA: vcDNA=SeqID_64626; Strand=+; Position=1-91

SEQ ID NO: 138204 - protein, 204 aa, Heterodera glycines
  Coding regions on vcDNA: vcDNA=SeqID_64627; Strand=+; Position=1 -57,259-453,1233-1592
MPFRHEEEGDSYTQTEEIQVASITWNYRAHDFVVKLDIWDVVDKGRRADPSTGAAAPLKLGFSRKNAYQSAKCSVDIPSAVQEVKSFLKNAMEANLRELRIAEEELDILAKEEGQNPTNWRRKSDESADEGKGEERNRRHSGEEETEEEREEEEEEHTEEEEKGHGERQRRQRDGERTSPAKSAQFAAASRPRPSPSSSSSSEE

SEQ ID NO: 138205 - protein, 231 aa, Heterodera glycines
  Coding regions on vcDNA: vcDNA=SeqID_64628; Strand=-; Position=1 -55,377-540,917-1123,1240-1509
KIFIFRGFILENFCSILRDPKNLSPYNLRCELTIRSGTIVGDHLDKQLQQRQTEIWTNYVEATVRKIRGHVEKDVQYQKVAQENYALQSFPGLDEIFRKSRFFLVNSQPQVDFDNYNIFNGIEKIKLIGGFQLKQNGRELDEKITANFGDRNGIVFVSFGTVMDTNKSDFSYVIEAIKVTIQKFPDYLFVCKLSKGHMEGIPNVFATDEWLDQQGILGEKKINKTKYDQIH

SEQ ID NO: 138206 - protein, 37 aa, Heterodera glycines
  Coding regions on vcDNA: vcDNA=SeqID_64629; Strand=+; Position=1 -51,101-163
MGRMLPAEAGPRYGLYAALAAIAGLAYCYRDRLGFKK

SEQ ID NO: 138207 - protein, 129 aa, Heterodera glycines
  Coding regions on vcDNA: vcDNA=SeqID_64630; Strand=-; Position=1 -87,659-958
MLLNVSDSDSAREGGLISGESVYKASFRKAGAGADFASSAGANASSTLRLRLLDRSLDGANSAAGSVANGGGGSSRGTPPPQPQTVQLQQQMAFGEERPASEASSSTRRMENNCNEKQQHSRSRRRVEQ

SEQ ID NO: 138208 - protein, 134 aa, Heterodera glycines
  Coding regions on vcDNA: vcDNA=SeqID_64631; Strand=-; Position=1 -84,143-463
MHIEIVHEDRILGTENVPLELTEQQLDKLSLGAYDRLLRQGSFRELVGKMMRNPLASPDLVVATFGQIRIRNRLGQALANHDKQELRGLFLFLRHNLFVASYFDILYDVATVAIGKNCCNYTQIVPLLQLFCCV

SEQ ID NO: 138209 - protein, 238 aa, Heterodera glycines
  Coding regions on vcDNA: vcDNA=SeqID_64632; Strand=-; Position=1 -98,164-251,303-347,458-501,576-837,885-1064
  Homolog annotation: Hit_ID=NP_573230.1; Match level="QueryCoverage =94%, HitCoverage=28%, E-value=2e-20, Identity=28%"; Hit description =CG5800-PA [Drosophila melanogaster] gb|AAF48747.2| CG5800-PA [Drosophila melanogaster] gb|AAM50282.1| RE1
MNRKGEAMLMLTPSQEPFVALLRQRNVPVTKVTVDSNKVFDVRNKITNLMVPFPSVKQFAQQSLIAYAKALYFSELKEVFDVQSIDFDALSRSYGLVVTPRIRFLRKKGIITRKYVELEKGTSPEMATKTEEILLGNPSGSGGKNPFDIQCQNEMEEEEPFLKVSRRDVFNSITEVDVKEEILSRISSKKPISKTMMARKMIKRMGVVGKRKRFENERESDEEEDTEQQKKKGDAICC

SEQ ID NO: 138210 - protein, 38 aa, Heterodera glycines
  Coding regions on vcDNA: vcDNA=SeqID_64633; Strand=-; Position=1-114
MISSKRIRTHYKPIVRIEDDDSAQFGCSEAERYWMGMA

SEQ ID NO: 138211 - protein, 198 aa, Heterodera glycines
  Coding regions on vcDNA: vcDNA=SeqID_64634; Strand=-; Position=1 -183,247-411,479-522,593-653,717-805
  Homolog annotation: Hit_ID=NP_490989.1; Match level="QueryCoverage =99%, HitCoverage=24%, E-value=5e-56, Identity=57%"; Hit description =probable atp-dependent RNA helicase Ddx10 (82.6 kD) (1D65) [Caenorhabditis elegans] gb|AAF60456.1| Hypoth
PIFGTDVDFEKQRLSSVNIIICTPGRLLQHMDENEHFSCDQLQMLVIDEADRILDMGFRHQIDAIIENLPKERQTLLFIDAIIENLPKERQTLLFSATQTRRTEDLVRVSLRNPVFVAAHEHSGSATPDQLVQSYFVCMEEAKLNMLWSFSFLKNNRTKKTLVFVTCCKQRFITETFTHLRPGLYLPGLWGDLKQSKR

SEQ ID NO: 138212 - protein, 146 aa, Heterodera glycines
  Coding regions on vcDNA: vcDNA=SeqID_64635; Strand=+; Position=1 -157,346-629
MKILLFFIAFIGILCHEVFAKFTKEKKDFFSSVNFKCLKLINEMKKYSTEAEYSEDKLMANFRDLSEKVKTCSCCVDEGNKSFFNSMDNAKEFFENIGKDANKSHIQKWLHQISTDFNTLTIESDLFEIWENFIEYSHAITSENLK

SEQ ID NO: 138213 - protein, 36 aa, Heterodera glycines
  Coding regions on vcDNA: vcDNA=SeqID_64636; Strand=+; Position=1 -21,578-664
MTDGTKSKTRIGAVLNEFRKKIKDEKLAKRCKALIK

SEQ ID NO: 138214 - protein, 205 aa, Heterodera glycines
  Coding regions on vcDNA: vcDNA=SeqID_64637; Strand=-; Position=1 -60,114-389,441-724
ILFLIHKQCQKTTSALTKKSLSAAIVGFWCSIFLRLLSSALKLRWSTAVLTASSTNTSKHANGNWAKCEFATKLERMARRKCKLSIPMEIHCQSRKIRCRTKSSDSDTFISSTSIKMSSHLSAVCSTDLYITTGNDRILEFILLNIWPMLHDSIRVMLLNSIAFRRLRQLAPSLLSECPSLRFVSFFDVIFPEFPPDESANASDG

SEQ ID NO: 138215 - protein, 104 aa, Heterodera glycines
  Coding regions on vcDNA: vcDNA=SeqID_64638; Strand=+; Position=1 -101,146-356
MNLAHRSAEECQTSSKVEATTTTTMAKDAIFGTILMNAKSTFMIQTLPSNPESLLRVIFGHCIQSSLNEAQRRGIEPSRLGATITSQLLDPDIWIPIRQITPNT

SEQ ID NO: 138216 - protein, 230 aa, Heterodera glycines
  Coding regions on vcDNA: vcDNA=SeqID_64639; Strand=+; Position=1-690
MASKFVLIPDEIYQGLTNNDSGNINLDFAQRTLERTKRRRENVTAKNVHYNQELSRYLHLRDEQQNRPTKVEIAKGLKALIKRGDESDEEPVFNLGSDRQQSHASQIRKPRRHHHSYNEDEEMPLQQPSPPLRAENRGQKRKPNDFYSSWEEGAKRQLRHQDEPVPPSSKIVNRQRRSQPPVSLRREEQQIPVDIPQEEPFQPVPQPSIPIHPQVNRKRKAQHTLNDIRE

SEQ ID NO: 138217 - protein, 16 aa, Heterodera glycines
  Coding regions on vcDNA: vcDNA=SeqID_64640; Strand=-; Position=1-49
EATPEGFGLPINLGAS

SEQ ID NO: 138218 - protein, 265 aa, Heterodera glycines
  Coding regions on vcDNA: vcDNA=SeqID_64641; Strand=+; Position=1 -12,486-653,979-1596
MSRNLLFFASTSLALVKVVKRQSGNGAAGPAEETHVGFEGNDPPPSSLNEPISAIGPDQQAEDGKGLADIAYDTVEEQSQSSAASSSWATSPSSTSAAATVGTVSPGIGDAESAAETRLQDTAASEGTPSATTEEASPVGVEEENNDNNNNSPSSSDSGDAAATASTVAEEGQRLEETVATATTASSTARRIAAVASAGKKQDERKGRKKTGLPTAAVETAATDGTATTPATAQQQQQRNCNSERLRQLIIEVGKAFGQPNNLII

SEQ ID NO: 138219 - protein, 131 aa, Heterodera glycines
  Coding regions on vcDNA: vcDNA=SeqID_64642; Strand=-; Position=1 -128,287-368,627-812
MANFKTLIYCFQFLNASHSGGIGLIQTICQHIDEKTSPITSADPRANTTVSNSGPISCAFCHLLHKKALSIINSFVRLFEGFNMMCDRLSDEKNACRLYVKQMTLKMGYIMDLHLEEQNARVYCKYVFNCV

SEQ ID NO: 138220 - protein, 94 aa, Heterodera glycines
  Coding regions on vcDNA: vcDNA=SeqID_64643; Strand=-; Position=1 -142,440-582
YHAILAADAIKLANPAGGNSNIVANLKRARAGFKQAIDIIDTVLGVASKKRPETVAVARKTPTALLRTDDSVAQIVGTLGPCFCKGSSFIIHSV

SEQ ID NO: 138221 - protein, 20 aa, Heterodera glycines
  Coding regions on vcDNA: vcDNA=SeqID_64644; Strand=+; Position=1 -30,566-598
MAKKGSQKFWCLKIRNKFIY

SEQ ID NO: 138222 - protein, 34 aa, Heterodera glycines
  Coding regions on vcDNA: vcDNA=SeqID_64645; Strand=+; Position=1 -60,369-413
MDNFLLSSIQTCPFCMVATTTDREHLGLSNDIKN

SEQ ID NO: 138223 - protein, 88 aa, Heterodera glycines
  Coding regions on vcDNA: vcDNA=SeqID_64646; Strand=-; Position=1 -53,221-433
MALLVSRATVLFASSYTVVYNCQPWSTVGDEECGKVYGIATEEDHPMRGPGRVFLLTMLSSGAVQLLSCSSDLAQPFQLIATTNHFPY

SEQ ID NO: 138224 - protein, 176 aa, Heterodera glycines
  Coding regions on vcDNA: vcDNA=SeqID_64647; Strand=+; Position=1-531
  Homolog annotation: Hit_ID=AAQ82688.1; Match level="QueryCoverage =50%, HitCoverage=9%, E-value=7e-10, Identity=50%"; Hit description =Epa4p [Candida glabrata]
MRDDFRQLPSSNGLVEALSASSSSSASSSSSSASSSSSACCCAENRLFLCSPQQRGLTFPSPIRPSGECSSSSSSSASSSASSSSSSSFALSSVTPRRPFFFHKVAKTIVAEDEDEVQQQGTENMWKTNPMIKRRTSKNSAKGKGNKGEEENCQRRTDPKKAIEAADAVSRMGFLN

SEQ ID NO: 138225 - protein, 39 aa, Heterodera glycines
  Coding regions on vcDNA: vcDNA=SeqID_64648; Strand=+; Position=1-117
MQNFFLYRYAKFGMNLTSRKKVKQDEVNVVLYIIKNEEI

SEQ ID NO: 138226 - protein, 95 aa, Heterodera glycines; identical to SEQ ID NO: 136988
  Coding regions on vcDNA: vcDNA=SeqID_64649; Strand=+; Position=1-828

SEQ ID NO: 138227 - protein, 349 aa, Heterodera glycines
  misc_feature (291)..(291): Xaa can be any naturally occurring amino acid
  Coding regions on vcDNA: vcDNA=SeqID_64650; Strand=-; Position=1 -255,421-595,795-1003,1160-1400,1688-1849,2020-2039
  Homolog annotation: Hit_ID=NP_490766.2; Match level="QueryCoverage =97%, HitCoverage=73%, E-value=9e-71, Identity=44%"; Hit description =bifunctional phosphopantetheine adenylyl transferase dephospho CoA kinase (51.1 kD) (1B134) [Caenorhabdit
PSIDIGLLVLRGKIRQKLKRLLAITMPKVRQKLYVHLEQMDVIRALLPAIYINAASIAPKIDLRVLLNRTTSVPVDRVFYDEMDSFATSHHKLPEKPYDHVVLGGTFDRLHNGHKLLLSEAAMTARTRITCGVTDGKMNEKKILYELMEPVETRCRSVTEFIGDISEGIECQTVPIYDAYGPAIVGDHYQAIVVSEETLKGGEAVNAKRMENGFKKLDICLVELLKNAEEVLNETKLSSSLKRKEMLGTLLAEPGPPKAAISNAHYVIGLTGGIASGKTHIATFLAEKDYXKVIECDTLVHQLYKNNMELREKLSKVFGDEIVKNGDIDRDKLATIVFGDKANFRFFYE

SEQ ID NO: 138228 - protein, 66 aa, Heterodera glycines
  Coding regions on vcDNA: vcDNA=SeqID_64651; Strand=+; Position=1 -60,540-600,652-731
  Homolog annotation: Hit_ID=NP_498540.1; Match level="QueryCoverage =83%, HitCoverage=29%, E-value=1e-17, Identity=52%"; Hit description =tissue specific transplantation antigen p35B like (3I150) [Caenorhabditis elegans] gb|AAA50647.1| Hypothe
MVGGLFHNLRHNLQFFVKNLVHNGPPHDSNFGYSYAKRMIDVLNRGYAQEHNRKYREKINILFLIK

SEQ ID NO: 138229 - protein, 97 aa, Heterodera glycines
  Coding regions on vcDNA: vcDNA=SeqID_64652; Strand=+; Position=1 -70,271-426,464-531
MESSTEEKISPKFLQFIPKSPIIVEQPPSYATVTQYQRQQQQQQQPNYNNYQSYPVQPPQHCYGCYDGAGRYGGNGGYNGNGGYNSNSGQGQLNSKN

SEQ ID NO: 138230 - protein, 89 aa, Heterodera glycines
  Coding regions on vcDNA: vcDNA=SeqID_64653; Strand=+; Position=1 -77,612-802
MRGGILSKALRRYAADGHLKGDDVPNKRRVSVVDSSDDDYRYGILGKSLRQFNDGGKLYLHDNHRRNDTETSSSSAEGTMTVQNAIGRK

SEQ ID NO: 138231 - protein, 86 aa, Heterodera glycines
  Coding regions on vcDNA: vcDNA=SeqID_64654; Strand=-; Position=1 -152,459-567
MAKMFFLSPRSLWIDAKYPFRKTPTREALVPRSMPIACEFRGIILCELEICGILTGFPITLPEIFFNGLYQKGKKYLATLTKNSKS

SEQ ID NO: 138232 - protein, 123 aa, Heterodera glycines
  Coding regions on vcDNA: vcDNA=SeqID_64655; Strand=+; Position=1 -102,132-284,327-443
MQTIAEIKNFEIIEGGRVFIVRVRIENVVHVEYRFFNACVLCRKGVCSCGVEKALTPYLKVSVADDTGILENVAFFGVRGKKNGMEELRGLSGAVCTMKIGARVKEIGGKKGIYYSLIDIVSL

SEQ ID NO: 138233 - protein, 158 aa, Heterodera glycines
  Coding regions on vcDNA: vcDNA=SeqID_64656; Strand=+; Position=1 -283,1411-1498,1539-1644
MNSEKSEKANTILVEAAKKETERAWRDVAALAEEVGDFAKSSRETLNRAIKSREKAPYANGVRELYLKMSDSIWEIFKIMDQINLESEKAESAWRIWTKSFEPINPNHEFPTVKYFEVKLVGHGTYGIGFSTRKYGSGEFVGWNDDSIGYDSMGDIIG

SEQ ID NO: 138234 - protein, 132 aa, Heterodera glycines
  Coding regions on vcDNA: vcDNA=SeqID_64657; Strand=-; Position=1 -193,546-751
MINLSFKLAVQIDEGNPDSRIAPDEHGRYLISKVHAVYVHQNNREIIFFHFMACFLSIEFLINQSWPGFEEWVQSEDCENMEQSNQFTELVTVEAIFDLMLKRPIAHHMAKIVETCPKYVQGRYKSGRKPLK

SEQ ID NO: 138235 - protein, 70 aa, Heterodera glycines
  Coding regions on vcDNA: vcDNA=SeqID_64658; Strand=-; Position=1 -63,608-757
MSGQGNGGKGRGKGGAKGYRKTVHGNIRCITNPIRYEAVNGISGAINDQIQPDDPVFGTVKFLGFLSESL

SEQ ID NO: 138236 - protein, 211 aa, Heterodera glycines
  misc_feature (88)..(88): Xaa can be any naturally occurring amino acid
  Coding regions on vcDNA: vcDNA=SeqID_64659; Strand=+; Position=1 -180,221-350,402-476,537-633
  Homolog annotation: Hit_ID=CAE63579.1; Match level="QueryCoverage =79%, HitCoverage=21%, E-value=1e-23, Identity=36%"; Hit description =Hypothetical protein CBG08068 [Caenorhabditis briggsae]
ISFQFGFTHTKTGLMFFLCDGSYCLTATLWGVLLDRWNCNNFLMFFGSSATIVSLVLFGVTPIFTSHFHRRLEWICISTPIFTSHFHXRRLEWICISLAILGIASGALYIPSFQQCLDVVKKRGYDDSFQTYGCVSGLIQKRGYDDSFQTYGCVSGLIQSSYALGGFMGPTVLGGWGCQGFMGPTVLGGWGCQKFGLRSIVLSIVVINLIF

SEQ ID NO: 138237 - protein, 205 aa, Heterodera glycines
  Coding regions on vcDNA: vcDNA=SeqID_64660; Strand=-; Position=1-618
MENRNLQCPSKFSIDYILSIPAKKPRHGVQAGAGTSSAKSAKDFVKKLENSVEHVPRFQYVKAKSKFSIEDVPTNPEGLLAGIFQFCIDEAITDSQERGIKPTHIGCLISSPLLTGGDIPTPIRQITNNTVDTILNQFNKVAQSKQQQNVTLWGEPFTVTVTTVDRTGLPDKRSLKGGARRSLASVHHRINDRCLIKVRSKECQF

SEQ ID NO: 138238 - protein, 94 aa, Heterodera glycines
  Coding regions on vcDNA: vcDNA=SeqID_64661; Strand=-; Position=1 -136,408-558
QKFRLADFCPATNPKVPAQLIRCVYAIESDEKNGIAVYEHEKPAWSDPTILAMFDDFEKLRSATVLKGLHARTLTGFIKSFLQELKVKFYYYYF

SEQ ID NO: 138239 - protein, 49 aa, Heterodera glycines
  Coding regions on vcDNA: vcDNA=SeqID_64662; Strand=+; Position=1 -30,330-449
MSEEEPCENNKTNFTKIEMPNLPEIPLINFRIILMGKEEVINGPKSLKD

SEQ ID NO: 138240 - protein, 157 aa, Heterodera glycines
  Coding regions on vcDNA: vcDNA=SeqID_64663; Strand=-; Position=1 -162,843-1152
  Homolog annotation: Hit_ID=NP_501829.1; Match level="QueryCoverage =98%, HitCoverage=44%, E-value=5e-37, Identity=50%"; Hit description =COLlagen structural gene (col-2) [Caenorhabditis elegans] gb|AAP97869.1| COLlagen structural gene, probab
MNYDTQVKAYKFVAYSALTFSLASVVAAFITLPLMYNYVSHVRRQLNQDMVLCQGSSSDIFREVEVLKNAPFVAHGNRTARQAGYEAHAAGAPSGAGPSGSSVGRAGGANVAGGGGACKPCCVPGPPGPQGRPGRHGKPGKPGAPGVPGAAGAGPAI

SEQ ID NO: 138241 - protein, 75 aa, Heterodera glycines
  Coding regions on vcDNA: vcDNA=SeqID_64664; Strand=-; Position=1 -132,737-832
MRPFQVPYLENVVSELGIYGSIIADSSNGKVLWNSAEGYLSRSKPANLNQGGVCEGSGVVDSVLLFPDNEFVGTN

SEQ ID NO: 138242 - protein, 45 aa, Heterodera glycines
  Coding regions on vcDNA: vcDNA=SeqID_64665; Strand=-; Position=1-139
ISKMPKRKVVVTIHQKFKKIYFLRKSKFLINGGEWHTNVAQNKMF

SEQ ID NO: 138243 - protein, 106 aa, Heterodera glycines
  Coding regions on vcDNA: vcDNA=SeqID_64666; Strand=-; Position=1-321
MSATITLTDHQQRHANQPPTGANNLSAITISNDAVFRPPIIVEHRRGTTTTNASTMVPRPKSADGEAANDDDGIARPMPIRPMHGATNSNRLLEELVREIIYGCIL

SEQ ID NO: 138244 - protein, 150 aa, Heterodera glycines
  Coding regions on vcDNA: vcDNA=SeqID_64667; Strand=+; Position=1 -423,476-505
MTELPHLVMDLHVRLPNSFKCPDACFILSGFVDALSFRELFPHCATDEFMRRAENAKIKTIGHRSKQQSATSDDSDDEQGQMDNPWVGFLVENPNGTKFELKLHYSPSNYDKWSKMVIRQLADDDHQQAAKELDENAENYDKCICFCFYK

SEQ ID NO: 138245 - protein, 1262 aa, Heterodera glycines
  Coding regions on vcDNA: vcDNA=SeqID_64668; Strand=+; Position=1 -567,609-1090,1136-1331,1386-1946,1969-2252,2293-2646,2691-3098,3138 -3352,3375-3533,3576-3863,3909-4000,4047-4227
  Homolog annotation: Hit_ID=NP_507780.1; Match level="QueryCoverage =74%, HitCoverage=63%, E-value=2e-79, Identity=26%"; Hit description =predicted CDS, DNA polymerase type B, organellar and viral family member (5T899) [Caenorhabditis elegans]
MPNSPPPSKRPRRFFIEELLREPFNQLSPPRKSPKDYVKLLNSETELVPKFQWLKNKSNFIIENVPADPEALLIGIFQECMDEAMNESRVKGIKPTHLGCTISSQLLTSDIWIPIRQLTPDTINTILNRFNDVAQSKKQDGVTLWGEPFTVSVTTVNRNGLPEKRQLKGGAARKLAPVNHKIHQQCLIKIENADNYCLFYAMQATMVRTVGTMTRQHFYDYLHGIKTMIGKLQRETTEMMNAVNAPLNLLNYDAEIYVPRIIDWWNDEKFARQWKFKAFIFGSAGHYKPLFKYGADDYDVSILLYFDEGHFNGVQKNGNLFGRPYCLSCEKTYDRPKQHTKSCKARCIKCSQMGPLFPCKPIDGFRQKCSDCNKMFFNQVCYQHHLSLNFCKTSKECKHCGVVWDLNNNTKNGREGHKCNERWCENCQIFHEFERGCFIRPLEPNHKKETMGWRLVTFDLETTQHTPIDPDFPEKRKHQVNFVTAKVACPDCISSGRWKESLRGKFCNVCGYHRTVTFSQMPFHETTVDKQNIDRHPLVAFVKWILYKLPKQYDTIAYSHFGGRFDMVLVFRELLLEGFNPSMIKKGNRLFEMKASFFLLINVKSRKKMNPNVTFRDSWNLIPGPLASMVPMFGLDVQDKPFFPHLANRPENYGCNLFPTKADYLADGMNIAKRKEFDKWYQENRNAPFLLDESLASYCKNDVDILMAGLIAFRSEFLEMTKRSAGADGKADRAAYTTPHNGIDPIRHCITIASACMRHFRTNHLKPAHLALVPEKGYDSCGDNQSDLALNFMEWYAEKFDVQIQNAYSANGEKRVGNFRLDGWIESQQKGLEIHGCIWHACSNCYPDDNEVLPCGKTAGRIREKNKRRMEIILEQVPNVEIFWQCEIETMLAKDKQMRKKFDEYTGDGGPIDIRASFMGGRTGALKLFHEAAEGQKISYYDVTSLYPFINFTTDYPIGHPTLHVPCEEVDWRRPEDNPYPLAILKVFVIPPRKIDVPVLPVKVDDRLCFPLCMKCCKKFPNVATGFDETIRGNVEAEEQFIAECNEQFGIQIDRTKMVTNKGKRALAKLAVNNLWGRFSLRNFGLSQTHITDDPSELANYLDNKKIEVTGLDMLTPDRILISYQQKKDWIKEHPCSNVVISLFTTSAARLHLLKAMQKVVRTPGCVLLYTDTDSLIYAHPIGLNPLKTGPHLGQFTDEFPEHEILEFVSGGSKQYGLKLRRNDSDQIEHVLKLRGITLNYDVTENQGLRYDTFKDSVIKFA

SEQ ID NO: 138246 - protein, 21 aa, Heterodera glycines
  Coding regions on vcDNA: vcDNA=SeqID_64669; Strand=-; Position=1 -43,217-239
MGAMNAVKVMGIRYEIVSSLH

SEQ ID NO: 138247 - protein, 253 aa, Heterodera glycines
  Coding regions on vcDNA: vcDNA=SeqID_64670; Strand=-; Position=1-759
MKSQTRQSKNLLVQIYDTHLGILHYMKQNWHCVGWFGMTHCEEYRKYLGILYQHFSDIYAEIPTKKPSFRTKNGEIRLTFVQVMERLANIFKFCHGSKLAEENAKEWEEMGLILPNEEEINAYKANSEDKTKGKGKQKAKMEESPQAKFDEMMENKFKTIEQNAQRNANSGGRGARGNQSGSSSLARADQSESLTSSPALSSLSSASAFSPLFSSSPLSPPPASLSVSSSTAANAEHIYNIVLNMPIHSMADA

SEQ ID NO: 138248 - protein, 114 aa, Heterodera glycines
  Coding regions on vcDNA: vcDNA=SeqID_64671; Strand=+; Position=1 -142,441-643
  Homolog annotation: Hit_ID=NP_510786.1; Match level="QueryCoverage =70%, HitCoverage=24%, E-value=6e-10, Identity=34%"; Hit description =predicted CDS, RNA-directed DNA polymerase family member (XR810) [Caenorhabditis elegans] gb|AAK68673.1|
MANIISGTNFQKRRKTDPLNYRPVSLTSTVCRVFERILSSKILEFLNGVPQGSVLGPLLFLIFINDQPSVITNEAASVGIKKYADDVKLYYANENDDHSNQLDKAIEALENGQK

SEQ ID NO: 138249 - protein, 224 aa, Heterodera glycines
  Coding regions on vcDNA: vcDNA=SeqID_64672; Strand=-; Position=1-676
  Homolog annotation: Hit_ID=AAF33533.1; Match level="QueryCoverage =55%, HitCoverage=34%, E-value=3e-13, Identity=36%"; Hit description =ORF2 orf1629 [Spodoptera exigua nucleopolyhedrovirus] ref|NP _037762.1| ORF2 orf1629 [Spodoptera exigua nuc
IVQNNNGSLKIHGFDESTNGSVNIADIFPVVPIAKHTRMDLPSSSGTVELFDRGLAFSVQEQYGLQTAATLRQKDNQFLTTSHAFAPTEISADALFKSVVAAATVQPQQKSPPSSSLSSASPQQQQQQQQSPFLASAPPPPPPPPPPPSSSSLSLAPPQQQQQQSPFLALAPPPPPAPPPPPLPSPAQASYSSVFLISPGDEQISSFLASVPPPAQHRTLRFID

SEQ ID NO: 138250 - protein, 76 aa, Heterodera glycines
  Coding regions on vcDNA: vcDNA=SeqID_64673; Strand=+; Position=1-231
MEKHGDIRGSELFQIQEQRSTMSPRMEKETEAPKTKKTDLFKYSRCHKRKVGPPWAEGIKLGLQWKKDSRSYSWEP

SEQ ID NO: 138251 - protein, 194 aa, Heterodera glycines
  Coding regions on vcDNA: vcDNA=SeqID_64674; Strand=-; Position=1 -249,658-766,964-1109,1295-1375
MGKLRAKIQFDQTILFVLLLFFCITVYLRHTVATCIEESSSSGGTQPTTLPPLTVDYTVCKRMAPDLRQACIMRLQWWQEARKKKYATDKKLPLKVCQPIGKRLRQKKQPNRRRRWPRNDQCISTAKAATQLFETSRPKRQSGEPDKSLARCKRMEYRMLSDDQRERFEVQAPMTKFLSDLKFVHEAIKIDCFK

SEQ ID NO: 138252 - protein, 354 aa, Heterodera glycines
  Coding regions on vcDNA: vcDNA=SeqID_64675; Strand=-; Position=1 -345,442-549,713-901,1240-1662
MTEIRDTNSKTLKSSLRESQTETLEYSFTTQTVAMHLDVKPHNFLYVPTVDVESGESEELLKLIDFDGAEPIPGKIRWGLWRKRLAHYKRADYRRVPKNPLYSPLYSSPESYRRKCSSKADMWSMGVITYEIIFVRMVKKEFPDANEETLRLAIAKKLFDIVPVYSGKSTDIKAKWPKPKRFVYDLRWLTSSVKTVKSILRIWLNFPRLAVLITNLLDVMPQRRMTAAGVLEYLAGKCYPAELFRTDYARDGTIFNKISFNKLSDMVNKQQKQQCDSDKCTQKWVKISQMVAKVAEMRQEGIVNKSQEMLDNGDLEECATRHGEGGKKGKVISHSLISQNKQKPDQPNQALRAK

SEQ ID NO: 138253 - protein, 259 aa, Heterodera glycines
  Coding regions on vcDNA: vcDNA=SeqID_64676; Strand=-; Position=1 -355,417-496,634-820,865-1021
MESPPPTPGPVPTPEMDEEILEFGFSLPSTSVTPIGDLVPFSTTPTAPMDTGEMTPPPLVIDERSPRIEHLEKQLKDQEDIIKFLREQVRNRDALISDLRCQLEQCAVPPTAPPTTSKTTPTGRPKKNVDHLQCTSRRKLAKSSNAQPLSPNDLDAFEHQIEEFRVFLAQEQRMRDFLSQKPKAHLLLNHFVPFARQHSFLGLLDEQGDEALHSVWRRLEQWWKCMPDADQILQQFEHHFVSNWLLDTGIIAEMKQASF

SEQ ID NO: 138254 - protein, 44 aa, Heterodera glycines
  Coding regions on vcDNA: vcDNA=SeqID_64677; Strand=+; Position=1 -42,95-187
MKARQFAHCISFPSFYIVSKKDLPMIGKKEIMFLSNNSTKGIQK

SEQ ID NO: 138255 - protein, 240 aa, Heterodera glycines
  Coding regions on vcDNA: vcDNA=SeqID_64678; Strand=-; Position=1 -73,145-794
  Homolog annotation: Hit_ID=CAE71402.1; Match level="QueryCoverage =83%, HitCoverage=16%, E-value=5e-28, Identity=37%"; Hit description =Hypothetical protein CBG18310 [Caenorhabditis briggsae]
MKRMGYIIVTAVDKGEILKAATLKASVKLWSIIQAITIDENQSADPRSAAPPIDYTSLCVRFPLPDSLDNAMSLFFDDTRHNRTNVPVEDELCVSNPLLELIKLLLDSSLKSQKILMDALTQNGTHANESIPIDSSLAQLLNSLSLDSLGNGVRGLLGGLSLEPETRKIAGAKALMLPYALKHGTEEEEANAEKWELKLAQVEKRRGIKQNSKQIDSHFSFSSSTISIRLTSKRIGKFLD

SEQ ID NO: 138256 - protein, 322 aa, Heterodera glycines
  Coding regions on vcDNA: vcDNA=SeqID_64679; Strand=-; Position=1-968
MPVLRTPPLTRTRALNQGIIVDRDGNAFRAENFGVSGGRPISPLANNENQRLDDNHENVLAETEIRRRLLYGGMEQSAPEEQLEYDEMENGDEQNVNGMVQQNFENGVEAGDRGSFGNDALDAHGLRAFSTPLNEQNLSALQRDLRMQLPENLSVIQNQIRVMNFMQNQMPNPVAHNFPALNHPQAVNPIACRPNGQLYENAAVNFERQREQQIRLTQQPVVEDQQSHVRRIPPPHAYTQGHRRSQDEGFEFHQGQQHPNFKKNLPIRANQQNRPECNQQPVPHPGLVFDGMMAQAIRSLDGFSYTMTLNAIPNLDGTEVLI

SEQ ID NO: 138257 - protein, 1091 aa, Heterodera glycines
  Coding regions on vcDNA: vcDNA=SeqID_64680; Strand=-; Position=1-3278
  Homolog annotation: Hit_ID=NP_498959.1; Match level="QueryCoverage =52%, HitCoverage=25%, E-value=7e-70, Identity=31%"; Hit description =zn-finger, CCHC type and RNA-directed DNA polymerase  and Integrase, catalytic domain containing protein
LCQADENKRVRPNFFASRQCSKHESNYCPTELEALAVRFGAWKFAQFITGIPTKIITDHKALPPMFRSKKQTGNSRVDRWLMELNARFTLTVEYSPGKSNIVADVLSRSGALISEVTENFDTDSAFVCKLKENEGEKNLEVDEIGEKERIDWVEATKVSEFSEIYNFLQKRILPDEIRKKQKILDTFHKFSIMDGLLYFIPSKPEGPKLFVPSKFRQTFIDQRHSGICSGHFSGKKLFRQLSEKYFWPNMFGDCVKTCLSCRICAHSRKPRSNEPPLRIIQTSEPLELVCVDILSIGMSENGNRYVLVSIDHFTKYIVATPIPDKSKDTVSKAFVKEFVLLFGAPKRFHSDQGKEFVNETLKEISAILGVEKTTTAGYDPQANGAAERANQTLLNMLKKSTSSHWSWDERLPFVVFSYNTTPSEVTGFSPFQLMFGKIANFPGEIDFKKYGNPFYTVDEETYLQAFKENLQLILEYARKNAEISRAETKNRYDSRPNVTANKFAIGDKCMVIYPGSKSRIQHKKLHWNQFGPYKIVKMFESSADVVPVDKSSAEPITVPIERLVRVPVGVPDISTLPHGKNPYRNILATILLANLEIIVQKREQTDETPVSSEEWQKKGITKNSAENFDQNQLGTTDILGGRKMQQDETAGLIWTMKCEGESHEFCGKLLCAELDPVLDAKTEPGNVEIGTPLQAILCLFILRSVATVSSAAAKSLVHLILGSESGMELVVYEGVRKDNIRAGALPREEDVEKIWSMWCEKCAVTKKLLQSSGFEKIRVQNSDGEPKEKPETIQVEMPEAVPKLPESERDGWSTLFEQTGWILEKVRSIAIHRSRTLVETPRVLIGDSTAFQLFPEMRAQTQFVGTERGLLTEVIRPLSECVFSSKVRAAMIILGRDSLVKDETVDQIMEQCQRIQQLCSRFPSVSFIWLPPPYVRQYDLAYHEMIGRLSELLGDWFVFVTPFGRSLIEIWRYGDSFDRSRVNADGWMTENGIKALSAWISTQIPKWPNNRQLGIRTVRSSVSVTRRVYGLGLCDRPETAASSSARGGLGLCDRRPNSRSRSPFRRRDNRQSQPFVRGGHRRDDVTRDRRH

SEQ ID NO: 138258 - protein, 1240 aa, Heterodera glycines
  Coding regions on vcDNA: vcDNA=SeqID_64681; Strand=-; Position=1-3721
  Homolog annotation: Hit_ID=NP_498959.1; Match level="QueryCoverage =77%, HitCoverage=45%, E-value=8e-75, Identity=25%"; Hit description =zn-finger, CCHC type and RNA-directed DNA polymerase  and Integrase, catalytic domain containing protein
MPVLRTPPLTRTRALNQGIIVDRDGNAIRAENFGVSGGRPISPLANNENQRLDDNHENVLAETEIRRRLLYGGMEQSAPEEQLEYDEMENGDEQNVNGMVQQNFENGVEAGDRGSFGNDALDAHGLRAFSTPLNEQNLSALQRDLRMQLPENLSVIQNQIRVMNFMQNQMPNPVAHNFPALNPIACRPNGQLYENAAVNFERQREQQIRLTQQPVVEDQQSHVRRIPPPHAYTQGHRRSQDERFEFHQGQQHPNFKKNLPIRANQQNRLECNQQPVPHPGLVFDGMMAQAIRSLDGFSYTMTLNAIPNLDGNRGSDSVNAFFKQFDVATEEWPEDKRLRALRSKCFGKAERAFNSAVDANRHDYQLIKRAIIRQLDDTDAKQLTSFDQLMRGIRRRPNESIDELGNRISGLVRRAYPGLTEQQYDEYSIMHFIRAMSNPELAITLEMTRRPGATFDEFIAQAARAEATQLAARSALRPNQQYQRPMTNSTGPANNYAPNNRSNNWPKPELGSNPSYRVTCYNCGQNGHVSRNCTTPPKFCSFQENRNQIAKHQGSGANAAPLNWNRQAPNKNGQQFPASRNFLRHNYLVEQNNEPPKRNDLLAGAVNAEYGPQIESFFQNAVNKTSDVDGSDGSPLVGKIIVAKVSVFERQSDAMLDGGAQISLISAEFFAQIMDKVDKNDIISHLERRIVDINGKEVKCFGIVCLPITRGTQTARVRMFVAQSSFGYDLLFGTNALNQLGFKLIDKVNMNVVEFSPMETHANSAHIIYRVTLLPQSSTLVELSMANGQEDKEVTVIGRNDLDEQLRIEPTLTSCKNGQIAVPITNFSSIPITLEANESVALVEHVDEWHELEHSFFPPFFVSSVTHENENIRTEQIKEILRTRIGMSQQHEADKLERLIIGFEQIFALDDSELTQTEITQHFINTGDASPIRGRMRPLPFAHRKKVSSMLQDYLSRGLIRPSKSPWASPIVLVPKRDGSLRFCVDYRGINSVTVKDAYPLPNIDYILLALGEKKYFSTLDFLSGYWQIRMDEKSVEKTAFVTEFGLHEFTVLPFGLCNAVATYQRFMSRLFEDLINDFVFVYIDDILVASESFEQHLEHLEIVFERIKDSELKLKIEKCRFSASELPFLGHVLTRRGLKMNADKVRPVIELPLPSTKKQLHSFLGFMTYYRKFIYGFGEIAAPLFHLLKKNTPFVLGEKEILVVEKLKEKLLEDAVLYFPDFKSAMNDAERCFIILTDA

SEQ ID NO: 138259 - protein, 86 aa, Heterodera glycines
  Coding regions on vcDNA: vcDNA=SeqID_64682; Strand=+; Position=1 -38,251-473
MYQQRVYLHSLARFARGEQQDGRGPADEQCSLFSDGARLNDCGGAHGRAVQKVGEMAAVDAQSAGQSRIPRNGQKATLFLILNIIR

SEQ ID NO: 138260 - protein, 898 aa, Heterodera glycines
  misc_feature (241)..(241): Xaa can be any naturally occurring amino acid
  Coding regions on vcDNA: vcDNA=SeqID_64683; Strand=+; Position=1 -468,652-1427,1792-2032,2090-2237,2282-2400,2464-2734,2842-2884,2944 -3178,3266-3379,3481-3690
  Homolog annotation: Hit_ID=NP_494939.1; Match level="QueryCoverage =98%, HitCoverage=60%, E-value=0.0, Identity=45%"; Hit description =phospholipase D, with tested activity similar to human phospholipase D2 [Nozawa group,Japanese Worm Meeting
RPISIKFPLFFVYSVLDLRCHREEDTQDWVDTIKRVEETGQIWLHRKRYNSSFPQRLSSYCQWFVDAKDCWEKVASLIEMAREEIFIADWWLSPEIFLRRPMAEGNYWRLDCALKRRAEKGIRIFILIYKEMEMALGLKSLYSKKHLQELHPNIKVIRHPDHYLGSGTFFWAHHEKLLIIDQLIAFVGGIDFCYGRWDDSQHMLTDLGSVVFEPRSEQNEVVKKGENAQRKTTEATTTIIXEPIPKDNGKVTEDGQNWQQIHRRTEHIIDEERGHKIGEKTTETISKPSAENGSETHIKLSDLVPIMRINYQGTEHATERGICDAKTAKVERSDATRGGQSARGTARECGRQQRHTDTATNAETTPFRGRKEIVVENGRPMVRFSNFTSNLSALEEHQTTNILDTSEGGPLGTNKCRRGNYKYGKLMHKFKQSKAPSGPKGMTTPTGNAQVMMEPKQNTLIRRALNNLKPEKARRRWRLAMQPSEETADYACDWFSYCRLQYACDWFSYCRLQETKVDMSGLQGAGKLWPGKDYVNFVHKDFVDVDLAFNDFINRYDTFINRYDTPRMPWHDIHSVVYGSAARDVARHFIQRWNAAKTEKLKSDTEKLKSDNRYPYLLPKSYNSIRVPRVLFGENTQRVEVQVLRSCAHWSSLIDKTEDSIQQAYLSLIANARHYVYIENQFFVSMINSADVGNEICRVLCDRIIRAYREKETFREKETFRVFVLIPLLPGFEGDIGATSYSALLAVLHWTMLSIAKGDHSLIQNLQRAGVENVQNYITFCSLRTHSQLYGKSVTELVYIHSKLMIVDDVHTIIGSANINDRSQAGNRDSEVCLLITDHEFVDGRMNGQPFRAGKFASSLRMRLMREHLGLLEQSLPKTSPERAAEINDPTCPSVFED

SEQ ID NO: 138261 - protein, 25 aa, Heterodera glycines
  Coding regions on vcDNA: vcDNA=SeqID_64684; Strand=+; Position=1 -63,124-138
MGGRIHIVDEFPANLKHAVAEAFRK

SEQ ID NO: 138262 - protein, 105 aa, Heterodera glycines
  Coding regions on vcDNA: vcDNA=SeqID_64685; Strand=-; Position=1 -214,547-648
CEDAQCFSVRCIGTDNSTLFHTKGCVNMDKLWDVKLPLKEFGLNECQSMNGTAERNFCDGNRCNGHNEKQSSSEATNARSAETKSRVITGAETVAVSYDGTKKNT

SEQ ID NO: 138263 - protein, 37 aa, Heterodera glycines
  Coding regions on vcDNA: vcDNA=SeqID_64686; Strand=+; Position=1-116
RCASCGCQHVIGCVLSGGGCAAARQETRVSTKLIRAA

SEQ ID NO: 138264 - protein, 215 aa, Heterodera glycines
  Coding regions on vcDNA: vcDNA=SeqID_64687; Strand=+; Position=1 -83,233-317,562-707,826-972,1147-1338
  Homolog annotation: Hit_ID=NP_506170.2; Match level="QueryCoverage =99%, HitCoverage=47%, E-value=3e-49, Identity=52%"; Hit description =putative nuclear protein of eukaryotic origin (47.8 kD) (5N183) [Caenorhabditis elegans] emb|CAA99907.2|
RVDKFIPIVLYCELCFARFGIIQQMKELDDGIAEAVSSLLWVAPRIGHEIAEFKVINDELTHKYGKQFAEAARMNQLPEPSRVSTKLVQKLSVSAPSKLLVEKYLVTIAQSAGVDFAPDAKVMREDDDEIARAERNLINFMNGVVPLGLGGPPPPFRSSTGGLSVNDDPNSKGGGGGHFAAAVGGAIGSADPLMNQGSNNASGNGANAMPMPPNG

SEQ ID NO: 138265 - protein, 58 aa, Heterodera glycines
  Coding regions on vcDNA: vcDNA=SeqID_64688; Strand=-; Position=1-437
SKPRKNGLSKNRNYAQKASQTILALPIPSTIAFIHPIMSAKIIRVPKIACDLSLEKMV

SEQ ID NO: 138266 - protein, 302 aa, Heterodera glycines
  Coding regions on vcDNA: vcDNA=SeqID_64689; Strand=-; Position=1 -454,1195-1649
MALKIPFEGKGNSEMLASCSTPKSSQEDLLCHFRLLDETSVYFRPKPSDDNQQQRHGNNKQRQKRAKCQQKQQQLQIDDYFNAIRRPKHLRGAKRHSKTTERAFLDMEFDHLGKTEMALEEEKQQQMDDEKCSSPILLDFRRNSAGSNETENFLPPPASPAVGLNCQMFSPQLLPRPSDPSANNFSPSGRHYTVLRRIRMKHKMKRDALMKRKSESYGDEQRQQYTNLPMEPIGGSKGSDQNEKEGREEDDSGRKRTNCNSDSGMEEKCEWGLIGGGRRSDGEERNWGGRDRGLIREDGSWD

SEQ ID NO: 138267 - protein, 94 aa, Heterodera glycines
  Coding regions on vcDNA: vcDNA=SeqID_64690; Strand=-; Position=1-283
SSVPVPFHSRRCQHFSSVDDSLLKLLLLFRFGVRLGEIPGGESGRTLGRDGVGTHGGEGTVGEHQQSSGGRRTRGRTTINKGTEEWALEGTKSR

SEQ ID NO: 138268 - protein, 99 aa, Heterodera glycines
  Coding regions on vcDNA: vcDNA=SeqID_64691; Strand=-; Position=1-299
MPKYVLHPIQLFTSLNNTENVENAQNSPRFARDRFHVQYNATARAFAPLFVLLAHVVYASPPTAQHDNDSDVEFGLAQDAAGAAELVEMAPATGIIVPR

SEQ ID NO: 138269 - protein, 19 aa, Heterodera glycines
  Coding regions on vcDNA: vcDNA=SeqID_64692; Strand=+; Position=1-57
MKPTFNFNLFASVFLVLCV

SEQ ID NO: 138270 - protein, 27 aa, Heterodera glycines
  Coding regions on vcDNA: vcDNA=SeqID_64693; Strand=-; Position=1 -46,157-194
MDVSWGSGLKKAPAEGGGRGNQSLIDL

SEQ ID NO: 138271 - protein, 53 aa, Heterodera glycines
  Coding regions on vcDNA: vcDNA=SeqID_64694; Strand=+; Position=1-162
FYLDRRKFFVYSTKIILTISGKFYFSKISLNFFAFLLLLVSSRCTFFPRLIHG

SEQ ID NO: 138272 - protein, 129 aa, Heterodera glycines
  Coding regions on vcDNA: vcDNA=SeqID_64695; Strand=-; Position=1 -192,450-599,673-720
MADADGGTERQFKLGMRQSICKSFGERRGDKTTNGIEVFGMNMFKEMMEKRSGQQQTTSACEILNSFSDSLLPSAERSAEFVIEKIDDEKFFNFGLKAKDASLSPYFGLFSDGEKYYAVVRNAKQKMDG

SEQ ID NO: 138273 - protein, 169 aa, Heterodera glycines
  misc_feature (146)..(146): Xaa can be any naturally occurring amino acid
  misc_feature (162)..(162): Xaa can be any naturally occurring amino acid
  Coding regions on vcDNA: vcDNA=SeqID_64696; Strand=+; Position=1 -21,626-725,1080-1201,1322-1370,1448-1635
  Homolog annotation: Hit_ID=CAE58998.1; Match level="QueryCoverage =88%, HitCoverage=24%, E-value=9e-39, Identity=56%"; Hit description =Hypothetical protein CBG02271 [Caenorhabditis briggsae]
CRQRWLSLFSLSVIQYPTHKEKIKRRFNRSEVVYNYVQRPFLHCSWEKEEARSRHVDFACPIVKSKSNPSLASAASDPLPQPAPLQQHQQWVGGGEWPVTTHHRPTPPVTTHHRPTPPHSTTPFPTTVVPQCRLGTTQLRSQRQQXQHWHNAAATTVPFDQXWGRRHTD

SEQ ID NO: 138274 - protein, 83 aa, Heterodera glycines
  Coding regions on vcDNA: vcDNA=SeqID_64697; Strand=-; Position=1-249
AVMGAYNENNGTIEVPLHGYNVGKAIVERILNTENGTVHLHGMREPMSLAKAVEIGFFDNLSLTVVDPNTTQRLFLDEALERK

SEQ ID NO: 138275 - protein, 43 aa, Heterodera glycines
  Coding regions on vcDNA: vcDNA=SeqID_64698; Strand=+; Position=1-188
MRQRNTMRQKRVEIEKYHQKPLSLNHPLPNSARLRAESAMVDA

SEQ ID NO: 138276 - protein, 26 aa, Heterodera glycines
  Coding regions on vcDNA: vcDNA=SeqID_64699; Strand=-; Position=1-132
MFKKLRLSRRLIIHTFLRFSFNRFHF

SEQ ID NO: 138277 - protein, 42 aa, Heterodera glycines
  Coding regions on vcDNA: vcDNA=SeqID_64700; Strand=+; Position=1 -46,1259-1341
MKCPLMSNFDGREAAGISVIALCPKLSGRRKNGRIFGIFKQQ

SEQ ID NO: 138278 - protein, 29 aa, Heterodera glycines
  Coding regions on vcDNA: vcDNA=SeqID_64701; Strand=-; Position=1 -63,381-407
MNGVIAHNDTICWLYELLDSPIFIDLAID

SEQ ID NO: 138279 - protein, 37 aa, Heterodera glycines
  Coding regions on vcDNA: vcDNA=SeqID_64702; Strand=+; Position=1-112
EQPEKQQRQQETQPNSALSQEVEEKTTTTITMARASE

SEQ ID NO: 138280 - protein, 97 aa, Heterodera glycines
  Coding regions on vcDNA: vcDNA=SeqID_64703; Strand=-; Position=1 -201,258-350
MGLKRRSTNEGETIALLTLGLKNVLQTLPDTVHHYDDDHWHGTDYGTVKMGEDDGREQHQEEANQYGNGYASGHPCQHLTVNRHQEKNEVSKRVHWH

SEQ ID NO: 138281 - protein, 47 aa, Heterodera glycines
  Coding regions on vcDNA: vcDNA=SeqID_64704; Strand=-; Position=1 -98,454-499
MDHVLKVRGLTLNYDVINNQGMRYENFKEEVVRLKNAQLSKRRCNLY

SEQ ID NO: 138282 - protein, 35 aa, Heterodera glycines
  Coding regions on vcDNA: vcDNA=SeqID_64705; Strand=+; Position=1-266
  Homolog annotation: Hit_ID=AAK26375.1; Match level="QueryCoverage =97%, HitCoverage=7%, E-value=1e-10, Identity=94%"; Hit description =class V aminotransferase [Heterodera glycines]
NSSNPEDIESLKQALKGALYEQEEEGQSDHFKAAI

SEQ ID NO: 138283 - protein, 176 aa, Heterodera glycines
  Coding regions on vcDNA: vcDNA=SeqID_64706; Strand=+; Position=1 -107,165-585
MAQRKCKIVNSDEKALPNPQNPLPNKVIGFSGIQIIFIDQNVLIFLRRFDCFFASCATKLAIRTENIRISEFLLLRIWPMFKDTTYLLCFYPIAFRLIRQLASSILNEFPSLRIVAFQGAIFPAFPPDDSANALDGQAVAKWLFTPHPSNLMKALYVTIENSSVDQLLATFEQIKA

SEQ ID NO: 138284 - protein, 99 aa, Heterodera glycines
  Coding regions on vcDNA: vcDNA=SeqID_64707; Strand=-; Position=1 -5,634-788,845-984
MKEWHNENSSQVLENLMEILQERIEGFGDPDLFKNAAILKNWAFLKSDSAITVGNNLFVFSSSGRPATFANGFPTFQSFFLIFDPFFTDSVRYYLHVMF

SEQ ID NO: 138285 - protein, 69 aa, Heterodera glycines
  Coding regions on vcDNA: vcDNA=SeqID_64708; Strand=+; Position=1 -85,480-557,618-666
  Homolog annotation: Hit_ID=NP_505710.1; Match level="QueryCoverage =100%, HitCoverage=30%, E-value=4e-26, Identity=82%"; Hit description= abnormal CATecholamine distribution CAT-4, GTP cyclohydrolase I (25.1 kD) (cat-4) [Caenorhabditis elegan
QERLTKQMLSAILQAVHPTGVGVVIEASHMCMVMRGVQKINATTTTSCMMGVFRDDPKTREEFLTLIKK

SEQ ID NO: 138286 - protein, 408 aa, Heterodera glycines
  Coding regions on vcDNA: vcDNA=SeqID_64709; Strand=-; Position=1 -140,483-656,1204-1351,1634-1726,2027-2184,2454-2967
MPTVLDYHGLDMLLEREFAPCVGPMSAQQNDDDAAAIVQPKRKGMKRPYDEFIGDESAVGMVKSPSFAEQMQHTAPPNLNDFCMEHYGFDEQYIRAQPDRVYDIFATILSIPCPPEEEHNWGMVRQYRMTTQNREGDTLYFRCSRCESLMRYTNDEYRPKLTMKDGDIQGDCFPAHHPQCYPVKKEWVILQQLDRQARLYMMQFDMAQWEAMRQQQQQQPAEDNDGTAAAEFDAYSGSIDHDGGEVSAGGNVPPAIAMLSNGVSAVGVGEEEYGDIGDDDTVLPPSATAMLSNGGVIGREYDDDDFVTTVPHSTSMAFVPNGAATAAAMPRGYGMDEVMATTTAAQQNHHPVLLGDRQMGFGGGTAGGKTAASNASRFRKYRIIRKRGAAPNMATAFDWRKTDLDNKR

SEQ ID NO: 138287 - protein, 147 aa, Heterodera glycines
  Coding regions on vcDNA: vcDNA=SeqID_64710; Strand=+; Position=1-444
MAEQNSFNSQKGENVVLQGQIGSDFDPIFFTPEENQNLNNVLTRMRTFESAICRQFRKLEREFAELKIVAHQSDDTDRMVKIERSIIDLEDREEMDNFQMEEKVIKMAEKAETLEIRQNAFERLTKVKFNKVVEKMKVEMAKNNRKH

SEQ ID NO: 138288 - protein, 32 aa, Heterodera glycines
  Coding regions on vcDNA: vcDNA=SeqID_64711; Strand=-; Position=1-96
TPTSYETNCFGCPRLGRRGSSPTRWTRKAGSS

SEQ ID NO: 138289 - protein, 101 aa, Heterodera glycines
  Coding regions on vcDNA: vcDNA=SeqID_64712; Strand=+; Position=1 -51,108-188,380-469,526-606
MPLRVLPQIIHPPPNVPAFRVQPVQQPIPLRDVPLFVNPPPNVPEIRVGPNHDGQQPMPLRVLPQIIHRPPNVPAFRVQPVQQPIPLRDVPLFVNPPPNVP

SEQ ID NO: 138290 - protein, 121 aa, Heterodera glycines
  Coding regions on vcDNA: vcDNA=SeqID_64713; Strand=+; Position=1-364
KTRLKPIFKGEGVRRNEICVIRDGDHLDGLKSVSWFFCVRNFCVGCEVTYDRPERHRMECKEKCKKCCRMGFGFPCADVCDKIHCEECNRNFYNNECFEAHKKAACNEYNKCEKCGEVYQT

SEQ ID NO: 138291 - protein, 188 aa, Heterodera glycines
  Coding regions on vcDNA: vcDNA=SeqID_64714; Strand=-; Position=1-568
TQSTSIPITGTQPTAFQSPGLNPPSFQSPGLNPPAFQSLGLKSPAFQSLGLKSPAFQTLGLKSAAFQSLGLNPQHFNRQDSIHQHSNHWDSTHLHSITGTQSTIVPIAGTQPTSIPITGTQPTGFQSPGLNPPSFQSPGLNPPAFQSVGLNPPAFKSLGLNPTAIQSLGLNSQAFQSLGLKSPAFQSL

SEQ ID NO: 138292 - protein, 176 aa, Heterodera glycines
  Coding regions on vcDNA: vcDNA=SeqID_64715; Strand=-; Position=1 -173,514-627,676-778,829-924
  Homolog annotation: Hit_ID=CAE74507.1; Match level="QueryCoverage =97%, HitCoverage=28%, E-value=9e-45, Identity=57%"; Hit description =Hypothetical protein CBG22259 [Caenorhabditis briggsae]
YWERKLVHRDLAARNLVGDKIRVFPVVKVADFVLARKLMEEDIYEAHAGAKFPLKWTAPESAVQGTFTVKSDVWSYGVLLYEIFTRGATPYPGMNNKEVVEQVVIGYRNNKEVVEQVVIGYRMSCPRSTGQFGMIPKGLQGWTRTTRTKSRKPKFFLVSHFNQNYFKKSIAHYSIK

SEQ ID NO: 138293 - protein, 75 aa, Heterodera glycines
  Coding regions on vcDNA: vcDNA=SeqID_64716; Strand=+; Position=1 -166,332-393
MLSRVAAVEVKCLRMEQLKIKFPSPEAEELKMIASKTSSSLISYSFNMMECDEDEYQMSVRLKMCLESTPQLAMC

SEQ ID NO: 138294 - protein, 37 aa, Heterodera glycines
  Coding regions on vcDNA: vcDNA=SeqID_64717; Strand=-; Position=1-111
FSNALQFSSRNSLAFSVASSMVSRTALSRALFSLFLP

SEQ ID NO: 138295 - protein, 460 aa, Heterodera glycines
  misc_feature (333)..(333): Xaa can be any naturally occurring amino acid
  Coding regions on vcDNA: vcDNA=SeqID_64718; Strand=+; Position=1 -119,385-544,871-1017,1227-1379,1617-1788,2045-2142,2551-2757,2793 -3042
  Homolog annotation: Hit_ID=AAT92059.1; Match level="QueryCoverage =98%, HitCoverage=31%, E-value=6e-69, Identity=34%"; Hit description =Patched family protein 3, isoform b [Caenorhabditis elegans]
GQKNVLTTTVLVLSLFTFFCCGLRYVYIETDIVKLWVSEGGRLNEELNFLSTLQQESRQRRQNATKRHSDEDEPTTAAYEQRHFLPEDMDERNLKFTPFQVLIQTADHSTPSRNVLTKKELLRHVQLMLEITQLSVHKFGLNWTLDDICFKPGALDISPDSMAYVLKPTLERLIPCIWISPIDCFFEGAKPLGPSPPIDIQNIPLGPLLQLMVDDIPDQVSWTNLDPEHVVSQVTATFDLGTMRNFFMRSGIGKGYLERLCIDPLDPACPPTAPNHYGGTVLISNKREYREKVRESERVRLVYKGMERKKGRVRHGERDGKRERIRYREILSXRQRERESKNRELVEVENDADSGAGADKSGQSSNATATNTSSVENDADSGAGADKSGQSSNATATNTSSTCSVHKTAFMRWLSHNLETFGGQFPAHLLPRFPNYGQVMRHGCRGVASSVMKWPARMVI

SEQ ID NO: 138296 - protein, 210 aa, Heterodera glycines
  Coding regions on vcDNA: vcDNA=SeqID_64719; Strand=-; Position=1 -183,228-677
MPSARSIDTEITQPSLVDIIATPLARQGPIKPFRHREPETGRKTNSFAVDEDILTVEEKEKELMSKVQPLDAPKAGFLGTPPPPLVDLFEFSDIIVRGPQLETKDIGTQVSFPEPSSAFGGQQPARNFNGFSAPVNVVAATQVPFSEPQSTFGGFGGQQQQPPSNSNGLSAPVGVVAETVSSSQIRLSWTDPNGSAFNQMYTIKYGIRYN

SEQ ID NO: 138297 - protein, 16 aa, Heterodera glycines
  Coding regions on vcDNA: vcDNA=SeqID_64720; Strand=-; Position=1-49
EAIPEGFGLPINLGAS

SEQ ID NO: 138298 - protein, 85 aa, Heterodera glycines
  Coding regions on vcDNA: vcDNA=SeqID_64721; Strand=-; Position=1 -72,175-320,374-413
AYAGNNIREHRNMIHSSTVNFPQKSQDPQMKPLFLSYADVLGLPSTVSSSASSASTSFSASVKPNFRPKSAAKDRNAARIRALLE

SEQ ID NO: 138299 - protein, 18 aa, Heterodera glycines
  Coding regions on vcDNA: vcDNA=SeqID_64722; Strand=-; Position=1-56
TIVIRRGTKVIRRGTTVI

SEQ ID NO: 138300 - protein, 28 aa, Heterodera glycines
  Coding regions on vcDNA: vcDNA=SeqID_64723; Strand=-; Position=1-108
INKSLLCMNYIIYIYSCCKFGNLVICIV

SEQ ID NO: 138301 - protein, 47 aa, Heterodera glycines
  Coding regions on vcDNA: vcDNA=SeqID_64724; Strand=+; Position=1-145
MKIIFVKIFTAGTLLAMLTVAVIVTKFYFIEEWEERRDGGGRHRNRQ

SEQ ID NO: 138302 - protein, 209 aa, Heterodera glycines
  Coding regions on vcDNA: vcDNA=SeqID_64725; Strand=-; Position=1 -191,290-339,399-475,709-1022
  Homolog annotation: Hit_ID=CAE56122.1; Match level="QueryCoverage =57%, HitCoverage=48%, E-value=8e-21, Identity=40%"; Hit description =Hypothetical protein CBG23731 [Caenorhabditis briggsae]
RHFRWIIPWLGTNLWLLANSSVSASFGCLLSQLSFPFYHWFSDDLLTALIVAQRKQIFECEYEDRNLYKDPNASAIYILSLAVSDRYRRRGIGTLLLNHLITDYSVPLASKLIFLHVLSDNHSAIVFYRKNGFRHHMTLPKYYLIDGQYRDGQTFVLFTSQGVFGEFVSSVGDWCAMAMSFLTSPFWRCFFNKNQTLNGRTNANCRHVK

SEQ ID NO: 138303 - protein, 103 aa, Heterodera glycines
  misc_feature (43)..(43): Xaa can be any naturally occurring amino acid
  misc_feature (54)..(54): Xaa can be any naturally occurring amino acid
  misc_feature (61)..(61): Xaa can be any naturally occurring amino acid
  misc_feature (64)..(64): Xaa can be any naturally occurring amino acid
  misc_feature (67)..(67): Xaa can be any naturally occurring amino acid
  Coding regions on vcDNA: vcDNA=SeqID_64726; Strand=-; Position=1-472
IKFWCTLEHFLKKIFMKQKNRFFQVSVWGTQTFMGSKNPTQNXSTGYREAIPEXIGLPINXGAXRSXECPENKKSIFFQCPFWVLKQLWGAKIQRRIKVQAIG

SEQ ID NO: 138304 - protein, 146 aa, Heterodera glycines
  Coding regions on vcDNA: vcDNA=SeqID_64727; Strand=-; Position=1 -91,265-426,598-682,763-865
MFLKQYNLDQIDYTKRIFKALLVNVLFVSTETIEIQFGLSNCVQQTSFWTISIHFIREILMRFVVEMSWRNDKLTSEMAELEMFGIIVKIFVRRIEDSFGYCYVDSSFKTMYSYYFGQIFFGFAVKQQIKWEETIDPSDFGNLFHT

SEQ ID NO: 138305 - protein, 27 aa, Heterodera glycines
  Coding regions on vcDNA: vcDNA=SeqID_64728; Strand=-; Position=1 -41,473-515
MKLRARKCANIKRRLTRGKCSTMLVMK

SEQ ID NO: 138306 - protein, 54 aa, Heterodera glycines
  Coding regions on vcDNA: vcDNA=SeqID_64729; Strand=+; Position=1 -36,160-288
MIVSYNFNHFNFKYLALFSRAEFAELIMQHTIRKKSSFWVRTQNPAWEASHAGL

SEQ ID NO: 138307 - protein, 30 aa, Heterodera glycines
  Coding regions on vcDNA: vcDNA=SeqID_64730; Strand=-; Position=1 -40,163-215
MSRSVPNYAGILPERVLKRTKFYLQVNKAL

SEQ ID NO: 138308 - protein, 78 aa, Heterodera glycines
  Coding regions on vcDNA: vcDNA=SeqID_64731; Strand=+; Position=1-235
KIFFWVFGAVPLNRCAQIYGETESFRNSFTIACTLILRWIFAPHNCLSTPNGHLKKSIYFCFRGSPPEPMRPRFMGRP

SEQ ID NO: 138309 - protein, 88 aa, Heterodera glycines
  Coding regions on vcDNA: vcDNA=SeqID_64732; Strand=-; Position=1 -56,106-150,534-697
MGEGETPQTVLNRRHRPRGESNGNLPLRIERRSNDLLTAKLGQRLHQLYLDYDFISTLDQGIFDNLDQLKKLPLDGNRRLQLTKGVSH

SEQ ID NO: 138310 - protein, 38 aa, Heterodera glycines
  Coding regions on vcDNA: vcDNA=SeqID_64733; Strand=+; Position=1 -49,220-287
MAVYLTHRDQKANNRSKFFEPHLMSNPPPMAEQVKLLN

SEQ ID NO: 138311 - protein, 60 aa, Heterodera glycines
  Coding regions on vcDNA: vcDNA=SeqID_64734; Strand=-; Position=1 -165,433-450
MRGLERKSWDRNSAGKWELCEGRKGKFCLGEYRKMVILEGKKGKILVENSAVKREKVREC

SEQ ID NO: 138312 - protein, 355 aa, Heterodera glycines
  Coding regions on vcDNA: vcDNA=SeqID_64735; Strand=-; Position=1-1068
  Homolog annotation: Hit_ID=NP_502799.1; Match level="QueryCoverage =93%, HitCoverage=52%, E-value=8e-09, Identity=22%"; Hit description =putative nuclear protein, with 2 coiled coil-4 domains (4P607) [Caenorhabditis elegans] emb|CAB16521.1| H
MNFKTAGGLGNKINEAFSHHYKIKKQRGRREAKAEDTKDSKIDVAKRAAERAGRDVERHFNQINNISNSIQTQLNTLRETNPQILEEPDIKIWFDKMVEMGTEIQTSRNELKAFQEEVDKAKNITLEHVEKNDLKKAKKSADVAKGIARQAKTKYTSTLEGYNDKSEKGFSGIVNRLNEALGEHIKRKDIENIQVSEAEKGPQKRERLANEDVQFQYDSIDQKFIVYLSAAVSHIDLSKHLAYVLGFKNTRLFHAEEANYMPDLTGGVRQLYIYAPNLIENTIIGNQMAPLLRIVNVVDDPGSISEVIYSTEYFHRLQSKRISEITIEIHTPFGEFVKFHWGSCILTLHFKKSIF

SEQ ID NO: 138313 - protein, 329 aa, Heterodera glycines
  misc_feature (9)..(9): Xaa can be any naturally occurring amino acid
  misc_feature (17)..(17): Xaa can be any naturally occurring amino acid
  Coding regions on vcDNA: vcDNA=SeqID_64736; Strand=+; Position=1 -134,178-226,271-395,438-566,618-839,887-997
  Homolog annotation: Hit_ID=NP_499779.1; Match level="QueryCoverage =82%, HitCoverage=36%, E-value=1e-101, Identity=69%"; Hit description= ATP-binding cassette sub-family F member 2 like (70.4 kD) (3O548) [Caenorhabditis elegans] emb|CAB04880.
STICFYTKXNNSHFIFXFYFFEPDNIPPPVIMVQHVSFRYNPESPYIYKNLDFGIDLDTRVPYIYKNLDFGIDLDTRVALVGPNGALVGPNGAGKSTLLKLFSRDVEPTDGMIRRHLHCKIGKYHQHLVEELPLELSAHLVEELPLELSALEYMQREFPDVREKEEMRKIIGRYGLTGREQVCPMKQLSDGQRVCPMKQLSDGQRCRVAFAWLAWQQPHLLLLDEPTNHLDMESIDALAEAINNFAGGMILVSHDFRLVQQVTEEIWVCDKQTITKWDGDIFSYKEHLRKIWVCDKQTITKWDGDIFSYKEHLRKKIESNDRKGTMTER

SEQ ID NO: 138314 - protein, 177 aa, Heterodera glycines
  Coding regions on vcDNA: vcDNA=SeqID_64737; Strand=-; Position=1 -239,285-398,422-537,592-653
MASRKNVEQAANMKNDEGEETTTNVADTVKAKTEVAVTHSTFTSDEESSSGRKRRHSFDGTATSLLGAMIHARGEKRENWLNALEQKYAKMEKELGIDDNASDVVDFEEDSMETILKNPTHACKYFIKRVERSEEKVRAWEEKEANAASTSASTSMQAPTDEWNLEKEQSSDDSQAE

SEQ ID NO: 138315 - protein, 76 aa, Heterodera glycines
  Coding regions on vcDNA: vcDNA=SeqID_64738; Strand=-; Position=1 -78,138-290
MRNELGANRVILKPQEFYKLALDHKVEISAIIPLTDDVIRVSYKQKKNFIDEHATSNIVLSLWTTSKHLTKMADKV

SEQ ID NO: 138316 - protein, 299 aa, Heterodera glycines
  Coding regions on vcDNA: vcDNA=SeqID_64739; Strand=-; Position=1 -48,146-443,500-1053
MTSNSYSMKRRWNFRSDQRRLQLGEGPSSRDVESEAAHWQSQNAPLFEQTAYHVHKLERFSLSRHVTEFVLNASVEEPEEALRSAFEMLIRQAVDNTQKQSGRPVAKIGISLHGRGLYEPIVLPLRPLEQNTCDVLMAELDKLGQSDGDDAGDEEGAGMDKRTLLLSEAIQVTVTCFAPPAGARPRHFPHQFWGYNEKHRIRICNWDDNYCLFYALIGSRAYHDPVLFKEWTQARQQPQQNMAQLTLLQDFCEGQEAFRLLLTNRALMRSSAERLLNGAGIREAMNAYGIDQLQPIQDF

SEQ ID NO: 138317 - protein, 103 aa, Heterodera glycines
  Coding regions on vcDNA: vcDNA=SeqID_64740; Strand=-; Position=1 -84,138-365
MGDNEPDTLAKILEKKLDQQVVVKLNIKEAKGEFEGQDFDWIILTIAANDDMEEDEDGGDKKKMKTLESEGAAKKVSDAYDEEIQFMGHSTSSKQGASIEKND

SEQ ID NO: 138318 - protein, 59 aa, Heterodera glycines
  Coding regions on vcDNA: vcDNA=SeqID_64741; Strand=+; Position=1 -26,163-316
MINEIWDKCCLATISSSDFKKALVEANGGEANADDDSQLKHVTVEEVISRINAMVTFVD

SEQ ID NO: 138319 - protein, 263 aa, Heterodera glycines
  misc_feature (262)..(262): Xaa can be any naturally occurring amino acid
  Coding regions on vcDNA: vcDNA=SeqID_64742; Strand=-; Position=1 -50,92-285,336-503,730-940,1004-1144
  Homolog annotation: Hit_ID=NP_504753.1; Match level="QueryCoverage =94%, HitCoverage=4%, E-value=1e-100, Identity=72%"; Hit description =UNCoordinated locomotion UNC-68, Ketamine Response Abnormal KRA-1, ryanodine receptor (unc-68) [Caenorhab
TVPYLSYQITGWLLGQALYWLSVALYWLSVFHAIASFALLISFYQLKIPLITFKREKEVARKLMFDGCWITEDDGEDRGLTDTCFWYLDRIYLDRIVISSKSFPMKYWDKFVRRKTKQKYREQVDEETLNALLGTERSPGDTSFDYRYNCWLWTGVILTNRQFLYRVCYLLCSASGVLFSPFFYAFLLIDVVLSFPMLKAILQSVTHNLQQLILTIMMTLMTLVVVYLYTVVAFNFFRKFYVQVINYGELPPPPPPPPLFLXI

SEQ ID NO: 138320 - protein, 90 aa, Heterodera glycines
  Coding regions on vcDNA: vcDNA=SeqID_64743; Strand=+; Position=1-273
  Homolog annotation: Hit_ID=S35221; Match level="QueryCoverage=94%, HitCoverage=13%, E-value=3e-09, Identity=38%"; Hit description =globulin Beg1 precursor - barley gb|AAA34269.1| storage protein gb|AAA32936.1| embryo globulin prf||1916404A b
MEKEGNGKRGEWKKRGMEKEGNGKRGEWKKRGMEKEGNGKRGEWKKRGMEKEGNGKRGEWKKRGMEKEGNGKRGEWKKRGMEKEGNGKRS

SEQ ID NO: 138321 - protein, 56 aa, Heterodera glycines
  Coding regions on vcDNA: vcDNA=SeqID_64744; Strand=-; Position=1 -164,549-555
MCLEDVQTAASGQMPHSDLAITRTGQNGGQTSGMFDQQIDLRTYGLNNLKIYEEIK

SEQ ID NO: 138322 - protein, 22 aa, Heterodera glycines
  Coding regions on vcDNA: vcDNA=SeqID_64745; Strand=+; Position=1-69
RTHDIFGIGVTMNGDGEMLDET

SEQ ID NO: 138323 - protein, 48 aa, Heterodera glycines
  Coding regions on vcDNA: vcDNA=SeqID_64746; Strand=-; Position=1-146
MLLKVTPWLLIRVRRCCAEPCVAWAPMHWRRRRVRCADDGTADEQCDR

SEQ ID NO: 138324 - protein, 141 aa, Heterodera glycines
  misc_feature (9)..(9): Xaa can be any naturally occurring amino acid
  Coding regions on vcDNA: vcDNA=SeqID_64747; Strand=-; Position=1 -102,222-246,314-345,396-416,593-653,698-810
  Homolog annotation: Hit_ID=CAE59416.1; Match level="QueryCoverage =99%, HitCoverage=22%, E-value=6e-39, Identity=53%"; Hit description =Hypothetical protein CBG02785 [Caenorhabditis briggsae]
VITKTSFSXRFRNCCARLGDGCQQLCSYDQNLGTIQLAVLTGRCPCPVSRVGEMMVCASGNEVCASGNEDATACCQAFGVFESGFDHCRPYCNPSGGLPNDGMLYCNPSGGLPNDGMLAEKYRCLQKLTQIQKCFYLTQRP

SEQ ID NO: 138325 - protein, 281 aa, Heterodera glycines
  Coding regions on vcDNA: vcDNA=SeqID_64748; Strand=-; Position=1 -180,542-743,1369-1829
  Homolog annotation: Hit_ID=CAE59416.1; Match level="QueryCoverage =91%, HitCoverage=42%, E-value=4e-12, Identity=31%"; Hit description =Hypothetical protein CBG02785 [Caenorhabditis briggsae]
MALVLILLGFIWHAPASVGADLPSCIRAKCSHCRVPFIAEMCPGACAVCGPIGNKLFITTAQQSAQVPDARAFGQAQVKVPFAQQLPFPSSVGGAPQQRVGEAVPAAQQRQHQRQVNSRGVNNNNNNGRQKAFRNQYGTDFGAGAAEQNHYHHQQQLPFQNGQQGGGGQFVPADHQNQGGQFVPAGGQFGPLPYQNQQQQQGGQFVAQSGQFGQFVPPGDQGGQQFVPQNQQGGGQQFVPADQRQGGQFAAPQQQQTTSFGGFYNQQQQPDEFFPQAGFGP

SEQ ID NO: 138326 - protein, 32 aa, Heterodera glycines
  Coding regions on vcDNA: vcDNA=SeqID_64749; Strand=-; Position=1-96
MRKMLRSVFLVLFVLLIGWLISSAARNLITAF

SEQ ID NO: 138327 - protein, 52 aa, Heterodera glycines
  Coding regions on vcDNA: vcDNA=SeqID_64750; Strand=+; Position=1 -79,129-207
  Homolog annotation: Hit_ID=AAL78229.1; Match level="QueryCoverage =90%, HitCoverage=25%, E-value=2e-18, Identity=93%"; Hit description =SCN esophageal gland cell protein [Heterodera glycines]
MNPNGFFFVLAVLFLVKVDFLHGVYNEPMARQVLQKHASQFQQHCKNPAEEV

SEQ ID NO: 138328 - protein, 73 aa, Heterodera glycines
  Coding regions on vcDNA: vcDNA=SeqID_64751; Strand=+; Position=1 -65,310-455,686-696
MTVALIGNRTSIFMMLFLGIERLLLCSSIDVVAGGGNNFIITILNNGVMGGTIIVYTLLWLKIKFASSPNAKN

SEQ ID NO: 138329 - protein, 26 aa, Heterodera glycines
  Coding regions on vcDNA: vcDNA=SeqID_64752; Strand=-; Position=1 -54,145-171
MGQDQGSRIFAGDLRVYQKNRDLFAN

SEQ ID NO: 138330 - protein, 35 aa, Heterodera glycines
  Coding regions on vcDNA: vcDNA=SeqID_64753; Strand=+; Position=1-105
MFACVIVDIRSKHTCAEFIIRDDIHKFFGFQLEEN

SEQ ID NO: 138331 - protein, 1927 aa, Heterodera glycines
  Coding regions on vcDNA: vcDNA=SeqID_64754; Strand=+; Position=1 -5781,6624-6626
  Homolog annotation: Hit_ID=NP_920205.1; Match level="QueryCoverage =70%, HitCoverage=87%, E-value=1e-113, Identity=27%"; Hit description= putative DNA helicase homolog [Oryza sativa (japonica cultivar -group)] gb|AAP52492.1| putative DNA helic
MTLQNDGCSCGFFVCLYAEAWLINNQSLILPNLDINLEKRRILWHINGLYNRDNVVYHPCSLFVGSENENLGSLHDSRDSSMSIDSNINQTPVKRRGRPAKNRSGSGRPKKTENNQILMPVFSHNSSLATDLNYSDCSDYVSVSSNCSSNRGGRPKKRSGGPGRRPKKTVHTNLKENINPAQENHTSNTQPVISNELLSLLNSDSIDVPDSQPVAPGRVCIQSINKDLIKETWSSPTDMFSDDLIYCFQRYLASKIANKIVAVVNPQYTDLQSFHVGPIAFPYNVIDNCFNYSANYDILLMTIFFNGHFALIIFDRSDRDNLICLFIDSLPHYDRLFDPQYPGYDVRRIEIIKNGICELTPGLTHDDVVIRALSSSEFTPQHDGINCGVFVLLYSEAYLNNCSLKFPNLNINFERRRILWHLAQLINNDNVEYIGRNANPHPQSLPLYNVESNIEQSCPRDGDGAFICVEPDIDRTPDVILRPPSTVSSITATRRSIRLQRSVSTEKSSDNNVNTLPKIERNDITQRCYVKHQGNPCADVRAKHTTEYYDSGNIGDKICEYCNALLLNSEAEKRNGKFSSSFCCNHGSVVLPSYKEHPPTLQRFLSGQDSESKEFLSHQNVYNSLLAFASISVGYYESSLDGDKCYLLNGEFTRKIGLLPGQFAPSFAQLYILDPMAAFMQRTKNIEYGGDRVNEKTIRKLDFIIRKYHPLAKELLNFHAQYQKTLDEHGPESVLNFRLTLVEAREAPLNIKDPFLHPRQANLPDEGNSLFSIWAESDQPPLLKGIWITTDEGKLQKFRPHHPQTDSLCYPLIFPNGDDGFHPKIPYNITNKKCEDEAMELDVESDENTSDSDEKASDDNLSVASSVDSVEKCGKRQFLSVRSYIRYRIALRNDKKLHHIWSAGGGLSQKFILDYSARIDTNVANYLRKPELNLRSTLPENALRWLSRNAGLNSTEELGSVVMFRRSAPGTRAYFQHKFYDATTIMSRFKRPGFASFFLTFTTNPRWPEISRNFLHQGQRTVDRPDLICRVYEDKLRHLHFLLDSKNILGKMIGQECREFQKKYGGPHAHRVYHTDLLAIPENIDGLIWAHIPAEPNKNDRSDWAIFIRKVRELLPKYQFHDCGRHCLNRKGKCKKGFPKPFSKFTILHDDRPAIYLRPSPEDGGQTLTVKRKKTQITYDNSRVSAYNPYILVHFETHHNLEYAYGQSTNLKYLYKYPFKGPSFSYVKTNEVNGKIGIDEPAYYAKMLYRSSPEAYCRIMSLKYAKLSHTVIALSIHLPGQQKIYYKKNEKESVAQQVQSGILPETPLTAYWKMCETDPDVRKILFEHMPEQFSFNRSGKYWKKRIFSTNPKRQKNHARKPIIGRIYPVSPRNPELFALYLLTKHFPGNPEQLKMLNPTHICKTFLETARLRGLIDDSDVWVRTMEEGAASLTPAQMRQLLANILIFGSTENCLIDGALLWEKFVSHMFDTRCTDAERPARIDHALALLEKLLVKLGKQCKDYGLPTPTISIINDPQRGLIEFFFPQHLNDDDVDDIVDTTAFERGKLNAEQQKFFEMIKTAFLNPSSSRLFYLCGDGGTGKTFLLNYILYQLRKIGAKIIPTASTGMASTRFYVGGTTVHSAFKFGINVEAGILPSIPFDSFFGRRIIESDIIIIDEMTMLERTVFENIDLVCRQLCTQKQHLPFGGKCVIISGDWKQSLPVVIGSYGSAAQVAACIQSSPLYPIFSKYKLTQSMRVNPNEIEFLKWLDDVGRGVNGDTVAIPKDMVVDSREELIGWVFDQGFNMPSSEMLKRLLLATTNRIVDINNSQISQSMYGNFLEYFSVDKATDENPLSVNAADFDVAQLNQLNPMGMPTHLLRLKIGSIIVLLVNLNTSKGLCNGTRLLIKKLTDNLIECETIGTGSSGNGIIIGIPRNRHTYKDKRPDG

SEQ ID NO: 138332 - protein, 81 aa, Heterodera glycines
  Coding regions on vcDNA: vcDNA=SeqID_64755; Strand=-; Position=1 -105,507-645
MDSSTSSGMSESANTPRAPSSNLAEEPTQHSDGKLLFLGIFQEQQNVEFVECCHFHSESTQNHPTDDLLLPCLPPLFHPQH

SEQ ID NO: 138333 - protein, 24 aa, Heterodera glycines
  Coding regions on vcDNA: vcDNA=SeqID_64756; Strand=+; Position=1-76
ITGVSIIAVLFLVFLMPSQNLVRF

SEQ ID NO: 138334 - protein, 80 aa, Heterodera glycines; identical to SEQ ID NO: 130323
  Coding regions on vcDNA: vcDNA=SeqID_64757; Strand=+; Position=1-532

SEQ ID NO: 138335 - protein, 233 aa, Heterodera glycines
  Coding regions on vcDNA: vcDNA=SeqID_64758; Strand=-; Position=1 -188,420-643,729-946,1041-1111
  Homolog annotation: Hit_ID=NP_502165.2; Match level="QueryCoverage =100%, HitCoverage=16%, E-value=5e-52, Identity=49%"; Hit description= cation-transporting atpase (132.0 kD) (4M238) [Caenorhabditis elegans] emb|CAB05683.2| Hypothetical prot
VNNSLVALQRLDIFCTEPFRIPFAGKVDMCCFDKTGTLTKDELVMEGVAGLPTTKADSPNSNGSTSNDAMASDSRSTENDTTPSDTTVTVVQNVAECGPNTINALASCHSLVRFENELVGDPLEKAILKWLDWNVTKQDAVMPNRRMPKMAPLKIFRRFHFTSQMKRMTVVAGYQPVAGSNDTFHIVSVKGAPEVLKPMVGEGMLREVEEFSNPPSDYDSHYQQLALAGARIV

SEQ ID NO: 138336 - protein, 29 aa, Heterodera glycines
  Coding regions on vcDNA: vcDNA=SeqID_64759; Strand=+; Position=1-87
GITDSPMPDFLARHLADIGKSSERTDIHK

SEQ ID NO: 138337 - protein, 48 aa, Heterodera glycines
  Coding regions on vcDNA: vcDNA=SeqID_64760; Strand=+; Position=1-144
MVDKPYEFVDRNSLPGDQCACIRKNTRHKRPKASGLRKCPNREIRNAR

SEQ ID NO: 138338 - protein, 68 aa, Heterodera glycines
  Coding regions on vcDNA: vcDNA=SeqID_64761; Strand=-; Position=1-205
MGKLQREIKEIFENQQNEYENKIYELEEIEELAKEEMEQIESKIEQNKTKLSSRTEQQRRKKNKKTED

SEQ ID NO: 138339 - protein, 79 aa, Heterodera glycines
  Coding regions on vcDNA: vcDNA=SeqID_64762; Strand=-; Position=1-555
ANGVNGFVNLQFSVKVYGHLPKGNSCQTIIGIYARTSVLFYSLTTISNDVPIGLVRALLQFALIVSTGCIFWMLVFVEA

SEQ ID NO: 138340 - protein, 118 aa, Heterodera glycines
  Coding regions on vcDNA: vcDNA=SeqID_64763; Strand=-; Position=1-357
STDVGNGNGAHLNGHLTAPKNEQQQNGNDECETAQQKTDDGTEITAESNNGNESANKPADGNGMENPAPPQGTPQKDANDAEGDHDDQHGFGADQKQGANNDDGGGSIAKMAIVCGRA

SEQ ID NO: 138341 - protein, 181 aa, Heterodera glycines
  Coding regions on vcDNA: vcDNA=SeqID_64764; Strand=-; Position=1 -73,1661-1848,2217-2501
MMQFARKHSSSSLAEQRMAMDRDHQSPANGLPDRWSAFTRTRRTRRRTTTTNVEEDDEDADDDDDIADDVDVSTEEQQTDVEQYKETVDSDEKIAPLIECEQLKNFLSGPPTTKCQINSDAILSVSSTTTKTPATAQNGGTIELVVVSKQKQPPQHNQPKPNKQSGGAESRANSAENGTRK

SEQ ID NO: 138342 - protein, 41 aa, Heterodera glycines
  Coding regions on vcDNA: vcDNA=SeqID_64765; Strand=+; Position=1 -59,1404-1470
MPLWEFGRLLKLVLWWWLNRVFPKKDISESPAGNAYRQKRN

SEQ ID NO: 138343 - protein, 71 aa, Heterodera glycines
  Coding regions on vcDNA: vcDNA=SeqID_64766; Strand=+; Position=1 -78,328-462
MADGNEWKREPLFHFARIVCLDLMKASLIASHCANVIYAGKQKDIDIDHRNIKLRLQEITTHMADWIAKML

SEQ ID NO: 138344 - protein, 92 aa, Heterodera glycines; identical to SEQ ID NO: 124679
  Coding regions on vcDNA: vcDNA=SeqID_64767; Strand=-; Position=1-606

SEQ ID NO: 138345 - protein, 135 aa, Heterodera glycines
  Coding regions on vcDNA: vcDNA=SeqID_64768; Strand=-; Position=1-660
VFGAVPPNRCAQIYGETESFGNSFPIACTLILRWIFAPHKCLSTPNGHLKKSIFFVFGAVPPNRCAQIYGETESFGNSFPIACTLILRWIFAPHNCLSTPNGHLKKSIFLFSGQSPRTDAPIFMGRPNPSGVASL

SEQ ID NO: 138346 - protein, 21 aa, Heterodera glycines
  Coding regions on vcDNA: vcDNA=SeqID_64769; Strand=-; Position=1 -63,133-135
MLVIEMLSIFKRICIISYSMV

SEQ ID NO: 138347 - protein, 19 aa, Heterodera glycines
  Coding regions on vcDNA: vcDNA=SeqID_64770; Strand=-; Position=1-58
GLLGSWVRVPPGELPFMFY

SEQ ID NO: 138348 - protein, 113 aa, Heterodera glycines
  Coding regions on vcDNA: vcDNA=SeqID_64771; Strand=-; Position=1 -141,529-729
MGQIKKLMCLCTSTNSWLSNDPGLFGSGPGKCPKKGGQATSTLVAISQDEEKDKKEEEREEKVEWKEGPIEEVEENVEELREEKVEAEREEKEKGRESVRGRKPGKLIESGRF

SEQ ID NO: 138349 - protein, 51 aa, Heterodera glycines
  Coding regions on vcDNA: vcDNA=SeqID_64772; Strand=+; Position=1-637
NRHFPYCFVANTDRAGTILEHWIAVLPTEIEYFDSLGDYPNEDLSSYLNLF

SEQ ID NO: 138350 - protein, 238 aa, Heterodera glycines
  Coding regions on vcDNA: vcDNA=SeqID_64773; Strand=-; Position=1 -172,543-1042,1232-1276
MDCENAENYDKVFEQETKGNKILKLHMSILLNLIDVLPDFYTFSKEKANEFATIKKLSEEKKVASFYENIFDAQNTEAARAKEMELALIRAIQHILLNDQREKTAVQSQRQKDEPHIMYLFMVLSVLDLFDDEVPARRTARMLCMALPSAKETTPKGKRQRNAIRGTTISQLVEKCLDNDIQNIERQTFADQREMSAQWHGQFFAHYLPNFPANDPLLKRIRQTIIMDGNLSHIDHEV

SEQ ID NO: 138351 - protein, 60 aa, Heterodera glycines
  Coding regions on vcDNA: vcDNA=SeqID_64774; Strand=+; Position=1 -94,236-324
MTFFRTKVFKNVQFLFSADLRFFCPKCVSTKYNRCFVGGIERYQECQSITLSIRSSVPSP

SEQ ID NO: 138352 - protein, 83 aa, Heterodera glycines
  Coding regions on vcDNA: vcDNA=SeqID_64775; Strand=-; Position=1 -87,140-304
MAIDQQRVDCATRLDQIPLETFVRPLPCNHIFHNHCIENSVFLRLFGSMFSYMCIYEEKIFYRLRSGHKTCPICRRGKTLMNL

SEQ ID NO: 138353 - protein, 193 aa, Heterodera glycines
  Coding regions on vcDNA: vcDNA=SeqID_64776; Strand=+; Position=1 -92,315-804
  Homolog annotation: Hit_ID=NP_500013.1; Match level="QueryCoverage =78%, HitCoverage=10%, E-value=5e-27, Identity=44%"; Hit description =predicted CDS, polyprotein family member (4B673) [Caenorhabditis elegans] gb|AAC02594.1| Hypothetical pro
RIMNEVLSDIGHTCAYIDDIIVYTDTFEEHMKFIPNYAAKAAPLTLLLRGKENETNFKWETEQQKAFLALKTELTKSPSLRPPNYKKEFHLFTDASQIAWGGALMQKDNEGTLYAVAYCSKILSQTEARYPPTHGELAAIVHAIGVFHSIFYECDITIYNDHKPLTFLLSKGKTNPKLNRWLLIFQDINPTIN

SEQ ID NO: 138354 - protein, 28 aa, Heterodera glycines
  Coding regions on vcDNA: vcDNA=SeqID_64777; Strand=-; Position=1-88
FANALERALLDMRDLVDWAGRLKGRAKL

SEQ ID NO: 138355 - protein, 56 aa, Heterodera glycines
  Coding regions on vcDNA: vcDNA=SeqID_64778; Strand=-; Position=1 -136,299-333
MASKHFVEAVAKMPAKTTMSIGTIVDGLMEAAIVGHKRYTGEVMNAIFMMNCYTSN

SEQ ID NO: 138356 - protein, 109 aa, Heterodera glycines
  Coding regions on vcDNA: vcDNA=SeqID_64779; Strand=-; Position=1-330
  Homolog annotation: Hit_ID=AAN32884.1; Match level="QueryCoverage =68%, HitCoverage=22%, E-value=3e-39, Identity=100%"; Hit description= cellulase ENG-5 [Heterodera glycines] gb|AAP97436.1| cellulase ENG-5 [Heterodera glycines]
MSAWICPGFLLFFVLILITDHCPMTQAVTQPPYGQLAVSGKNLVQKSTKKAVALHGLSMYWSQWVPKFWVKQTVNVMFNFSFILNKLSLKNDKNYLRNRNYEFCIRILQ

SEQ ID NO: 138357 - protein, 75 aa, Heterodera glycines
  Coding regions on vcDNA: vcDNA=SeqID_64780; Strand=-; Position=1-225
  Homolog annotation: Hit_ID=AAN32884.1; Match level="QueryCoverage =100%, HitCoverage=22%, E-value=3e-39, Identity=100%"; Hit description=cellulase ENG-5 [Heterodera glycines] gb|AAP97436.1| cellulase ENG-5 [Heterodera glycines]
MSAWICPGFLLFFVLILITDHCPMTQAVTQPPYGQLAVSGKNLVQKSTKKAVALHGLSMYWSQWVPKFWVKQTVN

SEQ ID NO: 138358 - protein, 81 aa, Heterodera glycines
  Coding regions on vcDNA: vcDNA=SeqID_64781; Strand=-; Position=1-503
KKSIFLFSGQSPRTDAPRFMGETESFGSSFPIACTLILRWIFAPHKCLSTPNGHLKKSIFLFHKYFFSESALKRTKFYFTT

SEQ ID NO: 138359 - protein, 146 aa, Heterodera glycines
  Coding regions on vcDNA: vcDNA=SeqID_64782; Strand=-; Position=1-439
NGVSKNRNYAQKASQTILALPIPSTIAFIHPIMSAKIIRVPKIACDLSLAKNGVSKNRNYAQKASQTILALPIPSTIAFIHPIMSAKIIRVPKIACDLSLAKNGVSKNRNYAQKAPQTILALPIPSTIAFIHPIMSAKIIRVPKIA

SEQ ID NO: 138360 - protein, 203 aa, Heterodera glycines
  Coding regions on vcDNA: vcDNA=SeqID_64783; Strand=+; Position=1 -385,428-654
  Homolog annotation: Hit_ID=NP_001004509.1; Match level="QueryCoverage= 78%, HitCoverage=11%, E-value=2e-17, Identity=31%"; Hit description =si:busm1-180o5.3 [Danio rerio] emb|CAD60788.1| novel protein similar to DNA polymerases [Danio rerio]
MKCASDHPTGGVDENYHCTHNDSQRGWVSTCTSLELNAALDEGYRVTKLFRVLEYQSSDDQLFKSYIAEFMALKIQASGFDTSIKGNPELEEAFVRECYEKFGITIDPTKMEPNKGKRSIAKLCLNNLWGRFSLRNFGLSQTLITDDPVVLAEYLDNRSLEVTAIDELDAEHILISYEKKKEWVEEHACSNIGIIIYENKIHN

SEQ ID NO: 138361 - protein, 25 aa, Heterodera glycines
  Coding regions on vcDNA: vcDNA=SeqID_64784; Strand=+; Position=1-78
MLSLVGVAISTLPMDAIQLAMEGTN

SEQ ID NO: 138362 - protein, 207 aa, Heterodera glycines
  Coding regions on vcDNA: vcDNA=SeqID_64785; Strand=+; Position=1 -36,254-625,671-886
MVEGVEYWRCPHVRNAAERLRQLAREAHPLQTRDAIDEARAALSAEARVTAPSSSAMGKVFRRAKRKAAELQGDQGLDSVNPLEMIVPNYLEPIILLNENIEIAGQQRKLIAFATQASLRMLGTYRSEISIDGTFKTAPKGFGQLFTVHTVIDSCAIPCVFACLPTKHMQGYLRVFDALRIRIGNWFPQKVMTDFEVAITAMGVMGG

SEQ ID NO: 138363 - protein, 141 aa, Heterodera glycines
  Coding regions on vcDNA: vcDNA=SeqID_64786; Strand=+; Position=1-426
  Homolog annotation: Hit_ID=XP_455240.1; Match level="QueryCoverage =82%, HitCoverage=8%, E-value=6e-10, Identity=31%"; Hit description =unnamed protein product [Kluyveromyces lactis] emb|CAG97948.1| unnamed protein product [Kluyveromyces lact
MLIKFFLNDHYCFSPWCDFWGFATWGPDIWGPDIWGSRHLGTRHLGIPTFGDPTFGDPDWGPDIWGSRHLGTRHLGIPTFGDPTFGDPDIWGPDIWGPDFWGPDIWGSRHLGIPTFGDPTFGDPTFGDPDIWGPDFWGSDS

SEQ ID NO: 138364 - protein, 65 aa, Heterodera glycines
  Coding regions on vcDNA: vcDNA=SeqID_64787; Strand=+; Position=1 -185,633-645
MTTSEGKATAITSPGPPGLDEGDSPPQAPTEQQQKGGPQQKEKDEKELHSLLNKEKARACECVFN

SEQ ID NO: 138365 - protein, 23 aa, Heterodera glycines
  Coding regions on vcDNA: vcDNA=SeqID_64788; Strand=-; Position=1 -5,396-462
MRQADLNPWHKKPIFNQLCNCFT

SEQ ID NO: 138366 - protein, 125 aa, Heterodera glycines
  Coding regions on vcDNA: vcDNA=SeqID_64789; Strand=+; Position=1 -80,132-430
  Homolog annotation: Hit_ID=NP_872117.1; Match level="QueryCoverage =100%, HitCoverage=12%, E-value=2e-50, Identity=80%"; Hit description= glycogen phosphorylase (97.7 kD) (5E63) [Caenorhabditis elegans] gb|AAO25987.1| Hypothetical protein T22
LAHTVRDHLVSRWIRTQQHYYEKDPKRVYYLSLEFYMGRTLSNTMLNLGMQATVDEALYQANDRILYYELSLFGIPFQLGLNIEELQEIEEDAGLGNGGLGRLAACFLDSMATLGIPAYAYGLRY

SEQ ID NO: 138367 - protein, 78 aa, Heterodera glycines
  Coding regions on vcDNA: vcDNA=SeqID_64790; Strand=+; Position=1-237
MIGPPPPPPPPPPPQQHGTGGGAAGGGPPPQQQQVLPPPPKKNVLDGDGKRRQNANKNDGKNAKDEAAARTKHVIGRN

SEQ ID NO: 138368 - protein, 52 aa, Heterodera glycines
  Coding regions on vcDNA: vcDNA=SeqID_64791; Strand=+; Position=1-160
DSLWLLKRAPLGVVAGQQMDEAGQEMNTAHCWQWTAGHSVLRVQFEDRDIGY

SEQ ID NO: 138369 - protein, 315 aa, Heterodera glycines
  misc_feature (3)..(3): Xaa can be any naturally occurring amino acid
  misc_feature (305)..(305): Xaa can be any naturally occurring amino acid
  Coding regions on vcDNA: vcDNA=SeqID_64792; Strand=-; Position=1 -204,370-502,1003-1303,1638-1831,2073-2191
  Homolog annotation: Hit_ID=NP_492127.1; Match level="QueryCoverage =94%, HitCoverage=86%, E-value=1e-122, Identity=34%"; Hit description= EGF motif related, Low-density lipoprotein Receptor Related (lrp-1) [Caenorhabditis elegans] emb|CAA9812
SHXGVGLRAKSMDIWENWLYLSDPLSNGIFRMNKFTGNFYESVAPDHRLPGTVRIFASESDIKTRNQWCNERTSHLCAKNNGGCDQICHVISDDMGTPAHKVQCSCNDTYQLVKQPGEDIATQCVNEAARVSCEGPYNFQCASDGHCIALDKTCDARADCADGSDEAPSYCFVRFCPETYYLCANRRCVQEQLRCNGVNDCGDRSDEIDCSSTPKNSSGSFACMNGHCINSSRVCDGHNDCHDQEVSDENAKTCPGLPIDCRGVRKKCPNTNICIQPADLCDGYDDCGDRADEQQLFCVSQQINXLFISKPKNCL

SEQ ID NO: 138370 - protein, 69 aa, Heterodera glycines
  Coding regions on vcDNA: vcDNA=SeqID_64793; Strand=-; Position=1 -12,1009-1044,1474-1635
MEKKEKFTPTTREETIVFLNHWDFMTTKLHLIFSNLFGTHLNIIIKKELLLLKILFCGSLEKSYKKIVK

SEQ ID NO: 138371 - protein, 272 aa, Heterodera glycines
  Coding regions on vcDNA: vcDNA=SeqID_64794; Strand=-; Position=1 -102,185-334,635-1051,1124-1273
MRSHINEFKILFINILVLYFFHSLTWFVYFLRYRLLLFFYTSTCDLLSPVWMVPVFMGPYQVYSVAYPSLHFAVTFERIRALFLWLASLLYLACIVGLALADPQISGHPQGVVYLTSDYNANLIFWAMLFTMLLVVATALCDWRIYLLNKRLNRVGNGPSTEYNLSLKYQINENTLSMMLIFPMDLLYALIYPIYNVIVLVLRAYRQMLSTANYVSYYHMANTLLFLHSLVTLVVYIRFIKYVSRVRKPSIVKSQPNEEANIHFKQLQAQWK

SEQ ID NO: 138372 - protein, 54 aa, Heterodera glycines
  Coding regions on vcDNA: vcDNA=SeqID_64795; Strand=-; Position=1 -49,127-175,316-382
MVETYTDLESKPKFHTCNINAIALHLQIKAEERFNTSFETVAAFDDFAQKVITK

SEQ ID NO: 138373 - protein, 245 aa, Heterodera glycines
  misc_feature (239)..(239): Xaa can be any naturally occurring amino acid
  Coding regions on vcDNA: vcDNA=SeqID_64796; Strand=+; Position=1 -109,161-303,356-515,558-761
  Homolog annotation: Hit_ID=XP_308875.1; Match level="QueryCoverage =91%, HitCoverage=34%, E-value=8e-32, Identity=38%"; Hit description =ENSANGP00000012802 [Anopheles gambiae]
KCFHARKRFRELTEPVKALLALLKYPFIMLLLLLLTLLTVTMVLLLTVTMVLLNTLQLFFGFKALPAYVQYMESIATLGIFGALGEIAIILYIMLSSLVGLYSVPLIRRLQYIMLSSLVGLYSVPLIRRLQPRRGHTSMTAIITNCVIILVLSSALPVLVRTLGITSFDLLGNYGRIITSFDLLGNYGRIHWISNFSLVWGYNLLFAAASIFCLANKFTQPVRRELLRRFFLCFLFLFXYILGSL

SEQ ID NO: 138374 - protein, 109 aa, Heterodera glycines
  Coding regions on vcDNA: vcDNA=SeqID_64797; Strand=+; Position=1 -82,135-324
  Homolog annotation: Hit_ID=AAP30754.1; Match level="QueryCoverage =96%, HitCoverage=46%, E-value=7e-25, Identity=57%"; Hit description =putative gland protein G11A06 [Heterodera glycines]
KMPSPSVSLLSIVAIFCLLCKCCVSAPHPCCPGSQKVASLLVNYVGIPCCPGSQKVASLLVNYVGIFRHFSSKSSLCSDVDSVAGGLKGRLIGGTNGGHATPLADIESP

SEQ ID NO: 138375 - protein, 78 aa, Heterodera glycines
  Coding regions on vcDNA: vcDNA=SeqID_64798; Strand=-; Position=1 -97,141-279
PITSPDNISQLCTPSNPSPPQGILSLPEFANSYQLDIISALRGNEHDFLAKAAIADAIRAVQSDEDKMELIDFIASEE

SEQ ID NO: 138376 - protein, 93 aa, Heterodera glycines
  Coding regions on vcDNA: vcDNA=SeqID_64799; Strand=-; Position=1-283
KDIYLIICDEILEIDEVKRHKKPMQYKLRDAKGEKFNGFFYPEELAPVRRDAETTYRIERVFRKRKMPDGTMEVLVKFVGYPEREWIHETQLV

SEQ ID NO: 138377 - protein, 93 aa, Heterodera glycines
  Coding regions on vcDNA: vcDNA=SeqID_64800; Strand=+; Position=1 -154,286-413
MVVKFDVQTDSQKFRLNPGFLSKIFQNQDIGPKKSDFGVENQDFLQNCFNGEIGIISSLPQNQNILINKNKWKPWFKGASLDSLILALTKSDD

SEQ ID NO: 138378 - protein, 182 aa, Heterodera glycines
  Coding regions on vcDNA: vcDNA=SeqID_64801; Strand=+; Position=1 -154,709-850,1221-1455,1612-1629
MFPYFVTPLLLITLIIPTFVVVNSKSFGNISDKYTIHPPGPYHIVVVFYVADGHQKEFPFATDENGRIKLSFNEKVLKKRANIDKEDKNLHSYIAFFERKEIRDDGSTVKIAVHLRNSANEERLLHPFEMFKYNEAHETELVRTFGNYALFMKDRKYNECRLHEVFQIMFDRLPLLTHFKNF

SEQ ID NO: 138379 - protein, 804 aa, Heterodera glycines
  Coding regions on vcDNA: vcDNA=SeqID_64802; Strand=+; Position=1 -1151,1499-2760
  Homolog annotation: Hit_ID=AAM11674.1; Match level="QueryCoverage =45%, HitCoverage=41%, E-value=4e-72, Identity=39%"; Hit description =pol protein [Drosophila melanogaster]
MQQTFRNENFPRISQSQNRQNCYNCGRFGHFARQCNYPRQVRTENANIGTPATGANKTSVEVPKDTSQPQYNKPLPFSRNYLRQNFLVEQQENPPPTSQNFLIGGISMSNDELEKLFERDKSVEAENSRAKLLNVSVGKIVVIKVSVCDLSATAMLDGGAQVSLVSFAFFSKIMTEKNLDKIQLCPTRKSTQVVDINGKTVEYVGVVSLPIVRKNTEVWIRFHVTKASFGYEFLFGTNALARLNFKLYDGQNQEMISFTEVDSEEKNSVHVIYRTTLLPQATTLVELASPMNFKGENVAVFPNSEKEIKIEPTLTVSEKGKLIVPITNFSSLPITLEKDTHVGNIELVENFGETEDFFLSPLIAYCRQQNEPSLAQMSEQNANKGINAVTKKDAFPLPNIDYILMAIGGKKFFSTLDFMSGYWQIRMSEDSVQKTAFTTEFGLHEFTVLPFGLCNAVATYQRFMTRLFNEMVNDFVFIYVDDILVASETWDAHLKHLEQVFERVEQAELKLKIDKCRFAAEELPFLGHILTTNGIKMDADKIRPILELPLPSSKKQLQSFLGFMTYYRKFIYGFGSLAAPLFHLIKENTPFVMGKKEQKIVNFLKRKVLEDVVLYFPDFKVAAENALRRFIILTDASKFGISAVLCQQDELKNVRPIYFASRQCNKYKSKYCPTELEALAIRFGTRKFSQFITGIPCRVITDHKALIPMFRSKKETGNARVDRWLMEVNARYQLSVEYQPGKQNVVADLLSRVGKQSDTEKMENLLDDCPSEVVVIKKLSIKEIKTNADIEKLDRKEWVEQTKS

SEQ ID NO: 138380 - protein, 105 aa, Heterodera glycines
  Coding regions on vcDNA: vcDNA=SeqID_64803; Strand=-; Position=1 -64,522-775
MAISGIAAQKQLLRLAIESEARILFFPFICACRMTIFFSAEYAIHSATPKRTENALFGKTHSLEVPRRRTKSGKAKQKWWRQLAKSLPTICCGITISISPIKRGK

SEQ ID NO: 138381 - protein, 16 aa, Heterodera glycines
  Coding regions on vcDNA: vcDNA=SeqID_64804; Strand=-; Position=1-49
EAIPEGFGLPINLGAS

SEQ ID NO: 138382 - protein, 37 aa, Heterodera glycines
  Coding regions on vcDNA: vcDNA=SeqID_64805; Strand=+; Position=1 -102,462-473
MTWTACHQRHATSARAFVACNHWIRPHRLLAAPRKML

SEQ ID NO: 138383 - protein, 118 aa, Heterodera glycines
  Coding regions on vcDNA: vcDNA=SeqID_64806; Strand=+; Position=1 -166,506-695
  Homolog annotation: Hit_ID=CAE56900.1; Match level="QueryCoverage =99%, HitCoverage=38%, E-value=2e-35, Identity=49%"; Hit description =Hypothetical protein CBG24741 [Caenorhabditis briggsae]
DGIVKDGLTDAYDSVHMGNCAEKTAKECQIGREEQDNYAIQSYKRAAQAWQARKDQNGTVTAGNASTLNDGAAAVLMASEEKADALGVKPMAKVIAYGDAATHPMDFPIAPALVIPKA

SEQ ID NO: 138384 - protein, 95 aa, Heterodera glycines; identical to SEQ ID NO: 124528
  Coding regions on vcDNA: vcDNA=SeqID_64807; Strand=+; Position=1-588

SEQ ID NO: 138385 - protein, 53 aa, Heterodera glycines
  Coding regions on vcDNA: vcDNA=SeqID_64808; Strand=+; Position=1 -117,623-667
MRYARHHIENAEDVGDELLHGPKELAEVDDTECGIAFCRLLLKFDLKKPKLTT

SEQ ID NO: 138386 - protein, 103 aa, Heterodera glycines
  Coding regions on vcDNA: vcDNA=SeqID_64809; Strand=-; Position=1 -116,169-458
NSKEQLNLQTMTMQLEILCEIMGITNITLIWGAISSWNQKIFHLLLLSLFKCSVLLCQQRKQFHVFSPVRLAFPAIGRAIRPNCREKRQSFHRREHNFLVILG

SEQ ID NO: 138387 - protein, 302 aa, Heterodera glycines
  Coding regions on vcDNA: vcDNA=SeqID_64810; Strand=-; Position=1 -330,941-1142,1637-1687,2058-2329,2758-2811
  Homolog annotation: Hit_ID=NP_499522.1; Match level="QueryCoverage =55%, HitCoverage=10%, E-value=2e-19, Identity=34%"; Hit description =golgi-specific brefeldin A-resistance guanine nucleotide exchange factor 1 (3M842) [Caenorhabditis elegan
MTPTSEECHVCPSEAAGSDNSRSSASPPGLQQQKPKSRAASPPVDTANPPLNSPPSSQPLHSRLAFNGTTSAKINDTARHWKQWNSSEEMALAFGENKKAQMAARAMFDLLAANTVAECHPEQIVLDSRYLASSSLTELVNSIIHCSFTVAPILCTLHGPTHHQQDNQQQHSQHESQDEHCAGESRQAGPSVVSDSLVSNQQTVQDRASNCADEVLHFMGCELLALRPPELFLFSRQIAFGLHQLLRANAANLHASEHWEMFFILLESVGAAAYRDEIDGAEMVECQIMIKMERIMSQNSNT

SEQ ID NO: 138388 - protein, 149 aa, Heterodera glycines
  Coding regions on vcDNA: vcDNA=SeqID_64811; Strand=+; Position=1 -177,247-375,420-691
  Homolog annotation: Hit_ID=CAE67661.1; Match level="QueryCoverage =47%, HitCoverage=3%, E-value=1e-14, Identity=56%"; Hit description =Hypothetical protein CBG13224 [Caenorhabditis briggsae]
NQQTVQDRASNCADEVLHFMGCELLALRPPELFLFSRQIAFGLHQLLRANAANLHASEHWEMFFILLESVGAAAYRDEIDGAEMVEVCFRRYVGYPFQLPPPPLPKNCSSVFKRGTIVLAFNLSRHDPAAFLKVRCLRTMVEASLDGGK

SEQ ID NO: 138389 - protein, 75 aa, Heterodera glycines
  Coding regions on vcDNA: vcDNA=SeqID_64812; Strand=+; Position=1-228
NDEWEQIEELVGVLKCAEEATKRFTEEPISFVLPQARSLHDELYEMKIVNRTVETIRTTLYYAFERRFFELANKK

SEQ ID NO: 138390 - protein, 188 aa, Heterodera glycines
  Coding regions on vcDNA: vcDNA=SeqID_64813; Strand=-; Position=1 -259,338-474,673-843
  Homolog annotation: Hit_ID=XP_517630.1; Match level="QueryCoverage =77%, HitCoverage=27%, E-value=1e-21, Identity=37%"; Hit description =PREDICTED: similar to membrane-associated RING-CH protein VI; similar to S. cerevisiae SSM4 [Pan troglody
MGVVHFKIVCASVLMGPDWWLKTAFEQVQQRTCAGLSLFVFKIYADGIWNIRLRDLYTNLVFPIVNTLTFLIAFPYVLSNFLLFFVDASREEQIIVIRFAYPFLLGSICFCALITWQWQKLKLLAQKIRNDKYLIGTQLVNFYRENTSAIVGNSTVKKSVTPMESIVNQQQQKSQVANGEQPGRNDEL

SEQ ID NO: 138391 - protein, 447 aa, Heterodera glycines
  misc_feature (131)..(131): Xaa can be any naturally occurring amino acid
  misc_feature (189)..(189): Xaa can be any naturally occurring amino acid
  Coding regions on vcDNA: vcDNA=SeqID_64814; Strand=-; Position=1 -57,106-264,363-1246,1291-1437
  Homolog annotation: Hit_ID=CAE66833.1; Match level="QueryCoverage =90%, HitCoverage=42%, E-value=3e-75, Identity=38%"; Hit description =Hypothetical protein CBG12203 [Caenorhabditis briggsae]
ICRVCRLSGNDVLYHPCLCTGSIKYVHQDCLLQWLKTGSIKYVHQDCLLQWLKYSKKDVCELCNHKFSFRPLYRPDMPERLPIFDLLRGSLAVGSVSTPSAFCYYGNFRPILGIVPLMAARIHRLVFLALXPLFSPPAFQLFSTENVAIDIARGSLVVTIFLCTFISLVWLREQIMVQFCGFQFLMSFXQIGGPAHLLHLNEDQPIVEHQQHQSEKNTHSHNLISTESDQPPDNAGQSAEADAEEHGDGKNENAYNGLTPTEQMSSFGPSTSAATSDSTDANDQTEAENQLDQLPQNRQPPSPILPVQAALVANQNQRQQAHNGGDAAAAEIDPQQQRFVDELTWQKLLGLDGSFAFIEHVFWTISLNIVFNIVFLYFPAQIGSGILSTIGLSGKNIVFLYFPAQIGSGILSTIGLSGKIAFFELPISILTGLVAIFIHGLVIHRIS

SEQ ID NO: 138392 - protein, 27 aa, Heterodera glycines
  Coding regions on vcDNA: vcDNA=SeqID_64815; Strand=-; Position=1 -61,347-368
GELQKAPILDEEACRQNVDSGTCQNYV

SEQ ID NO: 138393 - protein, 55 aa, Heterodera glycines
  Coding regions on vcDNA: vcDNA=SeqID_64816; Strand=-; Position=1-165
SASKQWWSLQCKRWQIHSFVQFPNIITILFPAPFLVIPTPFLQVQSRGVLLDGPL

SEQ ID NO: 138394 - protein, 171 aa, Heterodera glycines
  misc_feature (11)..(11): Xaa can be any naturally occurring amino acid
  Coding regions on vcDNA: vcDNA=SeqID_64817; Strand=+; Position=1 -443,1258-1333
  Homolog annotation: Hit_ID=CAE71741.1; Match level="QueryCoverage =92%, HitCoverage=30%, E-value=1e-29, Identity=40%"; Hit description =Hypothetical protein CBG18725 [Caenorhabditis briggsae]
EIDETLVVKRXYGVGRILEKQEVWLFGGVERDSNWERVFMVPVESRGAARLLPLIQQYILPGTTIVSDEWRPYRGIPNLPQNYVHWTVNHSQNFVNPANRLAYTQNVESMWKKLKRNFKQQFGNKTETYDTYFPEFIWRQRFGDRENANFLLIECMYYCDYVDRINVRDFR

SEQ ID NO: 138395 - protein, 50 aa, Heterodera glycines
  Coding regions on vcDNA: vcDNA=SeqID_64818; Strand=-; Position=1-150
MPLCVQRLRSWGQIWEPRESDDAQIGQNSVPTETDNLPSGCHNDRNRRKL

SEQ ID NO: 138396 - protein, 17 aa, Heterodera glycines
  Coding regions on vcDNA: vcDNA=SeqID_64819; Strand=-; Position=1-66
HKHLFDLFYHIHNLIKI

SEQ ID NO: 138397 - protein, 166 aa, Heterodera glycines
  Coding regions on vcDNA: vcDNA=SeqID_64820; Strand=+; Position=1 -135,1690-1912,1965-2107
MALAQKFSMNFGKLAENLQSQIDYALHDRSGFKSDLDTDSSLYSPNNHKKIEHEGHLYVFAKLSADGFIKFLRCENKNNKDMKCRGRLHTNLNDVVLKQVNEHVCGANPARVEAQRVVTGIKCRAIETAEPPSTLRSIALQNVGTPVLSEVPTKNATKQVVLISLR

SEQ ID NO: 138398 - protein, 274 aa, Heterodera glycines
  Coding regions on vcDNA: vcDNA=SeqID_64821; Strand=+; Position=1 -354,740-753,939-1128,1177-1442
  Homolog annotation: Hit_ID=CAE59319.1; Match level="QueryCoverage =57%, HitCoverage=12%, E-value=9e-30, Identity=47%"; Hit description =Hypothetical protein CBG02659 [Caenorhabditis briggsae]
SKNEFFEPHKIGRRQKRVNVREIFQDAFQRIRQHGTQIACVFYVFVALMALFGVICTIARLALFNPADYLAWLLMLWLFYVFGHYINAFIKECTGCLRNNNNQIHSIELAENGPAAAGPSVEEVIAITCSWCKRSYHNKRHCFSLARFDDRCDRGVLRELILPPGWLLRLAAPRRRSANPSTGSRMLAYADAAAQKRSRRRSKYRAFVVKPPPASRCSSAQAHGVANGYSRWATAAQLQPLPIQPLLVFVNPKSGGNKGAKALNTLCWLLNPRQ

SEQ ID NO: 138399 - protein, 138 aa, Heterodera glycines
  Coding regions on vcDNA: vcDNA=SeqID_64822; Strand=-; Position=1 -214,290-490
MDHELAMHGWQECVARMNNICPGQIVEFTRLKVREQGRNGNVKGSFPFTLLYNGESRHRVLGQAPAAVTNAVCSPNFNTPIIVEANDQHQHSSNGTIIGGGDRGGNDLNNPNNNNDSVINDALSAQLTNRSDQVNTSV

SEQ ID NO: 138400 - protein, 44 aa, Heterodera glycines
  Coding regions on vcDNA: vcDNA=SeqID_64823; Strand=-; Position=1-132
MIFFYRSYYRIIGSFFIGRIALFSIRNILIHLFISTLFQMVLRL

SEQ ID NO: 138401 - protein, 94 aa, Heterodera glycines
  Coding regions on vcDNA: vcDNA=SeqID_64824; Strand=+; Position=1 -151,698-831
MEILNEFNLMKKELRKESVYKNLSHSQLECEIAKKLGISRKKIYKWKNEFDPHSYQCLFSPAGTGLSFFQKPGPGLKKPGIPVSVPLSSNFSVI

SEQ ID NO: 138402 - protein, 134 aa, Heterodera glycines; identical to SEQ ID NO: 128331
  Coding regions on vcDNA: vcDNA=SeqID_64825; Strand=+; Position=1 -27,96-382,734-824

SEQ ID NO: 138403 - protein, 25 aa, Heterodera glycines
  Coding regions on vcDNA: vcDNA=SeqID_64826; Strand=+; Position=1-77
TCTCGVVVKLSTFHNFSPGFNFPHL

SEQ ID NO: 138404 - protein, 53 aa, Heterodera glycines
  Coding regions on vcDNA: vcDNA=SeqID_64827; Strand=-; Position=140 -193,601-708
MGFLFYMFVAAVAFGGGAYCGMIYTAKRARASAGGGSKKDKKQKASKSSSGEQ

SEQ ID NO: 138405 - protein, 24 aa, Heterodera glycines
  Coding regions on vcDNA: vcDNA=SeqID_64828; Strand=-; Position=1 -8,243-309
MGMCVQAHHDMRMFDGHKVISICS

SEQ ID NO: 138406 - protein, 53 aa, Heterodera glycines
  Coding regions on vcDNA: vcDNA=SeqID_64829; Strand=-; Position=1 -3,149-307
MANCLYNDRSAWQCGERIGKDELCVGIYRHFYLHFHLVAHEQNGQKIAKREWE

SEQ ID NO: 138407 - protein, 50 aa, Heterodera glycines
  Coding regions on vcDNA: vcDNA=SeqID_64830; Strand=+; Position=1-219
YKNKSDFGIPDQRGVTGFLSGKIFSQKTFKNMSLGLFYDADHEYVIRFYF

SEQ ID NO: 138408 - protein, 127 aa, Heterodera glycines
  Coding regions on vcDNA: vcDNA=SeqID_64831; Strand=-; Position=1-381
MQTRYASSVRFHLIGFTSSLTLSSKCFATFPHGTCSLSDSWPYLVLDEVYHLIWAAIPNNPTPRHVKMDRHRQLDRSCTFSGAPVKGNLNKRANPSSRSIRYTSQPRGAAIQRWTLPSSLAVTTGIL

SEQ ID NO: 138409 - protein, 121 aa, Heterodera glycines; identical to SEQ ID NO: 128908
  Coding regions on vcDNA: vcDNA=SeqID_64832; Strand=-; Position=1 -184,211-352
  Homolog annotation: Hit_ID=EAK91016.1; Match level="QueryCoverage =91%, HitCoverage=90%, E-value=2e-26, Identity=62%"; Hit description =hypothetical protein CaO19.6835 [Candida albicans SC5314]

SEQ ID NO: 138410 - protein, 87 aa, Heterodera glycines
  misc_feature (69)..(69): Xaa can be any naturally occurring amino acid
  Coding regions on vcDNA: vcDNA=SeqID_64833; Strand=-; Position=1-662
IIFIQKIFFWVFGAVPLNRCAQIYGETESFRNSFTIACTLILRWIFAPHNCLSTPNGHLKKSIYFCFRXSPPEPMRPDLWGDRILRE

SEQ ID NO: 138411 - protein, 31 aa, Heterodera glycines
  Coding regions on vcDNA: vcDNA=SeqID_64834; Strand=-; Position=1-95
MEIFDEYIIVDEKSLSINIGSKFNEVTQFAA

SEQ ID NO: 138412 - protein, 302 aa, Heterodera glycines
  Coding regions on vcDNA: vcDNA=SeqID_64835; Strand=-; Position=1-907
MNSWVSYTSLDRCSKAKEHQKRQRTTLKNWRTTSSTWPNSTTLKVKSKFTITDLPSTPEALLAGIFQHCIDEAIVESRERNIEPTHLGCMISSPLLEGGDIPIPIRQMTNNTLDTILNQFKKVAQSKQQKNVSLWGEPFTVTITTLDRNGLPSKRRVKGGARRPVKTAVHHRINDQCLIKIRNNDNHFCLFYALQATMVAKTCNWPRWKFSRYLNNQYGQQGQLYHDAVELMQQVNAPMDLVGYDADTFVPHVVDYWNNAQRQHRFAVFIFGSLGQYKPIYKYIDTTYDTPLMLYFNEDHFD

SEQ ID NO: 138413 - protein, 18 aa, Heterodera glycines
  Coding regions on vcDNA: vcDNA=SeqID_64836; Strand=+; Position=1-56
YREATPEGFGLPINLGAS

SEQ ID NO: 138414 - protein, 148 aa, Heterodera glycines
  misc_feature (1)..(1): Xaa can be any naturally occurring amino acid
  misc_feature (143)..(143): Xaa can be any naturally occurring amino acid
  Coding regions on vcDNA: vcDNA=SeqID_64837; Strand=-; Position=1 -127,177-231,273-388,687-770
  Homolog annotation: Hit_ID=CAG10967.1; Match level="QueryCoverage =70%, HitCoverage=28%, E-value=5e-21, Identity=52%"; Hit description =unnamed protein product [Tetraodon nigroviridis]
XIAKLRIEISSFTFSSSSAWRIISFVSTLFVKSFTLTFLAEWGDRSQLTGDRSQLTTIVLGAREDVVGVILGGIIGHMICTGVILGGIIGHMICTGIAVLGGRLLAQRISVRTGSAFLYYLDSVFLFRESFFLRSWVSLTLFXWKITS

SEQ ID NO: 138415 - protein, 76 aa, Heterodera glycines
  Coding regions on vcDNA: vcDNA=SeqID_64838; Strand=+; Position=1 -99,209-340
MLAEAISIKMEHAAATQTCGFENSVEHCEQNKSIVYAVIDEMDDEDVDEAMAPPPPQSSSSHKGTCSVATQTKMSY

SEQ ID NO: 138416 - protein, 90 aa, Heterodera glycines
  Coding regions on vcDNA: vcDNA=SeqID_64839; Strand=+; Position=1-271
MSITVPLSTSDKPFGTEVDNNFRFFDGELSGSGDDDDDNDDDDEIVRFNDARAVCTTATSTLPWRRIRSAMTSCTFSCCFNKSNDSRRTA

SEQ ID NO: 138417 - protein, 108 aa, Heterodera glycines
  Coding regions on vcDNA: vcDNA=SeqID_64840; Strand=-; Position=1 -169,223-380
MKKSVTVAVPEQKEINQPNAEVEPPKSDTTKKRKVEDRELWKLAKGKFMLATYLCADDWDRLFHNQQKVARLEDGRFAVSFELCEECAWANCRATDLIAPMKKKPNNA

SEQ ID NO: 138418 - protein, 537 aa, Heterodera glycines
  Coding regions on vcDNA: vcDNA=SeqID_64841; Strand=-; Position=1 -299,344-915,963-1154,1197-1292,1339-1469,1518-1841
  Homolog annotation: Hit_ID=NP_001004509.1; Match level="QueryCoverage= 97%, HitCoverage=35%, E-value=2e-56, Identity=29%"; Hit description =si:busm1-180o5.3 [Danio rerio] emb|CAD60788.1| novel protein similar to DNA polymerases [Danio rerio]
MVLPNGKTAGQVRERDGKRMEYIRRYCNRVDVYWECRISEMLARSKAMRKCFANYVDDGPLVIRDAFMGGRTGPMKLLRRAGPGEKISYYDFTSLYPYVNFTTRYPIGHPKVHVLNQQVDWSSAVDNPYPLALLKVWVVPPRRIDVPVLPVKVDDRLCFPLCISCAKEYPTGGVNNDYLCEHTDQQRGWVSTCTSIELNAALDEGYRVTKVFRVLEYEQSDDQLFRPYIAEFMAQKIQASGFDSMIKGNAAMEEQFVRECEEMFGINVDPTKMVVNKGKRSLAKLCLNNLWGRFSLRNYGLSQTLITDNPVILAEYLDNKSIEVSSIDQLDGEHILITYLHKKDWVDEHACSNIVISLWTTSAARIVLLKAMQKVVRSERCELLYTDTDSLILVHPEECCPLKTGPHLGQFTDEYPDHDIVEYCSGGSKQYGLCLRRKEAGPDAESEYVLKVRGMTLNYDVVNNQGLRYERFKEEVINYATRGDYEPIIVTYPNFLRPNIREGGRVVSMPMQKCYRPFVGKGIVGPNFNVLNFGHTL

SEQ ID NO: 138419 - protein, 18 aa, Heterodera glycines
  Coding regions on vcDNA: vcDNA=SeqID_64842; Strand=+; Position=1-57
YREAIPEGFGLPINLGAS

SEQ ID NO: 138420 - protein, 181 aa, Heterodera glycines
  Coding regions on vcDNA: vcDNA=SeqID_64843; Strand=+; Position=1-546
  Homolog annotation: Hit_ID=NP_294987.1; Match level="QueryCoverage =82%, HitCoverage=65%, E-value=7e-19, Identity=35%"; Hit description =hypothetical protein DR1263 [Deinococcus radiodurans R1] gb|AAF10836.1| conserved hypothetical protein [D
MPTAKVVISQDGRKLVPFFTSAYPFSNHFSCRFVIDGLEFSSSEQMYMWAKASVFGDEEAASAILRTSNPKECKRIGSRIRLFNTTAWRRISIFVMTCANWHKYKQNEDLMRHLFNFGPDAEFVECTANDVYWGAGVALSDVEKIRDINRWPGKNILGRILSALMKKFLRKKSGEMNTKKK

SEQ ID NO: 138421 - protein, 20 aa, Heterodera glycines
  Coding regions on vcDNA: vcDNA=SeqID_64844; Strand=+; Position=1-62
MDGPWVMKQGNGQEKEKQGD

SEQ ID NO: 138422 - protein, 20 aa, Heterodera glycines
  Coding regions on vcDNA: vcDNA=SeqID_64845; Strand=-; Position=1-61
LSGEKSQKGRNLNGTRRLCD

SEQ ID NO: 138423 - protein, 298 aa, Heterodera glycines
  Coding regions on vcDNA: vcDNA=SeqID_64846; Strand=+; Position=1 -158,209-866,912-989
  Homolog annotation: Hit_ID=XP_146481.3; Match level="QueryCoverage =72%, HitCoverage=15%, E-value=3e-14, Identity=29%"; Hit description =PREDICTED: similar to carboxylesterase 2; carboxylesterase ML3; acylcarnitine hydrolase M1 [Mus musculus]
MTTNGRGRSDQGQQQKQCQNTEALGDQPQKRDGTPEGGGKGAICGGGTGGNLLDILNLLSKRAEAAASKEKGQKEEGETRGGRETEEEKKTVKRKCNVKRESDEQQPQGRQWTEDGQRKEIVEGREEEDETAMDEGQTQTHLNHSVEHILKDGEEKEEEELAKKRAKTEEKTEGKTEEKTQERETEERETKGMEEREKEETEEMQVEDGYHCANREESADFRLDQMDRFALFLGTAFPPAALRHLMKENPFFRKFCSSLRADNALTFESVNKLMDTHFARMKDKIRRKLAHIQSSVLL

SEQ ID NO: 138424 - protein, 35 aa, Heterodera glycines
  Coding regions on vcDNA: vcDNA=SeqID_64847; Strand=-; Position=1 -54,95-190
IVLKKGAQKTHFCVKIFSFGRHFSSLEITILGFRH

SEQ ID NO: 138425 - protein, 87 aa, Heterodera glycines
  Coding regions on vcDNA: vcDNA=SeqID_64848; Strand=-; Position=1 -168,222-316
  Homolog annotation: Hit_ID=P49673; Match level="QueryCoverage=83%, HitCoverage=21%, E-value=2e-22, Identity=64%"; Hit description=cAMP -dependent protein kinase catalytic subunit (PKA C) emb|CAA49464.1| catalytic subunit of cAMP-dependent pr
LGHGQRPCQFVHVMEFLPGGELFAYFRALRKFSSTVVKFYSAEIILALEYLHSKQIAYRDLKPENLMVSIHGHIKLTDFGFAKVIQN

SEQ ID NO: 138426 - protein, 92 aa, Heterodera glycines
  Coding regions on vcDNA: vcDNA=SeqID_64849; Strand=-; Position=1 -125,197-350
MPLYVLCNSFYSVQQRCDVLCTPDGIMLVNLAENSFYKQDSVVMRMGDKMMRNVVQPLARLKLINEEFVLIRAIIYSHMGLQWQNFKKINKF

SEQ ID NO: 138427 - protein, 252 aa, Heterodera glycines
  Coding regions on vcDNA: vcDNA=SeqID_64850; Strand=+; Position=1 -73,360-1042
  Homolog annotation: Hit_ID=NP_500013.1; Match level="QueryCoverage =44%, HitCoverage=7%, E-value=2e-25, Identity=49%"; Hit description =predicted CDS, polyprotein family member (4B673) [Caenorhabditis elegans] gb|AAC02594.1| Hypothetical prot
MSRGHRFKCHGGVKGADRHSWLQNAFAAENYTIPPSSQVMIRANIKTALQPKHSLVVDKPDLNLLSNDLGIVPSVSAPFVEDIPLTIINPSNDPKILFKGMHLAYLNEIVENDGIFYESDQEKIKSGNPDPNGLTDPSFKIDLSKSDINEREREALKNLLEEFKDIFSKSQYDLGSFSGGEHHFDTTTEAPISSPPRRMPYKYRDELKKHIEQLLNKGVMVESETPWVTPFVVVQKKDGGIRPCLDFRKLNE

SEQ ID NO: 138428 - protein, 80 aa, Heterodera glycines
  Coding regions on vcDNA: vcDNA=SeqID_64851; Strand=+; Position=1 -163,428-507
MSSILGIVKFVPLCLVLTFVLEKIKKQSENSELGLETHRKTAAHMARFEASEKQWGGDTVNKNCHLECSMIHQEIYVSYH

SEQ ID NO: 138429 - protein, 72 aa, Heterodera glycines
  Coding regions on vcDNA: vcDNA=SeqID_64852; Strand=+; Position=1 -149,720-789
MPLFRTANPHALNSKVVRGIAKQRGITPEQVFFRFTMDIGITPLSGTTNGSLLIIRNQFTNCFIKKRTHSVE

SEQ ID NO: 138430 - protein, 119 aa, Heterodera glycines
  Coding regions on vcDNA: vcDNA=SeqID_64853; Strand=+; Position=1 -96,688-769,1954-2135
MGSLKMDTECILGFGPRGRGWLFAGAGVRVAGAYILKTFIELALNINNKIALNFIGIFPDRHFEKSLDLDLDSMLDLDLDFLDKNPGKSRSRKNPGSSRPGSRPGPGFFEIYFNNQKNV

SEQ ID NO: 138431 - protein, 207 aa, Heterodera glycines
  Coding regions on vcDNA: vcDNA=SeqID_64854; Strand=+; Position=1 -315,636-941
MYLSKIIFLFFYNFNGVFGIYEIDSKEDLKDLNVKTENCKKVKIENFSVSVKNEPIFDDKHLVGKIGHFAENATDQKHEEFAIKKESDQQSIYCIDEDNGDENGKISSAETDELEMVKQFDVMKNELRLNKNYKQLSKSKFEAIVAQKLGKSRAQIYALKRKLKKKYGKIINTKMEENAETKLMIIRQFDEMKAEEKRNGKLKTENL

SEQ ID NO: 138432 - protein, 97 aa, Heterodera glycines
  Coding regions on vcDNA: vcDNA=SeqID_64855; Strand=-; Position=1 -64,121-350
MVASSFSNNGKNILESPFKLTGECKLLYYCTNELGHFLNQTSNALIGNPLRIVPFDGLSSPQKVWFHGTWLSIRDQKQKLTETIATPKNNHSAQIRS

SEQ ID NO: 138433 - protein, 92 aa, Heterodera glycines
  Coding regions on vcDNA: vcDNA=SeqID_64856; Strand=-; Position=1-304
MIGRAVRNRPFIFEGIFKFILYPRKMSISFFEKFYTSQKRLRMRRRAVHNRHFISQRIFIFRGYPRKMDISFFDKFYTHTNALEHDREGGAQ

SEQ ID NO: 138434 - protein, 92 aa, Heterodera glycines; identical to SEQ ID NO: 125147
  Coding regions on vcDNA: vcDNA=SeqID_64857; Strand=-; Position=1-304

SEQ ID NO: 138435 - protein, 133 aa, Heterodera glycines
  Coding regions on vcDNA: vcDNA=SeqID_64858; Strand=+; Position=1 -43,343-701
MDDLYEEYKKHDEMDSIVYRVWKNRIEKYCANKKRTIFNLTFVKCAAEIAHFRVINQNKNSKDAYVNLKVVPDKYLQDGFVGFLHYDKTLGQQIAEKFEKEIFSNKEQINERVENQIMQLAFSFAARVILCIM

SEQ ID NO: 138436 - protein, 296 aa, Heterodera glycines
  Coding regions on vcDNA: vcDNA=SeqID_64859; Strand=+; Position=1-889
  Homolog annotation: Hit_ID=CAA82797.1; Match level="QueryCoverage =44%, HitCoverage=22%, E-value=2e-12, Identity=37%"; Hit description =gag protein [Ascaris lumbricoides]
MSSARCRMALGPALFRLRQHVTTAENLLDEPVINAETTENLEQERGHITRILSRMEVELDAWGAIMNGLQGPAREAEEALFTAFIRDDRHLTEWLEDAREMLAHIAAELADEPNQPIAAGGQQPAVAVNQPVPAVPFVNNAAFLGGANVQQPAAVANHANQPPLVPNNAQIVPNLPAVAAPAPLATARLPQLSLPVFSGEPMEWPAFWQSFESAVDRAALEPVDKLNYLHGCLRGKAARAVTAYRGGDNYAHAVAALRRLFGDPRKIAEALQSELINLRPVDDSVGSLQHFLETLE

SEQ ID NO: 138437 - protein, 29 aa, Heterodera glycines
  Coding regions on vcDNA: vcDNA=SeqID_64860; Strand=-; Position=1 -69,224-244
MALAQQGAEKNNAEQDQFHDDLMPDCPKL

SEQ ID NO: 138438 - protein, 161 aa, Heterodera glycines
  Coding regions on vcDNA: vcDNA=SeqID_64861; Strand=+; Position=1-563
SQPFFPCIHSIFWTRNSVFRKLISRPWSTNLPFPQQTFITQQNLGLALHCSTLIKTNEFCLGLTCPVPTEYTREPKNKTFFVCPFWRIENVQSPRSPFTNTAPPQSQISRINQFHSRLVSQINNSLPTPRLRGRRTGRGSGEMSNKYPNPTPAPPSLFNVI

SEQ ID NO: 138439 - protein, 49 aa, Heterodera glycines
  Coding regions on vcDNA: vcDNA=SeqID_64862; Strand=+; Position=1-149
MMLTRAKRASGGRWTTQQIIECIFAIFIPPVAVLIHGGHEWVLHLIINI

SEQ ID NO: 138440 - protein, 50 aa, Heterodera glycines
  Coding regions on vcDNA: vcDNA=SeqID_64863; Strand=+; Position=1 -39,783-896
MTLILMTEMTAVTKLANAKVSSTCTMSGSNFYGLAARRRKIKNSNSKSKK

SEQ ID NO: 138441 - protein, 51 aa, Heterodera glycines
  Coding regions on vcDNA: vcDNA=SeqID_64864; Strand=-; Position=1-262
YRGSYSRRIRSPLYLGASVRGDCPENLKIDFFKCPFGVLKQLSGSKNPTQN

SEQ ID NO: 138442 - protein, 113 aa, Heterodera glycines
  Coding regions on vcDNA: vcDNA=SeqID_64865; Strand=+; Position=1 -189,251-346,540-596
MLECLNTASQIKIINDKNSIIHFNFVFGLKRATVWGFFTDNSNALASRFRCSFQMVQLNAPSVEWDVALVTFADRSLLRNSWNALSNAIHTALIRSKKQIKRLNFGSFTVLNE

SEQ ID NO: 138443 - protein, 287 aa, Heterodera glycines
  Coding regions on vcDNA: vcDNA=SeqID_64866; Strand=-; Position=1 -70,1301-2092
MPTDNLCQWLKIRRIGRRSIANVPETEIRRRLLYGGMEQSAPEEQLEYDEMENGDEQNVNGMVQQNFENGVEAGDRGSFGNDALDAHGLRAFSTPLNEQNLSALQRDLRMQLPENLSVIQNQIRVMNFMQNQMPNPVAHNFPALNPIACRPNGQLYENAAVNFERQREQQIRLTQQPVVEDQQSHVRRIPPPHAYTQGHRRSQDEGFEFHQGQQHPNFKKNLPIRANQQNRPECNQQPVPHPGLVFDGMMAQAIRSLDGFSYTMTLNAIPNLDGNRGTDSVNAFFKP

SEQ ID NO: 138444 - protein, 50 aa, Heterodera glycines
  Coding regions on vcDNA: vcDNA=SeqID_64867; Strand=+; Position=1 -30,418-540
MLLKLADYFQYYFLDFDVIKLRTFFNANHEQVFPFISKEFFGELLLRVCG

SEQ ID NO: 138445 - protein, 241 aa, Heterodera glycines
  misc_feature (55)..(55): Xaa can be any naturally occurring amino acid
  Coding regions on vcDNA: vcDNA=SeqID_64868; Strand=+; Position=1 -169,388-479,534-565,615-998
  Homolog annotation: Hit_ID=NP_490866.2; Match level="QueryCoverage =81%, HitCoverage=34%, E-value=1e-42, Identity=46%"; Hit description =SRC oncogene related (60.7 kD) (src-1) [Caenorhabditis elegans] gb|AAN31394.1| protein tyrosine kinase [C
MGKCFSSLKRHHNLQADDSSVKEFQHFSKGFKQQAGTSSTIAQHNAAFRHKNGNXHSEGVSTSFQAIQKLVAMFAYESRSDEELEFQKGDIMYLMENSKGDIMYLMENSNLDWWYNLDWWYVRNMKGKQGFVPSSFVAFVKTPQAEEWFAGRIPRTVAERLVVDNHFPPGTFLVREREVDQLEYALTIRDMDTHGPCVKHYRVRQTDDAQGYFISHKAVFKSLDALVKYYSGKFIFSCYFT

SEQ ID NO: 138446 - protein, 85 aa, Heterodera glycines
  Coding regions on vcDNA: vcDNA=SeqID_64869; Strand=+; Position=1-258
MYAYGIMLIAGYGALIFAGAGLILALAALVIPVVNRMWKLENESSRQRDVLNALKSQVDNNQSECDKLNFEVFKLNKKCAHLPSD

SEQ ID NO: 138447 - protein, 91 aa, Heterodera glycines
  Coding regions on vcDNA: vcDNA=SeqID_64870; Strand=+; Position=1 -180,231-326
MRKTIVGTEWMIYKNRDIGIMLFASKIQLEAAKNCKVMVADATFEIAPRGFRQIWLIHGLTYGAIYMRCLCYTSKQNYKGCGENISNRKKK

SEQ ID NO: 138448 - protein, 190 aa, Heterodera glycines
  Coding regions on vcDNA: vcDNA=SeqID_64871; Strand=-; Position=1 -197,254-629
  Homolog annotation: Hit_ID=EAL25446.1; Match level="QueryCoverage =68%, HitCoverage=13%, E-value=3e-30, Identity=51%"; Hit description =GA15966-PA [Drosophila pseudoobscura]
MARFSIGGLNIFESESAIAFAMSERRNPKEQAPHGIELKMQEVPVNALGDENDETVRGEYSKCYHTFQQIGNGTFGSVKLATQKGTGLMAVSKFICKDKVLPESWIQCPKRANKMVPIEVHLLENLSHPNIVRVLGVFENDKYYQLVMEKCGCGMDLFEFIDHQPKMDEPLISYIFRQVTKSVVTPRLRL

SEQ ID NO: 138449 - protein, 119 aa, Heterodera glycines
  Coding regions on vcDNA: vcDNA=SeqID_64872; Strand=-; Position=1 -97,364-626
MRGTYDEDGYGSLEDKECDKGQQFCYLANCKTDMVSYLSWDCAKDTDCAKISADWTMNRGGGNYSCECTFGAPGLNLGNEKLHIPMARTIVFTEMEIPNSGISSCNMQIGGAILWVLGD

SEQ ID NO: 138450 - protein, 108 aa, Heterodera glycines
  Coding regions on vcDNA: vcDNA=SeqID_64873; Strand=-; Position=1-327
MTRLLLDVEFHVHVGLDEQQVSRMWSKDETWVIGDESIHQQVKLSDLEVAERVADANRCEDQCVIGFPLPGDDLADRSPIADEIELLFSKLRSISTYQQRAFAGFAVR

SEQ ID NO: 138451 - protein, 130 aa, Heterodera glycines
  Coding regions on vcDNA: vcDNA=SeqID_64874; Strand=+; Position=1-393
MNGGGSNNSFLCVIFDCNAYNWGCVVAERGVSTLNETVSALIALCNAHNFSSLGNRLLLLAKGAKQQEKKLFTNERITAKELTNFGPAIEGIIHQILAKNVSAEESPFNLSSALSLSICGMLMRLHHAFT

SEQ ID NO: 138452 - protein, 154 aa, Heterodera glycines
  Coding regions on vcDNA: vcDNA=SeqID_64875; Strand=+; Position=1 -177,1743-2030
MEDDAMVELAKGPEYFNKFCADKGLIINEKNQFVSDKYEVHLGLLYVMRMKWNHVMETRIEDNIFLVVLKEMRVEKFGAKLETAPLSANAKSLIHSQKLEIKLYLKIIYLMRLKWQCAEIENYRKECTKFRKYFNFLYEYLFRTYNEGIVRNFV

SEQ ID NO: 138453 - protein, 197 aa, Heterodera glycines
  Coding regions on vcDNA: vcDNA=SeqID_64876; Strand=-; Position=1 -205,529-672,730-852,898-967
  Homolog annotation: Hit_ID=CAE56725.1; Match level="QueryCoverage =94%, HitCoverage=15%, E-value=1e-60, Identity=69%"; Hit description =Hypothetical protein CBG24512 [Caenorhabditis briggsae]
VPSRLPFLSTLSTLHFQKRLPEYANRFSKCLMTADHGPAVSGAHNTNVCARAGKDLISSLVSGLLTIGDRFGGALDGAAKSFSEAMDTGLSAMQFVNEQKRLGKLIPGIGHRVKSINNPDKRINNPDKRVEILKEIAKNKTFFKQETPLFDYALKVEQITTSKKPNLILNVDERKPNLILNVDERIATIFVDILRHS

SEQ ID NO: 138454 - protein, 218 aa, Heterodera glycines
  Coding regions on vcDNA: vcDNA=SeqID_64877; Strand=-; Position=1 -85,132-218,270-356,402-521,573-748,796-895
  Homolog annotation: Hit_ID=NP_495405.2; Match level="QueryCoverage =99%, HitCoverage=41%, E-value=1e-22, Identity=29%"; Hit description =amino acid transporter family member (54.4 kD) (2H166) [Caenorhabditis elegans] gb|AAA68337.2| Hypothetic
NIVNIIIIVHQFGLCIMYYLFIASTFQTVFDKEKADNEPKGKDPRWFLFILLPIVALNSIMSMRILSVMCLVGDGLTITSLTLILFMLSQIVFTERAHSIPFALPSAEGFFKASGTIIVSCLAQSLVLPLEKRIKKPSQMLGPFGVLSGGIAISTIVYAIVGFLGYCAYGEEIQSTVLEHLECVNNAKELTVLTFIIRVALCLSIFASFMLPMFVLVG

SEQ ID NO: 138455 - protein, 18 aa, Heterodera glycines
  Coding regions on vcDNA: vcDNA=SeqID_64878; Strand=+; Position=1-56
YREAIPEGFGLPINLGAS

SEQ ID NO: 138456 - protein, 29 aa, Heterodera glycines
  Coding regions on vcDNA: vcDNA=SeqID_64879; Strand=+; Position=1 -57,258-290
MQENIEGILKNNIKNKDKNAVHRKLILKN

SEQ ID NO: 138457 - protein, 57 aa, Heterodera glycines
  Coding regions on vcDNA: vcDNA=SeqID_64880; Strand=+; Position=1-175
CCTKCYNSMTGCLQKCIIEHKGDPACRKTCKPNVYKCAAKCGPHCPLNWTTTTPKSG

SEQ ID NO: 138458 - protein, 179 aa, Heterodera glycines
  Coding regions on vcDNA: vcDNA=SeqID_64881; Strand=+; Position=1 -12,285-356,577-636,1127-1247,1309-1358,1737-1850,1917-2027
  Homolog annotation: Hit_ID=CAE59603.1; Match level="QueryCoverage =68%, HitCoverage=6%, E-value=8e-41, Identity=65%"; Hit description =Hypothetical protein CBG03011 [Caenorhabditis briggsae]
MQIFSSACSSQEEIWVGGANLERPLNTQLYFSPSAADSRRCSTLASPQSLLSSGMHSASSAVAWSPCSSRSLSPCASPANSLKGSWSYDIINLPVHLERHIKVLKSHLPLGVVLDANIDKAINGCVVKSICSKKALAKDGRIQPGDHIVKVNGESLRNVTNAQARAIMRRANLVGAQCG

SEQ ID NO: 138459 - protein, 173 aa, Heterodera glycines
  Coding regions on vcDNA: vcDNA=SeqID_64882; Strand=+; Position=1 -48,338-458,954-1177,1565-1690
  Homolog annotation: Hit_ID=CAE59603.1; Match level="QueryCoverage =63%, HitCoverage=4%, E-value=2e-18, Identity=50%"; Hit description =Hypothetical protein CBG03011 [Caenorhabditis briggsae]
MAKRNNGNLMNEFAGGKHRPPASPPISKSQQQIEEAAALISSSRKMGTDGQKTMAQSISIVGGRVEVTQRDSITDAGGTLPTTAVPICGGGAAADEEGTALVAKTVSGIFIKSVVPDSPAGRSGQLFMGDRVNDTDLSNTTHDYAVQVIKSAKNPVKFVVQSLQSLQAFVPSS

SEQ ID NO: 138460 - protein, 29 aa, Heterodera glycines
  Coding regions on vcDNA: vcDNA=SeqID_64883; Strand=+; Position=1-88
MLIKKGSNTKLIRSLLHGDLISPFWLGTR

SEQ ID NO: 138461 - protein, 82 aa, Heterodera glycines
  Coding regions on vcDNA: vcDNA=SeqID_64884; Strand=-; Position=1 -50,445-643
MGAYHKDGIVVEHNGKGHEGNETLEEYDRKFVDSLRLNLEECRNFIITLLAIAEKQMDLLVMSNEEKQKLSIKKEEYMSFYN

SEQ ID NO: 138462 - protein, 57 aa, Heterodera glycines
  Coding regions on vcDNA: vcDNA=SeqID_64885; Strand=-; Position=1-172
MSCPPPVVAAVLLMMMVRLGSQPAPAAKRVADAAGADGDDHAVDIAHQQQNGCHHLL

SEQ ID NO: 138463 - protein, 51 aa, Heterodera glycines
  Coding regions on vcDNA: vcDNA=SeqID_64886; Strand=-; Position=1-214
KIHSLLKVAKKFWGTYCGTSLLDTCLIAPVIWFCNFKKSNKLRISNFIFEN

SEQ ID NO: 138464 - protein, 17 aa, Heterodera glycines
  Coding regions on vcDNA: vcDNA=SeqID_64887; Strand=+; Position=1-53
IESHPLPADSRDNKALI

SEQ ID NO: 138465 - protein, 37 aa, Heterodera glycines
  Coding regions on vcDNA: vcDNA=SeqID_64888; Strand=+; Position=1 -63,583-633
MAVIEPGGTANANEAQQRKRRFFLMFTNNSINDSVIK

SEQ ID NO: 138466 - protein, 37 aa, Heterodera glycines
  Coding regions on vcDNA: vcDNA=SeqID_64889; Strand=-; Position=1-112
MCKLANDRSIQLEMDIRAGAINSSFHHPPSSTSSASR

SEQ ID NO: 138467 - protein, 106 aa, Heterodera glycines
  Coding regions on vcDNA: vcDNA=SeqID_64890; Strand=+; Position=1 -259,408-469
MSNDHNLCKIFCELYTVCPPICHGNGTAQFAIQIGAVRRVYSSNIIHAKAFIGAEGGRSRLSPCRGEIRRPIFLANRMTNSVASTAASRKFKSSQFCTKKKSKDIK

SEQ ID NO: 138468 - protein, 131 aa, Heterodera glycines
  Coding regions on vcDNA: vcDNA=SeqID_64891; Strand=+; Position=1-396
YIRAELHLHGRLDSFLDAKWTKSTTPPLHIVQFMCSSNKWTQKIGKNGKDYGKWPKNGTGGTIWPSRKISLGLTRIDQMDEKQQKKNYHRHHQIHSPGWSTFDAMTPLLYASKDNAEQQQDELHINVQRDK

SEQ ID NO: 138469 - protein, 129 aa, Heterodera glycines
  Coding regions on vcDNA: vcDNA=SeqID_64892; Strand=+; Position=1 -175,348-389,430-581
  Homolog annotation: Hit_ID=AAQ72736.1; Match level="QueryCoverage =100%, HitCoverage=24%, E-value=1e-35, Identity=55%"; Hit description= TGF-beta-like ligand precursor [Trichinella spiralis]
NAKGSPKMINFKFPFRQRCAWHNMTVDFHQLGWSDRIIAPKRFEAGFCGGHCDYPLENESNPSNHAILQSLIHNHGAEPSHNHGAEPSPSAVCCAPAEFDSLTLLYFDERDNVVLKNYPRMVVMSCGCL

SEQ ID NO: 138470 - protein, 128 aa, Heterodera glycines
  Coding regions on vcDNA: vcDNA=SeqID_64893; Strand=+; Position=1 -156,342-572
MDKVRKTAEYFSYGMAKGNVNDAANDAQMPTESAGDGNDFDTFRRLNRRRKMRNRKSKSAQKKYPGFDANDPMLGFGTPFSPWQRMSPSVNRRTKMLQSPNAGTSLNDILGLREHGYWFGTEMGPKIN

SEQ ID NO: 138471 - protein, 71 aa, Heterodera glycines
  Coding regions on vcDNA: vcDNA=SeqID_64894; Strand=+; Position=1-218
KILWNEWSCYGVEYSAQRLSKIRMDTVDQNRARDNLPPRATGDQWQCTAQFGKTGVSMSNALFMPPLVKIV

SEQ ID NO: 138472 - protein, 29 aa, Heterodera glycines
  Coding regions on vcDNA: vcDNA=SeqID_64895; Strand=-; Position=1-95
LDFLIFYFLRLVSSTIICQFGRMCVKRKK

SEQ ID NO: 138473 - protein, 147 aa, Heterodera glycines
  Coding regions on vcDNA: vcDNA=SeqID_64896; Strand=+; Position=1-444
MNSFPSPLPKFSTIGIGTFLLLLVINFHLIASNEFGPEDSVDRKKTAENNESFALLRRPNYFAKKLIVSMDAFSDTDSEDETKQRTAHFELSDSEEEFKEWQERQRERKLEKENAEMEKAAKRESAEKGTVKDKKGKLSEKKSDWKL

SEQ ID NO: 138474 - protein, 170 aa, Heterodera glycines
  Coding regions on vcDNA: vcDNA=SeqID_64897; Strand=+; Position=1 -222,878-1168
MPMIGSNANVDFEAVLIEKRFLRFWDSMNGDRRLPMSAKNGGSAAAALPPPAIVSVSGGLLDEFIDEGWTLSRACPSQSVHQKFDLLANSIGKRRLLLLAIANLTDRDNSVPKFDLLTASKCGQNPQSVGGTRFLDTDHLFAVANLSNCEGRGNVLVAPNTNLWVLIDPH

SEQ ID NO: 138475 - protein, 160 aa, Heterodera glycines
  Coding regions on vcDNA: vcDNA=SeqID_64898; Strand=-; Position=1 -291,1538-1729
  Homolog annotation: Hit_ID=CAE72016.1; Match level="QueryCoverage =56%, HitCoverage=17%, E-value=2e-22, Identity=51%"; Hit description =Hypothetical protein CBG19098 [Caenorhabditis briggsae]
MLCFSSTNASRCQATLLFVYNNVHVPQPQETPLWILFYGSMGTCIGFWMLGHRVIRTVGQELTEINPFCGFCIELGSAITVVIASKLGIPISMTLCIPLRSSTLRQVPIKYKNLFLTAMFKKRPNTARGKVLLVNVVDSANRKKKRTLRERDEVKEQKGR

SEQ ID NO: 138476 - protein, 774 aa, Heterodera glycines
  Coding regions on vcDNA: vcDNA=SeqID_64899; Strand=-; Position=1 -33,81-267,333-398,440-871,940-1543,1899-2501,2651-2693,2750 -2875,3043-3115,3474-3630
  Homolog annotation: Hit_ID=EAK87696.1; Match level="QueryCoverage =99%, HitCoverage=70%, E-value=1e-17, Identity=20%"; Hit description =large low complexity coiled coil protien with large repeat region [Cryptosporidium parvum]
MAQTKEKRRKRNSTEMQKINVSRSNSDIKAFSMNEDDELTREILALFDYEDKWDKAQNRTIDTQRGDHSNGSNVNWAKATKLETEQLQFSMDPSAANSTNEWTTKSGEKTGEIQMEKGPAKEQQQLAEYDQLASNGPTKVETIVTKTTPEQAEMTMATENASETTAYSQRNHSIAKADLEREVNGTEMAQRKWEKVANDGERKGNSSEGEEKVPKMEENGHEKEMPTDETENKANRTEKVGSVLPVSPFSSAPTVPSLQIAMPSVGILEEALGIGTASPSTITYSENKLNKSTEPSIEFTNITMPLVGTEMAPSNFKSIKNENETEILAKNQSENAKSNLTTNTSQSTTELKILYPLESELSLPLLSPMPPTELPMINYEANGTDTFVEEMSNRTEEGKEANGTSAGEGIKGGALEELKRKVEGKMRIDDAECEQKEEGKGFISISASMPNRNSDLFIARKNAISVSVSSNFEEIRKSPVKMGTTEAITVQMEKMPILTTTEKTKKEKIDREKETDGKETMGQKTKTIEEETNTEEIVGKKGGNTVEEKKETEEETTEKERMAKETKTGEKEARETMAKETKIGETVARETEARKTTETRETETRKTVAKEETETRKAMAKGIETRETETRKTMAKGTETCWAEHFSSKYFSLIPLRNISAVDHCKHLAQDDLVHELKQKGTYNPELMAWASDRKSEKRQSKAPKSSDQAVKRNVEALERLLTDAPQTQLRIGTFGGEKRRKTAEAKGDEKGGQNGAKGREKAAEKAKAKAEND

SEQ ID NO: 138477 - protein, 215 aa, Heterodera glycines
  Coding regions on vcDNA: vcDNA=SeqID_64900; Strand=+; Position=1 -82,1342-1907
MQEMVQLLGHALRVHVALKTKNSHTFVYLLCTVCNIKLTPKETGQRYNMMAIFTNLLRQVPTGRLNFGDVSSKTAVWTSSKDGFGLHFEMNSSAWRHLPHTYERNPSHVIAQKVTTAIKRRAVETMEAPSVIRAISLQSISSPALSEVPSKKATNFVNLFNQNLLKDLSADARILAKVQIYYVDMPNNDDHNYINRHPRRIEYLKGISRNYQMNP

SEQ ID NO: 138478 - protein, 45 aa, Heterodera glycines
  Coding regions on vcDNA: vcDNA=SeqID_64901; Strand=+; Position=1 -108,177-206
MNLCKSPVQALVKIKNFYFLLSNVFCFFQKYEKFFKHDAGKMQTN

SEQ ID NO: 138479 - protein, 170 aa, Heterodera glycines
  Coding regions on vcDNA: vcDNA=SeqID_64902; Strand=-; Position=1 -132,178-310,1190-1275,1843-2004
MDKISGSENFVFFGCGIPTPEMLCKVLKNFAEVIFEFLYPVKISSIFYPNFGISWKYFFLETNLNLRKVFVQCVIIHLISIISIPFYQSQKRRWNNAATDAATAQNPLDKESARITVLFLLAVCMDMRVQFAQMIRKMFVPFRRRGTQTMTVQTVQANFNSRMRHNANAN

SEQ ID NO: 138480 - protein, 21 aa, Heterodera glycines
  Coding regions on vcDNA: vcDNA=SeqID_64903; Strand=+; Position=1-64
MPFWSCKKANNSDSPEPVIPR

SEQ ID NO: 138481 - protein, 135 aa, Heterodera glycines
  Coding regions on vcDNA: vcDNA=SeqID_64904; Strand=-; Position=1 -183,1674-1898
MCLYMLFLCPYTHHSTWPLDSDPDPLTPRSESGKLTIVKHVPIGIKDIIPHIVLSVVGLSKQMNCTIINSLSPLSKVRDAFRITNFLICIAFMILCAFPMYRLARERLTLYMVISKVWFFIGRVDLIRVGHDHSG

SEQ ID NO: 138482 - protein, 335 aa, Heterodera glycines
  Coding regions on vcDNA: vcDNA=SeqID_64905; Strand=-; Position=1-1006
  Homolog annotation: Hit_ID=NP_912739.1; Match level="QueryCoverage =99%, HitCoverage=23%, E-value=2e-34, Identity=32%"; Hit description =unnamed protein product [Oryza sativa (japonica cultivar-group)]
MHGLLEDDKIWDKTLAEAALSRWPDQMRWLFVSILVYGQPSNAIELWNKYKDQIYNPQGITTPAQRQAAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQMSPLFGQFTTMKLTINQRLGQ

SEQ ID NO: 138483 - protein, 104 aa, Heterodera glycines
  Coding regions on vcDNA: vcDNA=SeqID_64906; Strand=-; Position=1-313
MRRKIQMPNWSKLSRFIHSATLACSRVGFGLFGRISWPNDGTKGAEKKDKWAKWLSVETKARTVSDCVRQCYEYRFWSVCGGKTMDQSENQSGMRVGNGKGRVE

SEQ ID NO: 138484 - protein, 76 aa, Heterodera glycines
  Coding regions on vcDNA: vcDNA=SeqID_64907; Strand=-; Position=1 -176,252-306
MPKNVQFPTQVCPCADQKCVAEWKIAIGTAHRAHQKDLNGNGTDKCRSLLPMLARQKELLKTDLANGEIFLSIPIV

SEQ ID NO: 138485 - protein, 62 aa, Heterodera glycines
  Coding regions on vcDNA: vcDNA=SeqID_64908; Strand=-; Position=1 -57,90-221
MAITNLRTEGGDHNQFLWNCFISCQFQSDDDDFIMPFGFTNQLTGERLAFKSANILGRLGYN

SEQ ID NO: 138486 - protein, 101 aa, Heterodera glycines
  Coding regions on vcDNA: vcDNA=SeqID_64909; Strand=-; Position=1 -107,285-481
MALTSEMSSANSNATKATPKGATNARTNPSTAHFAGMPNIGQLPPGKYNWREFEKLQKEIGNKIEHLIKNDQFDMGMCRYDLKDRAKRRAEMEKKMQMEIS

SEQ ID NO: 138487 - protein, 1269 aa, Heterodera glycines
  Coding regions on vcDNA: vcDNA=SeqID_64910; Strand=-; Position=1 -456,512-924,1064-1139,1207-1305,1372-1784,2616-2907,2965-3471,3520 -3787,3828-5115
  Homolog annotation: Hit_ID=A45605; Match level="QueryCoverage=84%, HitCoverage=62%, E-value=1e-21, Identity=21%"; Hit description =mature-parasite-infected erythrocyte surface antigen MESA - malaria parasite (Plasmodium falciparum)
KNGDITLMDVCFLRNFWLYVEKLKTKKSVEFEEMNAFCEQLEMHVTELKHPEQFKNFAKQFNMFLSDCHFVYLDNLLTEREMRKNSNFRQIFEIENRKTDEESEMTQRFRELTAKNEFDQIKHAKRIMIAFLMDQSSVDQLELNNPILLAIGIESDDFFRMLYEGINKNGFNGNVMFIKLSILFAKIIAHFANCQKKDSINKYKIYWKQFDKIMGKNDEWRKESNKQKILAQLDELLAKMDSEFGTSKVTERLKLILNDLGRCLIELYLENEAFRNNFREQPENWEGVNKLFESAVSSSCDDSLLNKTMELFESRISKPQKDDFINNANRSFVKELKDQNIEFENTKEQDAIIVMKQYMELLTTESADNLRKDSPFMQNLKMHATHWYYRKCINSFLELADTLIEQHGQQNAKFKDRIDKYKLKGQNLSGQNSEKSNGRKRELCMTYKLAYELATDQTLIKMNSDWKTEIEKFVQKEKEDLSKYTGINAKNVTKIVKWKPTECETEKGVKRALAEQRQRMRKTHFEYLDRLLSEEFFRAKFNKISGAKERIRKLLTDGTDKGEEANAEKIRAMFRTPECVREAFLNAPLSQFYEEALLDEKCQFHQMANWLKADVVVIAQKIELALEQNAKRLQPLGKFWEKNKYSFMELFDRILDSEISEIELRVMEFVELIDEYMDKVMKKCMEMSLNGEEDKAMKLLCLNSDDKTSDRQKTEQKADAEFYGKWINNLHFDTLTKLMAENGQMKSNLKKVYESSEEAIKTLMNRFGIERANEILIICGTREEIKEQSVEEILMEITEKERENGIKKNNKNRRKKENKKKQKEKPTNGRIENGGAKTETKKNESELSKSDSNEMENKILSDEETQKNDDGQKDKTLVKMKVKKDDKVTTKEDEKITTKDEDKVTTKEEDKVTTKEIGDGQNLEDIQSVRGGKMMEQIHAADQNESRTNDQTLGSDKGTTNGNKIIGNRGEKADEKRKTKEEELSSEVKDNLKRNLNELKSERKANYESEEEEEEEEENCNGKMPKFDGKVPNRNEQEMANWETKSEENSEEEDKLDQNELLHLKIGHFSDDNLLSLKYGELFWAVSKESWENDEENDALTVKTLCWTLHLGVYANEISNRIGLFGTLEELKIIGKNEKLEIEKQWEKLKMVELSKIISLCERNKLMAKLHLLLKKIVASMDGFCAENGTNLWTEIEETKSQLHSRKLAKTMAKSETERQLKRKMDKVILALIQTENDGREDGMPKHRAEFEEQLKAVKHFDGQRKLGN

SEQ ID NO: 138488 - protein, 273 aa, Heterodera glycines
  misc_feature (12)..(12): Xaa can be any naturally occurring amino acid
  Coding regions on vcDNA: vcDNA=SeqID_64911; Strand=+; Position=1 -96,172-245,293-356,436-552,603-762,823-857,903-960,1069-1120
  Homolog annotation: Hit_ID=CAE68560.1; Match level="QueryCoverage =95%, HitCoverage=41%, E-value=3e-77, Identity=60%"; Hit description =Hypothetical protein CBG14395 [Caenorhabditis briggsae]
NLKKLPSLIVTXIPPYNSLVPKMQSEDFDDGFKLPPTELSKAFKLPPTELSKAPDEVFDVISKIGEGSYGSVHKALHSYGSVHKALHRESGHTLAVKMVPVVPVDTDLQEIIKEITIMQQCDCRHVVKYYGSYFKDSDLWIVMEYCGIVMEYCGAGSVSDIMRLRRKTLNECEIGAILKDTLLGLNYLHGLKKIHRDVKAGNILLNMDGNAKNILLNMDGNAKLADFGVALADFGVAGQITDTIAKRNTVIGTPFWMAPELIQEMGYDMKADI

SEQ ID NO: 138489 - protein, 69 aa, Heterodera glycines
  Coding regions on vcDNA: vcDNA=SeqID_64912; Strand=-; Position=1-211
FEYPKRTLEKIDFFVFGAVPPNRCAQIYGETESFGNSFPIACTLILRWIFAPHKCLSTPNGHLKNRFFC

SEQ ID NO: 138490 - protein, 56 aa, Heterodera glycines
  Coding regions on vcDNA: vcDNA=SeqID_64913; Strand=-; Position=1-168
MIILFNIYNYFNNILNYSDDDEKKLRNGRRSKWLNGTSVAMEKCLPKRFGKNSSTK

SEQ ID NO: 138491 - protein, 97 aa, Heterodera glycines
  Coding regions on vcDNA: vcDNA=SeqID_64914; Strand=-; Position=1-293
SGDIVRVLLENFLYHFDEELDDAKMSGGGSGAGRRQSRSDSFVVSLWSTLQRTLALGPQADGDSDGSDCFPPHSLSTLILTLLLSLVYYPSFEGRTN

SEQ ID NO: 138492 - protein, 97 aa, Heterodera glycines
  Coding regions on vcDNA: vcDNA=SeqID_64915; Strand=-; Position=1 -160,280-413
  Homolog annotation: Hit_ID=AAV34698.1; Match level="QueryCoverage =91%, HitCoverage=35%, E-value=3e-11, Identity=41%"; Hit description =IC5 [Globodera pallida]
MGTYAFDNYGFLWINGKEKGTNIEYFYRVGDTVGIGVHLFTRQLFFTKNGLRLDSSGLFVDPSFADGSLYPFVSLFGSGYKIEANFGPNFKFDLATL

SEQ ID NO: 138493 - protein, 100 aa, Heterodera glycines
  Coding regions on vcDNA: vcDNA=SeqID_64916; Strand=+; Position=1-455
VFSLLRAFLRWLVHPTIFSLPYPSLFILFYLSFIFSSVLFLVPFHIQVLLALYFEHISEERGRRNIAKIVICYLLAIQSKAKTFSQVDLICDFCDAYFVW

SEQ ID NO: 138494 - protein, 547 aa, Heterodera glycines
  Coding regions on vcDNA: vcDNA=SeqID_64917; Strand=-; Position=1 -172,366-1525,2054-2110,2396-2650
  Homolog annotation: Hit_ID=CAE61412.1; Match level="QueryCoverage =42%, HitCoverage=25%, E-value=5e-15, Identity=27%"; Hit description =Hypothetical protein CBG05276 [Caenorhabditis briggsae]
MTTKSEDDSFDKIAVEQMNESMKKFTGIKPDNVQTTHNVHRSQTEDRDFERNFGFPKELTLYRPNQKEYTFWGHQCLLLKHSVQFWTNLLNDPFDIKSQEMMPISAEECQEISKTKKCRFGILVGDSDGTMITENKLIYEHSWWSWGKKSVETVNCIVNNITIIGYPGSQRIDSIVGDLQHCQYDDGRCSLHDSIVVWDVDRYHTSEPWAARHGHCVFKSFSKKNGTIYRIGWISDPPDLALTFGEDPTFITSCLRRLVVSQQGFAIEEREFVKFNRQLDRTRRNVNFDEPLDGEVRTSQLDAQLTARSMFADKEMRKVLQAYFKLICDSIFGSVLGTDLSHLNPNFLIRQLSDNQQIEAEWISQNILEIWPCSPVYEYGFAQTKDKCYKKIPVKVTLVRKDKPILAYLDPKTLIISAEARKVDCQTDRYKHIVLEGRLYEIDQEVISGSDSEFDTKAVMPRKQKQQSADEIAVFAPSLSVPPICISPLHIHRFISAPPLLGHPSSHLPSHPPPLSLHRTSFAPSPPGPNAWTMPLKNDGRKTFHIV

SEQ ID NO: 138495 - protein, 294 aa, Heterodera glycines
  Coding regions on vcDNA: vcDNA=SeqID_64918; Strand=-; Position=1-885
  Homolog annotation: Hit_ID=NP_561076.1; Match level="QueryCoverage =48%, HitCoverage=72%, E-value=2e-10, Identity=35%"; Hit description =hypothetical protein CPE0160 [Clostridium perfringens str. 13] dbj|BAB79866.1| conserved hypothetical pro
ALASLAHLAFAPRITQRGGSALYKKRCQQPFSDDHSSGATKSKRFRPVEDQPSHSEWTQAIRPIRPVEDLQQHQSSSNPRLHRQQQFPVKAVYDFWKLESIPPIPPFINDRAPFCRRVRVEKRELLGFFNQQFYFSNFNEAYEFVIHERTYRCVEQYYCAQKALYLKRFNAADAIMLGTNKYGKRISAFEMKKFANMNGEDEVTVREWTELKIGIMEEALKAKFSVPDLKDVLLSTGSAIICELSPDQFWGVGCRPGLIYDKWPTADIQQWNGSNTLGRLLMQLRDDLKEATPK

SEQ ID NO: 138496 - protein, 48 aa, Heterodera glycines; identical to SEQ ID NO: 130859
  Coding regions on vcDNA: vcDNA=SeqID_64919; Strand=-; Position=1-144

SEQ ID NO: 138497 - protein, 127 aa, Heterodera glycines
  Coding regions on vcDNA: vcDNA=SeqID_64920; Strand=-; Position=1 -120,275-538
MVFFSHYMQACHSPTRIARKRKASTEQSADLDFVLDKRQTGSTTAKKETDFVDYVLGKKRKQRRRQQKFFTSSEEEEKEVWCWNNISGRCDLNFKFTILRRMSSIPKLVDKCDLLSHLYCFAYKFLA

SEQ ID NO: 138498 - protein, 101 aa, Heterodera glycines
  Coding regions on vcDNA: vcDNA=SeqID_64921; Strand=-; Position=1-305
MASELDHSPSPSIIGSNNNSAKRSSRSAESSAESTRNRRFLANLQATLGGTGKSQNSSPRRGNKPRNFGRNVLPKTVDSLEEALRLINLSEGRRLRFADGR

SEQ ID NO: 138499 - protein, 106 aa, Heterodera glycines
  Coding regions on vcDNA: vcDNA=SeqID_64922; Strand=+; Position=1 -136,213-397
MTSTETSADRLAVINSSFADGPQNEEQRYDGFQVEKQRFNTGPCATCRDRKRVDKLKLTNWTNRKVLILHPKNNNTNNNSKLFNKFKCSATNRQILVFVRKRSSKS

SEQ ID NO: 138500 - protein, 106 aa, Heterodera glycines
  Coding regions on vcDNA: vcDNA=SeqID_64923; Strand=-; Position=1 -73,157-404
MERGHKDPAFAHRRFKLPRSRPTHGEIKQVDIQKEQNEDPEMSILIQFLKSGEFPNEMLRQEKDRLSILAKDLCIESNILYFRQKDTKPRIYIPASLRALIFDSFP

SEQ ID NO: 138501 - protein, 143 aa, Heterodera glycines
  Coding regions on vcDNA: vcDNA=SeqID_64924; Strand=+; Position=1 -75,132-347,401-538
MITIIKHKQFSKSPFYKLFFIRAVADILSLVPNSLGILLPAFFGQQLLSIYSTVPNWAIVLLTFFTKTLVFQVSNIVTVFILLNRFTAIAFPLRHKMLWKKHFRHLMVFLLIVPMLITFPIMRMRTIIVFYDSNSFLLDDKDP

SEQ ID NO: 138502 - protein, 94 aa, Heterodera glycines
  Coding regions on vcDNA: vcDNA=SeqID_64925; Strand=+; Position=1-390
PKNSYLFFLIFLPQTWYQQLPSLVWPYQTILRYLKRKQKKFLTKKWLSLFSHFFTANLVPTVAFSCLALSNNLTIFETQTKKILDQKMAISFFS

SEQ ID NO: 138503 - protein, 45 aa, Heterodera glycines
  Coding regions on vcDNA: vcDNA=SeqID_64926; Strand=-; Position=1 -106,453-484
MTFYSKHVAISIKTFMNLKVYISRNDFFVGVRYLKNMRFAHKKFL

SEQ ID NO: 138504 - protein, 89 aa, Heterodera glycines
  Coding regions on vcDNA: vcDNA=SeqID_64927; Strand=+; Position=1-270
MAFRGPKMSEIEIQCHPRHEPGMAFRGPKMSEIGIPCHPWHEPVMAFRGPKMSEIGIPCHPWHEPFHGFTPPKQVCSPNFMSAVFYLFS

SEQ ID NO: 138505 - protein, 15 aa, Heterodera glycines
  Coding regions on vcDNA: vcDNA=SeqID_64928; Strand=+; Position=1 -36,565-576
MKKIIKKNNAGVKML

SEQ ID NO: 138506 - protein, 40 aa, Heterodera glycines
  Coding regions on vcDNA: vcDNA=SeqID_64929; Strand=-; Position=1-351
KIFNSFLNRPKSLGLTFFSETDQKRTKLSRDTERKRNNLF

SEQ ID NO: 138507 - protein, 27 aa, Heterodera glycines
  Coding regions on vcDNA: vcDNA=SeqID_64930; Strand=+; Position=1 -78,171-176
MIVFCCFMKKEKDIFFKFDETELARRV

SEQ ID NO: 138508 - protein, 51 aa, Heterodera glycines
  Coding regions on vcDNA: vcDNA=SeqID_64931; Strand=+; Position=1-192
ESMKYAPVTSCDVECSFSIYKSILADNRMSFTPEHLECIRFAIVFAKLIDC

SEQ ID NO: 138509 - protein, 136 aa, Heterodera glycines
  Coding regions on vcDNA: vcDNA=SeqID_64932; Strand=-; Position=1 -264,810-905,985-1035
MFIAPFTLILSGATGSGKTQWLMKLLRSYAELIDPPPAKVLYCYSEMNQSVIELMKRGIETHNGVPDQALIQSQPKPLLLVLDDLMLNTNRCQNSHAYCFGLITAMDCFGMQTHHCRWYPAGATPDNLHFPVCGAA

SEQ ID NO: 138510 - protein, 17 aa, Heterodera glycines
  Coding regions on vcDNA: vcDNA=SeqID_64933; Strand=+; Position=1 -21,95-127
MYNNPKRSLKTAKINAH

SEQ ID NO: 138511 - protein, 126 aa, Heterodera glycines
  Coding regions on vcDNA: vcDNA=SeqID_64934; Strand=-; Position=1 -116,171-435
MVNKHIQPEFASVVPAIGENGFSNLWWIYLEWQPDMVMNRVVGLVVLAGPFTTQTDIRGYDVRIIFDHHNLEHEMAMHGWQECVPRMSNICAGQIVEFTRLKVRAQGHNAKGSVSLHSALQSGVAL

SEQ ID NO: 138512 - protein, 28 aa, Heterodera glycines
  Coding regions on vcDNA: vcDNA=SeqID_64935; Strand=+; Position=1-84
MHCLCVASWDHVLVRVLTLLAQLGCGVL

SEQ ID NO: 138513 - protein, 21 aa, Heterodera glycines
  Coding regions on vcDNA: vcDNA=SeqID_64936; Strand=-; Position=1-65
KVKPKIFGLFKKELKILKILF

SEQ ID NO: 138514 - protein, 678 aa, Heterodera glycines
  Coding regions on vcDNA: vcDNA=SeqID_64937; Strand=+; Position=1 -70,114-481,525-674,722-923,966-1502,1550-1870,1914-1974,2016-2340
  Homolog annotation: Hit_ID=NP_001004509.1; Match level="QueryCoverage= 91%, HitCoverage=43%, E-value=6e-87, Identity=32%"; Hit description =si:busm1-180o5.3 [Danio rerio] emb|CAD60788.1| novel protein similar to DNA polymerases [Danio rerio]
MKEEEYEKFEGWYNENFETEFELGEQLKVYCENDVEILMEAIMKFRQLFLDITDGMDVLKDSVTIAGVVMRIFRTKFLKDRHIPIMPEGGYERADNQSKIAVKYFEWLAHREGIRVRHAENGGEIKFGDLKVDCVIGGQKRIIEFQGCAYHGCKNCFLPWAVGPNGLCMEENYRRTEMRMEVLREMCKNFSVEEVWECEVKAELKKNKEMKRFFESVPDKGPINPRDAYAGGRTMPFCLYAKATEAVEISMFDIISLYPFVNYDTPYPVGVPKIVVSRNFNVNWTVPDDVPYDGLLKVKVIPPKELLYPLLPVHIDEMLLFPNCGICARKAKNEFVTTKDVKKCNHRPEQRAFLGTFTSIELRKALELGYRIVGFYRAYHFEQFDNQLFKGYVRMFLKIKVEASGWPAEVKSEEEKRAFTDMYKAKYDICLDHDKIVFNPGLPMKIKGLNSLWGKFSMRNTLSTSEIFNSMERWVALSQDNTLDVSTPIQICEGVERVVYRKKEEFIKEHKVSNIVLSLWTTSAARIKLYEYMEQVYREEGCKPLYCDTDSLAFAHRKGRCPLKEGKFLGEMTREYSDSEILEYVSAGPKQYALKLRRKKDGEIWEKTKIRGFTLNRSNKMRYEEFKEMVLGYQEGVKKVFRYPEKIGPTRDSRILSRDVKKEYGPVQRKGIVDENFN

SEQ ID NO: 138515 - protein, 152 aa, Heterodera glycines
  Coding regions on vcDNA: vcDNA=SeqID_64938; Strand=+; Position=1-459
MSFQNTPKEVRRARNTRHFFKATPDKGKCLEKIESHVNERAKFGIREHVTSFYFKCPPNEDAENNFRIIIDKLIQEAKEKEPAQGWKTERILLNLYCAALSDPVMIPLRPLHQVTSDVVLNEFMHRQQSFGDVNLMDERISVIVTTFAYPLK

SEQ ID NO: 138516 - protein, 96 aa, Heterodera glycines
  Coding regions on vcDNA: vcDNA=SeqID_64939; Strand=-; Position=1 -146,370-514
MAKKAESSSSSGGANANIDKRDNDDSDEQHGLNEEQLLMMDNQNNKKHRFTDIRKQSWLRESIFALLIFENRILASRVKFLINRGGSQCLASGAKI

SEQ ID NO: 138517 - protein, 193 aa, Heterodera glycines
  Coding regions on vcDNA: vcDNA=SeqID_64940; Strand=+; Position=1 -47,94-366,424-685
  Homolog annotation: Hit_ID=AAL78214.1; Match level="QueryCoverage =73%, HitCoverage=75%, E-value=1e-10, Identity=30%"; Hit description =putative esophageal gland cell protein Hgg-20 [Heterodera glycines]
MSDDRKEAEKKMAKAIFISGDAWLAVYDLLPPSQVGLGIATISLRYDYYVDEHLKTRKWTLKFIRIRSKIGENGTEIEIVNSDGKALPIPQIEVPRKVIGFEYISISYIDHNVIAFVNRFRPIFDVCQINLAIRSAGARALENIKNNIWPMIKRNICGIHLCEDIFHRLRQFVPSIHNGCPYHFALSLSVLRI

SEQ ID NO: 138518 - protein, 69 aa, Heterodera glycines
  Coding regions on vcDNA: vcDNA=SeqID_64941; Strand=-; Position=1 -33,83-256
MLFKIENYIKRPANEAAFRAVVQDVENRANQAEEEIEERHKEDRETINAQQQELELLYLCSRLVRQFRK

SEQ ID NO: 138519 - protein, 285 aa, Heterodera glycines
  Coding regions on vcDNA: vcDNA=SeqID_64942; Strand=-; Position=1-858
  Homolog annotation: Hit_ID=NP_702063.1; Match level="QueryCoverage =77%, HitCoverage=4%, E-value=2e-10, Identity=22%"; Hit description =hypothetical protein PF14_0175 [Plasmodium falciparum 3D7] gb|AAN36787.1| hypothetical protein [Plasmodium
MDSNLRHSKHWDSLNPPTFNDIPISGTQLSDFPIAGTQPTSISLDSIHQHSNQRDSTHQHSNHWDSIHQHSIQRDSTHQHSIQRDSTHQHFNLWDSNLRHSKQWTQISGILNTGTQPTNFNGTQSTSISITGTQSTNIPIIGTQSTNIPFNGTQPTNISLGLNPPTFQSLGLNPPTFQSTGLNPPTFQSLGLNPPAFQSLALNSPTFQSLGLNPPTFHWDSIHQHSNHWDSTLQHSNHWDSIHQHSNQQDSTHQHSITGTQPSSISISGTQISGIPNNGLKSPAF

SEQ ID NO: 138520 - protein, 278 aa, Heterodera glycines
  misc_feature (49)..(49): Xaa can be any naturally occurring amino acid
  Coding regions on vcDNA: vcDNA=SeqID_64943; Strand=+; Position=1 -139,459-623,672-867,913-1001,1054-1190
  Homolog annotation: Hit_ID=CAE60078.1; Match level="QueryCoverage =98%, HitCoverage=87%, E-value=5e-52, Identity=42%"; Hit description =Hypothetical protein CBG03598 [Caenorhabditis briggsae]
TITEFKRNKLETEARKNWDRFYKRNSDFFKDRNWTKREIEQMCAKVTFXAPLTLLDAGCGCGNTLFPLAKFFPNWTFCGVDFSSNALSLLQQRAVQIGTNIHTELVDLSHTELVDLSGIPVNFSSLPKADLITLIFVLSSISLEHHSKVVQNLRKLLKPSGSVIFRDYGDSDHAMHRFNTAMHRFNTKSKIVDRFFARQDGTRAYFFCPDETKKLFESCGFETIKSEYTHCPDETKKLFESCGFETIKSEYTHRITENLKEQIRIERIFVEGRFKAPA

SEQ ID NO: 138521 - protein, 181 aa, Heterodera glycines
  Coding regions on vcDNA: vcDNA=SeqID_64944; Strand=-; Position=1 -85,243-304,347-521,1233-1456
  Homolog annotation: Hit_ID=CAE71615.1; Match level="QueryCoverage =58%, HitCoverage=74%, E-value=3e-48, Identity=74%"; Hit description =Hypothetical protein CBG18577 [Caenorhabditis briggsae]
MSRPKVFFDITIGGKAAGRIVMELYSDIGKPLHYKGSKFHRVIPNFMLQGGDFTRGNGTGGESIYGEKFVDENFKEKHTQPGILSMANAGPNTNGSQFFVTTVKTEVIRLTWTEEIGPCPVLASEETINNFGLCVESMHSTEFAIIKQLSKSQWQLIGVAVIAENDTARGFEKFSQILDNF

SEQ ID NO: 138522 - protein, 298 aa, Heterodera glycines
  misc_feature (204)..(204): Xaa can be any naturally occurring amino acid
  misc_feature (213)..(213): Xaa can be any naturally occurring amino acid
  Coding regions on vcDNA: vcDNA=SeqID_64945; Strand=-; Position=1 -261,332-489,548-971
  Homolog annotation: Hit_ID=CAE65250.1; Match level="QueryCoverage =87%, HitCoverage=56%, E-value=7e-42, Identity=41%"; Hit description =Hypothetical protein CBG10134 [Caenorhabditis briggsae]
CCFCCRAVPRASLPPPLRRVPPLRPSPSTVLSLTLLQLAVFFCFKSLFIIAIFTRSPRLLCVQLMFQYCTCVFLILNASFTLAADFGGYDERRIYAKRNPLLGYDERRIYAKRNPLLIRFVAFFSLAFIPVQIYLRLMTVPVYKFLRDLRKFRQAIYNAIYNGKWRYRKRVYFTYCSLMMEQQQKNLARNSARQSPIRGMISNXAIIEMIREXMEVIRASLKVDSSDEGQHTLLTVTDENGSSSAAERGGGGGAAIVAAPLPLPQRKRKKKQQQTVKKQKRSNKKREKKHTEEEEEKE

SEQ ID NO: 138523 - protein, 160 aa, Heterodera glycines
  misc_feature (149)..(149): Xaa can be any naturally occurring amino acid
  Coding regions on vcDNA: vcDNA=SeqID_64946; Strand=+; Position=1 -37,325-773
  Homolog annotation: Hit_ID=AAP92584.1; Match level="QueryCoverage =82%, HitCoverage=26%, E-value=2e-35, Identity=61%"; Hit description =Ab2-057 [Rattus norvegicus] gb|AAP85373.1| Aa1262 [Rattus norvegicus] gb|AAP85367.1| Aa1011 [Rattus norveg
ARMSSLIKNESHAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 138524 - protein, 74 aa, Heterodera glycines
  Coding regions on vcDNA: vcDNA=SeqID_64947; Strand=+; Position=1 -46,243-421
MKSHKIFGLMKISGIEDIFTRSKNGLTNMEVEVKQQEGFYLKAIVTDVLENSLDVVYDRGCRKPETVEFRFQTQ

SEQ ID NO: 138525 - protein, 32 aa, Heterodera glycines
  Coding regions on vcDNA: vcDNA=SeqID_64948; Strand=-; Position=1 -87,127-138
MDNKIDQNHNQNDIVGQNKETVKRNKSNNNFD

SEQ ID NO: 138526 - protein, 61 aa, Heterodera glycines
  Coding regions on vcDNA: vcDNA=SeqID_64949; Strand=+; Position=1 -95,374-464
MTFQSLKLNPPAFQSLGLNPPTFQSTGLNSFHRICRGKRFVELTMSDMTIAITVVTGETYT

SEQ ID NO: 138527 - protein, 38 aa, Heterodera glycines
  Coding regions on vcDNA: vcDNA=SeqID_64950; Strand=-; Position=1-184
IFKCLDFFFGLPKLHRTWFFLFSFKSPQIFFYSLTRPY

SEQ ID NO: 138528 - protein, 45 aa, Heterodera glycines
  Coding regions on vcDNA: vcDNA=SeqID_64951; Strand=-; Position=1 -17,214-263,514-584
MVHKTGHDDLGWLKTADDYYTGTKAAIVPVGVQFILNTVIEELER

SEQ ID NO: 138529 - protein, 72 aa, Heterodera glycines
  Coding regions on vcDNA: vcDNA=SeqID_64952; Strand=-; Position=1 -70,139-234,279-328
MSNSGVEARRKRKEWRRDLGRSVGLKQTNAAPTADGEGTSTQATESGPSTSASDLRPRSSPRPLSATPIRRH

SEQ ID NO: 138530 - protein, 488 aa, Heterodera glycines
  Coding regions on vcDNA: vcDNA=SeqID_64953; Strand=+; Position=1-1467
MQFLRQHKISPEENCKDNRNFLVSLQNGGCESEKEQKQICSLEFLLTLEKLPELNGNEGREQIRTFFKKFSLATEEWPEKRRISALECKVSGKAERAFSAAAVNRPAKFDAIRSEMESLLDEWDCTAIQAFNELWDGPKRRPGENLEEFAERVYQLVLCAYPGLPLDLYNDYAAKHFIRALENAKISIALEMARRPGLSYDSLVALAVRAEIAQKAAKLIAEDENAHIARSFKPNKAEKTTTDWEKFYVRPTNKSVCYNCRKIGHIARNCKVKFTWKKCGFEQNNSNMNFQKENQRIRTDNLPRAKIFPKVSAPKRAKDGRNERNLSQKPIESADASTIFAGLFASFLVVANAFSNVKAKTHSRRISSTASSSSKLPALWNPLNVAFEKLRKRENSKENGINSKVKTPKGNGQLRTIVFSKAGEELADSTGPTTKLLKADTERKLSAVDGTITNKAASSHAIRPVQNCSFRFFRTFYRSNYDVGLCHC

SEQ ID NO: 138531 - protein, 121 aa, Heterodera glycines
  Coding regions on vcDNA: vcDNA=SeqID_64954; Strand=-; Position=1 -138,237-393,516-583
VVTRPLDRIELFYNDITDPNKERSLYKQQFIEKCSEIGSSPLIVLVDMKTSLKTACRLPTQEQMEGYAEVLELFQKIEKRHFQNSDIIRMEEYQHMKRYSKQYRCQTSIGQTELGFAWRAR

SEQ ID NO: 138532 - protein, 162 aa, Heterodera glycines
  Coding regions on vcDNA: vcDNA=SeqID_64955; Strand=+; Position=1 -417,775-846
MSKSKSGERMKRNYDKKAGKAKNFENGQPIFARNYLGGPKWMQGRILEKIGAAMFRVKTARGVWCRHFDQLKADLTSTADNCDQESESESETDAESDDEQQPQPIPIGCPRQEIRQKIAPEGGVPDQALRRSTRDRKKRCQFSEYVHSNNYLELQTNNVKKK

SEQ ID NO: 138533 - protein, 141 aa, Heterodera glycines
  Coding regions on vcDNA: vcDNA=SeqID_64956; Strand=+; Position=1 -265,308-468
MSSMNDNVTVQGERNGPQTDIEAVNTDKVQPKPNTRSMIKKSRWDNNCAKPVQKDAEEAPAVKKRKVEDNELWKLMKGKYLLGFYLCAEDWNKLYFNKGKVLRAVDHQHFSVNFEMCEDCARKNIFATDLLAPPKIKKYNE

SEQ ID NO: 138534 - protein, 156 aa, Heterodera glycines
  Coding regions on vcDNA: vcDNA=SeqID_64957; Strand=-; Position=1 -84,416-802
MKKYFFSRKVILFLKIAIPTNQMGQQQKLVEKAKSNDKDVKLKAVTEIHRMLKDGFKNDAAVMLVINEFISAGVLGPLVECLSIDNPSHPQLVSNAMAALAIIASRKAEPILELLNVMDYLNYGRTYLRGDEVNKNVASILKNFMHNVRILAQIMR

SEQ ID NO: 138535 - protein, 62 aa, Heterodera glycines
  Coding regions on vcDNA: vcDNA=SeqID_64958; Strand=-; Position=1 -171,218-235
MFKPFKFMLFIALIIGDGAAAITGTVLIQIVIILWLQQKMIFALLFRRTLQQVVEHVRPGIR

SEQ ID NO: 138536 - protein, 151 aa, Heterodera glycines
  misc_feature (13)..(13): Xaa can be any naturally occurring amino acid
  Coding regions on vcDNA: vcDNA=SeqID_64959; Strand=+; Position=1 -83,281-375,589-862
  Homolog annotation: Hit_ID=CAE60310.1; Match level="QueryCoverage =100%, HitCoverage=7%, E-value=8e-55, Identity=70%"; Hit description =Hypothetical protein CBG03901 [Caenorhabditis briggsae]
AGPVLEAFGNALXLQNNNSSRFGKFIKVNYRENGIVCGANVEIYLLEKSRIISQAVGERNYHVFYYLLEGASEQERKDHFLLEPKDYYYLNQNSASDSCCPISNDQCNEKHEFERLKHAMGAVGFSENSQQKIYGMISAVLLLGNIEYIKK

SEQ ID NO: 138537 - protein, 357 aa, Heterodera glycines
  Coding regions on vcDNA: vcDNA=SeqID_64960; Strand=+; Position=1 -159,398-545,638-788,858-924,1202-1306,1869-2033,2152-2196,2663-2893
  Homolog annotation: Hit_ID=CAE60310.1; Match level="QueryCoverage =100%, HitCoverage=18%, E-value=1e-104, Identity=55%"; Hit description=Hypothetical protein CBG03901 [Caenorhabditis briggsae]
MLDKLNHFLRTNEYYEVPHKREAAFIIAHYAGKVKYQIAGFREKNKDLMRHDVMNTLKGSKSAFVRELVGEDPLAVFRWALVRATFRAAYAFRAAGKRNKRAGSVDRYGTSTVGNHGIIGTKINGDCANGSPKMLHRRSSDSRLNAFLRGELAPSIVPDFCDTSVFKTIVERARKAPKKPHNDRFSNLRTLQQLKGIMSKKKQLSNKPSSVSRQFGESLSRLMKTLDRASPYFIRCIKSNNDKIPNYFDDNIILRQLRYTGMLETSFANQYRTLLPNGHNSTKEDIQEFIRSIPVIDYNNLQYGNTKIFMRDTEKLLLDDHLHRVIMKNIVTLQRWFRAKLEQHRYQKFRQGIIKLQ

SEQ ID NO: 138538 - protein, 103 aa, Heterodera glycines
  Coding regions on vcDNA: vcDNA=SeqID_64961; Strand=+; Position=1 -72,172-411
MLRRAASTESDQIQREEDRNAMVKITNSFSKVAPRAKSGFMKAKKHLKTLLTKTGRQGTTEGTFSEESLNMEGPSSSTRRSQSVNNSMDSHGYKLEQILLNNY

SEQ ID NO: 138539 - protein, 366 aa, Heterodera glycines
  Coding regions on vcDNA: vcDNA=SeqID_64962; Strand=+; Position=1-1101
MVRVPDGVPDISTLPKGKNPYKNQLNALLCIVCLIYNEKLENETDYNLLKGKDHLQNISKNTSFPGDRMDSQKSPKVNGKNLMGTEIKDFLGKFDGIVAQLRTIVFQGTEEVMETDNIDFALTWDMQCGGLGPEHRNCVQLTTADLDPVLERAGFGLKVAEGRLKPQNAKFGLKVVGTPLKALLATFLLKTNAISSSAAGRKLAQSVIGAPVGFELITFIGSREDQIKSGRIPVEEDLEAILEKWTECCAVTRTKLAKCGFGAINVPIPRSIEDLPEGEGKPWTELLGKAGFVLEKVKATSVLRKHQFVTSPRIIIGDSSAKQFEDLWPTSQFIGATQGSVWRCNSGILTQWPCRQSQSGRDYNRA

SEQ ID NO: 138540 - protein, 164 aa, Heterodera glycines
  Coding regions on vcDNA: vcDNA=SeqID_64963; Strand=-; Position=1-492
  Homolog annotation: Hit_ID=CAE64067.1; Match level="QueryCoverage =96%, HitCoverage=81%, E-value=4e-17, Identity=28%"; Hit description =Hypothetical protein CBG08669 [Caenorhabditis briggsae]
MTPKVGPQMSVRKSRSANVGPQMSVRKCRSANVGPQMSVRKCRSANVGPQMSVRKCRSANVGPQMSVRKCRSANVGPQMSVRKCRSANVGPQMSVRKCRSANVGPQMSVRKSRSAKVGPQKSVRKCRSAKVGPQMSVRKSRSAKVGPQMSVRKSRSAKVGPQMS

SEQ ID NO: 138541 - protein, 90 aa, Heterodera glycines
  Coding regions on vcDNA: vcDNA=SeqID_64964; Strand=+; Position=1-272
MPTKIVPSHLVLLLELLPPPFCCAVRSRPCQSLARDGRCRSASSTGVVVPIARDCYSPCWACAAAANRWQNLNGVIVEDYAEWGGSEVVV

SEQ ID NO: 138542 - protein, 314 aa, Heterodera glycines
  Coding regions on vcDNA: vcDNA=SeqID_64965; Strand=-; Position=1-945
MKSRRAKAKGRKGTDRKVEKRNWWRNARNAHSKNIACCFEMVTSSVCSAPTALGKHRNPSGSGRSAPSLANAPAATNGPKRRGRKRIVQQQVEQEMNNKDDGQEGHQTEQKDRPKEEAQASDKPTKQGGANHHFELAMPLLPGWHSVRWHPFGLFRQRNFRVQRGGGRPFVHKCCGDNNGTASAAAPQPQCEQRPFDIHRGGGAEWGDTAGERRERCQKLRHAEANATDDEQPRYGSTVVIKKIHLVVCAVDECWRSVKRQDKCRGDKAPEGTATEETGGRSDGRGRSGREQQERHGRGGGGRADGRSTARKDI

SEQ ID NO: 138543 - protein, 139 aa, Heterodera glycines
  Coding regions on vcDNA: vcDNA=SeqID_64966; Strand=+; Position=1-420
MEDQDKQNQQERNDKNDSQEEPEQKHKNQDQGQQPQQHEQQQHQTSQDGNGHANGDLLSRTLSMPARVTGSDFVSADVNEVLEDARQIMTNSHQRKDDHHQNEQVLVSQFDDDNLNMGKLKKRNLLGRINAGQSDEDRR

SEQ ID NO: 138544 - protein, 39 aa, Heterodera glycines
  Coding regions on vcDNA: vcDNA=SeqID_64967; Strand=-; Position=1 -45,104-178
MAMSPVTAIETWIMKAMPIMENIRWRLQFVSKTSTFMTC

SEQ ID NO: 138545 - protein, 219 aa, Heterodera glycines
  Coding regions on vcDNA: vcDNA=SeqID_64968; Strand=-; Position=1-660
QFPVPNSASSLAATGIANTSSNNNGTEKEALSGTEEGASLCHSRGYGTETPFSTIVPSSPSVSISNFEWVEDIQIGDLPNQNESFARVPSPATPPPLAPSALSKDIPFDATFEHFRVPPPATPPLSSSSSVLTMSTTAAEDSSNCSTIFSTTTTPKADAIDNENSANCYLDRFGKEWRLLVEAAADVKQLDQIAGEHCLNRKGPTKNDGRIYFKWVTMS

SEQ ID NO: 138546 - protein, 18 aa, Heterodera glycines
  Coding regions on vcDNA: vcDNA=SeqID_64969; Strand=+; Position=1-55
MQSEANKQKDGDLVDKQK

SEQ ID NO: 138547 - protein, 113 aa, Heterodera glycines
  Coding regions on vcDNA: vcDNA=SeqID_64970; Strand=-; Position=1 -89,283-397,527-664
MRAQLAQSLLDGTVHSIVDSLKDLQTIQEQHLWAQREEKPSQLNCDGISDEKERQTNEDKAILERIDQIAHEQQSTLICAGLPLFKSSDDASDLRIQMALIQFILSLGSIYRD

SEQ ID NO: 138548 - protein, 293 aa, Heterodera glycines
  Coding regions on vcDNA: vcDNA=SeqID_64971; Strand=+; Position=1 -189,350-457,507-722,976-1059,1103-1245,1298-1439
  Homolog annotation: Hit_ID=CAE71520.1; Match level="QueryCoverage =96%, HitCoverage=63%, E-value=7e-71, Identity=46%"; Hit description =Hypothetical protein CBG18455 [Caenorhabditis briggsae]
MLLSILLKQIHATDVTNASRTLLMDLQNRKWSTEMCTFFDIPINVLPEIRSSAEIYGHLQKGRAGEAKNTYGTGTFMLCNTGQRAYISKNGLLTTISYQFGQASPVCYALEGSGSIGGNVVRFLRDNLKFFEVIKGTWLFISISNALISFRKPRTLRDWPRVFPTLRTFISAVAFQTVEMVEAVEADMSDLGATVLSLRADGGMTQNALFNQIQADLLGLLLECSKMTEITGWGAALAAAIGAGQINANTMIELQQRIRPQSTIFYQPKTDEEQRKKENGRWKEAIRKAFRWA

SEQ ID NO: 138549 - protein, 69 aa, Heterodera glycines
  Coding regions on vcDNA: vcDNA=SeqID_64972; Strand=+; Position=1 -98,146-255
MESGELFTFAFGAFAIALIALVIIYYKCIDRRFAKKTILLNGHKKEKIEEKADEQKKGKATSKERKKKQ

SEQ ID NO: 138550 - protein, 324 aa, Heterodera glycines
  misc_feature (7)..(7): Xaa can be any naturally occurring amino acid
  misc_feature (309)..(309): Xaa can be any naturally occurring amino acid
  misc_feature (314)..(314): Xaa can be any naturally occurring amino acid
  Coding regions on vcDNA: vcDNA=SeqID_64973; Strand=+; Position=1 -95,373-439,480-568,611-746,794-963,1021-1200
  Homolog annotation: Hit_ID=AAP88024.1; Match level="QueryCoverage =83%, HitCoverage=52%, E-value=1e-39, Identity=36%"; Hit description =beta-1,4-endoglucanase-4 [Heterodera glycines]
RSFMWQXIGLMGWQLASVQISKDLALSTLSQYGQLQIKGSKLMSSSGKEIVLRGMSLFWSQWDPKYWNAETVKQLKCNWRGMSLFWSQWDPKYWNAETVKQLKCNWGINIIKLRAPMGVEGSDGYLQSAAASGINIIKLRAPMGVEGSDGYLQSAAASAEKLMTIVDACINLGIYVIIDWHYTSGKAYTAQAVDFFKKMVIIDWHYTSGKAYTAQAVDFFKKMAQKYGKNPHVLYEIWNEPVGVDWNKVLKPYHQTVISAIRAIAIRAIDPDNVILLGTPTYSMDLNPVISSPMGGLKNIMYVTPVFIXTITQXISDKNYAEKI

SEQ ID NO: 138551 - protein, 97 aa, Heterodera glycines
  Coding regions on vcDNA: vcDNA=SeqID_64974; Strand=+; Position=1 -113,162-521
  Homolog annotation: Hit_ID=AAC48326.1; Match level="QueryCoverage =98%, HitCoverage=30%, E-value=8e-13, Identity=38%"; Hit description =beta-1,4-endoglucanase-2 precursor [Heterodera glycines]
MLKKAIKSGLPVFVTESGAGSGGSNAPVNLPVMNQWWSLLEQLKISQIIWAVRGEGNLQNPLNKNTAPANIGQNWALTEYGKVVKNVFTKNAKPIGC

SEQ ID NO: 138552 - protein, 363 aa, Heterodera glycines
  Coding regions on vcDNA: vcDNA=SeqID_64975; Strand=+; Position=1 -153,542-721,771-949,992-1387,1760-1940
MYNNCGQQNSNSATDEFIQTANQRQFQTHFCGAQNEGDRAIGQRPPIGGGNGVIRNGHGIIDALMLKNALVPLDNRQTNFYQQTMGGVGPMKRAFSEHENVDGRREGTDEKENQQPMAKRMHLSVTESAETKRHNDGKFGEHGEKEEEEEEKEEEEEEGEGEEGENSRTTKSSSSAENEEPLGCYSSSAGHPQQSHLSAHLMATPLQRTQHTSASIVYPEFGQLNTPNGHRLQGNPLAHSTPYLGALSLNSFPQQPLDYWGNCFGCSLPLNSLTSFSRRCRAASADELPFFVDGFQQKHRRGGDSGVGSVRAELKGGFLNTESTQWEESQKKGEMRRGAARREGRTKAEAAEVPWDSIGCALG

SEQ ID NO: 138553 - protein, 144 aa, Heterodera glycines
  Coding regions on vcDNA: vcDNA=SeqID_64976; Strand=+; Position=1 -68,134-348,395-546
MKRFITPANNYFLKLTPEKENEGVGEANDVGGKKKKPKIGNEDEKSTETRKEEHQQQQQEVQADESPAKERKVEDRELWKLCKGKFMLSTYLCQDDWNHLYHNKQKVTRLENGRYSVSYELCPECVWANCRATDLVAPMKKKGK

SEQ ID NO: 138554 - protein, 324 aa, Heterodera glycines
  Coding regions on vcDNA: vcDNA=SeqID_64977; Strand=+; Position=1 -141,187-508,559-1070
MESELIAQVKEYCDAFLSLKVHVNDLKNMAINLSSRTELIEKWATNSRYSPYPKGIGSTMAPAVMRESFQLLKQQSNQRQQLEQRILRDGNFEETVMRTAIASLKGTINAASAAQSSSPTPLDDAPTSSSSSMPKIAQKRKYMATDGLLSEEDREVAALALAAFNHLKVHIEQKQQTLELKLNKIEHESKAKSEWQMRQLMKSLEANFKLQIMSMEQRLDRKWSALIGKEKERAQRIATQAATVIGELIAEGGGKGKEKQCSGVMWSDKCKWCLDAGNVCFGSSNCGHAFVCPQCSITIAGSDQPKCLTCFCESTEFVYLGMEK

SEQ ID NO: 138555 - protein, 104 aa, Heterodera glycines
  Coding regions on vcDNA: vcDNA=SeqID_64978; Strand=-; Position=1 -114,157-327,390-416
VFRNGCEIEDMEEFWKQAQQIQTDNHELSERVSSLTREHNRILVDHNTLRTEHERILVDHNTLRTEHERILVDHNTLRTEHERILQRQLDDFHYWILCFAFFIP

SEQ ID NO: 138556 - protein, 51 aa, Heterodera glycines
  Coding regions on vcDNA: vcDNA=SeqID_64979; Strand=-; Position=1-8,78- 225
MANRKLENRDSRRVLISEFLIQKCSITSDHNSGFRPGNSEQNLYEEKLRLS

SEQ ID NO: 138557 - protein, 21 aa, Heterodera glycines
  Coding regions on vcDNA: vcDNA=SeqID_64980; Strand=-; Position=1 -17,62-110
MRKFIRLAVLTIDEIIFFNDQ

SEQ ID NO: 138558 - protein, 191 aa, Heterodera glycines
  Coding regions on vcDNA: vcDNA=SeqID_64981; Strand=+; Position=1 -292,436-610,655-827
SFVHFAVSMSPPKRAKVSADDDGETISDDGEPSTSAGAKRKQKASKPRQRKAHEAFILLVDVGRSSAENSAGAQSDHGTTTDLDRSVQIVDWVLSRKIFTESSDRFSLMFFGHENTSSDDHPNVYVHNEQFATARIEWLHVLQNEVQTNVKCPGDYVDALYAALDALKVHFDDAKEAGEPMSGATVTLVSI

SEQ ID NO: 138559 - protein, 136 aa, Heterodera glycines
  Coding regions on vcDNA: vcDNA=SeqID_64982; Strand=+; Position=1 -234,339-516
NPETGELRSCGTAAALHGDLDSVQHGICPSSFVCKRDVQRRKPATKGEEAPRVCCSPIAFCPDARLPQVDPRTRHAKRCLSADVKASPTAGAVKRHHHYYGDSDNDYGNCTPPYTCQPSTVSGIFVCCKVPPMTGI

SEQ ID NO: 138560 - protein, 331 aa, Heterodera glycines
  Coding regions on vcDNA: vcDNA=SeqID_64983; Strand=-; Position=1-994
  Homolog annotation: Hit_ID=NP_507780.1; Match level="QueryCoverage =100%, HitCoverage=23%, E-value=3e-30, Identity=25%"; Hit description= predicted CDS, DNA polymerase type B, organellar and viral family member (5T899) [Caenorhabditis elegans
MFNKSSNYDKVLQHLPPREDYCPNQMMKTDLQKFITWYNNNCHQKFDLKEKLPEYCCNDVLILTHALVELRREFKQLTQREGKHGGIDILVASHRRSPKLAYLTLHSTSTSRRHTPGTANTFSKEKGGQVYQVDGYIKGTNGKRDKIIEVNGCVWHGCEECFGNMDEETLMPNGKKLCEIRQREKKKHEMLRRYVDLEVVWEHEINERLKKDKMMKQFFNNWKENSPIKIRDAFHGGRTDVKKLIHTIKPGQKISYKDFTSLYPWTNFSTSYPLGHPKIINLPQNEQIVNWRKPSDNTYKGILKVLLLPPNNNLSVTVMPVKFNQRLLFPL

SEQ ID NO: 138561 - protein, 363 aa, Heterodera glycines
  Coding regions on vcDNA: vcDNA=SeqID_64984; Strand=-; Position=1-1089
  Homolog annotation: Hit_ID=AAA59875.1; Match level="QueryCoverage =65%, HitCoverage=67%, E-value=1e-18, Identity=30%"; Hit description =mucin
MSNSFFVFLPSNVTDYPENQPNKFRVRLPKPLHFNGTWVCGLHSISYPFSWSTIGTLDEQWIDIHFTDRNAPDEDKQRVIRVPVPKAAHNRAEQLKDFLTVTLRNHSDAKLLPLPREVEQDRNRTKPLESPPPLKRVKRDTGTITPSQPPSPQPPPILDEHGKPLGSPPKYKEGEENVIDSPPLYQETQKDGVTTSVGSKEPSPTPPTQSSAKPVTATTPVPPTSKPPPSSIQSAASVKPPITPNPATKPSTPAAAAATVSPTSSTPVNTTAPVVAAKSSTLTKHPVQTPTTPKTVASTASAEQTTSAPPPSAQPKATNTVKKSATTPTTSTTPETVHKQTVSPTKTEQDDAKQSSGPVAAAL

SEQ ID NO: 138562 - protein, 125 aa, Heterodera glycines
  Coding regions on vcDNA: vcDNA=SeqID_64985; Strand=+; Position=1 -153,234-302,697-851
  Homolog annotation: Hit_ID=NP_500734.1; Match level="QueryCoverage =100%, HitCoverage=38%, E-value=3e-39, Identity=38%"; Hit description= LAMinin related (lam-1) [Caenorhabditis elegans] pir||T15099 hypothetical protein W03F8.5 - Caenorhabdit
CVDGYYGDPRLGINLPCKPCPCPGGPGSGFQHADSCYLTPSPSPTVTCNCRSGYAGERCDQCAVNYWGNPREIGFVFNNLGANSSAGSCDRVSGQCPCYANVVGPQCDQCAPLHYDLASGKGGMR

SEQ ID NO: 138563 - protein, 224 aa, Heterodera glycines
  misc_feature (4)..(4): Xaa can be any naturally occurring amino acid
  misc_feature (22)..(22): Xaa can be any naturally occurring amino acid
  misc_feature (80)..(80): Xaa can be any naturally occurring amino acid
  misc_feature (96)..(96): Xaa can be any naturally occurring amino acid
  misc_feature (162)..(162): Xaa can be any naturally occurring amino acid
  misc_feature (183)..(183): Xaa can be any naturally occurring amino acid
  misc_feature (218)..(218): Xaa can be any naturally occurring amino acid
  Coding regions on vcDNA: vcDNA=SeqID_64986; Strand=-; Position=1-689
  Homolog annotation: Hit_ID=BAB33421.1; Match level="QueryCoverage =98%, HitCoverage=79%, E-value=1e-82, Identity=72%"; Hit description =putative senescence-associated protein [Pisum sativum]
PHQXGKTNLSHDGLNPAHVPYXWVNNPTIGEFYFAMIGRADIEESKSNVAMDAWLPQASYPCGNFSDTSSLKFKELKDRXATLSRFVFILKIKIKXAFTLLFYMRFLFSLSSLGHLCYHLTDVPPQPNSPPDDVFHVAHPHKSTGFHLELGTREDGQARYKXNDIRSSGISLLAASHLSYTSXVISQRQTRVKLNRVFFPADFSKPVPLAVGSLDSRXGQWESH

SEQ ID NO: 138564 - protein, 44 aa, Heterodera glycines
  Coding regions on vcDNA: vcDNA=SeqID_64987; Strand=-; Position=1-134
MQVPPLLYAYQLVSNDGKLLKKETKQTHQLLAPVDNPKGPLGQW

SEQ ID NO: 138565 - protein, 50 aa, Heterodera glycines
  Coding regions on vcDNA: vcDNA=SeqID_64988; Strand=-; Position=1 -93,518-577
MRGGKAAEIMLTGASVGHESDEIEWKKLAKKANVGPFLLSEQKMVVPKEF

SEQ ID NO: 138566 - protein, 75 aa, Heterodera glycines
  Coding regions on vcDNA: vcDNA=SeqID_64989; Strand=-; Position=1-228
MLFVSLLATFCFQPSRCAFFDKHRKRNAMDNADGECAEDGCVSDVEAGSGAEDGDELLDDDDVQQQQHLRSDESE

SEQ ID NO: 138567 - protein, 98 aa, Heterodera glycines
  Coding regions on vcDNA: vcDNA=SeqID_64990; Strand=+; Position=1 -232,402-466
MRYARHHVDNAEEVADKLLHGPKQLAEVDDTEEQQKTENGENPNFFEIKLKFHIISIEKNVRRADIRATAKRRRAQLRFVSHTSQEIAEDAQIELLII

SEQ ID NO: 138568 - protein, 21 aa, Heterodera glycines
  Coding regions on vcDNA: vcDNA=SeqID_64991; Strand=-; Position=1-66
MAQMDICTLAWSTVNSVLPTI

SEQ ID NO: 138569 - protein, 152 aa, Heterodera glycines
  Coding regions on vcDNA: vcDNA=SeqID_64992; Strand=+; Position=1 -152,244-422,566-697
  Homolog annotation: Hit_ID=NP_497039.1; Match level="QueryCoverage =94%, HitCoverage=24%, E-value=4e-44, Identity=59%"; Hit description =putative protein (67.0 kD) (2O915) [Caenorhabditis elegans] emb|CAB07587.1| Hypothetical protein C38C6.6
RRYSQFYCSILCTFPLELKMLPPNHAAINEQRKHIDVDTSWTGKEQKTQQQIGLDASDKERAVVDLLTERKQLAASAHGNVAAAETSDGKRAQVQRFGDKGGIAQVEGHSAQLKTKENAEGRHALLKADGKYELDTMAKGSLETKDTEFESA

SEQ ID NO: 138570 - protein, 62 aa, Heterodera glycines
  Coding regions on vcDNA: vcDNA=SeqID_64993; Strand=+; Position=1-284
ANFVTSSTQISKNFFRRRLSAPPDLPFPLFLQVFCLKTAKIWSFLVKKCSCYSAVEKKLLVK

SEQ ID NO: 138571 - protein, 111 aa, Heterodera glycines
  Coding regions on vcDNA: vcDNA=SeqID_64994; Strand=-; Position=1-336
MRGRLCPHGITSCCVDISVRGVQQISAYCCYKCAAAASSSAAIEANTTTTTATSDGGGTLAKVATVADDSDGQLTVPVVAANNDDEIKMEQQHHSPPAQHRSPTATATVYN

SEQ ID NO: 138572 - protein, 195 aa, Heterodera glycines
  Coding regions on vcDNA: vcDNA=SeqID_64995; Strand=+; Position=1 -162,204-345,388-579,631-722
  Homolog annotation: Hit_ID=NP_502301.1; Match level="QueryCoverage =83%, HitCoverage=70%, E-value=1e-17, Identity=33%"; Hit description =RNA and export factor binding protein, ALY family (aly-3) [Caenorhabditis elegans] emb|CAA92829.1| Hypoth
MGGASLGPLKAVKGGAGSSIGARIARNAIERNSGGMVKLQVSNLPGSVVTLDLEELFQDFNVFGVAVHYDEMGNHLGTADLFTDQQSATNILNEFKNIAIDGQEIKFCLVTEGADSVGGKRGNIRDRLQRISGGPNPIRKKPMVRKRISGGPIRKVSRTVGGRLKVAGAGTSKAAPKAKTADELDKELEAYMKKL

SEQ ID NO: 138573 - protein, 76 aa, Heterodera glycines
  Coding regions on vcDNA: vcDNA=SeqID_64996; Strand=+; Position=1 -129,505-606
MTFAVEEGESLLLGEDLSQLARNDAETIHGSICARYERKKRFYKWGTNGKEHSVKILEESLENLEGEGKRTFAIGP

SEQ ID NO: 138574 - protein, 265 aa, Heterodera glycines
  Coding regions on vcDNA: vcDNA=SeqID_64997; Strand=+; Position=1 -153,197-838
  Homolog annotation: Hit_ID=CAE70637.1; Match level="QueryCoverage =52%, HitCoverage=5%, E-value=2e-13, Identity=31%"; Hit description =Hypothetical protein CBG17336 [Caenorhabditis briggsae]
MTDGKLNPKALQRQLRILSVSDHCLAVRHGFQHKIPIKKFADLFHVLLPEEVVHGQNSHQIAKDILDAQGIRYAGLFEFIPGHLFLMESLFAKLCQLKQSTLTLAALIIQKNFRKFLARQHFLLKRTATIQIQAAFRGWKCRKMCGRKAWTEKKMKSLMEERLRVGAKKEEQREISEDEESDEGGKDMMRTMMKMEDMEEERRREISAMLNRTDYAGRKAKAEHTKWALFRECSDYVRSTWPPAKAKGPSFGPTITFEQFAEQIK

SEQ ID NO: 138575 - protein, 167 aa, Heterodera glycines
  Coding regions on vcDNA: vcDNA=SeqID_64998; Strand=-; Position=1 -62,118-230,489-573,678-878
  Homolog annotation: Hit_ID=AAR11446.1; Match level="QueryCoverage =97%, HitCoverage=25%, E-value=1e-73, Identity=83%"; Hit description =matrix metalloproteinase [Heterodera glycines] gb|AAR11445.1| matrix metalloproteinase [Heterodera glycine
TYLREFGHLKHNENGLSHGVKHFQRFLGYRQTGNVHFQRFLGYRQTGNVDLATLQKMSWKRCANSDEGYTAQDPSQLWERSTLFWNLNASHPKQFTHGETKGLIAQAFRAWEIVIKIDFLETNNADNAQIIFTFESDGAKKEKSKIGERRKERKGKKAKSLSDLINT

SEQ ID NO: 138576 - protein, 71 aa, Heterodera glycines
  Coding regions on vcDNA: vcDNA=SeqID_64999; Strand=+; Position=1 -87,190-318
MEPFIVRISYAGKLRPYELAEYETIAMLKITNWRTRESCPPWCNSHSCGAAWWRTRLMCQDSSESPCFFCG

SEQ ID NO: 138577 - protein, 101 aa, Heterodera glycines
  Coding regions on vcDNA: vcDNA=SeqID_65000; Strand=-; Position=1 -131,275-392,447-681
  Homolog annotation: Hit_ID=CAE66322.1; Match level="QueryCoverage =87%, HitCoverage=20%, E-value=7e-12, Identity=43%"; Hit description =Hypothetical protein CBG11573 [Caenorhabditis briggsae]
QFASLRRRFTLRFRKHRSMIGPLIENALSDSDLRSSDIDAVSVSNCPGLVYCLKVGLIASLPLLPFRCFRRPLIPVHHLRAHSLVARLLHPHLSFPFLTLI

SEQ ID NO: 138578 - protein, 100 aa, Heterodera glycines
  Coding regions on vcDNA: vcDNA=SeqID_65001; Strand=+; Position=1 -45,273-377,808-960
MRWNYNYAKRKHQEEVNDFADGVNRVAMDSSTAGKTYEFVGPHCYEMCELAAPADGIRGPHDRRKAKYIRQDNNLQALVANFDQRDPLEYLRACAYHLHF

SEQ ID NO: 138579 - protein, 81 aa, Heterodera glycines
  Coding regions on vcDNA: vcDNA=SeqID_65002; Strand=-; Position=1-386
DICGPDICGPDICGLLEIGHLRPDKCGRTFAVRTFAARFFRAIFGHLRPDICGPRENRTFAANETPNCHSFFKLIIPNIFI

SEQ ID NO: 138580 - protein, 35 aa, Heterodera glycines
  Coding regions on vcDNA: vcDNA=SeqID_65003; Strand=-; Position=1-105
CVPICQLKLGQLLLLHHQICVGITTMPNENTKKRW

SEQ ID NO: 138581 - protein, 15 aa, Heterodera glycines
  Coding regions on vcDNA: vcDNA=SeqID_65004; Strand=-; Position=1-56
MIEEDNMWANRIADF

SEQ ID NO: 138582 - protein, 110 aa, Heterodera glycines
  Coding regions on vcDNA: vcDNA=SeqID_65005; Strand=+; Position=1 -129,400-603
  Homolog annotation: Hit_ID=NP_501755.2; Match level="QueryCoverage =87%, HitCoverage=8%, E-value=7e-12, Identity=40%"; Hit description =probable cation-transporting atpase w08d2.5 family member (4K582) [Caenorhabditis elegans] emb|CAA94236.2|
MSVARECGIIRPNKRSFLLEATKAHDGQTHLTLKQSVSSSEEVLEFDENVSFYDAEQGTGGGVSGSGVGKLFNNNNGDGRIAESTYHVAVSGPTLSAFGGGGGGGNVQKQ

SEQ ID NO: 138583 - protein, 166 aa, Heterodera glycines
  Coding regions on vcDNA: vcDNA=SeqID_65006; Strand=-; Position=1 -220,441-721
MPQNMPEANIDRELAPLQRTGETAHPQRNQKNFEPGDLIWYKEHTGKWVAGILLQPMGERMWEIQIEGSTVTRKLNSITKMSSGKNSPSNELERLEKEALLSKKSKSRDEKVAKEVRELVEQLQSKTEKEMRETADQLKGSIKLEMAAAVDGLWKKIEPWLSGQVG

SEQ ID NO: 138584 - protein, 19 aa, Heterodera glycines
  Coding regions on vcDNA: vcDNA=SeqID_65007; Strand=-; Position=1-59
TFAFSSLALPNTHTIFEML

SEQ ID NO: 138585 - protein, 19 aa, Heterodera glycines
  Coding regions on vcDNA: vcDNA=SeqID_65008; Strand=-; Position=1-59
TFAFSSLALPNTHTIFEML

SEQ ID NO: 138586 - protein, 19 aa, Heterodera glycines
  Coding regions on vcDNA: vcDNA=SeqID_65009; Strand=-; Position=1-59
TFSFSSLALPNTHTIFEML

SEQ ID NO: 138587 - protein, 19 aa, Heterodera glycines
  Coding regions on vcDNA: vcDNA=SeqID_65010; Strand=-; Position=1-59
TFSFSSLALPNTHTIFEML

SEQ ID NO: 138588 - protein, 19 aa, Heterodera glycines
  Coding regions on vcDNA: vcDNA=SeqID_65011; Strand=-; Position=1-59
TFSFSSLALPNTHTIFEML

SEQ ID NO: 138589 - protein, 19 aa, Heterodera glycines
  Coding regions on vcDNA: vcDNA=SeqID_65012; Strand=-; Position=1-59
TFAFSSLALPNTHTIFEML

SEQ ID NO: 138590 - protein, 19 aa, Heterodera glycines
  misc_feature (16)..(16): Xaa can be any naturally occurring amino acid
  Coding regions on vcDNA: vcDNA=SeqID_65013; Strand=-; Position=1-59
TFAFSSLALPNTHTIXEML

SEQ ID NO: 138591 - protein, 38 aa, Heterodera glycines; identical to SEQ ID NO: 129423
  Coding regions on vcDNA: vcDNA=SeqID_65014; Strand=+; Position=1-363

SEQ ID NO: 138592 - protein, 38 aa, Heterodera glycines; identical to SEQ ID NO: 130624
  Coding regions on vcDNA: vcDNA=SeqID_65015; Strand=+; Position=1-377

SEQ ID NO: 138593 - protein, 129 aa, Heterodera glycines
  Coding regions on vcDNA: vcDNA=SeqID_65016; Strand=-; Position=1-391
  Homolog annotation: Hit_ID=XP_522969.1; Match level="QueryCoverage =99%, HitCoverage=85%, E-value=4e-15, Identity=32%"; Hit description =PREDICTED: similar to putative protein family member (XC187) [Pan troglodytes]
GTTAIRRGKTVIRRGTTLVRSGKTVIRRGKTVIRRGSTLVRSGTTAIRRGTTEIRRGTTEIRRGTTEIRRGTTAIRSGKTVIRRGSTLVRSGTTEIRRGTTEIRRGTTAIRSGKTMIRRGTTLVRSVQQ

SEQ ID NO: 138594 - protein, 396 aa, Heterodera glycines
  Coding regions on vcDNA: vcDNA=SeqID_65017; Strand=-; Position=1 -576,1608-1809,1852-2261
  Homolog annotation: Hit_ID=NP_001004509.1; Match level="QueryCoverage= 51%, HitCoverage=13%, E-value=2e-28, Identity=35%"; Hit description =si:busm1-180o5.3 [Danio rerio] emb|CAD60788.1| novel protein similar to DNA polymerases [Danio rerio]
MGWDQSGFWFFGVRYFCVSCEVTYDRPERHRMEYKERCKKCCRMGFGFPCTDVCDEIHCGECNLKFYNPECFEAHKKAACIEYKKCEKCRETHNTRNKHTCGEKFCKLCKVCHPGRQCFIKKIQVRPQKAYRIVAYDLETTVDGGEHRPNLVSVARTCNICAGEERECEICEGPSKITWSVADGFEPMSEFIECDVREELKKNKEMKKFFESVPDKGPINPRDAYAGGRTMPFCLYAKATEEIEISMFDIISLYPFVNYDTPYPVGVPKIVVSRNFNVNWTTPDDIPYDGLLKVKVIPPKNLLYPLLPLHIDDMLLFPNCWACAKRAKNEFVMTKDVKKCNHRPAQRAFLGTFTSIELRKALELGYRIVGFYRAYHFEQFDSQLFKGYVRMFLKIK

SEQ ID NO: 138595 - protein, 17 aa, Heterodera glycines
  Coding regions on vcDNA: vcDNA=SeqID_65018; Strand=+; Position=1-51
MGHQHAECIDKLGVVAR

SEQ ID NO: 138596 - protein, 23 aa, Heterodera glycines
  Coding regions on vcDNA: vcDNA=SeqID_65019; Strand=+; Position=1 -40,168-199
MAKTSALLLILLLYERNCLRRSF

SEQ ID NO: 138597 - protein, 164 aa, Heterodera glycines
  Coding regions on vcDNA: vcDNA=SeqID_65020; Strand=-; Position=1 -163,207-346,387-577
NTLNIEPEKRMTARGIVDYLNKKCIPGTSKQIDNVPSLPFFHKVTVGILRRTFEKRKDQKMLGLLGIVEEKQRKAMDELRMRGITCETKNILLGEEANEFSENDEFAKSAENESGQNEEENESKSKFKRMFSLKSKEKPKNDFWAIAKTKYSKLSKNSREEGDK

SEQ ID NO: 138598 - protein, 1157 aa, Heterodera glycines
  Coding regions on vcDNA: vcDNA=SeqID_65021; Strand=-; Position=1 -45,159-205,260-335,386-531,585-630,725-854,1074-1207,1259-1316,1470 -1509,1550-1625,1693-1848,1899-2046,2103-2188,2236-2298,2369 -2431,2478-2548,2612-2714,...
  Coding regions on vcDNA: Position=...2761-3075,3121-3273,3334 -3593,3792-3916,3988-4064,4176-4204,4264-4431,4477-4682
  Homolog annotation: Hit_ID=CAE69237.1; Match level="QueryCoverage =98%, HitCoverage=91%, E-value=0.0, Identity=45%"; Hit description =Hypothetical protein CBG15280 [Caenorhabditis briggsae]
DEVDEWHLKRPTFTGGGRVGDLCTQNTDCQSGMFCSVGQCICLSNYVPISSGMFCSVGQCICLSNYVPISSFCWPKVNPGDSGCVGDVQCESVVNPGDSGCVGDVQCESVWPGARCAKGGLCQCPDYYVPAKTRDGTMCVASSVPPACPLPESSVPPACPLPEPNNAAPSPVPSPVTLLANPSTHPLAPGSYMPVLCTSSSAETDDSNGGDGSTWCIYPDGERDVPIVDLYNCVPHPQVRPEYFPEYAPTVDGICCHSRAFVCIQPFVCIQPMEQGEEPSVPRWWYNSVTGTCTQFLWDPAQSDGVSPDPAQSDGVSPNNFRTMEHCESFCRDTCCRRGPAQFRRSLRASLSDDFPVANCVRQSGSCAPENTCVQIGSLQQCCPTVAHLCSAAGGRTLHLCSAAGGRTLSGGADALFDPGIQIAGSAPTSRFYYDAEQGRCSNFICSNFIYEGGLGNFNNFVTKQDCEHFCSKLVCELGQPLRVAEEWQRCELCSKLVCELGQPLRVAEEWQRCELAADCPNTHSCDSAHRVCADCPNTHSCDSAHRVCCPTAQTICTQPKRVGECTGSVSRYWTICTQPKRVGECTGSVSRYWYNAGTRQCELFDFTGCQGNGTRQCELFDFTGCQGNDNNFEQLIECQMKCRNIASEPRCPEPRCPQGRAHRDLSGLFTRCSLAEGCPLNHECHFDGQIFGCCPLRAWTCSLGSDRGTQCGAGRSFRFFFNAEKQSCESFQYEGCDGNANNFQSLDICQEYCGIGGCPNGGQPLRDQTSNQFLSCADSIGGCPNGGQPLRDQTSNQFLSCADSQPCPSRDSRECVPINANGVIAHRCCPTKAFICSLPPQVGTFICSLPPQVGTVCRKASLTRWYFNIVTRECGEFGFGGCNGNMNNFESREQCTKFCSSAGVFLQSNLPFRFNFAHFSSLCLNAALSSCPRDFLCVRDELGHRHVCCGSPSSAVCAEGEKPFWEAADETVRECQANVAGSCPSVRECQANVAGSCPSNFLCRFSAAHNKYFCCAPRNGTVVCPFGHSLYRTPKSLRPLRCFVGTSEITPLGQCPDGFSCQSRVSSDSQGHCCSVEPICRGGSPFLVICRGGSPFLVEELTQMPKNCVPGAFAECPREFQCEKSHANAIQSIGICCRRSRRKENDEKTTAGKRKI

SEQ ID NO: 138599 - protein, 514 aa, Heterodera glycines
  Coding regions on vcDNA: vcDNA=SeqID_65022; Strand=-; Position=1 -73,283-565,705-827,868-902,963-1065,1130-1223,1349-1504,1801 -1932,2008-2182,2233-2276,2365-2568
  Homolog annotation: Hit_ID=NP_499033.1; Match level="QueryCoverage =100%, HitCoverage=65%, E-value=0.0, Identity=66%"; Hit description =abnormal ThermoTaXis TAX-4, cyclic nucleotide-gated channel (83.9 kD) (tax-4) [Caenorhabditis elegans] emb
LWLTLDLCMDSVYLVDMFVRSRTGYLEQGLLVRDARKIRSLYLRSRHFVVDSASLFPLDFLVFFVWRPLPILRLNRLLRKERIQRFMEQTETRTARPNAFRVGVVVWYIAVIIHWNACFYFMISENIGLGSDPWVYGKNNKQSMPDGINDTLTRRYIYSFYWSTLILTTIGFYWSTLILTTIGEVPGPEVPGPQQNIEFAFVTIDLMCGVLIFATIVGNVGSMIANISADRMIANISADRTEFQNRIDNIKQYMDLRGVGKQLEVRVIKWFDYLWANKQGLTDAQVLKVLPDKLQAEIAMHVHFETLRKVRIFQDCEAGLLAELVLKLQWQVFSPGDYVCRKGDIGREMYIVKRGMLQVVADDGAKVFATLSEGAVFGELSILNIAGSKNGNRRTANVRSVGYTDLFVLNKNDLWTALREYPEARKIMIGKTALREYPEARKIMIGKGRELLRKDNLLDENAPEERKTAEERIEELRASVRVLQTRIARLVAEHTNTETKVGGGISMEKLLNKY

SEQ ID NO: 138600 - protein, 235 aa, Heterodera glycines
  misc_feature (10)..(10): Xaa can be any naturally occurring amino acid
  misc_feature (35)..(35): Xaa can be any naturally occurring amino acid
  misc_feature (234)..(234): Xaa can be any naturally occurring amino acid
  Coding regions on vcDNA: vcDNA=SeqID_65023; Strand=-; Position=1 -270,324-573,636-751
  Homolog annotation: Hit_ID=CAE69933.1; Match level="QueryCoverage =90%, HitCoverage=46%, E-value=4e-60, Identity=60%"; Hit description =Hypothetical protein CBG16309 [Caenorhabditis briggsae]
PVRKFDAKIXMFSLQAIAVPEIAKKLKCTLIPGKXTKFTNFHLYSRTILGDGVGPELVYAVQDIVKATGIPIEFEEVFLSEVYYSRSASIEDVVDSEDVVDSIARNNCVALKGAIQSSLDDKTDGLNTQLRKRLDLFANVVHIKALEGIRTRHNKMLDFVIIREQTEGEYSRMEHELVPGVIECLKIMTRVKCERVAVIECLKIMTRVKCERVAKFAFDYATKHGRKKVTAVQXV

SEQ ID NO: 138601 - protein, 21 aa, Heterodera glycines
  Coding regions on vcDNA: vcDNA=SeqID_65024; Strand=+; Position=1-63
MAFRGPKNFWKSEFRAIPGLM

SEQ ID NO: 138602 - protein, 60 aa, Heterodera glycines
  Coding regions on vcDNA: vcDNA=SeqID_65025; Strand=-; Position=1-181
FCSNDSQNVSSHSTNQIEIEAKKTEHGSAGLSILEILLLWLSRFSVLEIVLWALVPVVIW

SEQ ID NO: 138603 - protein, 122 aa, Heterodera glycines
  Coding regions on vcDNA: vcDNA=SeqID_65026; Strand=+; Position=1 -104,146-242,283-450
MTVTSNTEFRLIECVPILEEVAREFGCITPLPNLGSHRDYRVSGCMMIRTLTSLNRLYIFDAEDCIEVKGFLRQEDGTSQKVVNEYYEKYDGLNGFAEFIRNWAFTFFCFHAFDDDDTPDED

SEQ ID NO: 138604 - protein, 101 aa, Heterodera glycines
  Coding regions on vcDNA: vcDNA=SeqID_65027; Strand=+; Position=1-305
MIGRAVRNRPFIFEGIFKFILYPRKMSISFFEKFYTSQKRLRMRRRAVRNRHFISQRIFIFKGYPRKMAISFFDKFYTHTNDLEHDREGGAQYTVYTLREF

SEQ ID NO: 138605 - protein, 24 aa, Heterodera glycines
  Coding regions on vcDNA: vcDNA=SeqID_65028; Strand=+; Position=1-76
ITGVSIIAVLFLVFLMPSQNLGRF

SEQ ID NO: 138606 - protein, 23 aa, Heterodera glycines
  Coding regions on vcDNA: vcDNA=SeqID_65029; Strand=+; Position=1-86
FDRKSIREPYLTLIKIGAFQSTF

SEQ ID NO: 138607 - protein, 147 aa, Heterodera glycines
  Coding regions on vcDNA: vcDNA=SeqID_65030; Strand=-; Position=1 -94,549-652,1384-1629
MKFANLFLLKVFILAFFDNYHFAIGERLYKEPPTTLSRYLRGQIWDNNDAVDYYDVEVIGDDVQFPETVHAFVLEAPNGEKAIDFTKYYAFDLTEQQIFVFPTFSALQEELERRKNMPTPEQILATLRQALADLDSRLSEKLKTETV

SEQ ID NO: 138608 - protein, 21 aa, Heterodera glycines
  Coding regions on vcDNA: vcDNA=SeqID_65031; Strand=+; Position=1 -60,186-191
MFKISSFIFVLCLVRLCVSMN

SEQ ID NO: 138609 - protein, 270 aa, Heterodera glycines
  Coding regions on vcDNA: vcDNA=SeqID_65032; Strand=+; Position=1-3,45- 242,601-699,902-1060,1496-1684,2507-2671
MDLKYPKNRRNSHIVKSSISRGSFWDGIKIRFNYGNQLKIMLENSIEYKNKRKFLSLQIVGTIEEQSFYTFYQCLFFPVAQPAPGPEVNLKNRDSDLGGSPGQGYNVSALQAAVEKEEEILMGPQIGGFEHILKIATVMMEAINQLNAAAIGPIPDRIKVEQLRFIGLVLAHLVLRDDPIVDPETGDYVFIAQMEPCIDPMDPHVWRQMREELDIQFDFSSKYLSKVETGDANRDLAGFSGSRGICSGPEFGQDQKVPPSLSIVFPKSWD

SEQ ID NO: 138610 - protein, 60 aa, Heterodera glycines
  Coding regions on vcDNA: vcDNA=SeqID_65033; Strand=-; Position=1 -51,145-276
MIYLKKRRYENGGTKTAVCILVKITIVPNFSLSDHFWRVVMIKISTTFLSLCLYPSKISI

SEQ ID NO: 138611 - protein, 66 aa, Heterodera glycines
  Coding regions on vcDNA: vcDNA=SeqID_65034; Strand=+; Position=1-199
FMTSNFSSFSTRIGYEFVVKGINREWFPHKLPTVFMLFSFRWSSFAYGRHSHPTQIDPGPRLGTQL

SEQ ID NO: 138612 - protein, 30 aa, Heterodera glycines; identical to SEQ ID NO: 126607
  Coding regions on vcDNA: vcDNA=SeqID_65035; Strand=-; Position=1-92

SEQ ID NO: 138613 - protein, 81 aa, Heterodera glycines
  Coding regions on vcDNA: vcDNA=SeqID_65036; Strand=+; Position=1 -43,86-174,438-551
MAQRNENNPKKNFNFTVVTVLVHEVPHEIGDFAILVQAGFSKWKVSMIPDLLEKSTVCQSVKEICALLLGLAMMYAIAFFE

SEQ ID NO: 138614 - protein, 69 aa, Heterodera glycines
  Coding regions on vcDNA: vcDNA=SeqID_65037; Strand=+; Position=1-207
MAVAILLFLLPAENPLGASAGSKSNSKEQDNTTNSSSSREGDNNSNNNDDNSMAGKRLMDWPTMQKQFP

SEQ ID NO: 138615 - protein, 19 aa, Heterodera glycines
  Coding regions on vcDNA: vcDNA=SeqID_65038; Strand=+; Position=1-59
MSLWTNICLPFCCLPNPRN

SEQ ID NO: 138616 - protein, 23 aa, Heterodera glycines
  Coding regions on vcDNA: vcDNA=SeqID_65039; Strand=+; Position=1 -43,443-471
MNIFKKLLKTQIFKPNINLLEMH

SEQ ID NO: 138617 - protein, 111 aa, Heterodera glycines
  Coding regions on vcDNA: vcDNA=SeqID_65040; Strand=-; Position=1 -39,84-116,677-740,792-863,1038-1075
  Homolog annotation: Hit_ID=CAF99311.1; Match level="QueryCoverage =100%, HitCoverage=22%, E-value=4e-24, Identity=60%"; Hit description= unnamed protein product [Tetraodon nigroviridis]
MSILEKIQEIENEMARTQRNKATMMARTQRNKATMGHLGLLKARLAKLRRELISPKGGGGGGGGEGFDVAKTGDARGGGGGGGEGFDVAKTGDARIGFVGLPPAGDSNSLS

SEQ ID NO: 138618 - protein, 327 aa, Heterodera glycines
  Coding regions on vcDNA: vcDNA=SeqID_65041; Strand=-; Position=1 -276,326-525,569-961,1006-1120
  Homolog annotation: Hit_ID=NP_001004509.1; Match level="QueryCoverage= 99%, HitCoverage=23%, E-value=5e-36, Identity=29%"; Hit description =si:busm1-180o5.3 [Danio rerio] emb|CAD60788.1| novel protein similar to DNA polymerases [Danio rerio]
AKALECGYSVDRFYRAWHYEEEADDLFKGYVRLFLKLKEEASGFPKGVETEEQKNIWREEYKEKYGIDIELAKVKKNPGLRYISKLMLNSLWGKFSMRNCLNKNAVIDRASEFYKIACDHKVEMCDIVEYSDEAIRVIYRDKEDFVMEHKSSNIVISLWTTSMARLKLLEFMREAEGNGGEILYTDTDSIFVRHDRDVEPITTGKFLGEMSEEYGGHEIEEYCCGGAKQYALKMKNKQTGETEYVMKIRGITFDVDNRKTLHYDTFREMVLSYGKGEVDPAFFVYKNDFGPTRDSKVVTREKHKMYRPVCQKGIIDEELNVIPFGFC

SEQ ID NO: 138619 - protein, 127 aa, Heterodera glycines
  Coding regions on vcDNA: vcDNA=SeqID_65042; Strand=+; Position=1-536
RRKHMMNSYEIEIFLSKHPTTRKYFIGVFASDKMPKLKDRHFPYCFVANTDRVGTIGEHWVACFVNSPTEIEYFDSLGDYPNEDLSSYLNLFKRILINDRIVQHQFSDACGQFCIYFLTQRCYGITY

SEQ ID NO: 138620 - protein, 631 aa, Heterodera glycines
  Coding regions on vcDNA: vcDNA=SeqID_65043; Strand=-; Position=1 -74,150-620,1103-1310,1353-1910,1953-2214,2262-2584
  Homolog annotation: Hit_ID=NP_507780.1; Match level="QueryCoverage =54%, HitCoverage=27%, E-value=3e-27, Identity=26%"; Hit description =predicted CDS, DNA polymerase type B, organellar and viral family member (5T899) [Caenorhabditis elegans]
MAAKRNGTSQQSGPSTKKWDFRSIGNNFIEEMETFKLVDYRSTICEKFGFTKNIAEFVINPDVERPDEAMQDAVDTMIQVAFKNTEERMMRKVRMFGVAITGAGLAFPVWVPYRAYPQNNAEVIMQEINKLGQSGDGEENKKMLLLSEPITMKITCVTMPSGEGPRNVHKFDFGFKEHQRIRISNGDKFCLFYALASSMNYLVMDKYSFIRFMKNVVRQKETAYELLRNCEINGNEMNYGVEHLSSVQNYWDEIYPGKYRVVAFEKSADPRKSIRVLWKGPMGRENVVPIFLENGHWDGLKNYVCFFNRGRKFCIDCECFYSRDVFHTLECRARCYYCNRVGGVPCQKESGVKIECPKCRRYFYNWECYNYHQGHTCKLWKRCVICDKTYRFNPKKDHECGETYCQLCSVSHDPKRGCYIMPIEEKEDKDVYRIVVWDSETSQDTVYKGDQKEHVINYISVRVTCTECCDDKNRTNCKICGEERTKDWSEAVGHEPTKDFVEWILTAFTSYDTYIFAHNAGRFDGHFVFNYLCRTGKNPIPLINGLKIYEFKVQNSRKHSMLIWRDSCLLMPVKLESLKATFNLDCEDKPFFPYYYNKKENYGIRLEHLPPMEDYSPGSMNKEKYAKFEKW

SEQ ID NO: 138621 - protein, 95 aa, Heterodera glycines; identical to SEQ ID NO: 124528
  Coding regions on vcDNA: vcDNA=SeqID_65044; Strand=-; Position=1-801

SEQ ID NO: 138622 - protein, 47 aa, Heterodera glycines
  Coding regions on vcDNA: vcDNA=SeqID_65045; Strand=+; Position=1-143
SPSPAPVSFFCTKICCVGSIKAKVLPVPVGDCTTQSKLANMWRRVHA

SEQ ID NO: 138623 - protein, 41 aa, Heterodera glycines
  Coding regions on vcDNA: vcDNA=SeqID_65046; Strand=-; Position=1-347
FFNRFLNVWIFFWLTKTSSNLVLSILFQIAPNFFYSLTRPY

SEQ ID NO: 138624 - protein, 95 aa, Heterodera glycines
  Coding regions on vcDNA: vcDNA=SeqID_65047; Strand=-; Position=1-560
LFEYPKRTLEKIDFFVFGAVPPNRCAQIYGETESFGNSFPIVCTLILRWIFAPHKCLSTPNGHLKKSIFLFSGQSPRTDAPRFMARPNPSGIASL

SEQ ID NO: 138625 - protein, 106 aa, Heterodera glycines
  Coding regions on vcDNA: vcDNA=SeqID_65048; Strand=-; Position=1 -75,452-607,653-739
  Homolog annotation: Hit_ID=NP_498920.1; Match level="QueryCoverage =72%, HitCoverage=13%, E-value=5e-09, Identity=40%"; Hit description =vacuolar protein sorting (3J791) [Caenorhabditis elegans] pir||S27790 SLP1 protein homolog - Caenorhabdit
QNEANDFLVANKIRVDVNDPKEEEQNAQPDKVIPFIENAIIERRDKVSILRMIAIQSMYAKGLKPVVLHSYSKLLVQSYGFSMLKWLLKLQIAGIIRDDFSDSKIE

SEQ ID NO: 138626 - protein, 66 aa, Heterodera glycines
  Coding regions on vcDNA: vcDNA=SeqID_65049; Strand=+; Position=1-201
MLPHGCFPFRACLDCIQGPSLTATQSYAQLREEMRTVRLDRNHMGVLCKGPGILGKIGTRKAGIGA

SEQ ID NO: 138627 - protein, 124 aa, Heterodera glycines
  Coding regions on vcDNA: vcDNA=SeqID_65050; Strand=+; Position=1 -61,102-415
MLFLFVIVGQLLLASEMVVHGGHYGGYSFEQPSIERAETDQIDSDKDTISDEALINGSTTSTFGSSSSPALIRRVDRSADTDDSSEHLRSGINQGWAKLKNKKRNAKSQNVRKGEMRNFQKFYQ

SEQ ID NO: 138628 - protein, 140 aa, Heterodera glycines
  Coding regions on vcDNA: vcDNA=SeqID_65051; Strand=-; Position=1 -167,218-406,458-524
  Homolog annotation: Hit_ID=CAE64964.1; Match level="QueryCoverage =99%, HitCoverage=75%, E-value=3e-38, Identity=41%"; Hit description =Hypothetical protein CBG09798 [Caenorhabditis briggsae]
VLYNATMSFRVGQAPTAETAYNTLVRWIIDRNNFQVGQSGLFINPMPSPFGPCFMNDCHPKGICIATGPNSYRCECAHGYRDMSVANPGHDCVPLYGINECENTTLNECSEHAQCFDLEYLYRCECLRGFKDISPKGAVA

SEQ ID NO: 138629 - protein, 34 aa, Heterodera glycines
  Coding regions on vcDNA: vcDNA=SeqID_65052; Strand=+; Position=1 -42,124-186
MLAVVAVSFGATVTRSRIRKLMAEKNGKMTIYGE

SEQ ID NO: 138630 - protein, 71 aa, Heterodera glycines
  Coding regions on vcDNA: vcDNA=SeqID_65053; Strand=+; Position=1 -94,203-324
MDLSKLEPCLKEYYLNCYPYDLIFKWLSYSNKNRDYLSKREFAFILEKDEHLRFLSFVEPKEFIVKLYQLR

SEQ ID NO: 138631 - protein, 17 aa, Heterodera glycines
  Coding regions on vcDNA: vcDNA=SeqID_65054; Strand=+; Position=1-55
QHYGYAPVSDKIAHNTK

SEQ ID NO: 138632 - protein, 179 aa, Heterodera glycines
  Coding regions on vcDNA: vcDNA=SeqID_65055; Strand=+; Position=1 -84,1047-1260,1845-2086
MSVPKPRRFTYFERLKSTFNAVHDQETKHNAMVKTVDQHCYQVLCLCALFCPVDMQKGVMDALFAHLCRIQPDRVFRPVDHALWTALLLLINPVKLKQQCLGISHELDEIELVNDGIKNMAFEYMQAFIVKAPAFFEFPFSIDVVDSLIKNFICYFRDKVDNLIVQFNKWYQNGVNGIS

SEQ ID NO: 138633 - protein, 34 aa, Heterodera glycines
  Coding regions on vcDNA: vcDNA=SeqID_65056; Strand=-; Position=1-102
MAKLMLAPTQLWCLYVDVVVLQFDGNAMDAISLA

SEQ ID NO: 138634 - protein, 122 aa, Heterodera glycines
  Coding regions on vcDNA: vcDNA=SeqID_65057; Strand=+; Position=1-369
MQYFVGTRYQRGAGLLKNVARFLMPVASNLLKTVSREGLTAGNRVLEDISQGKALRESIQAHAKHGMENLAEKLRQCGKGAAKTTTTLTKNKSSVNNKKKKYPSSVMTKGKRHVIDQLTFAP

SEQ ID NO: 138635 - protein, 244 aa, Heterodera glycines
  Coding regions on vcDNA: vcDNA=SeqID_65058; Strand=-; Position=1 -612,663-783
  Homolog annotation: Hit_ID=NP_001004509.1; Match level="QueryCoverage= 95%, HitCoverage=16%, E-value=7e-25, Identity=31%"; Hit description =si:busm1-180o5.3 [Danio rerio] emb|CAD60788.1| novel protein similar to DNA polymerases [Danio rerio]
MTVPSFPPAPTLELNAALKAGYTVRKLFYVLQYDQWSDNIFKSYVSEMMALKIHATGFPSWCGSEGEKDEYIEECRQLFGIKLDKQKMKAEPGKRYIAKLCLNSLWGRFSMRNLLSKALITDDCDKLLQLNDNKKIEVSGVEEMDEENETYLISYKEKEEFVEENPYSNVVISLFTTSAARLHLYGILKKVADTPKCEVLYFDTDSIIYVHPEDNDPLPTGKGHLGELTDEKPDHDILEFISAG

SEQ ID NO: 138636 - protein, 42 aa, Heterodera glycines
  Coding regions on vcDNA: vcDNA=SeqID_65059; Strand=-; Position=1-128
TVFALIKAPGGLFFNLLRKGDIIGDRAFNGDGGIIFRQIFND

SEQ ID NO: 138637 - protein, 74 aa, Heterodera glycines
  Coding regions on vcDNA: vcDNA=SeqID_65060; Strand=+; Position=1 -94,193-323
MDKKEKTEGKATKKGRLQKRRTTPYDIWEDEGEQITATTKCKRVKYVPNLLPAVVPPPEGMSYNPPIDSYLVRK

SEQ ID NO: 138638 - protein, 31 aa, Heterodera glycines
  Coding regions on vcDNA: vcDNA=SeqID_65061; Strand=+; Position=1-95
DYFSKHLVDWGIIGDCGINRDWAIIRAYTVL

SEQ ID NO: 138639 - protein, 175 aa, Heterodera glycines
  Coding regions on vcDNA: vcDNA=SeqID_65062; Strand=+; Position=1 -54,1295-1768
MNMSCHFTVPSGGLSFVGEIAHFVVDVVFYRLPIFAPTCPWFGTSPLALYTIGTFLVYFFEYPIYVLHIAITLNRCSCVWAPIRHKEVKQTHKQFTPLHFLSFGAVLVSRQLRLLLLFLWHFLPTVWSLLPSWSNSTKRTRPRAQFRSLSPTNFILYVQIFANSFEIFVALRIAL

SEQ ID NO: 138640 - protein, 41 aa, Heterodera glycines
  Coding regions on vcDNA: vcDNA=SeqID_65063; Strand=-; Position=1 -51,112-186
MKNNFDIYPATPKKQLNEEICVVHGNVLARSARHMANNTHG

SEQ ID NO: 138641 - protein, 234 aa, Heterodera glycines
  Coding regions on vcDNA: vcDNA=SeqID_65064; Strand=-; Position=1 -20,72-510,890-1134
MSVEKDGCFDKTVITLLKDWQSFFSGGVSLELLDVGLAGMVVWQLYSERLLPLIGKDKIFAFIKISYNGILCLRHLTGFGLGDFVNLQKISLSIMTEDERLGFTSVGENEMTASQRVAEWLQTPLSNGQPKVLMTDFAYEVYKVQDLRRLLKELFTSASSAAKYFFILPKMASDSLNLVNNNTQERMMDRIIKEKCWLIRAPIGDEVFTNELDEKELTKVCENSMAAGFYEKDI

SEQ ID NO: 138642 - protein, 113 aa, Heterodera glycines
  Coding regions on vcDNA: vcDNA=SeqID_65065; Strand=-; Position=1 -239,603-702
MCIPNLCLLVHFSVFSKLTITPIICKEMTEIVCKKIVIRWTEKEEYSAIVATIDEGVTTQFVCPVWPRYKFIGFNHIELRCFDKTVINLLKDWQSFFSGGVSLELLDVGLAGM

SEQ ID NO: 138643 - protein, 109 aa, Heterodera glycines
  Coding regions on vcDNA: vcDNA=SeqID_65066; Strand=+; Position=1 -224,470-575
MRRSIKICKSDNTYRERKRWTPRKRETERKRERETDRHTDRDRKRANKRKEKETDRQRGRKKKRDIQKDRDGENCFTELPSTKFFLKKSSAKKRCENKKVNSYVIPSFY

SEQ ID NO: 138644 - protein, 153 aa, Heterodera glycines
  Coding regions on vcDNA: vcDNA=SeqID_65067; Strand=-; Position=1 -204,1971-2228
MAETVWPMISNENIKAICLYSGKRFVVLRNTNPAAGRCECEKRLVSHSMAMCCTDYARKEWAPIQCQWHFGEKFVPINSFNSSFSQMHGSFKHSELHNVPSNNTLTNCIWGCCHFEMHSRIRRENLRKTEEDNDQICFDKNAVFFSFRETDIG

SEQ ID NO: 138645 - protein, 187 aa, Heterodera glycines
  Coding regions on vcDNA: vcDNA=SeqID_65068; Strand=-; Position=1-564
MVVTNKESTGSKPTHMQKAKQHREGKTLRRHQVNKLLSSAATLRPRRKRESVPNSTTPIVIDLSSDSEGNSSDVEIIQDPVADQQISSSNKHSTAPLPKELRRSTATKQSSSNSTRPVSFRKRTQGKAAPSAGISRTFEHSSQTKALSPTTKEKRANQQHAMALEGSTDPTTNTYDWQSAKFSKHML

SEQ ID NO: 138646 - protein, 665 aa, Heterodera glycines
  Coding regions on vcDNA: vcDNA=SeqID_65069; Strand=-; Position=1-1998
  Homolog annotation: Hit_ID=CAA82797.1; Match level="QueryCoverage =92%, HitCoverage=85%, E-value=6e-47, Identity=26%"; Hit description =gag protein [Ascaris lumbricoides]
MVSLIQKGITFTLKALDSARTTTALSLHPDADLSNWENAVKLETQCTRVNREVQTIEAQLDNLRDLSNNWIDLLNRLEGAEKDKGEKEYVKFDTHEKIAERHDAATTKLRDLRDLEATLSADAKLYRGRTEREAKADQQANPPPQTAMPPMAAPTFTAPLYQFQPIQLDKFFGQKRKWPEFYESFKSAIGSQSISKAQKLNLLRNLLGGEARELIAGFRLEDQNYETVLQLLKDTYGAPEEHIRALHFELANLKPCRSLRDTKEFLLQLERLTRELNNAGEDIEGPQVFLMLEKKLTPAFLRNILNKKGEDPANWTTTKFRDVLNEAVRKEVQIQEVMGEYGHHYVQSKAEVVSAAHVQSPITANQRSRRPNQPSTQRHESFIASTLDESLRQQAYKKQQDMQLANSRHPQARDQAQSINRIPPYPCTFCNGNHWHDECKKVSTLNERISIVREKKLCFKCLKANHQASNCARPSKCYHCKRRHPTALCRDQCRSENDINMPSNSYSEKKPNDQNGRRSTAIEQQQMCNAVQSRDTRALLMTARATIFNPAQPGLSMMATVFIDPGSHRSFISSSAAKQLELTNLGTEECFLTSFGEREPKRYLSDRVAIGILCPDNDRFIFNLNALKFLLNEMPVLQLNAVDHDELQQKKLNLPNAPRQPDILL

SEQ ID NO: 138647 - protein, 99 aa, Heterodera glycines
  Coding regions on vcDNA: vcDNA=SeqID_65070; Strand=-; Position=1 -146,376-435,534-626
MRFSAPRQVLKYFYKRTNAFWDKSMLHKERVAYAKLRLKLYGALVLSMCSSFANYVQTKGAGGLDIADETMYKQFSFSKGRLLENALETPEGQAMGLSE

SEQ ID NO: 138648 - protein, 63 aa, Heterodera glycines
  Coding regions on vcDNA: vcDNA=SeqID_65071; Strand=-; Position=1 -112,583-660
MTNKFTCTSFTGIGRSCDKCVDGHSAEQHGIAKSGRLAMLFVIALLVIALIAFCLVSVFIGTW

SEQ ID NO: 138649 - protein, 68 aa, Heterodera glycines
  Coding regions on vcDNA: vcDNA=SeqID_65072; Strand=-; Position=1-207
VPPNRCAQIYGETESFGNSFPIACTLILRWIFAPHNCLSTPNGHLKKSIFLFSGQSPRTDAPRFMGRP

SEQ ID NO: 138650 - protein, 95 aa, Heterodera glycines
  Coding regions on vcDNA: vcDNA=SeqID_65073; Strand=-; Position=1-290
LIELCEGIKKGKNLNAEAFSKNWQKMVKIGTENGGKQWKSEGGEKIAKPNETIQKMHFEAMKSIKQQGNDTELDEIIGKLMQGFSQLLIEGANPC

SEQ ID NO: 138651 - protein, 69 aa, Heterodera glycines
  Coding regions on vcDNA: vcDNA=SeqID_65074; Strand=-; Position=1-242
ITYTLPKIRHSHRFVQSAKTAANVCTEQNGGHPSKSPKVAGAEFRVIYKVFAVPDGLVLLLTFTNDVPK

SEQ ID NO: 138652 - protein, 107 aa, Heterodera glycines
  Coding regions on vcDNA: vcDNA=SeqID_65075; Strand=-; Position=1 -47,118-394
MSDRRKEAEEKMEKAIFISADCWLGVFDLLPPSQLGLGIAMISHRFDYYVDEHFKTRKRALAFIRIRYKIEENGTKGMEIVNSNCESLSIPQIQLPKKIIGFKRISI

SEQ ID NO: 138653 - protein, 194 aa, Heterodera glycines
  Coding regions on vcDNA: vcDNA=SeqID_65076; Strand=-; Position=1 -66,247-402,750-902,1039-1248
  Homolog annotation: Hit_ID=XP_396299.1; Match level="QueryCoverage =61%, HitCoverage=33%, E-value=6e-11, Identity=33%"; Hit description =similar to ENSANGP00000017738 [Apis mellifera]
MQLLADPLLKQIANKTAFVSIEEFAIRFKNIRMNCSMEIGNECAAGTKLIMLAMSGRTSFERRTGARETWMKEAAPGEILRFFVADPSAGEAADVKQKLEEEQKKHGDIVFLHGFVDKYKHLHLKWFGALTWQQRHCAGAEWVAKVDDDTVVHLRRMDYWINKKFRQIADDHPLIIFGDMDASRKPFRDREIKW

SEQ ID NO: 138654 - protein, 180 aa, Heterodera glycines
  Coding regions on vcDNA: vcDNA=SeqID_65077; Strand=-; Position=1 -48,155-273,323-443,884-1058,1119-1198
  Homolog annotation: Hit_ID=NP_504672.1; Match level="QueryCoverage =73%, HitCoverage=44%, E-value=8e-12, Identity=31%"; Hit description =glycosyl transferase, family 11 (41.9 kD) (5H60) [Caenorhabditis elegans] gb|AAC25845.2| Hypothetical pro
MTTHKSWQFHEYIKKKGTAFQSFKYFETRRTEIRQIFRIEQKLCRTVDKYKKELFGDDQSHKYCVYTRRGDFVNFAWASNKDFTEQGIEFGVKYLMLIVNVYLPKAMPRINDLAFSIITCDSLLITANTSTWGWWVAYLMPDNATIFYNSKFGKGFPHNRENFLAEWVPIQLFNGKMTLD

SEQ ID NO: 138655 - protein, 18 aa, Heterodera glycines
  Coding regions on vcDNA: vcDNA=SeqID_65078; Strand=-; Position=1-54
MRTRPIWTVKQRLLTSQK

SEQ ID NO: 138656 - protein, 95 aa, Heterodera glycines; identical to SEQ ID NO: 130684
  Coding regions on vcDNA: vcDNA=SeqID_65079; Strand=+; Position=1-677

SEQ ID NO: 138657 - protein, 248 aa, Heterodera glycines
  Coding regions on vcDNA: vcDNA=SeqID_65080; Strand=-; Position=1 -222,523-569,613-724,783-937,1096-1236,1402-1421
  Homolog annotation: Hit_ID=NP_500372.1; Match level="QueryCoverage =99%, HitCoverage=24%, E-value=2e-72, Identity=57%"; Hit description =OSMotic avoidance abnormal OSM-9, Neuron Specific Serotonin deficient NSS-2, olfactory channel involved i
ALGITDEMRTEPADSRFSEHEAQWRMNKRGMDGETLIHLLLNRKELVCHEVARILINRYPGMARDIYLGEELFGQGCLHLAIVNDDYDTAKILLEYGASVNARANGDAKILLEYGASVNARANGDFFMPDGYEPGHSNRNMDYEGAYYGEYPLAFAACFENKDIYDLLIQYGADPDKQDTFGNTIVSATIYFNEISLYSYSAKHWHKPAHSLENFAGQTPLTLATKLGRKQIFEEMLELMKVKLYGFS

SEQ ID NO: 138658 - protein, 89 aa, Heterodera glycines
  Coding regions on vcDNA: vcDNA=SeqID_65081; Strand=+; Position=1 -172,221-318
MVLATKLLVNITYILTSGCVNRRIWTWEKALRALGASLPRLAMGCGVIVGPEESYNKCCFVENRRGTTAIRRGTTVIRRGTKLLEEVQK

SEQ ID NO: 138659 - protein, 205 aa, Heterodera glycines
  Coding regions on vcDNA: vcDNA=SeqID_65082; Strand=+; Position=1 -115,209-379,438-487,546-662,724-812
  Homolog annotation: Hit_ID=CAE66579.1; Match level="QueryCoverage =94%, HitCoverage=23%, E-value=1e-48, Identity=60%"; Hit description =Hypothetical protein CBG11896 [Caenorhabditis briggsae]
ALRRRKLLFGFGVGTVIGAGFYYMDKNNERRFKRDKVSHAHAHAATVDTKAALNKRPSGSLPTRAELLKGMRDEEFDILVIGGGATGAGVALDAQTRGLKTALKTALVELDDFSSGTSSRSTKLIHGSRSTKLIHGGVRYLQAAIMKFDREQYKMVKEALFERANLLEIAPHLSYPLEIAPHLSYPLPIMLPIYKTHTFLFYLFF

SEQ ID NO: 138660 - protein, 287 aa, Heterodera glycines
  Coding regions on vcDNA: vcDNA=SeqID_65083; Strand=+; Position=1-864
  Homolog annotation: Hit_ID=EAL22930.1; Match level="QueryCoverage =55%, HitCoverage=8%, E-value=6e-14, Identity=37%"; Hit description =hypothetical protein CNBA6990 [Cryptococcus neoformans var. neoformans B-3501A]
MPPYGPAHNQQQQMMPPSALVGVPPGAAATNTWMDWNSSAAMPPRGTYPMAPTNAMKAGTQTGTYIPPQSGGMMPPPAGQVPYYAVGMPTSTTAVHGQPMEPAAYHQQQQQQHYQAVQQQYTNYHQQQQPNMIYNSQQQQQMLFHQQQQQQLNQQMMMQQRQQQQHRQMVATATAPPAAGTAQQKAELGGVQAGQPAVQLGSYASSAAGGGGGGMAPAAGGPSAVNSAAQQQHQWPGSVTPVEDLYVRFHRRVGFGKSKNAWDFVLPFFMSPFLRINLTIAMYDIID

SEQ ID NO: 138661 - protein, 32 aa, Heterodera glycines; identical to SEQ ID NO: 130549
  Coding regions on vcDNA: vcDNA=SeqID_65084; Strand=-; Position=1-166

SEQ ID NO: 138662 - protein, 37 aa, Heterodera glycines
  Coding regions on vcDNA: vcDNA=SeqID_65085; Strand=+; Position=1 -67,155-201
MNRSDSFRLLSSVAVEGILIFVEEMDSKPQEHIPITV

SEQ ID NO: 138663 - protein, 633 aa, Heterodera glycines
  misc_feature (245)..(245): Xaa can be any naturally occurring amino acid
  misc_feature (590)..(590): Xaa can be any naturally occurring amino acid
  misc_feature (612)..(612): Xaa can be any naturally occurring amino acid
  misc_feature (629)..(629): Xaa can be any naturally occurring amino acid
  Coding regions on vcDNA: vcDNA=SeqID_65086; Strand=-; Position=1 -107,184-2022
  Homolog annotation: Hit_ID=NP_510671.1; Match level="QueryCoverage =95%, HitCoverage=61%, E-value=1e-102, Identity=37%"; Hit description= predicted CDS, endonuclease/exonuclease/phosphatase family and RNA -directed DNA polymerase (XR69) [Caeno
FSINQKYSPLTNVLLRNFKWNSNKGVYQRKILTPPSKPSKKKHYSDSISFSIKNTNKKYHNQIEKKAIQKGRNSIYKYIQNFNVNPFEIPNLIYEDKCYHNSAEKCEIFANLFANSFNNKETDPSNTYLGNIIEKCFISDINFNIIETQNLMKKLPNKNGTSPDNISYKILKICHSSLSTVITDLFRISLDTGSLPDIWKESIVFPLFKKGDKNNPENYRPISLTCSLCRVMERILSRHFTIFYXNKKISEYQFGFVRNRSTTSQLNSCGRLEAIINGKNVDCIYIDFQKAFDSVPHELLLYKLEKIGIRGKLLIWIKDFLSNRTFRVKIEEALSSNKVCSGVPQGSVLGPLLFLIYINDLPDALPSGVRIKLYADDVKLYISDTEIMHKALHNLSEWANKWQIRISIKKTFVLHLGNKNPKEIYKIDGNIINVVDTIRDLGINIDNKLQFSNHVAQIIKNAYLRMRSLFRVIKSKSSRIWIILYKTYVRPLLEYAPEVWNPSLLKNIKKIEKCQKYFTKRVLFKCSLPPIPYQQRLEYLQLRLESRRKLSDLFMAHKIIYGRTEIPLKYSNLLNALTFPFIDLIRNINXAKNLYLLQGETKIWNQLDKLYXNNSLSFKNKTKTISFLXNRPK

SEQ ID NO: 138664 - protein, 73 aa, Heterodera glycines
  Coding regions on vcDNA: vcDNA=SeqID_65087; Strand=+; Position=1 -41,293-473
MSGSEPVSNEILNNTVMIAFIFINQIRYFKGIDIKVLYIFINRISSLLNSLFLNLVMVFILFVFLIEKDMLSE

SEQ ID NO: 138665 - protein, 83 aa, Heterodera glycines
  Coding regions on vcDNA: vcDNA=SeqID_65088; Strand=+; Position=1 -72,344-523
  Homolog annotation: Hit_ID=NP_500910.2; Match level="QueryCoverage =100%, HitCoverage=8%, E-value=1e-25, Identity=61%"; Hit description =solute carrier family 12 member, possibly N-myristoylated (4G837) [Caenorhabditis elegans] gb|AAF39883.2|
MYIIGAVEIFLIYIMPQAKLFEDMYHNFRLFGSLLLILVGLIVLAGVKIVNKFALPAVLIVIACIVFTFVGIFLKFDGSDSLQ

SEQ ID NO: 138666 - protein, 225 aa, Heterodera glycines
  Coding regions on vcDNA: vcDNA=SeqID_65089; Strand=-; Position=1 -372,610-723,815-1006
  Homolog annotation: Hit_ID=CAG87052.1; Match level="QueryCoverage =72%, HitCoverage=22%, E-value=7e-21, Identity=43%"; Hit description =unnamed protein product [Debaryomyces hansenii CBS767] ref|XP _458899.1| unnamed protein product [Debaryomy
MNSQLLCIFLLVICTVSIGTLTQAKPIPEEAAATETKADEGKKEEPKKEEAEAKKEEATKEEPKKEETKKGEGKTEEAKKDEAKKEEPKTEEAKKEEAKPSAPAVLTEAADNVNKAVDDLSVKQTAVNKILEAKAKNDAELESEVKTKTATLSEDSKKASAELTLIIEDKKTTLDEKVKRTEELTAKMSDNTKKELNLNNSADVVAFVKSYSAVAVPAVATEGKA

SEQ ID NO: 138667 - protein, 90 aa, Heterodera glycines
  Coding regions on vcDNA: vcDNA=SeqID_65090; Strand=-; Position=1 -171,603-704
MRHTPRQIHNGGRAAHRNLSRSRKCSVTAAAATEEKEGVETNNNDDDNDADKDEDKENFQLNFLGSGYPTEYRHTRLFQDTDPVPGSEFQ

SEQ ID NO: 138668 - protein, 249 aa, Heterodera glycines
  Coding regions on vcDNA: vcDNA=SeqID_65091; Strand=+; Position=1 -70,119-154,212-334,385-494,550-616,674-762,824-928,993-1142
  Homolog annotation: Hit_ID=AAL78226.1; Match level="QueryCoverage =40%, HitCoverage=87%, E-value=3e-45, Identity=95%"; Hit description =hypothetical protein Hgg-17 [Heterodera glycines]
MLFFPIATVLLGVFVGSLQGKPTEQNAEIKPAAPLEATRNEIKDTPQRTENKEISRSEINEIKEIPRNEFKTAPITESRERPFIKSEIIRDISSAMNFLNEQIREYSERTKDREEFKGIIEARNKLETAIKPLHGVMESDMASSSLETSMTNSANIARQALEELPVRQMEQIAEEGKSKTVEEQERALREYAEKNSESVKKAVDQVFVAKDRADIALETYLRSHADTFSQEARKANDQAKSQIQKEKHS

SEQ ID NO: 138669 - protein, 77 aa, Heterodera glycines
  Coding regions on vcDNA: vcDNA=SeqID_65092; Strand=-; Position=1 -170,222-284
MPQQNAFNQPPNGQGQFGPNGFNLNDQQMMAQQQQQQQPNIGQNAFGQPQQMPPKGNRRKWWHFFKFGTQIDEFYGQ

SEQ ID NO: 138670 - protein, 40 aa, Heterodera glycines
  Coding regions on vcDNA: vcDNA=SeqID_65093; Strand=+; Position=1 -36,98-182
MAEGQCDVAVGGDIDEGDYQCLAFNGNGTAYSEKMRLQQA

SEQ ID NO: 138671 - protein, 41 aa, Heterodera glycines
  Coding regions on vcDNA: vcDNA=SeqID_65094; Strand=-; Position=1 -51,131-205
MRRLVTIDGHLLKAGTMVFENPTAILSRTIPGREWKAKASE

SEQ ID NO: 138672 - protein, 96 aa, Heterodera glycines
  Coding regions on vcDNA: vcDNA=SeqID_65095; Strand=-; Position=1-291
VQAWIQVSRSLDFSWTWIFLDFCPLNPGPGFSKIPISNHHILKRYCTTWTTKSRPNCTSVSGPNTLTLDKNSECGATRKKTIRITSTRVSASSSRS

SEQ ID NO: 138673 - protein, 17 aa, Heterodera glycines
  Coding regions on vcDNA: vcDNA=SeqID_65096; Strand=+; Position=1-52
MISTNDDTDSSWIAIDN

SEQ ID NO: 138674 - protein, 339 aa, Heterodera glycines
  Coding regions on vcDNA: vcDNA=SeqID_65097; Strand=+; Position=1-1020
  Homolog annotation: Hit_ID=NP_830279.1; Match level="QueryCoverage =85%, HitCoverage=95%, E-value=2e-15, Identity=29%"; Hit description =surface protein [Bacillus cereus ATCC 14579] gb|AAP07480.1| surface protein [Bacillus cereus ATCC 14579]
MTTNLSSLPLPLPLSPEVSFVVRSSSSGTISGHNGKTNDGTAKAEQKQKHQMEGRSRNTTREEGRKSTEKAMEKTEKGKTKTTTKLIITISANDNGTLENGDKGNGTLINGAKDNGTLINGASNATLENGTKGNDTSGNCANGNDTLINCASNATLENGTKGNGTSGNCAKGNGTLINGAKGNGTLINGAKDNGILINDASNATLENGTKRNGSSVNCVNGNGTFGNCANLSANTERGICAGSYILANTTKENDILRNGTKDKDNGTYTDNAIFMNGTIANGTLENYSAKGNDTLINGGTTTTVLPSKIMGKSAVSTPTNGTTKTTPNEAISKGNNSRY

SEQ ID NO: 138675 - protein, 199 aa, Heterodera glycines
  Coding regions on vcDNA: vcDNA=SeqID_65098; Strand=-; Position=1 -309,407-694
MENTNVRPDNIKEKNPLQFDLNIPLPEINEEYENVKEALEPKDKEISDKKASLTKADQEKNMSNKDVPITQELNKLSIIGEPLISREKQLPVNPKRTQLEKESVTNSSANSSKQVALTDIHPELSERNEAKPLQVELNTEMSNRGKAKSVQMETNHQLIEKNKIKSVQVGPNARLIERSEARPVQTGSKEAIDRKQQSK

SEQ ID NO: 138676 - protein, 525 aa, Heterodera glycines
  Coding regions on vcDNA: vcDNA=SeqID_65099; Strand=+; Position=1-1577
  Homolog annotation: Hit_ID=S08405; Match level="QueryCoverage=95%, HitCoverage=43%, E-value=1e-93, Identity=38%"; Hit description =hypothetical protein 2 - silkworm transposon mag
MFKCNVIQESREFLAILFSFNSTIHNGKWELELASGADVTVMDEIDWKNIGNQKLEPSRGLVAYGGKSICGILGKAKVKVTHEGRTIESNIHVISGKHKNLCGRDLIMGLKIDLNRAFGISTIRAVEIKQELDACLGQYPEVFQDGVGRCKKMASLKFKEGCQPKRCKPRPVPFSLRNEVEKVLDQWQSEKIIEPVATSEWATPLVIVPKANGKLRLCFDYKVTVNPCLDVHQYPLPRPEELFSILNGGEKFTKIDLKDAYLQLLLDEKAKSCLTICTHKGLFHFARLPFGVASAPAIFQQVMEEVLQGIDGVAVYLDDILITAATDQQHIKRIDQVLKRLSENGLQVKHEKCEFLKPEIEYLGHIVDKKGLHASPGKIEAILKMPEPKNLKELQSFLGMVNYYGKFVASLATLSEPLNELRRNDAKWTWTKSQQKAFDVIKKVLTSTKVLVHYDPKKPLFLAADASDYGVGAVIFHKDEKGRVGVIAYAFRTLNSSERNYSQIEKEARAIIFGVDKFKQYLYGR

SEQ ID NO: 138677 - protein, 231 aa, Heterodera glycines
  Coding regions on vcDNA: vcDNA=SeqID_65100; Strand=-; Position=1 -132,236-395,442-584,642-779
  Homolog annotation: Hit_ID=CAE57602.1; Match level="QueryCoverage =99%, HitCoverage=99%, E-value=1e-32, Identity=36%"; Hit description =Hypothetical protein CBG00583 [Caenorhabditis briggsae]
MGRKKTEAVTVLLKDAGIADRVTMDQYIAEYDKHVLQIMRALTELPGATKLIDHLYAHNIPMAICTGSDNEEFASKMLKFDEWLKKIPLRVLCGSDPEVRIGKPNPDAYEVTIGRFAAKSDPEVRIGKPNPDAYEVTIGRFAAKPTSPKNVLVFEDSINGVESALGAGCTVVMVPQREFLPNDWPVVMVPQREFLPNDWPEKELRSRPNFAALLDSLDNFCPKQFGLPDYR

SEQ ID NO: 138678 - protein, 58 aa, Heterodera glycines
  Coding regions on vcDNA: vcDNA=SeqID_65101; Strand=-; Position=1 -40,92-227
GRPTPVHAFSRTSVTKYGSTRSTGHGNEYKSADWKVIRRKHHFLLYCLNILSLIHFER

SEQ ID NO: 138679 - protein, 55 aa, Heterodera glycines
  Coding regions on vcDNA: vcDNA=SeqID_65102; Strand=-; Position=1 -70,116-213
MAANRLPPAEPEAEEEPEVIPWQARSADDDDDHDDPDAPDNWRSMLFILVFFQIE

SEQ ID NO: 138680 - protein, 59 aa, Heterodera glycines
  Coding regions on vcDNA: vcDNA=SeqID_65103; Strand=-; Position=1 -42,90-224
  Homolog annotation: Hit_ID=NP_501094.1; Match level="QueryCoverage =88%, HitCoverage=57%, E-value=6e-13, Identity=57%"; Hit description =transport to INner mitochondrial membrane (yeast TIM) TIN-9, TIMeless related (10.2 kD) (tin-9) [Caenorha
MTQQQGATDTDLRTFRDFLFQYNAVTEQCFDACIRDFTSRDISEKEERCSKNCMDKFLK

SEQ ID NO: 138681 - protein, 73 aa, Heterodera glycines
  Coding regions on vcDNA: vcDNA=SeqID_65104; Strand=-; Position=1 -21,77-333
HESRRNVADITCYKCGEKGHYANRCTKGILAFLSNTATASDQQREQPRDNQQKKYAGGEGGTKTQNDGQENFD

SEQ ID NO: 138682 - protein, 95 aa, Heterodera glycines
  Coding regions on vcDNA: vcDNA=SeqID_65105; Strand=+; Position=1 -128,338-495
  Homolog annotation: Hit_ID=NP_509834.1; Match level="QueryCoverage =97%, HitCoverage=7%, E-value=1e-12, Identity=40%"; Hit description =peroxidasin (XL592) [Caenorhabditis elegans] emb|CAA91999.1| Hypothetical protein K09C8.5 [Caenorhabditis
MVGSQTADAHLDVQSAQIDQLDTTLNDQTLRSIVDEASQNIDRAISKTNEELKISNPQDLLKHFKFVGKRPTSQLSRAREIYEESLRLIEKHVEL

SEQ ID NO: 138683 - protein, 745 aa, Heterodera glycines
  Coding regions on vcDNA: vcDNA=SeqID_65106; Strand=-; Position=1 -23,1538-1847,2014-2301,2329-2468,2523-2591,2640-2958,3006-3187,3403 -3628,3682-3756,3822-3992,4071-4237
  Homolog annotation: Hit_ID=CAE63611.1; Match level="QueryCoverage =98%, HitCoverage=59%, E-value=1e-114, Identity=32%"; Hit description= Hypothetical protein CBG08103 [Caenorhabditis briggsae]
PTSIKPGQPQITAQPTEAVREGEFVTVRCESQDGNPLPRFQWLFDNRTRVPDAWFHERHEGGGGSGTKPRAISTLQWHLTRSDNGAYLTCQTWNKALREGEVINAETNRLNVLYAPRVKVVPTPELNIEEGELAELKCTADANPPATNFAWTHLPSGETHADREWRVHVRRAHAGEFRCTAVNSLDSASDRIRLNVLYGPTVRIRTVVSPAEGDRLVVDCEADANPKADTIAWSIRTVVSPAEGDRLVVDCEADANPKADTIAWSGPGGFQRNGSRLVIEAVNRAHSAHSGNFTCTAWNTLALSSVSASLIRTGIRTGSARVLVDVRRRPGSATISAKQTTLNVGETITLSCGTDGDAGSPSAHFRWAGPPTKGAYERKARNKAQLRLPDAQLAHNGIFRCVAHNELGQGEEATVRITVVEPARISRMPMPSKILNNGANDITVVEPARISRMPMPSKILNNGANDVTIECEARGFPRPSIRWLRDGVQLPIELFVHWTVTERICPSDESCVRSILSILRFAHSISWADKGNYSCLAHNSATSPPVSSQSLLSVIHQPIALNERFVDGSLTAAEIGASAQIVCRISARPEPKVAQIVCRISARPEPKVTWSRDGTEIGGGGGLSFTFGGGGLSFTFPSPLDAVDEFEAVLELREVSEQHFGVFTCEARNGVGAKAAVDIRLQAPPQTPLPQTPLQARLIQSGTTWLMVGWRPAFDGGDRQQFELEYRLVDPYKGKAGGDGQTDTL

SEQ ID NO: 138684 - protein, 179 aa, Heterodera glycines
  misc_feature (1)..(1): Xaa can be any naturally occurring amino acid
  Coding regions on vcDNA: vcDNA=SeqID_65107; Strand=+; Position=1 -47,5645-5748,5796-5908,5960-6144
  Homolog annotation: Hit_ID=XP_514087.1; Match level="QueryCoverage =98%, HitCoverage=8%, E-value=5e-28, Identity=41%"; Hit description =PREDICTED: similar to kinesin family member 21B; N-5 kinesin [Pan troglodytes]
XCVKLNILTSLCSILLIRPQSGKEKEEPIYLSVIPGEPQLTIGRDKSFAYDFVFDQLTPQKTVYDKCVRELVAYDFVFDQLTPQKTVYDKCVRELVDGAFEGYNTSVFAYGQTGSGKTFTGSGKTFTMGTSLGDPAKRGIIPNAAQQIFDEIEGRREQARRSGKVIPSLEVSAQFIEVR

SEQ ID NO: 138685 - protein, 64 aa, Heterodera glycines
  Coding regions on vcDNA: vcDNA=SeqID_65108; Strand=-; Position=1 -115,161-239
NVQPDPHSQCGPYKPNWREADGADFLSPTKQLDNSIGFDKEEEAFGGSKNQWRELALFWSILRE

SEQ ID NO: 138686 - protein, 25 aa, Heterodera glycines
  Coding regions on vcDNA: vcDNA=SeqID_65109; Strand=+; Position=1-75
TCTCGVVVKLSTFHNFSPEFNSPLG

SEQ ID NO: 138687 - protein, 265 aa, Heterodera glycines
  Coding regions on vcDNA: vcDNA=SeqID_65110; Strand=-; Position=1-796
  Homolog annotation: Hit_ID=NP_493893.1; Match level="QueryCoverage =100%, HitCoverage=94%, E-value=2e-14, Identity=22%"; Hit description= putative mitochondrial protein (2B324) [Caenorhabditis elegans] pir||D88035 protein M01D1.5 [imported] -
GLNSPAFQSLGLNPPAFQSLGLNSPAFQSLGLNPPAFQSLGLNTPAFQSPGLNSPRLQSLGLYSPAFQSPGLSFYAFQSPGLILLHFNHWDSTLQHFNHWDSILLHFNHWDSTLQHFNHWDSILLHSNHWDLTSPGPSAFQSLGLNSPAFQSLGLNTPAFQSPGLNSPGLQSLGLSFYAFQSQGLNSPAFQSLGLNPPAFQSLGLNSPAFQSLGLNPPAFQSLGLNSLAFQSLGLNTPAFQSPGLNSPRLQSLGLYSPAFQSPGL

SEQ ID NO: 138688 - protein, 316 aa, Heterodera glycines
  misc_feature (5)..(5): Xaa can be any naturally occurring amino acid
  Coding regions on vcDNA: vcDNA=SeqID_65111; Strand=+; Position=1 -92,472-569,623-706,756-875,922-1110,1206-1357
  Homolog annotation: Hit_ID=CAE57734.1; Match level="QueryCoverage =93%, HitCoverage=35%, E-value=8e-85, Identity=57%"; Hit description =Hypothetical protein CBG00745 [Caenorhabditis briggsae]
LFSSXFISFEATGDLTKYLDCLIISHFHLDHCGALPYMTEMIGYQGPIYMTYPTKAIVPVLLEDFRKVVTEHRGETNFFTSAHVEDFRKVVTEHRGETNFFTSAHVKACMKKVIAVNLHEIIQVDEQLTIVIAVNLHEIIQVDEQLTIQAFYAGHVLGAAMFMVKVGEESVFYTGDFNMTPDRHLGAAKVPPGESVFYTGDFNMTPDRHLGAAKVPPGLCPNVLITETTYATTIRDSKRARERDFLNKVHETIQGGGKVLIPVFALVLIPVFALGRAQELCILLESYWERLDLKVPIYFSHGLASRATEVVFYLSI

SEQ ID NO: 138689 - protein, 83 aa, Heterodera glycines
  Coding regions on vcDNA: vcDNA=SeqID_65112; Strand=+; Position=1 -58,375-568
MADRNFSTKKTSIRELYLECSFRRTTVAQLQANQQHEDGQQIAAVSANSHLMLAPEFAAVKSALIVQKAFHRFALIVQGKPTK

SEQ ID NO: 138690 - protein, 45 aa, Heterodera glycines
  Coding regions on vcDNA: vcDNA=SeqID_65113; Strand=+; Position=1 -124,819-832
MNKLYFPLLFVATIFIYAVALPRLNLPINKHKNNTEHLTKTDLEA

SEQ ID NO: 138691 - protein, 54 aa, Heterodera glycines
  Coding regions on vcDNA: vcDNA=SeqID_65114; Strand=-; Position=1 -147,427-444
MGEKGYPELADANGDARIVFKGRERHFTCAWQAEKAWNAPGSVWNERRQIISTI

SEQ ID NO: 138692 - protein, 37 aa, Heterodera glycines
  Coding regions on vcDNA: vcDNA=SeqID_65115; Strand=+; Position=1-112
MENIFFNFILFTIFIVFMKENCFACGTDECPIDCEDK

SEQ ID NO: 138693 - protein, 454 aa, Heterodera glycines
  Coding regions on vcDNA: vcDNA=SeqID_65116; Strand=+; Position=1 -409,1141-2097
YFFCIFKILMSLSELFLKELIMVQKIHRDLISGPNPVNLAQLYNNFVATNCAPLTRTNGTEIGQIGHEQQRQSPIGTNLASSSRQTQTWPNGLHRQQFRTDEKRMPNSSQVGEPDEKSHLAKMPCQIKFHKKDWLRASHVTASGVLAPINSLSHHHKNPSVQTNLPANKKDQNAEVKEQFEQQSTSNATQMPFELAQIVAKSDQQEKNGTILNRKTSNSMPQIEAKKVENLNQGAGNDQEIDEIDLFIDIETIDPFDQPEPSKRLFVDRIQPNWNDRRQCLNVINSESVGTSSSFERSIYESADNESASSSSFDHCGQNANGETEESAIMDKISTKIDHLDNDWEDFANWKKSAGIKVEMVENKQIENKSCKEQIWIKEEVSEFDQMVENDQNAKENEKIKSANDENENGAKENKKFNRNKKIVVQNIIRKCEWAECELKFENDNKLYDHLKTV

SEQ ID NO: 138694 - protein, 99 aa, Heterodera glycines
  Coding regions on vcDNA: vcDNA=SeqID_65117; Strand=-; Position=1-819
MFEYPKRTLEKIDFFVFGAVPPNRCAQIYGETESFGNSFPIVCTLILRWIFAPHKCLSTPNGHLKKSIFLFSGQSPRTDAPRFMGRPNPSGIASLYPVL

SEQ ID NO: 138695 - protein, 54 aa, Heterodera glycines
  Coding regions on vcDNA: vcDNA=SeqID_65118; Strand=-; Position=1-504
KSFLQPLIANIISCRLKAIHCLPVSAQQSTNSVFDSLQKIIHYPKVFYNHIFPI

SEQ ID NO: 138696 - protein, 92 aa, Heterodera glycines
  Coding regions on vcDNA: vcDNA=SeqID_65119; Strand=-; Position=1 -26,371-509,567-680
MISFRIIPRITEKPTGLEQTVGKKELLFFYVCLLRRMNIFLDMPNKEKIFFEFHEETVELIQFIGQFITKFMFELTQIHKMDQVGVSSNGAV

SEQ ID NO: 138697 - protein, 600 aa, Heterodera glycines
  Coding regions on vcDNA: vcDNA=SeqID_65120; Strand=-; Position=1 -196,1359-2439,2553-3078
  Homolog annotation: Hit_ID=BAA04539.1; Match level="QueryCoverage =33%, HitCoverage=34%, E-value=6e-22, Identity=36%"; Hit description =caldesmon [Gallus gallus] sp|P12957|CALD_CHICK Caldesmon (CDM) pir||A33430 h-caldesmon - chicken gb|AAA488
MDESKRENFSPQNDDDVITIGDNNNTQTLLDLQPGPSKRGRKPRLDKIHEEIASAMKKAKAMEAEEKAAKEKKAKEEKEASEKKAREEKLAREKKEEQRIAKEKKGEKETKDKKAEEERVAKERKAEDERVAKERKAEEERVAKAEAERVAMVTKAEEERAAKAEAERAENETKKKQEEEKQLEELKRQQQAIRKQKELELLKEFRPWRGGYMRLVHGKDPTPDVHYLHETDDYHFVNAVHKYRVRHSELPWEAPEFNPSAHIQQNIGEFRELFEQEVYDENYAVKTREEKEELIELVKGFRFYFTEQIGRFELKVFNGKISHITLTDQLAYVLGYEQEQQIRNEELAKYAVDLGGGVSHLCIYLNSGVIESMIVGNTFANLLQVIAVEGKSGSVVEKDFQAPLFHKIIAREVDVLDVEIRTLTGREMVRVIFDGSNLRLEKIYPQSGGGGPISVFEGAPTFQRGYGYFLGVPRQKGAGVGSVLRNLWRYLRPMVTAARPYAANIAAEIGKEGLETGARFLNEVSKGGNIKDALVSEGKEGAKKLLDKASSSLQKGRGRRKRRGGGKKAEIILKPSDVVGQTVSQKALLKKKRFDSLGYY

SEQ ID NO: 138698 - protein, 130 aa, Heterodera glycines
  Coding regions on vcDNA: vcDNA=SeqID_65121; Strand=+; Position=1 -277,432-547
MVLPLTAALSKLLNCKPENLAEYLNNPEAVNKANAYLAGKKLKTTYQGRDSKTKEVKFGTFSVKAAAETYAFEGFLGKFPKIQFRSNTHAFRELLAVEEGGESEPVERPAAETDYLDYLNFRSGWQSTLY

SEQ ID NO: 138699 - protein, 70 aa, Heterodera glycines
  Coding regions on vcDNA: vcDNA=SeqID_65122; Strand=-; Position=1 -112,882-982
MAFLDSRWVRIERPKQQKIMSLNDKCENLVRFSSQTPMLKQMTNALSEHSVPLLGSAGGVEFRRRNAIDF

SEQ ID NO: 138700 - protein, 43 aa, Heterodera glycines
  Coding regions on vcDNA: vcDNA=SeqID_65123; Strand=+; Position=1 -67,453-517
MEINEFSFSNKWKSKVKIEGRAANDDLDFLKIKLIRLDIYLCV

SEQ ID NO: 138701 - protein, 126 aa, Heterodera glycines
  Coding regions on vcDNA: vcDNA=SeqID_65124; Strand=+; Position=1 -70,141-451
MLGSALFKIRFPLLSKEDFSGKIVPSGILTTNEVVGVEEYHTIQNLQFPSHQRIKAFGTLLMDIEKVSEFAGEEVGSRRHIENVYISGLSWIILAQIRMKWRSTDNEKCLGIYLLCTEPKEGAINS

SEQ ID NO: 138702 - protein, 331 aa, Heterodera glycines
  Coding regions on vcDNA: vcDNA=SeqID_65125; Strand=-; Position=1 -211,282-618,757-858,904-1010,1050-1201,1317-1403
NLDIRIAILQSEALKPRASSLFFWFALLAFAMVSIASAAAGTVFASGRIRSRQRRYAKTWKPEFPAQESKIAKNSLATLCGGVGPGHYQPPLIDGNTQQHLFNAYTQHNHHQQNAYQFHQPQQQQQYLMFNAGSISTDSCASSTAASAIPLIRHADSLNSLTSNVHANNAINNNNNQQQQEHGQFHQLTDRKQQHFGPAQYHSLVSHNKQQTIHSNSVHPHHAPPAAAAAGTYCSRSSSSGIGGSSTEHSPIAIMHNIHLLSDSHGRMVEDMERRKLLAHLREKALFSPIGLLGLEERLEPQLADDEQCLVNNIQLLFTKGAKINALDTGE

SEQ ID NO: 138703 - protein, 66 aa, Heterodera glycines
  Coding regions on vcDNA: vcDNA=SeqID_65126; Strand=-; Position=1 -64,321-457
MPIERHCENGCRNGGKCGKTKGPSPCKHKGKCVNIGNDRYRCDCAPGWIGLNCEENRNDCEKMWQK

SEQ ID NO: 138704 - protein, 87 aa, Heterodera glycines
  Coding regions on vcDNA: vcDNA=SeqID_65127; Strand=+; Position=1 -70,258-449
  Homolog annotation: Hit_ID=NP_498328.1; Match level="QueryCoverage =100%, HitCoverage=14%, E-value=4e-34, Identity=80%"; Hit description= mevalonate kinase (64.1 kD) (3H214) [Caenorhabditis elegans] gb|AAF60558.2| Hypothetical protein Y42G9A.
RDLLAVKVTVRFKLPSCVGLGSSGAYCVCIAPALLQTAGLIPPPSVSAESDELTWDDSVLDIIRKWSSAAESLIHGRASGLDAAICT

SEQ ID NO: 138705 - protein, 98 aa, Heterodera glycines
  Coding regions on vcDNA: vcDNA=SeqID_65128; Strand=+; Position=1 -158,614-751
MRIVLANGTEASFGPESAELRAVACGLGAFGVITEVELNLVATFDTISYNFVSAFSSFFQLFSLPTESLYAHFDEIQKMGNNVLLMTSLANETLWDKV

SEQ ID NO: 138706 - protein, 136 aa, Heterodera glycines
  Coding regions on vcDNA: vcDNA=SeqID_65129; Strand=-; Position=1 -28,126-295,344-412,460-601
  Homolog annotation: Hit_ID=NP_998650.1; Match level="QueryCoverage =97%, HitCoverage=10%, E-value=1e-23, Identity=40%"; Hit description =zgc:55729 [Danio rerio] gb|AAH47184.1| Zgc:55729 [Danio rerio]
MRKRAISTLGHLADVVGDEQFDRIVEKVLGTCADSETELSSLKTFIISVITICRTSGARFAKFLPQIVPILIQKCESVEDDELREICLQAFEIFAFRCTTELSPFVPSIVKISVEMVSYDPNYNYGAEEEGEERGM

SEQ ID NO: 138707 - protein, 75 aa, Heterodera glycines
  Coding regions on vcDNA: vcDNA=SeqID_65130; Strand=+; Position=1 -134,432-525
MRNIIIFPCHRHCSLRDDYRGDTDLRVQLAHGQTIYGIDYLSLFWRIKCTLILSTANGAPKFAGLPVNWTLLDIK

SEQ ID NO: 138708 - protein, 718 aa, Heterodera glycines
  Coding regions on vcDNA: vcDNA=SeqID_65131; Strand=-; Position=1-2155
  Homolog annotation: Hit_ID=XP_318550.1; Match level="QueryCoverage =99%, HitCoverage=71%, E-value=1e-178, Identity=45%"; Hit description= ENSANGP00000020240 [Anopheles gambiae]
MNGDSGAQATVISFKTWIKLGQPKLSPTDIETRNCNDTAFSTEGKFHCTVSCFDRPSKTLIAYVSSDLKHDLFGLPWIEEFELIPREILYPKSIKGKPNASINANVVKAPNPAIGITDESSLTAVLQNDFEEVFKSGLGHCAIKAHLILKPDARPIFCKARPVPHGAIEAVDTELDRLLQIGAIKPVEFSHWAAPILAVKKKNGKTRVCIDFSTGLNDSIELNRHPLPRPDVIYAALNGAAFFSNLDLRDAYLQMELDEKSKHLCTINTHRGLFQCQRLPFGVKSAPSIFQHLMDQICAGIPGVFSYLDDCLIASKTLEDHVNALHTLFQRIKDFGLRIQLEKCKFLQKELLFLGHIVSSNGIRPDPARSEAIQKMPAPHDKTTLRSFLGALNYYGRFVKPMREIRAPLDQLLRKDESWSWGDDQQSAFEKAKAIMVSELLLTHYDPTLPIVVAADASKDGIGATISHIFPDKKEKVIEHASTVLTNAQQNYSQIEKEALALVFAVQKFHRMLFGRKFTLLTDHKPLLAIFGSKKGIPIYAASRLQRWALIMANYDFEIRYINTASFGQADVLSRLIANYPRPEEDILIANICTETECYISTLLQTKTDQLPVTADEIAEATPKDEILKKILAFIKSNWPKKSSDPDIAPYFPKRENILEIEGCLLYQNRVVVPQSLRNRMLKSLHMAHPGIVRMKALARQHVYWPGMDSEIERIVRQ

SEQ ID NO: 138709 - protein, 733 aa, Heterodera glycines
  Coding regions on vcDNA: vcDNA=SeqID_65132; Strand=-; Position=1-2199
  Homolog annotation: Hit_ID=XP_320889.1; Match level="QueryCoverage =96%, HitCoverage=82%, E-value=1e-108, Identity=34%"; Hit description= ENSANGP00000012033 [Anopheles gambiae] ref|XP_313651.1| ENSANGP00000013044 [Anopheles gambiae] ref|XP_31
MSADQIKQLLEAMRVQSDAIQQLMGQAPQNAASASLNHANLSSSIDGQISKFNYDAETGNTFEQWFKRFGVLIEEDGKDLPESTKVRLLLGKLGDEEYGKYRDSISPTQPDKVTWVDSITKLKGLYPETRSLFVRRYECFKIRQQPSQDISSLVAHINASCENANLSPTKEQLKCIILVIALNDEHHDLRQKCLKMLEDAEKTGTDITLQKVEEELKAIQIVKESALSLLTQPVSTSAIQLRPQQWRETSKGKHKAKPGPKWPQHESAPKSPHHAPSPKQKSDDKANRGRPPHPCASCGSTDHWRSDCKFANAFCNKCNRQGHIAIVCRQRSSNTAPKFQNRSFHTVVAKSHCMVIGTTQGRWWKIPVMINGINLKMNGDSGAQATVISFKTWIKLGQPELSPTDIETRNCNDTAFSTEGKFHCTVSCFDRPSKTLIAYVSSDLKHDLFGLPWIEEFELIQKEILYPQSTKGKTNASINANVVKAPNPAIGITDESSLTAVLQNDFEEVFKSGLGHCAIKAHLILKPDARPIFCKARPVPHGAIEAVDTELDRLLQIGAIKPVEFSHWAAPILAVKKKNGKTRVCIDFSTGLNDSIELNRHPLPRPDVIYAALNGAAFFSNLDLRDAYLQMELDEKSKPLCTINTHRGLFQCQRLPFGVKSAPSIFQHLMDQICAGIPGVFSYLDDCIIASKTLEDHVNAIHTLFQRIKDFGLRIQLEKCKFLQKELLFLGHI

SEQ ID NO: 138710 - protein, 49 aa, Heterodera glycines; identical to SEQ ID NO: 129911
  Coding regions on vcDNA: vcDNA=SeqID_65133; Strand=-; Position=1 -73,249-314,676-686

SEQ ID NO: 138711 - protein, 16 aa, Heterodera glycines
  Coding regions on vcDNA: vcDNA=SeqID_65134; Strand=-; Position=1-49
EAIPEGFGLPINLGAS

SEQ ID NO: 138712 - protein, 53 aa, Heterodera glycines
  Coding regions on vcDNA: vcDNA=SeqID_65135; Strand=+; Position=1-209
FEYPKRTLEKIDFFVFGAVPPNRCAQIYGETESFGNSFPIACTLILRWIFAPR

SEQ ID NO: 138713 - protein, 40 aa, Heterodera glycines
  Coding regions on vcDNA: vcDNA=SeqID_65136; Strand=-; Position=1 -112,174-184
MLLFEFAKFTLLSIIFMHLLCQSDQTAELAHGSNGVGAIF

SEQ ID NO: 138714 - protein, 40 aa, Heterodera glycines
  Coding regions on vcDNA: vcDNA=SeqID_65137; Strand=+; Position=1-121
LFRLSISERFISNMVNGPFRKGPFMISMTICHHRWTADPY

SEQ ID NO: 138715 - protein, 564 aa, Heterodera glycines
  misc_feature (10)..(10): Xaa can be any naturally occurring amino acid
  Coding regions on vcDNA: vcDNA=SeqID_65138; Strand=-; Position=1 -183,232-402,447-557,614-709,837-952,998-1099,1159-1312,1378 -1499,1569-1782,1833-2037,3446-3467
  Homolog annotation: Hit_ID=CAE58514.1; Match level="QueryCoverage =96%, HitCoverage=84%, E-value=1e-73, Identity=31%"; Hit description =Hypothetical protein CBG01665 [Caenorhabditis briggsae]
GEISINFRKXTQIFFLFLGSEKDRVVGRIQHLQNELSDLAFHNYRTYVDVGRTAEHCKEMFAEMFAEMNSFLVKLKAEFPDLIGCINLANSDSEKFTEEYKLLHEVESVSNIIWKVLRLPKLMDKYIRTGRYEQLMDKYIRTGRYEQAYSLTNFAISLKQSKLTQKNAMLAKVVDVLIEARHNLLNELKVVDVLIEARHNLLNELFSKFAGPIDLSRSIQIVNNIRKIPFISNIQLRESILQYRDIYMDKNIQRVMVNTDFFLRAIDVDFFLRAIDVYRECMYDTIVLYLAVFPDCDVQHKNSSEDPRWERWTGSSQSSEDPRWERWTGSSQNFLLHSWAQRNIERLSSLLRGSENKNYLDMEVMHTKLMLMSFAFSFGRMGLDFRPLVVNEFAQMVLEICRRRVETATNCIDGDIFENTRQDFEDSGHPSIDLSVLSAPLELCIWDDICVFGNLLIDILNDLRHSFSIILVFTMISLLYSVQNVFKWVQNVFKWVDSFLSVSAEIVSAKRAISLLLKYFVPFFNRCFFHCFPHEKCVHFFRSSHCPVEDYVSVFFDLKSTAKS

SEQ ID NO: 138716 - protein, 70 aa, Heterodera glycines
  Coding regions on vcDNA: vcDNA=SeqID_65139; Strand=-; Position=1 -49,109-272
MHISKQICPIWDSPEYEEDIAKAEAEVNKTPNIELLDHEYKRLIEIKCVEFEDLMEGKARTKLKFYRRLG

SEQ ID NO: 138717 - protein, 324 aa, Heterodera glycines
  Coding regions on vcDNA: vcDNA=SeqID_65140; Strand=+; Position=1-973
  Homolog annotation: Hit_ID=XP_319741.1; Match level="QueryCoverage =75%, HitCoverage=58%, E-value=2e-21, Identity=27%"; Hit description =ENSANGP00000006515 [Anopheles gambiae]
MAANFDQLVRLMTQQQQQFEDQQKLVQQQSQQIAQLLANQNAANIAAGQQNPPNAVAIPSLPDISLFEVCDEKSRVSEWLDRFKFALDCAAPTASDQIKVKSLMNKLSEMAFSEYSRSVLPASVTDFDFSTTVQKLEKLFAKPQSIFIDRYECLKAVRGEGEEFRHFINRHKKLINDFKFDDLKKEQFYALMLLTALKSPSDAALRQRILAKLATDGQNVSYDGIVEDLINFQSTIAEARAIETPISSRNVNAVHQKGKKNFLPKNKFPKSGQTTTANKSCWRCGECDHQPINCRFKVTKCHKCGAMGHLGKKCESVQAWKKQQ

SEQ ID NO: 138718 - protein, 1094 aa, Heterodera glycines
  Coding regions on vcDNA: vcDNA=SeqID_65141; Strand=+; Position=1 -764,935-3455
  Homolog annotation: Hit_ID=NP_491240.1; Match level="QueryCoverage =88%, HitCoverage=77%, E-value=0.0, Identity=39%"; Hit description=zn- finger, CCHC type and RNA-directed DNA polymerase  and Integrase, catalytic domain containing protein fa
MLLTALKSPSDAALRQRILAKLATDGQNVTYDGIVEDLINFQSTIAEARAIETPISSRNVNAVHQKGKQSFLPKNKFPKSGQTTTANKSCWRCGECDHQPINCRFKVTKCHKCGAMGHLGKKCESVQAWKKQQSAKMMGNKKIGHLRIGMTSCSINALSLMQIKILLNQQKVQFFLDTGSDIDVIDEFTYADIGKPPIEACDEIGKTFDGKEVPFIGKGIGIFKFGEIEVKRPFYVAKKGSLNLLSCQTMDKFGLTLHKGEGTAVVKEDAAPIFRKARPVPYNSLEVVEKELGRLEKMDVISKVDHLNWAAPILIVKKADGSARLCIDYSTGLNDALLDCQHPLPVPEDIFATLNGGKIFSQIDLRDAYLQIELDEESKDLCGLATHKGNYRMERLPFGVKSAPSIFQSIMDKMLAGLNFATAYLDDIIVVSGTTEQHVRHLEEVFSRIQAYGFRVKLEKSSFFRDQIKYLGQIIDRNGRRPDPAKTHAIAQMPAPKDISSLRSFLGMVNHYQQFVKNMRFTRKPLDDMLKDDVEWKWTEERQKAFQKLKEVLTSELLLTHYDPKLDIIVAADASELGIGAVISHKFSNGQMKAIAHASRSLTPAEKNYSQIEKEGLALIFAVQKFHKMIYGRHFTLQTDHKPLISIFGSKKGIRQCSANRLLRWSLTLLAYDFDIEYVNTKDFGQADALSRLIAKEFECDDERVIAACNIDEDLGMILDMAKQILPIKFENLVSESKKDKTMQIVMKFVRDGWPDERKLAPQSEEIELFGRRKADLTILKDCLMYGERIVIPEIFRTKILTLLHKGHPGIKRMKQLARQYVFWPKLDQQIEEFVKNCAPCQLAAKAPTKTDLHSWPKSTRPWQRIHADYAGPFFGKEFLIVVDSYSKYPEVFEMATKSAAATIERLRYLFTRHGIPETLVTDNGTQFAASEFAKFTEANVIAHLFSAPYNPMSNGQAERFVDTFKRAFRKIKGEGVPNKEIINTFLVTYRTTPNDSLPDAKTPAEMLLGRKPRTTIDLLMPPLPQPTERDTKMEHISIAGLAPDHRNLCQISQFGLDTDSRRIGELGQFVIAPESSTRSNSPTVRQIAFMRIN

SEQ ID NO: 138719 - protein, 311 aa, Heterodera glycines
  Coding regions on vcDNA: vcDNA=SeqID_65142; Strand=+; Position=1 -172,2002-2172,2594-2750,3402-3615,4031-4250
QIHLVLKQKHNARLKDVKMKFWHKFNQIGVAFGKHGTQLTNICQMICMNIGQQCKVNEICADIDRLHELCNEPVVEQIITQNCCNKLEMPKTDAKNSHLDEIASSSSPSMFMKLTTKSQKKPELPNYTKAFNLGCYLEELLRSITNGAEPAGAELAGGVLNNAFRVGINDEKVKRLIIKLNVDIAMADLFVEVNDPAKKRANLCLMDSLLTHLVANGTLYTEVQEWQTHMLYEHFINHNEIPRPSDADLRWAKPECHKAEVAQAAVSKLLGQMYLVVQSHSFVLGQVAKDCAEFVQFVNQNGKGILKNLYC

SEQ ID NO: 138720 - protein, 85 aa, Heterodera glycines
  Coding regions on vcDNA: vcDNA=SeqID_65143; Strand=+; Position=1-258
MPKITSCILVIFWDIILIDAPKFQVWMCRFEHLLSLQLPAVRQEIEKIWLFFRCYYDIISDFEPPISTEIDWPLAAATNELILGN

SEQ ID NO: 138721 - protein, 174 aa, Heterodera glycines
  Coding regions on vcDNA: vcDNA=SeqID_65144; Strand=+; Position=1 -197,268-593
  Homolog annotation: Hit_ID=CAE65711.1; Match level="QueryCoverage =100%, HitCoverage=10%, E-value=7e-26, Identity=44%"; Hit description= Hypothetical protein CBG10790 [Caenorhabditis briggsae]
MDTTGKTVLSKNAINHIPFDKTELTAILKFGAAELFREEGEESQDLELDIDEILNRAETRECENMESANDLLNSFKYANFTIDEEKDLAEISQLDDSGMGENSPKLTDNSLDNSVKRDLEKQWDEIIPRQEIERLKEIEQSKSGEGDILLPRNRPSVSNVNYGGFTDESSDDLD

SEQ ID NO: 138722 - protein, 154 aa, Heterodera glycines
  Coding regions on vcDNA: vcDNA=SeqID_65145; Strand=+; Position=1 -177,223-374,942-1076
  Homolog annotation: Hit_ID=NP_505733.1; Match level="QueryCoverage =100%, HitCoverage=46%, E-value=3e-89, Identity=98%"; Hit description= yeast Glc Seven-like Phosphatase (37.2 kD) (gsp-1) [Caenorhabditis elegans] emb|CAA98273.1| Hypothetical
KRRFSIKLWKTFTDCFNCLPIAALIDEKIFCCHGGLSPDLQNMEQIRRIMRPTDVPDTGLLCDLLWSDPDKDVQGWGENDRGVSFTFGPDVVAKFLNRHDLDLICRAHQVVEDGYEFFAKRQLVTLFSAPNYCGEFDNAGGMMSVDETLMCSFQ

SEQ ID NO: 138723 - protein, 34 aa, Heterodera glycines
  Coding regions on vcDNA: vcDNA=SeqID_65146; Strand=-; Position=1 -91,222-235
MYLHVILPTNIHKQIINSEQIWIIIIRKRTTNDC

SEQ ID NO: 138724 - protein, 267 aa, Heterodera glycines
  Coding regions on vcDNA: vcDNA=SeqID_65147; Strand=+; Position=1-804
  Homolog annotation: Hit_ID=NP_917837.1; Match level="QueryCoverage =90%, HitCoverage=11%, E-value=6e-31, Identity=37%"; Hit description =B1158C05.18 [Oryza sativa (japonica cultivar-group)]
MCRQIGLLETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 138725 - protein, 153 aa, Heterodera glycines
  Coding regions on vcDNA: vcDNA=SeqID_65148; Strand=+; Position=1-462
RYIDIGGSEIVPLSGVLRMHREHSRIVPLCMQLTLESIKPPNRASEWLPKECTFFRSLIRTDRAMSCRIRHSNQRWACPLKRDGCPLNPFFGSANYQPSSYNSSPQRWSGVFGVTSLLNGNFRVEEQMVGGVENGEGNREVMAAWANLENGFH

SEQ ID NO: 138726 - protein, 40 aa, Heterodera glycines
  Coding regions on vcDNA: vcDNA=SeqID_65149; Strand=-; Position=1-120
MVVPSNCPEDLPRTMQVDPFVEQTARQKATDVAQRMIDEK

SEQ ID NO: 138727 - protein, 136 aa, Heterodera glycines
  Coding regions on vcDNA: vcDNA=SeqID_65150; Strand=-; Position=1 -313,1207-1304
MDLNNGFYDREEDKVKLIIDLTTVDEPKVDKFNLDQSKSNGTISMEIEKVSEFAREVFWSERKSETVHIKGLPWKIWAQINPKIGSTDNEKWLAIFLWCDAPKGEIDISQLTESTDNIEKCLGIYLLCAAPQEGAN

SEQ ID NO: 138728 - protein, 163 aa, Heterodera glycines
  Coding regions on vcDNA: vcDNA=SeqID_65151; Strand=-; Position=1 -51,280-432,507-645,775-923
  Homolog annotation: Hit_ID=BAB55143.1; Match level="QueryCoverage =67%, HitCoverage=36%, E-value=1e-13, Identity=37%"; Hit description =unnamed protein product [Homo sapiens]
MYNKLRILRPINCCCLINFANCCLAYIGKNADTLLKTDAFLQIDQKLLCEILECDELQIRGEISIWNAALRWADEKCRENGIDCSAENRRQMLGPALFKIRFPLLSNVEFTKKIVPFGVLSKDEVIAVYQFKSLPNCHGISDGIFPMPFSTNGRISDRKRAQF

SEQ ID NO: 138729 - protein, 70 aa, Heterodera glycines
  Coding regions on vcDNA: vcDNA=SeqID_65152; Strand=-; Position=1 -64,408-556
MMELLIMSQSVLDRMKHLLSTASADCPVEVPDVEAAAFKVMLSFIYTDDLSELNVENAMAVLYAGGFNFM

SEQ ID NO: 138730 - protein, 68 aa, Heterodera glycines
  Coding regions on vcDNA: vcDNA=SeqID_65153; Strand=-; Position=1-274
AVLVRFITAPNLLASQQSLLNLPDRTGAHDSTVPSTPPKAKRYNQNIRENFLKNFFSIFLFDTKASEC

SEQ ID NO: 138731 - protein, 165 aa, Heterodera glycines
  Coding regions on vcDNA: vcDNA=SeqID_65154; Strand=+; Position=1 -85,165-577
MHECGERISIAKYDQQGFRRNQIRRNSKDNFQILKSLNEYKFSVYESTKMLKKIYEQMKEISYGNYNSFHGNNQTEEKMPKIIGELIEQIHKDFRILHEVKKFEFYLLKIITDYFEECEYFRLQKYILVNLERMLKENGIANEKNEYHANVDKFIQEKFEKECKM

SEQ ID NO: 138732 - protein, 20 aa, Heterodera glycines
  Coding regions on vcDNA: vcDNA=SeqID_65155; Strand=-; Position=1-60
MCFSVPWVAANGANSAKQFK

SEQ ID NO: 138733 - protein, 310 aa, Heterodera glycines
  Coding regions on vcDNA: vcDNA=SeqID_65156; Strand=-; Position=1 -204,320-435,525-614,766-891,1064-1462
TFQFQQQQLEAQQQQQQEEEEERESSMTKEEEGKKRQHIDVKRGPVEKKGRRGAVPCRSVGKDGTTKGSKYFIPEDVWRDYLGTEWVDMDNLQLEEVDQPQYEPMMPLNPDKPGEVDCWVKELQDVEDNGLARGWEVESVIGVSAKAADGTRQCFVKFVGFKLPQQIPLAVVQEMAPEAFIQWCTWQNGMDNLDKCGAYWEEQLRQPPSWMCRRSLDAFAAWKASKLKQCNNNANNGSNGSTIANSNVFCDDDDDDNGAAADDHRQGQSQVELPPKWKWAPPEEEEEEAEEEEREDDIEEAEDIDDGDDV

SEQ ID NO: 138734 - protein, 294 aa, Heterodera glycines
  Coding regions on vcDNA: vcDNA=SeqID_65157; Strand=-; Position=1 -164,826-1391,1715-1866
MGRIAHLLQSDGFFRTHSQRRFSSSSDVKDESLPLVRIWNRHQWREYMCCQPKHRAMETKKEHQQQQRLAHGHRQLTPETVQMHGVGEQEEEEQQQPPEDPSTSGDDGVATVAVPGAASSPVASAADGQQTPPPLSADRRAAVERVKSSESVSPLAFDERDLDELVTTGGCDEPRTSPPHMDNADEAVEEEEEVEMGDQQQQPMVDMDNGGGDGGSDDVVAAAEAVVDVQQQVVVQQDADEDDEDNLIFIIDKARGGGKVGGVGIIGLLRMEGTPPHHITFVLTIDWLFVTNVT

SEQ ID NO: 138735 - protein, 308 aa, Heterodera glycines
  Coding regions on vcDNA: vcDNA=SeqID_65158; Strand=+; Position=1 -211,269-434,476-594,637-766,818-978
  Homolog annotation: Hit_ID=CAE66574.1; Match level="QueryCoverage =87%, HitCoverage=16%, E-value=3e-51, Identity=44%"; Hit description =Hypothetical protein CBG11891 [Caenorhabditis briggsae]
GQLNVCLYFTFIAQAVAIRRLDTFERRAIVTDPCKRSLWMDCEYLQCCDRGKLRLGEETFWDELIDKYLKPVETTTREQAQVANGLPVETTTREQAQVANGLVALRNRIAFSIILLNCLLVLAIFLLQRHKDVLSVKFTPYDGFKWTKMGFKWTKMNETTGKFEDTTEALKVDPLGIGIIFFLMGILIVQTIGMLIHRLNTLVQTIGMLIHRLNTLVEALHELSEMKDVQYNTTFTDHIKVLNEARQMIDTVNYDRRQMIDTVNYDRAHGADGYTRHGLGDQKVQKNVLYKLQKQNNLLYLSILPCFS

SEQ ID NO: 138736 - protein, 26 aa, Heterodera glycines
  Coding regions on vcDNA: vcDNA=SeqID_65159; Strand=-; Position=1-78
MPVAFPAALFLSSSLSSCDSTAAMAE

SEQ ID NO: 138737 - protein, 250 aa, Heterodera glycines
  Coding regions on vcDNA: vcDNA=SeqID_65160; Strand=+; Position=1-753
  Homolog annotation: Hit_ID=XP_146481.3; Match level="QueryCoverage =64%, HitCoverage=13%, E-value=1e-16, Identity=36%"; Hit description =PREDICTED: similar to carboxylesterase 2; carboxylesterase ML3; acylcarnitine hydrolase M1 [Mus musculus]
MKRRWQSADEKRECTTAEDNRSNGICGNGKGIGGEAAKALADTASTSAAELSPPQVKRAKPQQKRQKFSSIEHLLREEKRRDEENGGRGEERIRRKRSIEKEEEEEGGREGVGPKSRKEGEREGHTNERYAREREEERGKIMMEEGGSGKDREEEEQRGEEGRQRMGPKRKRKGEEEEGIEREDQEGEEEEEEEEELKRKNWLRAISVPDNGSALDGLNCELENAETWSMGGGGGLGENLTLLWGELDMI

SEQ ID NO: 138738 - protein, 227 aa, Heterodera glycines
  Coding regions on vcDNA: vcDNA=SeqID_65161; Strand=-; Position=1 -93,430-561,616-1011,1074-1136
  Homolog annotation: Hit_ID=AAH77357.1; Match level="QueryCoverage =39%, HitCoverage=31%, E-value=2e-09, Identity=37%"; Hit description =Unknown (protein for MGC:81325) [Xenopus laevis] emb|CAA87093.1| homeobox protein [Xenopus laevis] sp|Q918
MEREFVANKYLSASQREKLAKEIGLTETEVKTKLQNFSSDQLDILKCAFDERKYPDIFMLEELARETGITVDQIQAWFQKRRAQHRQHKECKANDNQQKNVCENDQNYAIRIIMPQVQSQPNANGIGIDSFFCPSVCAIFGRAKCRRLNYKILKDGQQKLLATPFKPLDLAPQFKPLEGLFKKTKYPNRTECTFLAMLSNQSINQVKEWFKNRRDELERQGNEEAFW

SEQ ID NO: 138739 - protein, 267 aa, Heterodera glycines
  Coding regions on vcDNA: vcDNA=SeqID_65162; Strand=-; Position=1 -763,1156-1207
  Homolog annotation: Hit_ID=NP_500013.1; Match level="QueryCoverage =97%, HitCoverage=18%, E-value=1e-66, Identity=47%"; Hit description =predicted CDS, polyprotein family member (4B673) [Caenorhabditis elegans] gb|AAC02594.1| Hypothetical pro
TLSADGYRPTMSRIELIKDMSIPGNVKEVKSFLGKASFCRRHIKNFATIAEPFLSLSRQSVKFEWKEEQQKALEMLKKFISESPNLIFPNYFKPFHIFTDASGSGLGGVLMQKNEIGTFSAISYCSRTLSASERRWPTVQIEMCAIIYALREFRPFIFMSDIELHTDHKPLAYLLKKAETHPHLARWLVELQNYQIKIVHVAGRQNTLADALSRAAEEVPTIDGLPEMEDIVQFPICFSVSRSHIVFAPFATPTDPLSYRAKCKWSL

SEQ ID NO: 138740 - protein, 879 aa, Heterodera glycines
  Coding regions on vcDNA: vcDNA=SeqID_65163; Strand=-; Position=1 -1514,1634-2756
  Homolog annotation: Hit_ID=DAA04499.1; Match level="QueryCoverage =35%, HitCoverage=22%, E-value=4e-36, Identity=29%"; Hit description =TPA: pol polyprotein [Schistosoma mansoni]
MKDDVKLLIEACEKCQVRKIQPGQAKSAPSVPIEPSNGPFQRIHCDLMGPLKKTERGNLYIFLAIDSFSKWVMAKAIPDQKANTVSENFVEMVVHQHSTPEIVVTDQGRQFTSGIFNDLAKIYGFEHVTTTPYHQQSNGMAEGAMRIMANIISQMVNEKGNNWDEILPHAIFSYNVSIHSATKFSPFFIINLRQPKLPTDRLLKLPSPDELVSDISVYTRIQTEKAAKAWEIVRNEILKAQERNKEENDRIRKANEREFEIGDLVLFKKEVLSHKFDQRWLGPMRCVGVEKEKKNVILQSIDGRAKLRKVHQEKVKHFNGPAILPLRQSDEPLNWEKYVDDPNLEQEEIEGESCESDCEETQDNENAQSKNKMGLKVSKYGFESSDDENDWNIVAFVRENQNSEDDEGPEVIMDRNPEIEIMPIFTILEVLIEGSFTEVYTGWRDPVTISLISSIPENLVRENWEIYVNGNGSRFVMAWIFGESFEIFIVNEFDQIMLGIDAQMLKGKFGNWVWAKLCNSRDSEGMISDQDDLEEVNDFSRTDINVINYVKPFKSLLDFSNEIDEDEGNEELVENAGERERNMNNSLEILGRMENEQLNEKGRLNKSNKTQNKKYASHSFFKELDRMTSPAPLHFESLTDDEEESLRRLERRLQEQLNKVRQTLAQEQPEECHVKAREEKCIEQLKQQTVKDTVDQKGTAEKEEKSGELCEKKEPEAKKAEPEAKDRKTDEDGIVQTKMEKEKSTVEDVLSLGDEEEDSPYEAAKVFETGTSFFESAGVRANSRRELEELTKSRNEAKIKAKNELEPPALLDMPKERQNGRKRLREGSPNKGELFTNNRWDEKMREIEEVNKNSKEVRNALNGLLTMRQKIFEIQDEAQ

SEQ ID NO: 138741 - protein, 456 aa, Heterodera glycines
  Coding regions on vcDNA: vcDNA=SeqID_65164; Strand=-; Position=1 -600,643-1201,1251-1464
  Homolog annotation: Hit_ID=NP_921207.1; Match level="QueryCoverage =42%, HitCoverage=18%, E-value=3e-24, Identity=33%"; Hit description =putative retroelement [Oryza sativa (japonica cultivar-group)] gb|AAP53494.1| putative retroelement [Oryz
ITNDPRRLPSISVRLNDLLTAALVDSCASVSYCRERTARKAGLKILEQNDGKGNLTAANDSSIEILGKTMAKLRIEDNVTGNVGEWEVVLLVSVDEHCPGPLLIGLPLLMELKGVISLGEKRVRLGDEWTNIVSVIGSEKPKPPSVILENTEVLEPRSENILSAKVNECFPMEQNFLVKGIKLKYPGIIVGRTLVSPGNTVKLYGKSHLADLESVQINASPGDEIPAKDYIPPETRWSENLPKLPENGLNRPPSKRINLEGTKLSENAKNDLKKIVDECSEAFVGDDGKIGKYNGPIVHKIDLIPGSLPFHCRPYRYPPETQKEIERQIKMMLDQNIIRESESEFASPIVMVPKADKKSWRFAIDYRTLNKMTKKRVFHLPNIQEFKDLGPEQEHAFQTLKQMLTTVPVLQSPRFGRTFTIECDASKKAIGAVLLQENGPVAYISRALNRHETNYP

SEQ ID NO: 138742 - protein, 17 aa, Heterodera glycines
  Coding regions on vcDNA: vcDNA=SeqID_65165; Strand=-; Position=1-51
MLLLHLYFSTTPDRNYM

SEQ ID NO: 138743 - protein, 97 aa, Heterodera glycines
  Coding regions on vcDNA: vcDNA=SeqID_65166; Strand=-; Position=1 -156,347-483
PFVEQQRENQQVMRSLRANVVTGAHCCIGLVDLFTWFAPLLWFVLQPPVKASLWSDGGGDGHEQRQMVQRVVELMRSFGISLVRTTGADGMARFAFE

SEQ ID NO: 138744 - protein, 120 aa, Heterodera glycines
  Coding regions on vcDNA: vcDNA=SeqID_65167; Strand=+; Position=1 -186,397-573
MNPPNLLLFVLFIFSFQIHFAHSDDNVICGIASNQVLTFKYQSRKEPKEMEIKISLYAKKSGTVIFDGFITESDNLSKKQCVVIKMYRKSDEKFYKNSVNLWKKLKKVDQKNEYFVNIID

SEQ ID NO: 138745 - protein, 173 aa, Heterodera glycines
  Coding regions on vcDNA: vcDNA=SeqID_65168; Strand=+; Position=1 -65,111-424,468-610
MLKQHVEDVMKAEQYAAWHVNKVKLELKRKMALKEEIQKMVGMLHQVKHSVRMGSIGTVCFQNSLDRDIEKAEKTFGNFYSDLANAPWLPEKREIQREFKKYDDELAKFREQIAEYINAISKIKSEAELHAKLPFRTFVYALANYSRQSGKVCQLTKREQKKAKQVKVMDLKQ

SEQ ID NO: 138746 - protein, 251 aa, Heterodera glycines
  Coding regions on vcDNA: vcDNA=SeqID_65169; Strand=+; Position=1-754
MPSNSFYVILPSNTSVDGNRTNSFRVRLPLKIQFNSEWEVGLAVIVYPHSWPSIGTVEEQFVQVDWQTGSTVHIAVPTTNIKNPDDLSKSLYRLLGEGSEPLAKKARTAQLAFNNSASVARQWAKDEYIRRKTREKRAIRDEQMLLDALQTGGTDSTVDLMDAAAQGIVSREKRAESSQIPLREKMYDKDTYQNKLDNYFSTLKGEDLELLDELGRNKLNDEIANMFDEDRTILDATKELGLEAWIQAYKK

SEQ ID NO: 138747 - protein, 17 aa, Heterodera glycines
  Coding regions on vcDNA: vcDNA=SeqID_65170; Strand=+; Position=1-56
TVWGTQTYMESKNPSHN

SEQ ID NO: 138748 - protein, 61 aa, Heterodera glycines
  Coding regions on vcDNA: vcDNA=SeqID_65171; Strand=+; Position=1 -112,948-1021
MALQSVPSTNIALATICRTGHRMKSAQPQPYNQHLSYWYHKEKDQQKDGRRDENQSLCQIL

SEQ ID NO: 138749 - protein, 64 aa, Heterodera glycines
  Coding regions on vcDNA: vcDNA=SeqID_65172; Strand=+; Position=1-195
APASSTANDGTIEDEEEEEESAGGATNAKNRKNRKSRQTQQQQQKQGPKTKSNKELFNGVVERK

SEQ ID NO: 138750 - protein, 90 aa, Heterodera glycines
  Coding regions on vcDNA: vcDNA=SeqID_65173; Strand=-; Position=1 -84,140-328
  Homolog annotation: Hit_ID=EAL35225.1; Match level="QueryCoverage =81%, HitCoverage=12%, E-value=5e-15, Identity=51%"; Hit description =hypothetical protein Chro.30409 [Cryptosporidium hominis]
MEMEKEEEDRQREKTKREEEEKEEEKEEEIEKRQDKEEEKEEEDEKDEEEEEEEEEEQQIWERSRHGKKEKRVPSWRGTQLQAAKVAQLL

SEQ ID NO: 138751 - protein, 240 aa, Heterodera glycines
  Coding regions on vcDNA: vcDNA=SeqID_65174; Strand=-; Position=1 -129,647-755,1077-1561
  Homolog annotation: Hit_ID=CAE72586.1; Match level="QueryCoverage =71%, HitCoverage=33%, E-value=8e-27, Identity=36%"; Hit description =Hypothetical protein CBG19775 [Caenorhabditis briggsae]
MAILQAVDHQGIIKLDSMFETDDKTFVVMEKMDGNMLEMILGQTKLCDFGYARFIGETQFRKTIVGTPAYLAPEVLKKKDQCRCCGFDPTTAQSPSRLISEAPGLSKSQSFSKLLNFQLSFDQIEERLTIDECIGHRWLKDAQTYWDLICLEKRLGHRYLTSEAEDLIWAPQLSAMGLIQTATTTTAQQNANGCEAIETTGKCQRTEQQPIEQQRSTISMETDPQQQQGATANIVDLLGG

SEQ ID NO: 138752 - protein, 387 aa, Heterodera glycines
  misc_feature (13)..(13): Xaa can be any naturally occurring amino acid
  Coding regions on vcDNA: vcDNA=SeqID_65175; Strand=-; Position=1 -231,291-454,619-711,822-983,1142-1259,1365-1423,1547-1662,1842 -1931,2138-2236
  Homolog annotation: Hit_ID=NP_493390.1; Match level="QueryCoverage =96%, HitCoverage=50%, E-value=6e-77, Identity=40%"; Hit description =protein kinase D2 (80.9 kD) (1O232) [Caenorhabditis elegans] emb|CAB04940.1| Hypothetical protein W09C5.5
CSGRTNETNWGNXTKSLFRQTRQMVEKQLQLESSISSNGGHPTGTSAQVTASEVQLFLHDYKSFNMLTCLTSLAQLDNGSVVEIIRIDRDNGSVVEIIRIDRSEKPTKPHLLQVNTFVTPTFCDYCGEMLIGLVKQGVQCRLCKCNFHKKCALAPRNNCPSQRLCRPPFWPVPDITTAPFPSAAEAAAVLQLPHSLWPHNYRTPTVCKVCDKLLMGVFKQGLRCKDCRVNVHKKCVHLLPPNCQMNAENPLTFSTDQPNLPMGGTDQMIPLARLPGEKGATISSKRKCEGWLIHFLLQEKERRRLRHYWVLANGVISLYNEYNDGGGVNTSRVFRHIHLAEIVALIPYEGLPIDPKFAPHAFEIRTSSGLTFCVENLGALVGSLGTN

SEQ ID NO: 138753 - protein, 94 aa, Heterodera glycines
  Coding regions on vcDNA: vcDNA=SeqID_65176; Strand=-; Position=1-283
MDQGNGFYNKGEDKMTLAIDLIVKNAKVAKFTHDPSKSDATISMEIEKFSDFSREIIWSERKSESVTFIKGLPWKILAQINQLMENKCLGIYLQ

SEQ ID NO: 138754 - protein, 58 aa, Heterodera glycines
  Coding regions on vcDNA: vcDNA=SeqID_65177; Strand=+; Position=1-303
GGRCAIDLLFLREFLNLYSIPEKWLSLFLINFIHIKALAYETEGCAQSPFYFTEDFYI

SEQ ID NO: 138755 - protein, 34 aa, Heterodera glycines
  Coding regions on vcDNA: vcDNA=SeqID_65178; Strand=+; Position=1-102
KIPSKIKGLLRTALPIMLESICMCIKFIKKRDSH

SEQ ID NO: 138756 - protein, 68 aa, Heterodera glycines
  Coding regions on vcDNA: vcDNA=SeqID_65179; Strand=+; Position=1-207
MVAELKRRLRSSQMQLRPSQRRHPCHRLRLRTYRQAQEAYFCFKYLICYFISNLIIIFLILANICSVG

SEQ ID NO: 138757 - protein, 55 aa, Heterodera glycines
  Coding regions on vcDNA: vcDNA=SeqID_65180; Strand=-; Position=1-165
  Homolog annotation: Hit_ID=NP_416727.1; Match level="QueryCoverage =100%, HitCoverage=12%, E-value=2e-24, Identity=100%"; Hit description=short chain fatty acid transporter [Escherichia coli K12] gb|AAC75283.1| short chain fatty acid transpo
MPLLAATPGNPVEHIAGLIPVGDTLFSGFNIFITVALIVVMPFITRMMMPKPSDV

SEQ ID NO: 138758 - protein, 34 aa, Heterodera glycines
  Coding regions on vcDNA: vcDNA=SeqID_65181; Strand=+; Position=1 -7,208-305
MASIHLRQGQDKKRMKLMPHETRNWLCLVENILT

SEQ ID NO: 138759 - protein, 102 aa, Heterodera glycines
  Coding regions on vcDNA: vcDNA=SeqID_65182; Strand=-; Position=1 -75,135-368
MHHLGAIATSFCKYKYKFRCSTPVKFDLLHKVLSDCEPLFDAKLMQDSQRLEDFFALFCPKLKLIYPPTKKDSIGKARNPGEKNTEKSPSLISVSTLLQLDE

SEQ ID NO: 138760 - protein, 109 aa, Heterodera glycines
  Coding regions on vcDNA: vcDNA=SeqID_65183; Strand=+; Position=1-660
LPYSLYFNCALDFCSPYMLEYPKRTLEKIDFFVFGAVPPNRCAQIYGETESFRNSFPIACTLILRWIFAPHNCLSTPNGHLKKSIYFCFRGSPPEPMRPDLWGDRIFRE

SEQ ID NO: 138761 - protein, 72 aa, Heterodera glycines
  Coding regions on vcDNA: vcDNA=SeqID_65184; Strand=+; Position=1 -6,119-212,553-671
MQEQLFQRQEQMLAKIDELQKSVFALKEGQSSIVSVFEKQFSSLGTKLDDKINELMNSKTGSIGVQMVKFKI

SEQ ID NO: 138762 - protein, 158 aa, Heterodera glycines
  Coding regions on vcDNA: vcDNA=SeqID_65185; Strand=-; Position=1-476
MLSNEQQMTPSSSGTSSVTDETVGQQGQMPWHQMPEAQFGQTPTENWHQIYAEQTLYNTYPTDQNWEQSLSLDLWWQKYAQQFVAGEQIYCPSDPPNWQQSHELHQFAQQGMGGFDQFNQNDFQMQMDKAMQRQTEPEQPIDAFAPQFAEISLEELQQ

SEQ ID NO: 138763 - protein, 176 aa, Heterodera glycines
  Coding regions on vcDNA: vcDNA=SeqID_65186; Strand=+; Position=1 -100,599-695,747-768,897-1110,1350-1427
  Homolog annotation: Hit_ID=NP_509725.2; Match level="QueryCoverage =85%, HitCoverage=36%, E-value=9e-35, Identity=49%"; Hit description =neuropeptide receptor NPR1 (46.3 kD) (XK900) [Caenorhabditis elegans] emb|CAA92126.2| Hypothetical protei
LFTFSVPLSFPFPPGGHSFPSCKSANFPFLLSFARPLFLIAYLSLFFVGFVGNFLVVWVVATCKNMQTVTNVNMQTVTNVFIANLAVSDLFVCCTSIWLTPSYTFIGHWIWGAWMCYALPLFQGASIFISSLTLTAIALDRHWVGGERRGNLELTHRPPMRCLLSVFLCPMSRSFV

SEQ ID NO: 138764 - protein, 172 aa, Heterodera glycines
  Coding regions on vcDNA: vcDNA=SeqID_65187; Strand=-; Position=1 -189,537-598,643-717,798-881
  Homolog annotation: Hit_ID=NP_493175.1; Match level="QueryCoverage =97%, HitCoverage=35%, E-value=2e-40, Identity=49%"; Hit description =predicted CDS, zinc finger protein EZNF (1N119) [Caenorhabditis elegans] emb|CAB05558.1| Hypothetical pro
PSQRRQRSSGGNSLKCLYCPKKIVGGQAELQAHLEDCRMVRMHECTQCGKRFKARGGLQQHSKIHINDRPYHCRYCPKRFTQKSHLDQHERIHTGLKPFTCQYCGRQKSHLDQHERIHTGLKPFTCQYCGRQFRQRSQQLGHEARQRSQQLGHEATHMNRQRNSMGGMAMSA

SEQ ID NO: 138765 - protein, 100 aa, Heterodera glycines
  Coding regions on vcDNA: vcDNA=SeqID_65188; Strand=+; Position=1 -51,99-212,644-781
GALDGPYFRAFANYFKRFFEEYQRSANVTFWGLTLTNEPLHGQRPGMSMNSSVQRFLANGMSPKMPSPALASIGTPLPNIRTTCSHESTRFSPKNFYWPQ

SEQ ID NO: 138766 - protein, 67 aa, Heterodera glycines
  Coding regions on vcDNA: vcDNA=SeqID_65189; Strand=+; Position=1 -49,105-259
MTFWKWKKELMPNCHKSPNKYSNEEKLRKIKQYFETKEKNPKICDETKAKKLRIASDTLRIWKRNLL

SEQ ID NO: 138767 - protein, 141 aa, Heterodera glycines
  Coding regions on vcDNA: vcDNA=SeqID_65190; Strand=+; Position=1 -103,173-289,347-549
MTTLKKIDTASEDGLEGGLSLFDIPPTNVAINKSNNQFCDLNKTFLYLSTSIERKDKSNWIPITKDSEADQHVGVESYDSGIYYAFRAYMMNELGFSEDVKKGLCEASCYYVDDVDQDDYTNSGFKNRASRFADGAKCETM

SEQ ID NO: 138768 - protein, 682 aa, Heterodera glycines
  misc_feature (18)..(18): Xaa can be any naturally occurring amino acid
  misc_feature (35)..(35): Xaa can be any naturally occurring amino acid
  misc_feature (38)..(38): Xaa can be any naturally occurring amino acid
  Coding regions on vcDNA: vcDNA=SeqID_65191; Strand=-; Position=1 -531,811-1538,2170-2906,4148-4209
  Homolog annotation: Hit_ID=NP_500013.1; Match level="QueryCoverage =95%, HitCoverage=46%, E-value=1e-176, Identity=46%"; Hit description= predicted CDS, polyprotein family member (4B673) [Caenorhabditis elegans] gb|AAC02594.1| Hypothetical pr
SFPPNGHEWYNSLNPSFXIEFSISSDSVPDRSYLXNLXEEVSDIFSKSQYDLGSSTAGAHEIVTSTQEPITCKPHRTPFKYRDELKKHIEQLLKSGVMVQSDTPWVSNIVLVQKKDGGLRPCIDFRKLNEITIPDHYPLPRLETIMEKIGHCHFYSSLDLSSGYFQIPLTKEASRKCHTVSSKGYSPSLSRIEVIKNIPTPQNLKQVKRIVGMASFYRRHIPNFSTIVEPLTSLTKKEKKFIWDKAQEDALTRIKELLSQNPILTFPDYSQPFHIFTDASVVGQGAALMQKKNDLFSAVAYASRTLSAPERRWPPVQIELGAIVYALRTFKPYIYMSEIELHTDHRPLAYLQAKAQQHAHLARWLIELQNFNIKIVHISGKKNALADALSRLSDPQIPSDSQELQDIIEFPVCLSLHYCKGSPSTCFLKFGGCTELISDNATTFTSDFFKSFCSLLYINKSFSTPYWSQGNGATERTFRTFHNILSKYINPKEPNFDEFLDAATFCYNTSIHESTGESPFFLVFGRDPIFSIDQILDPSVHLPLPHNDLAEFKTLLVLSLRKAWNSAADSIKEAQNKSKVQYDKKFRNPDISIGDRVLLRNYTGKPGTSQKFHNPWKGVFRVINIEELHVTIVSCSSPQSNPFKVHINQLKKLFEISGPPSTLTTNADSTITPAAYSTEPAD

SEQ ID NO: 138769 - protein, 75 aa, Heterodera glycines
  Coding regions on vcDNA: vcDNA=SeqID_65192; Strand=+; Position=1 -176,352-400
MTETFDAIDNEIAKIEKQRQFETNLCAVSLVDHFLDAINNNEQRKKNGTMPLAQDKYFHMESLRSVCFDFYIAAN

SEQ ID NO: 138770 - protein, 66 aa, Heterodera glycines
  Coding regions on vcDNA: vcDNA=SeqID_65193; Strand=-; Position=1 -95,158-260
MGDPLDRNTKWVLSYVSDKGSYPVLGKDAEGRERMNALIVGHFDGHTFEKLFEQQMDFVGGSFAYQ

SEQ ID NO: 138771 - protein, 150 aa, Heterodera glycines
  Coding regions on vcDNA: vcDNA=SeqID_65194; Strand=+; Position=1-1216
EWVICAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHGLIFEMNTSVQAGSTR

SEQ ID NO: 138772 - protein, 19 aa, Heterodera glycines
  Coding regions on vcDNA: vcDNA=SeqID_65195; Strand=-; Position=1-60
EPVNSCIGCKCRRCCTPNI

SEQ ID NO: 138773 - protein, 151 aa, Heterodera glycines
  Coding regions on vcDNA: vcDNA=SeqID_65196; Strand=-; Position=1 -119,163-237,293-423,896-1026
  Homolog annotation: Hit_ID=CAE58487.1; Match level="QueryCoverage =85%, HitCoverage=11%, E-value=3e-48, Identity=73%"; Hit description =Hypothetical protein CBG01631 [Caenorhabditis briggsae]
MMRMMEQYANNLEKLVQERTGLLEDANKRADKLLNQLLPSYVANELKLGRSVPPKTFKTASVMFSDIVGFTTLCSSSTPLEVVTMLNTVYTGFDDLINKHEAYKVETIGEYGLADGVHWASGEDSVQRILHGGAAQALPRVQNGTTWENRY

SEQ ID NO: 138774 - protein, 136 aa, Heterodera glycines
  Coding regions on vcDNA: vcDNA=SeqID_65197; Strand=-; Position=1 -108,557-578,627-907
  Homolog annotation: Hit_ID=NP_500309.1; Match level="QueryCoverage =69%, HitCoverage=13%, E-value=5e-17, Identity=37%"; Hit description =guanylyl cyclase (gcy-23) [Caenorhabditis elegans]
MGCGESFEGVAVGADMFHQQNVKAFIGPYCNAEMDAVAIVTNTGPMAFERTQAFEEVFHQRHVTVVKKILFEENADAKMIQASGYLEDLKNSARGQWQGTEGIHWPFHWQFPLVIAIVNCHCPLPLLIAICHYQGH

SEQ ID NO: 138775 - protein, 51 aa, Heterodera glycines
  Coding regions on vcDNA: vcDNA=SeqID_65198; Strand=-; Position=1 -93,1064-1126
MALGKEGKHGDGRKAEDELKTDKRKKERMGKASVETTTARSLELMNNPKFK

SEQ ID NO: 138776 - protein, 36 aa, Heterodera glycines
  Coding regions on vcDNA: vcDNA=SeqID_65199; Strand=+; Position=1 -70,624-664
MGIPYFGRIDMIRAFIGIISIKWETGSETHQILFTC

SEQ ID NO: 138777 - protein, 62 aa, Heterodera glycines
  Coding regions on vcDNA: vcDNA=SeqID_65200; Strand=-; Position=1 -50,107-245
MNFLQSDSFSFIQGPFKERNDERNTTFDHNQLSKEAEGFKENIRSQISTRVGTDENTSLINA

SEQ ID NO: 138778 - protein, 72 aa, Heterodera glycines
  Coding regions on vcDNA: vcDNA=SeqID_65201; Strand=-; Position=1 -21,427-492,821-910,962-1003
  Homolog annotation: Hit_ID=NP_497261.1; Match level="QueryCoverage =97%, HitCoverage=27%, E-value=1e-19, Identity=62%"; Hit description =synaptotagmin (3B404) [Caenorhabditis elegans] pir||T16355 hypothetical protein F42G9.7 - Caenorhabditis
MVPDKMDKVHLSITVWDYDKMSKNDFIGEVLLSSANLQLASVSLAAQEQWNEMMLTRRPVVRWHTLQPRDKK

SEQ ID NO: 138779 - protein, 95 aa, Heterodera glycines
  Coding regions on vcDNA: vcDNA=SeqID_65202; Strand=-; Position=1-664
LFEYPKRTLEKIDFFVFGAVPPNRCAQIYGETESFGNSFPIVCTLILRWIFAPHKCLSTPNGHLKKSIFLFSGQSPRTDAPRFMGRPNPSGIASL

SEQ ID NO: 138780 - protein, 95 aa, Heterodera glycines
  Coding regions on vcDNA: vcDNA=SeqID_65203; Strand=-; Position=1-706
MFEYPKRTLEKIDFFVFGAVPPNRCAQIYGETESFRNSFPIACTLILRWIFAPHNCLSTPNGHLKKSIFLFSGQSPRTDAPRFMGRPNPSGVASL

SEQ ID NO: 138781 - protein, 84 aa, Heterodera glycines
  Coding regions on vcDNA: vcDNA=SeqID_65204; Strand=+; Position=1 -120,589-723
MALLALHRYHLRLADSGLPNMSVDQGQSVSRCFGCEVPPRGMPFQYPMGRAEKLANALLRFDCAALPNAMATSDDCLNKLRVIR

SEQ ID NO: 138782 - protein, 198 aa, Heterodera glycines
  Coding regions on vcDNA: vcDNA=SeqID_65205; Strand=-; Position=1 -103,160-461,500-610,666-746
  Homolog annotation: Hit_ID=NP_001004573.1; Match level="QueryCoverage= 96%, HitCoverage=69%, E-value=2e-45, Identity=51%"; Hit description =zgc:92353 [Danio rerio] gb|AAH81655.1| Zgc:92353 [Danio rerio]
MALSLRSKFSVLKGDITKMTTDCIVNAANSSLLGGGGVDGAIHRAAGPQLLEECRTLKGCEVGEAKITKAYNLMPNIKGRTIQRRFAHKSSKCLAIIHTVGPQIGTEVSDEQCRQLRDCYANSLSLARDNKLRSIAFPCISTGVYNFPKKEASEIAIKTVRDWLTEGQNNEKLDTVIFCVFGDDDLGFYEKNIPQFIL

SEQ ID NO: 138783 - protein, 86 aa, Heterodera glycines
  Coding regions on vcDNA: vcDNA=SeqID_65206; Strand=+; Position=1 -66,335-526
MSGFSEKLMRDRLQKLSNTAHSEVRNNSENERLISLINLANDVIQNSRKKVPSFMAAFFEVLQPAFVHASECLDESHRKMVARIVA

SEQ ID NO: 138784 - protein, 200 aa, Heterodera glycines
  Coding regions on vcDNA: vcDNA=SeqID_65207; Strand=+; Position=1 -123,340-552,602-868
MFDFPALPSSASFALSSPVAQLSHSNAVLVQDNERLNDRVGGELVHLSQFHGFPLRFICTKTTESEAIVADEEQHRILEQATDNRHTVGQARRFMLQQRQRHRQQQGSVNEVYDWVGITVFPLFALPPILLSYCQSLSSGSSSSFASSSSTFDSSFAADPTDFSLAMMRRLCIRPVARDDSEEMQVKRRRFAVSKFEWPN

SEQ ID NO: 138785 - protein, 111 aa, Heterodera glycines
  Coding regions on vcDNA: vcDNA=SeqID_65208; Strand=+; Position=1 -251,310-394
MVLLCCSQHKMDRSLPNCLRGCRCGILVGRKGKKNVPKSSGEEGKAEQSQQRNERKQNNENYYCSVEEMAYDAMYDEKMPADERDKTGTVLQRVAMALQGKAGPEQYQQFK

SEQ ID NO: 138786 - protein, 44 aa, Heterodera glycines; identical to SEQ ID NO: 126591
  Coding regions on vcDNA: vcDNA=SeqID_65209; Strand=-; Position=1 -45,128-217

SEQ ID NO: 138787 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_65210; Strand=+; Position=1-666
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 138788 - protein, 124 aa, Heterodera glycines
  Coding regions on vcDNA: vcDNA=SeqID_65211; Strand=+; Position=1 -165,439-648
MQYNAFKPRREAGQFQNFVPHFTVESPSTLLDNYVSMSTVAFGQLWNGKMGISDGLLITLYNAFKPRREAGQFQNFVPHFTVESPSTLLDNYVSMSTVAFGQLWNGKMGISDGVRSFLKIPLFV

SEQ ID NO: 138789 - protein, 79 aa, Heterodera glycines
  Coding regions on vcDNA: vcDNA=SeqID_65212; Strand=-; Position=1-391
IVKNIRKLFSLLIMQYNAFKPRREAGQFQNFVPHFTVESPSTLLDNYVSMSTVAFGQLWNGKMGISDGVRSFLKIPLFV

SEQ ID NO: 138790 - protein, 173 aa, Heterodera glycines
  Coding regions on vcDNA: vcDNA=SeqID_65213; Strand=+; Position=1 -259,313-432,478-618
QKSALPKKEFLFLGVPIEMAFIFASKDKLPTSADNTRINMNNFGIFANYFVENIKKLINSDNFDEKMNQGEMKIQQDLLDNPSCFRNKFEMDKILKEKRQLEITKEKAQERRKIVGEQEAMLRALSRNLMNERILEILSPVQKLDKNYNKKVFNENSNERLRVVLAYLELWAK

SEQ ID NO: 138791 - protein, 17 aa, Heterodera glycines
  Coding regions on vcDNA: vcDNA=SeqID_65214; Strand=+; Position=1-65
TCYEMYKNNFIILNIIL

SEQ ID NO: 138792 - protein, 136 aa, Heterodera glycines
  Coding regions on vcDNA: vcDNA=SeqID_65215; Strand=+; Position=1 -292,375-448,970-1014
MALQLLIILPLFRFYIFQQTVGQHTDKRELHRQYRLPLGVDPGTVKAHLTATGSRLTVTAAGNKATGQPPPPPAVLATHGTTFGQSIIPVKHVPASSFPITQKKQKFQVELDVQQFGPQEIDAHKEHLDLSNDSKD

SEQ ID NO: 138793 - protein, 174 aa, Heterodera glycines
  Coding regions on vcDNA: vcDNA=SeqID_65216; Strand=+; Position=1 -74,168-329,1049-1238,1290-1385
AEYGFVMADKIGTSLLEQNRELQEKNEFLEASLATSRDNVAQLKRQLEQRCDLFKKLQLQLEGMEEEEPNGTDKYHQTGSESKTRKCIRTGISGLKFSFFRVPFSGCKKDITWFEFLPGFRIGSPGNPYRTIPIHQWYRTINTKDSDELRVIAEKREEQRINEYCSRLRGANLK

SEQ ID NO: 138794 - protein, 67 aa, Heterodera glycines
  Coding regions on vcDNA: vcDNA=SeqID_65217; Strand=-; Position=1 -110,280-372
MVEGGLPLNRQYASPCEFPQTWAVSIVGECVCKDKCKQFIESLVKLANDRGVKMGMPPRVDMTKAIT

SEQ ID NO: 138795 - protein, 70 aa, Heterodera glycines
  Coding regions on vcDNA: vcDNA=SeqID_65218; Strand=-; Position=1-212
MEFHNIPTLIFGFCFHLSHVFDILSRVPRDRDRAGNSRSSEVPVPGPGFLKAQVPVPVPVGQPGTEKNKH

SEQ ID NO: 138796 - protein, 21 aa, Heterodera glycines
  Coding regions on vcDNA: vcDNA=SeqID_65219; Strand=+; Position=1-67
VRLGTQQIWGAKIQRRIKYRL

SEQ ID NO: 138797 - protein, 107 aa, Heterodera glycines
  Coding regions on vcDNA: vcDNA=SeqID_65220; Strand=-; Position=1 -109,226-287,344-496
MEEEGAEIDGQQRRDGIASQMPIIRMVYMEQQQQNIEAINSANEQQSLEELERELEELGIEEANLAKSEAEEGERSAQLTVELEQLDNEEQEQQKAYETHGTELVKN

SEQ ID NO: 138798 - protein, 39 aa, Heterodera glycines
  Coding regions on vcDNA: vcDNA=SeqID_65221; Strand=+; Position=1-117
MGCNEALSPGDFSEHANFARLCRWHGLDGLLSAMSRGPK

SEQ ID NO: 138799 - protein, 59 aa, Heterodera glycines
  Coding regions on vcDNA: vcDNA=SeqID_65222; Strand=+; Position=1-182
SSLPKILRLPNSIGFTVCGFGLSIGAFIVGALLLDGPMYAYTEWVQQRTDKGTEKQKVE

SEQ ID NO: 138800 - protein, 188 aa, Heterodera glycines
  Coding regions on vcDNA: vcDNA=SeqID_65223; Strand=-; Position=1 -466,641-741
MTCKSQNIQSDQRELKRKAKVALDLLEIGLVAYALQDSESWKKAKTAMNVLGNVLLAESLATVKKENKNSPDSPVAQNIAQPKAAPQKETTKKREASEEKKDPTKSHLDSASTQIDDVSVPKADKKPKSNNEEEDVGDIDKTLDEFFASIKAATTACLYTVLFWGNEFAVPALQRAGVAVYLASLLKN

SEQ ID NO: 138801 - protein, 84 aa, Heterodera glycines
  Coding regions on vcDNA: vcDNA=SeqID_65224; Strand=-; Position=1 -44,162-372
MGGYCGVSFSALSKGIKMPSPSGLPWLPVENCQCPILDNECIRPLNYTKPVICAHKSIKNLLDFVASPGEEHPGTHNHLPIYFF

SEQ ID NO: 138802 - protein, 213 aa, Heterodera glycines
  Coding regions on vcDNA: vcDNA=SeqID_65225; Strand=+; Position=1-640
  Homolog annotation: Hit_ID=XP_345024.1; Match level="QueryCoverage =99%, HitCoverage=88%, E-value=1e-22, Identity=27%"; Hit description =similar to SPAC23A1.17 [Rattus norvegicus]
LNPPAFQSLGLNPPAFQSLGLNSPAFQSLGLNSPVFQSLGLNPPTFQSTGLNPPAFQSLGLNPPEFQSLGLNPPAFQSLGLNPPTFQSLVLNPTAFQSLGLNPPAFQSLALNPPAFQSLGLNSAFQSLALNPPAFQSLGLNPPAFQSLGLNPPAFQSLGLNPPTFQSLVLNPTAFQSLGLNSPAFQSLRLTPPTFQSLGLNPPAFQSLGLTPP

SEQ ID NO: 138803 - protein, 62 aa, Heterodera glycines
  Coding regions on vcDNA: vcDNA=SeqID_65226; Strand=-; Position=1 -42,259-403
MHDNVMGNLATLLKALSDKGTLLDSCIVKGFTRLYAVLADLYLDLPAAFALAQLWIKKSLKA

SEQ ID NO: 138804 - protein, 46 aa, Heterodera glycines
  Coding regions on vcDNA: vcDNA=SeqID_65227; Strand=-; Position=1-141
VDELSKDVPKLCDTLAVLIAKLVEQNIVTSNVISFLAYKNSDGKES

SEQ ID NO: 138805 - protein, 62 aa, Heterodera glycines
  Coding regions on vcDNA: vcDNA=SeqID_65228; Strand=+; Position=1-212
LFFSFITQRSRLIRCSPNFAGKLLRTLQMLINFLRIFCLEEHSSSHLPHQHYFFLIIFFILS

SEQ ID NO: 138806 - protein, 108 aa, Heterodera glycines
  Coding regions on vcDNA: vcDNA=SeqID_65229; Strand=-; Position=1-658
STGYREAIPEGFGLPINLGASVRGDCPENKKIDFFKCPFGVLKQLWGAKIQRRIKVEVYRSYSRRIRSPHKSGRIGSGGLPRKQKNRFFQVSVWGTQTIMGSKNPTQN

SEQ ID NO: 138807 - protein, 18 aa, Heterodera glycines
  Coding regions on vcDNA: vcDNA=SeqID_65230; Strand=+; Position=1-56
YREAIPEGFGLPINLGAS

SEQ ID NO: 138808 - protein, 113 aa, Heterodera glycines
  Coding regions on vcDNA: vcDNA=SeqID_65231; Strand=+; Position=1 -22,279-598
MEFFEKIVPSGVLTQQEVTSVEQYCSKPKICGGTSGGIPYPLKFPCHERNLTFGKIVMEIENVSKFAHEKMWHIRCSKFVHISGIPWRIVAKINTNEALAFYLQCDVSMKGSH

SEQ ID NO: 138809 - protein, 119 aa, Heterodera glycines
  Coding regions on vcDNA: vcDNA=SeqID_65232; Strand=+; Position=1-360
MSESERVVFNLRIGVPSLKKVMSSSFWLLAQFKMAHFLLTLCLTFALLAHCVSAKRRPGLRTWDFEAKPGMDNSVGKAKDEQDEDEEKEPKADDGVGDKAVTDPIPPFKISSTTRQAKI

SEQ ID NO: 138810 - protein, 96 aa, Heterodera glycines
  Coding regions on vcDNA: vcDNA=SeqID_65233; Strand=+; Position=1-817
LFEYPKRTLEKIDFIFVFGAVPPNRCAQIYGETESFGNSFPIACTLILRWIFAPHNCLSTPNGHLKKSIFLFSGQSPRTDAPRFMGRPNPSGIASL

SEQ ID NO: 138811 - protein, 45 aa, Heterodera glycines
  Coding regions on vcDNA: vcDNA=SeqID_65234; Strand=+; Position=1 -18,1058-1177
MRSKFMISVPDGVVYEGHRPSGLFSVGVLELGNDYGGESRDCFHR

SEQ ID NO: 138812 - protein, 76 aa, Heterodera glycines
  Coding regions on vcDNA: vcDNA=SeqID_65235; Strand=+; Position=1 -96,171-305
MDKQTFGGDSSANSAAEDKMSGCCSEHIVEIEWKHFDYLSALSGLYTASVERRKCNLLVLVQGNLDNLEGKMVEMN

SEQ ID NO: 138813 - protein, 110 aa, Heterodera glycines
  Coding regions on vcDNA: vcDNA=SeqID_65236; Strand=+; Position=1 -124,308-380,493-538,797-883
MPPNTLFDQCVSVGFSVDGPGVGVDPLHFDNPRNCRKHQRDSQFGPNPKALRGLAEVGDEPTQFEPVDVLLVSGAKAPHNENMMHMFKNMANDRTGLLMAEDCVDVLSEA

SEQ ID NO: 138814 - protein, 55 aa, Heterodera glycines
  Coding regions on vcDNA: vcDNA=SeqID_65237; Strand=+; Position=1-166
NLGPLHCFHPNCCAECESTGAGKNCKEAGSRPMSGHVGAPSSSRKKETLKRSVAS

SEQ ID NO: 138815 - protein, 81 aa, Heterodera glycines
  Coding regions on vcDNA: vcDNA=SeqID_65238; Strand=+; Position=1 -36,788-997
MHLQENQNIKHKLLLNLCQWARIADGVLFRAEAEPEHQPMRYAKFGGPVPQKTSAFECAVSRGGPVQLPSEQRTKGGDLGF

SEQ ID NO: 138816 - protein, 101 aa, Heterodera glycines
  Coding regions on vcDNA: vcDNA=SeqID_65239; Strand=+; Position=1 -129,186-362
  Homolog annotation: Hit_ID=CAE66400.1; Match level="QueryCoverage =81%, HitCoverage=6%, E-value=9e-30, Identity=74%"; Hit description =Hypothetical protein CBG11664 [Caenorhabditis briggsae]
MEQDMLLLGATAIEDKLQDGVPQTIATLAAANIKIWVLTGDKTETAINIGYSCRLLTEEMREVFIIDGKEEKEVEVQLKDTRRRICSAKQTQQAKEMKREK

SEQ ID NO: 138817 - protein, 98 aa, Heterodera glycines
  Coding regions on vcDNA: vcDNA=SeqID_65240; Strand=+; Position=1 -19,134-240,486-656
MARRRDDQKGKEGGKDGESNGQTVQEHFAFGDLEYWGNETETNFPMPDGVDKFTKIASMNAELVALADNGQLYAWTWAKGSVPSNVPHVVNSQFAITG

SEQ ID NO: 138818 - protein, 128 aa, Heterodera glycines
  Coding regions on vcDNA: vcDNA=SeqID_65241; Strand=-; Position=1 -141,640-885
MEQERKARQKAAKKAGGGVVKKQSKKLATTNPLSSIEALAKRVAKDEDNYNANQFLVDSLPEVPGATTENSDTKAGARANAKSVRSFAAEVRRTIENADIVIEVNIGGKKDLNLSDCFHLDLGFFLPK

SEQ ID NO: 138819 - protein, 387 aa, Heterodera glycines
  Coding regions on vcDNA: vcDNA=SeqID_65242; Strand=+; Position=1 -320,1049-1362,2685-3214
  Homolog annotation: Hit_ID=NP_509377.1; Match level="QueryCoverage =69%, HitCoverage=51%, E-value=1e-29, Identity=32%"; Hit description =predicted CDS, reverse transcriptase like family member (XI784) [Caenorhabditis elegans] gb|AAB37984.1| H
MEHLTDAPPWASAMLGLVNQMVGMCRELISMVREQDGGSNPNSVFDEERRLHSVVIAQLQESNSQTPTQRATDDLANVKELMDHCDIECLPTQVYRMGKKQADGRPRPPNTSANFTKKILNLNFIIMGDFNLNAKDITWTSGTPYAKSEKGNIFCEFFNKYGLFLMTNGPTRGSAWLDLILSSKPDFVNNVLIEDIFSSDHLTTNFSLSFPILEDWYDSIYGKKNIDCIYVDFRKAFDSLPINILINKLHNIGIKGKLLSWLSEFLRDRSYRVKINNKSSNLHPIQSGVPQGSVLGPLLFLIYINDLPQVIPSVVSIKLFADDVKIYVSYKTRDERSKLNIALENIGKWANAFGLNISQNKTFIQNNNINYLTILLMRLNLLVIWAF

SEQ ID NO: 138820 - protein, 82 aa, Heterodera glycines
  Coding regions on vcDNA: vcDNA=SeqID_65243; Strand=+; Position=1 -9,105-344
MALCPYLPALASVKYTRWLTVSSARWSSSARSMFTNTNGLPPSMSARATFVATPPLPWSSQNSRPRSESTAMAMGCATAVGV

SEQ ID NO: 138821 - protein, 82 aa, Heterodera glycines
  Coding regions on vcDNA: vcDNA=SeqID_65244; Strand=-; Position=1-246
PLSVAQPMPMSTIPLQPMYPMQQHIYGPLGPDKNDATKPGTTPTPTRTECGTATGATSHASVECAMATGAAATSDATERNAR

SEQ ID NO: 138822 - protein, 92 aa, Heterodera glycines; identical to SEQ ID NO: 125147
  Coding regions on vcDNA: vcDNA=SeqID_65245; Strand=+; Position=1-304

SEQ ID NO: 138823 - protein, 55 aa, Heterodera glycines
  Coding regions on vcDNA: vcDNA=SeqID_65246; Strand=-; Position=1 -12,222-377
MGVLSADWGTQTIMGSKNPTHNYSTGYREAIPEGFGLPINLGALGSEGLSRKQDN

SEQ ID NO: 138824 - protein, 64 aa, Heterodera glycines
  Coding regions on vcDNA: vcDNA=SeqID_65247; Strand=-; Position=1-3,50- 241
MARKSFRFCKANKACNEPYARTIWILLTKKKVIIQRRAGAQLSESVTNNAKKSLTINFSLSSLW

SEQ ID NO: 138825 - protein, 137 aa, Heterodera glycines
  Coding regions on vcDNA: vcDNA=SeqID_65248; Strand=-; Position=1 -106,319-415,1226-1436
MQKVFKLKTPFISIYIARFIQCLFYYAGHKIWSFAAQGLIEKIVNKNKVCLMNIYINKLMTISKKKVKFERARRALHIQTYQLRAYRHSQARYGQSKQSVTHNHEALLQNSCNVSRQIFVIIFFTDFFYLYAYALFV

SEQ ID NO: 138826 - protein, 90 aa, Heterodera glycines
  Coding regions on vcDNA: vcDNA=SeqID_65249; Strand=+; Position=1-273
MAILLKPTKLPMPFGVTMTQFWPIAPGFLGIYLVAFKEIKKEGIEFVIAALINSSSASKCAFISVSALSNCSNCSRDSLALYTLTNESFF

SEQ ID NO: 138827 - protein, 62 aa, Heterodera glycines
  Coding regions on vcDNA: vcDNA=SeqID_65250; Strand=-; Position=1-755
CQKLIENINLYSGYSSVKNDATLAIRPRKRALSNGTFKSKNDCQGAELQKKIPSQGQATIAV

SEQ ID NO: 138828 - protein, 94 aa, Heterodera glycines
  Coding regions on vcDNA: vcDNA=SeqID_65251; Strand=-; Position=1 -21,1962-2225
MTDQSLQGRVGGFKRERENGFEWLFKWFFYRLFQRGGGVPGTDERQKTEEQPRDQWSKIGEYFFYGINGERRRLRGRGHGKGGKNGKIPLERTI

SEQ ID NO: 138829 - protein, 478 aa, Heterodera glycines
  Coding regions on vcDNA: vcDNA=SeqID_65252; Strand=+; Position=1 -67,144-269,325-434,543-695,757-895,970-1320,1388-1530,1587-1934
  Homolog annotation: Hit_ID=CAF92976.1; Match level="QueryCoverage =43%, HitCoverage=42%, E-value=5e-26, Identity=33%"; Hit description =unnamed protein product [Tetraodon nigroviridis]
MNTSDVFEAMFRFDSQNGKAENANCPVVEVPDIEPTTFKLMLKYIYVADFSELNGENAMAVLYAAKKYNIPALVDRSLQIPISELRNVFMAYAYACLFELKDFANKCLSYICQNAAHLFKSDDFLEIDQKIFCVLLDLDRLLLSNEFEIWKTALRWADEKCRQNGIECSSDNRRSVLGPALFKIRFPNIPEEDFSKFVVPSGLLTVEEVFGVYQFNSHPNLYLRGVPELYSLKFPSHGRISDWNTAKRNGRGTLALEIEKVSEFAGESVGGYRCSDTVYINGLAWNIQAEIREGTAADDEKKYLGFFLWYERTKHEKPLNCLFSATFRIVSEKSETENSIGTLCDYNNQMNSSWGFGNFISFEEVVNPINGYYNREEDKVTLTIDVMTVDEPKMDKFILGQNKSTGTLFMEIEKASEFGREVFGSDRKSETVHINGLPWKILAKIQTKNGSVDNEKWLGIYLSCGAPEKGVNELPIIA

SEQ ID NO: 138830 - protein, 66 aa, Heterodera glycines
  Coding regions on vcDNA: vcDNA=SeqID_65253; Strand=-; Position=1 -106,368-462
MILPDNILFITLIKKFFRRAGRTDLYGFEFVGKMLVDQSGEEIESDPIDQFTDNSDQNIAKREGGK

SEQ ID NO: 138831 - protein, 26 aa, Heterodera glycines
  Coding regions on vcDNA: vcDNA=SeqID_65254; Strand=+; Position=1 -58,393-415
MPITNLTSISNCEFDKRCKCHHEGVI

SEQ ID NO: 138832 - protein, 132 aa, Heterodera glycines
  Coding regions on vcDNA: vcDNA=SeqID_65255; Strand=-; Position=1-396
MKFDQFALVIFLDKTDQSKFDQRRENERDADKEPKINCLRQIWPFLEEFKNKRDFDERNAGQIFHDISELESQCHETEVKQNDGKRNGKRTENERPGHAESDPGGECTTVQPKGDPADTGGIKQTHLNHLDK

SEQ ID NO: 138833 - protein, 250 aa, Heterodera glycines
  Coding regions on vcDNA: vcDNA=SeqID_65256; Strand=+; Position=1 -139,585-647,705-771,820-1151,1294-1367
  Homolog annotation: Hit_ID=NP_494951.1; Match level="QueryCoverage =95%, HitCoverage=44%, E-value=3e-52, Identity=51%"; Hit description =GABA/Glycine Receptor subunit (ggr-3) [Caenorhabditis elegans] gb|AAA68348.1| Gaba/glycine receptor famil
CVHPEFVGLGFSGAWDQLKVTFHFKRLYGYYVLQMYLPTYLSVFISWIAFWLDSRALPARITLGVSSLMALTFQFGNVVLMALTFQFGNVVKNLPRVSFVKAIDLWFFVCVSFIFAIDLWFFVCVSFIFSSLVELALVGFVEKNHERKLVKFHRERLSRRNPHKHSTGISLFWNFKISFLSSKPRNSLALPTTTLNNNSQNDDQIRNGEVVRSGSLLKRVYSRRYTTELSNRVDAVAARLFPALFALFNG

SEQ ID NO: 138834 - protein, 92 aa, Heterodera glycines; identical to SEQ ID NO: 125147
  Coding regions on vcDNA: vcDNA=SeqID_65257; Strand=-; Position=1-304

SEQ ID NO: 138835 - protein, 78 aa, Heterodera glycines
  Coding regions on vcDNA: vcDNA=SeqID_65258; Strand=-; Position=1-234
MIGRAVRNRPFIFEGIFKFILYPRKMAISFFEKFYTSQKRLRMRRRAVHNRHFIFERIFIYIRYPRKMAISFFEKFYT

SEQ ID NO: 138836 - protein, 48 aa, Heterodera glycines
  Coding regions on vcDNA: vcDNA=SeqID_65259; Strand=-; Position=1 -46,81-181
MPMSSKAFSTFYIGKEEFVRNEHFPCIVKEWSEKGRYVEHLRRNSCIS

SEQ ID NO: 138837 - protein, 42 aa, Heterodera glycines
  Coding regions on vcDNA: vcDNA=SeqID_65260; Strand=+; Position=1-128
MEIMTSKTLNEPTSFNVNGRVHRPEDGAEQNHQTMHGAADAS

SEQ ID NO: 138838 - protein, 66 aa, Heterodera glycines
  Coding regions on vcDNA: vcDNA=SeqID_65261; Strand=+; Position=1-250
FLNFSLYQKTTIITRQSIVHNPETINLWMLKLLHICQSFFSTVGAKSVAKFQFHQPSSQPHQSLNC

SEQ ID NO: 138839 - protein, 94 aa, Heterodera glycines
  Coding regions on vcDNA: vcDNA=SeqID_65262; Strand=-; Position=1 -75,289-498
MALLINGTDKHYDNAYREDSYITLQINWPRYLKNILPNEVISRRYSEAIGTVKVRIAEVQLIKVGANLATQLAQNEMFSEIRKIGTESVGTNTQ

SEQ ID NO: 138840 - protein, 81 aa, Heterodera glycines
  Coding regions on vcDNA: vcDNA=SeqID_65263; Strand=-; Position=1 -139,650-756
MANLDRLEAKNVTIFIPELHFSSQNGVIEMSSFNITADFLEVNSAEAILDDRAHFHALPPYDRMMFAMFDACMVTIVSPFC

SEQ ID NO: 138841 - protein, 42 aa, Heterodera glycines
  misc_feature (6)..(6): Xaa can be any naturally occurring amino acid
  Coding regions on vcDNA: vcDNA=SeqID_65264; Strand=+; Position=1-179
LRIGNXQRPLMARVDVTRGITYDLLKAISSSCNNNKRGDSNK

SEQ ID NO: 138842 - protein, 98 aa, Heterodera glycines
  Coding regions on vcDNA: vcDNA=SeqID_65265; Strand=+; Position=1-297
MPLSSPADAIAIVAFVLKPTPYIEEFLHRLSLLEYPDKNSRVNLRIYNNQMYKKRHFETWAKRRSGKKKTIWDCANFEWHGKGQTKIPAEAGAVKFEI

SEQ ID NO: 138843 - protein, 50 aa, Heterodera glycines
  Coding regions on vcDNA: vcDNA=SeqID_65266; Strand=+; Position=1 -43,99-208
INFATSQVILQHVQLRLGRPIAMQNERVGVVQKIFKHDKIFAVFVGLVEK

SEQ ID NO: 138844 - protein, 53 aa, Heterodera glycines; identical to SEQ ID NO: 126655
  Coding regions on vcDNA: vcDNA=SeqID_65267; Strand=-; Position=1-159

SEQ ID NO: 138845 - protein, 183 aa, Heterodera glycines
  Coding regions on vcDNA: vcDNA=SeqID_65268; Strand=+; Position=1 -28,161-252,345-450,500-596,659-885
MEMEQKKQEVSTDKIEHLQNEQKRNINALEKELKKNQMEIALLKFRQNCWDANNSHNNIDIIDDKCLAVNHKENESEFCKIFATHPILFDKDFSKIFYFEIEIKKMQNSFDNFLSFGFSTKQQKNVDEINTYSYCNHGFFIINAEYHYQEAQQDDSFKENDVVGCGINSATRQVFFTKNGRRQ

SEQ ID NO: 138846 - protein, 107 aa, Heterodera glycines
  Coding regions on vcDNA: vcDNA=SeqID_65269; Strand=+; Position=1 -69,124-378
MIRILCSFQQPLVGLDVLNPEEMITPGLDRELVQDMFRSLSMLHLQQQLLATKSKSGGSRSVERPTKALFPPNDSMAQSDELSERVTNLMETLRPMLTQALANCFLD

SEQ ID NO: 138847 - protein, 61 aa, Heterodera glycines
  Coding regions on vcDNA: vcDNA=SeqID_65270; Strand=-; Position=1-185
  Homolog annotation: Hit_ID=BAD35374.1; Match level="QueryCoverage =98%, HitCoverage=38%, E-value=7e-20, Identity=64%"; Hit description =putative glycine-rich cell wall structural protein [Oryza sativa (japonica cultivar-group)]
MNGGVAAGGGGGGGAGGGGGGGGGVGNGGGAANGGGAGNGGGNGGGAGSGGGFGGGSGNGQ

SEQ ID NO: 138848 - protein, 52 aa, Heterodera glycines
  Coding regions on vcDNA: vcDNA=SeqID_65271; Strand=+; Position=1-310
QKNGRKLFSFFSASINCLSVKQNKYILFIKIKTISSKQLDWPIYVCLTVNPG

SEQ ID NO: 138849 - protein, 82 aa, Heterodera glycines
  Coding regions on vcDNA: vcDNA=SeqID_65272; Strand=-; Position=1-249
MNGNCTDRSYMKTCLDPVSKQYTNSLAIISFHYRITTLCPCPNAASLAQKCAPQSLPASTFPFRSVAAAVAACKLRMESDCR

SEQ ID NO: 138850 - protein, 131 aa, Heterodera glycines
  Coding regions on vcDNA: vcDNA=SeqID_65273; Strand=-; Position=1-395
  Homolog annotation: Hit_ID=EAK82978.1; Match level="QueryCoverage =100%, HitCoverage=89%, E-value=1e-48, Identity=49%"; Hit description= hypothetical protein UM05104.1 [Ustilago maydis 521] ref|XP_402719.1| hypothetical protein UM05104.1 [Ust
GNGGGKGNGGGKGNGGGDGGGRGNGGGGGNEGGGIGNGGGSGNGGGGGEGGGAGRGTGSGDGGGGGDGGGNGGGKGNGGGIGNGGGDGGGIGNGGGKGNGGGDGGGIGNGGGSGNGGGGGESGGAGKGTGS

SEQ ID NO: 138851 - protein, 212 aa, Heterodera glycines
  Coding regions on vcDNA: vcDNA=SeqID_65274; Strand=-; Position=1 -294,341-460,509-646,950-1036
  Homolog annotation: Hit_ID=XP_312968.1; Match level="QueryCoverage =98%, HitCoverage=43%, E-value=1e-39, Identity=37%"; Hit description =ENSANGP00000023014 [Anopheles gambiae]
MANILLSHTFESMPFNGVDELLQILGDIINGFNVPLKEEHRQFLFRVLLPLHKSPALPMFFSKLAYCVMLFVEKDASLAKPAIKSLLRNWPSKSGIREILFITELDEILSQVGEDQFRAIMKPLVGRLVRCTTSQNARLAERALLLWKSPKMLTFLKDNQLAFPEAIRAIDKAQRHWSSGVIAMKMTICLSAPYSSSRHQFKLIQQKFQSLK

SEQ ID NO: 138852 - protein, 114 aa, Heterodera glycines
  Coding regions on vcDNA: vcDNA=SeqID_65275; Strand=-; Position=1 -64,107-318,1268-1336
MANFGHKIKKCQKFLLLYTALVFGYRTLFLHFPPIFLFTVNAMHSENGRLCLGHPSALDQEAGRLAEEVQNWHAWGGKSGGNALQCAPVVRKGFYLFLSVRNALILEGSDTVWF

SEQ ID NO: 138853 - protein, 30 aa, Heterodera glycines
  Coding regions on vcDNA: vcDNA=SeqID_65276; Strand=-; Position=1-90
MGAKSTAELGTDYREAIPEGFGLPINLGAS

SEQ ID NO: 138854 - protein, 334 aa, Heterodera glycines
  Coding regions on vcDNA: vcDNA=SeqID_65277; Strand=+; Position=1-1005
  Homolog annotation: Hit_ID=AAG00554.1; Match level="QueryCoverage =96%, HitCoverage=60%, E-value=3e-19, Identity=25%"; Hit description =retinitis pigmentosa GTPase regulator-like protein [Takifugu rubripes]
MVPKPPEGVAEKERIGTNEERGETESTDNGNNGQMHLNAFKGQRKVIGEGAGGSDQLDIPTLSERTDELREEKQTEAESQTTEERQTRAEKHTKVPFEEEGKTQPKTAEEAKSRTDQRDTGVQLVDEGARSRDLEKPKETASKVSSPMKRMAVQENSWEFHKKFAERLVNKTAKDEEEMGTDEKRKEEEEEEKRSEREEEKEEESVTTEESQQRERRERQSNLNTTPAFGEVFKGRNDQQQLEEEEEKEGEEEEGVWEDKQKEKWVGRRDEESEPKCEERPKEGHMAQMPAEIEVEEENPAEMFDSPPLDEMTTDESSSSAGEETPIVVRRERI

SEQ ID NO: 138855 - protein, 100 aa, Heterodera glycines
  Coding regions on vcDNA: vcDNA=SeqID_65278; Strand=-; Position=1-745
LFEYPKRTLEKIDFFVFGAVPPNRCAQIYGETESFGNSFPIACTLILRWIFAPHNCLSTPNGHLKKSIFLFSGQSPRTDAPRFMGRPNPSGIASLFRLIL

SEQ ID NO: 138856 - protein, 141 aa, Heterodera glycines
  Coding regions on vcDNA: vcDNA=SeqID_65279; Strand=+; Position=1 -209,263-479
MSRCSSVQSSGPEFSSNVSVESAIFDDNEKMEQDQNEGKASDDKDRTMVANGEGMDTAIVKEEGATTSNGFKLELRQQRQNAHSQQQLNVPLHLNSSDPSLSDMAKPLANLQHQSAFQTSPAFPFPFGQNSFIQPPFNRFF

SEQ ID NO: 138857 - protein, 187 aa, Heterodera glycines
  Coding regions on vcDNA: vcDNA=SeqID_65280; Strand=+; Position=1 -150,659-1072
MAEAIEKLRLSVVQLKNNGTQKRQECAKLSQAIASVGGEGTANAGTNHANLAEFKDCRANASEKVIQMETIRESIGDKAEQVKQLEQLIAATGRELPETERQLRAMERSKKAKCESAKAIWPFLFKELEMTVQQNLRKMTLDVDSINATLDKITEMGESNERDRLSMFATPTDFREMVTHPFGDKIN

SEQ ID NO: 138858 - protein, 108 aa, Heterodera glycines
  Coding regions on vcDNA: vcDNA=SeqID_65281; Strand=+; Position=1 -32,385-679
MNPQQIWTRISKMIEGEQNNRRSGNREEDEMELNRSLQLIVITYVRRLVEHLHLACRPEYIYSMAKDENGVSHIKAHRQISAAGDGDDELEMCLLEPKNFEKHSISSH

SEQ ID NO: 138859 - protein, 91 aa, Heterodera glycines
  Coding regions on vcDNA: vcDNA=SeqID_65282; Strand=+; Position=1-816
LFEYPKRTLEKIDFFVFGAVPPNRCAQIYGETESFGNSFPIACTLILRWIFAPHNCLSTPNGHLKKSIFCFRGIPPEPMRPDLWGDRIPRE

SEQ ID NO: 138860 - protein, 216 aa, Heterodera glycines
  misc_feature (9)..(9): Xaa can be any naturally occurring amino acid
  misc_feature (91)..(91): Xaa can be any naturally occurring amino acid
  Coding regions on vcDNA: vcDNA=SeqID_65283; Strand=+; Position=1 -417,462-658
  Homolog annotation: Hit_ID=AAO85452.1; Match level="QueryCoverage =88%, HitCoverage=35%, E-value=5e-39, Identity=49%"; Hit description =putative gland protein G12H04 [Heterodera glycines]
DETEGRCEXKTNGICQNAKKSWERLRQRIVRFATTFERRTKPNGNVFNLFGRKKREGAGRKKETEHRKFSQFGEAGLRVCDKNGRTSKKRXQTGREGGDQAVPGEGSGHCGRKQKGGEIGLCLVLGTAVLDKQMDRGIRKSGDGSQTRTGTIRKSGDGSQTRTGTTVRILKNGNGRLQGAEGRGGQMRGEVGQTEGMDRRLFQVKMEMTNHPIHTA

SEQ ID NO: 138861 - protein, 32 aa, Heterodera glycines
  Coding regions on vcDNA: vcDNA=SeqID_65284; Strand=-; Position=1-96
MVFISTAKSLPLVTYNFNQPIQLLRLLKMNPR

SEQ ID NO: 138862 - protein, 88 aa, Heterodera glycines; identical to SEQ ID NO: 124691
  Coding regions on vcDNA: vcDNA=SeqID_65285; Strand=-; Position=1 -96,135-305

SEQ ID NO: 138863 - protein, 67 aa, Heterodera glycines
  Coding regions on vcDNA: vcDNA=SeqID_65286; Strand=+; Position=1-204
MLLLLLLLLDMLLLLLLLLLLVRVPLDAHYHLLNGQWNPGENLVLNQKFGCCHVMTHHYQGYPFCIA

SEQ ID NO: 138864 - protein, 269 aa, Heterodera glycines
  misc_feature (177)..(177): Xaa can be any naturally occurring amino acid
  Coding regions on vcDNA: vcDNA=SeqID_65287; Strand=-; Position=1 -39,1418-1496,1532-1749,1786-1912,1971-2085,2144-2195
  Homolog annotation: Hit_ID=CAG00553.1; Match level="QueryCoverage =93%, HitCoverage=64%, E-value=3e-40, Identity=39%"; Hit description =unnamed protein product [Tetraodon nigroviridis]
INLGAYVKICDGTIRFCMRCACIKPDRCHHCSTCGRCFLKYDHHCPWVRLYFRRIQSIDSFSLLKYDHHCPWVRLYFRRIQSIDSFSLYQINACIRFNNYKFFVQFVGYAWLLSVFIFSTIFPFLCVSFFPIFLPDEVCRILVTFLFVLDEVCRILVTFLFVLMFLLGLSLTFFLTXHLCLISKNRTSLGESPVFTYGEDKRAFPVFTYGEDKRAFDLGIRRNFHEVFGTVKWKWFFPLFSSQGDGVRFERRQGDGVRFERREEVQAVA

SEQ ID NO: 138865 - protein, 134 aa, Heterodera glycines
  Coding regions on vcDNA: vcDNA=SeqID_65288; Strand=+; Position=1 -58,1587-1716,2044-2261
  Homolog annotation: Hit_ID=XP_421743.1; Match level="QueryCoverage =97%, HitCoverage=10%, E-value=4e-46, Identity=66%"; Hit description =PREDICTED: similar to hSLK [Gallus gallus]
LYILKAKNGIFPNNSRISIADFGVSAIKNNERRDSFIGTPYWMAPEVIICETFKDRPYDCRADIWSLGITCIEMAQMEPPNYNMNPMRVAFKVQKSEPPTLEQPHKWTTEFSDFLLKCLVKKVDERWGASQLLM

SEQ ID NO: 138866 - protein, 91 aa, Heterodera glycines
  Coding regions on vcDNA: vcDNA=SeqID_65289; Strand=-; Position=1 -105,395-565
MRRGRKSTRARTCVHEATHGWILWKTKDCSDTFEMLKVRKKPGRLNNGYCSYFTTKWYTRPELKGKLLMTMGGRATEEVLWAFNWTSFGQS

SEQ ID NO: 138867 - protein, 187 aa, Heterodera glycines
  misc_feature (4)..(4): Xaa can be any naturally occurring amino acid
  Coding regions on vcDNA: vcDNA=SeqID_65290; Strand=-; Position=1 -146,1461-1575,1724-1838,1881-2020
  Homolog annotation: Hit_ID=NP_501418.1; Match level="QueryCoverage =93%, HitCoverage=34%, E-value=3e-54, Identity=61%"; Hit description =SQuashed Vulva SQV-1, UDP-glucuronic acid decarboxylase (52.7 kD) (sqv-1) [Caenorhabditis elegans] gb|AAA
KINXLKKHLNLARYALSANQTEMSKRERPFGHSKAKNEARPLQQAKSYPPVRQRNEAQRKRILITGGAGFVGSHLVDRLMTDGHEVIALDNFFTGRKGNVERWVGHPNFELVHHDIVNPFYSEVDQIYHLASPASPPHYMYDQIYHLASPASPPHYMYNPVKTLKTNIVGTINMLGLARSAQQVPPP

SEQ ID NO: 138868 - protein, 26 aa, Heterodera glycines
  Coding regions on vcDNA: vcDNA=SeqID_65291; Strand=+; Position=1-79
MDNSDIELKLFRQSLPNVLGAFAINS

SEQ ID NO: 138869 - protein, 66 aa, Heterodera glycines
  Coding regions on vcDNA: vcDNA=SeqID_65292; Strand=-; Position=1 -131,1149-1218
MPVLPVKFDQRLLFPLCRTCALKHPHGAVNKDYECTHREDDERGENIRVERDREFWAKPGPGLAGT

SEQ ID NO: 138870 - protein, 97 aa, Heterodera glycines
  Coding regions on vcDNA: vcDNA=SeqID_65293; Strand=-; Position=1-294
MAFITSKVQQVLVFWECEINAEKRNNDEMKRAFAQYKDSGPIRLKDCYHGGRVGPQRLHYEVPKGWRMKYYDVRSLYPHECCDSISCGPPNTSEHHR

SEQ ID NO: 138871 - protein, 194 aa, Heterodera glycines
  Coding regions on vcDNA: vcDNA=SeqID_65294; Strand=-; Position=1 -182,267-669
MPVPLGALPGAFGLNVQDKEFFPHLANVEASYGHILQSLPPKADYLYGGMTPDRQRRFDQWRWLLLAQFLAIRDPLEWHGCLDDEDDEEEEEEEEDNDNAFDVIVGGIDITWEPMNIASASMRHFRLNHLKRDQLAIVPEYGYYTTNTQSLIALKFIDWYAKKNGVSIQTAHSPDGEKKLANTLWTDTSRRPTP

SEQ ID NO: 138872 - protein, 472 aa, Heterodera glycines
  Coding regions on vcDNA: vcDNA=SeqID_65295; Strand=+; Position=1-1419
  Homolog annotation: Hit_ID=XP_318550.1; Match level="QueryCoverage =82%, HitCoverage=40%, E-value=5e-76, Identity=40%"; Hit description =ENSANGP00000020240 [Anopheles gambiae]
MGEERIVASISTDSGSAVHNAIEKGLPIVNDDLIRAAEQDQTILKVKKFVKTQWPNKKAISDELMQFHRRREALTIENNCLLYSERVVVPASLQNEVLQLLHKGHPGIKRIKSLARQYVYWPGMDEHIENMIKSCQPCAAEAKAPVKTELHSWPKTDGPWKRIHMDYAGPFFGKMFLIIVDSFSKWHEVFEMRSSGTTATIEKLRGIYSTFGLPETFVTDNGIQFTSNEFKQFVTRNGITHLFSAPYNLMSNGQAERFVDTFKRTSRKLKGEGIANALETFLVTYRTTPSESLNGKSPAEMFLQRKVRTTLDLLMPKQRQPIIRDEAMEKNFNRRFGATPRFFLVGDKVYARHRLSQQWNAGHVTSCKGVMYDVEFVLGSTSRFHANQLIKSDTDQLDVDPLNVFNEDFGLPKMAHQPNQRPNEAVVEPNIVDNAEPANDPPPVEQQPISPIRPRRQYPKRNRRPPDRYSPK

SEQ ID NO: 138873 - protein, 92 aa, Heterodera glycines
  Coding regions on vcDNA: vcDNA=SeqID_65296; Strand=-; Position=1-304
MIGRAVRNRPFIFEGIFKFILYPRKMAISFFEKFYTSQKRLRMRRRAVHNRHFISQSIFIFRGYPRKMAISFFDKFYTHTNALEHDREGGAQ

SEQ ID NO: 138874 - protein, 40 aa, Heterodera glycines
  Coding regions on vcDNA: vcDNA=SeqID_65297; Strand=-; Position=1-122
MIGEGRCAIDLLSLRGFLNLYSIPEKWLSLFLRNLYLTKA

SEQ ID NO: 138875 - protein, 105 aa, Heterodera glycines
  Coding regions on vcDNA: vcDNA=SeqID_65298; Strand=-; Position=1 -29,342-630
MPVITVERQWYFVALERDANNTRGNSSNNDSAELLRDERVWRMFARSQQRCAAIRDASRARAQIAAGRRAVVADLLTGGSSESMYSQTSPPKSPGPGQNVAAKKK

SEQ ID NO: 138876 - protein, 159 aa, Heterodera glycines
  Coding regions on vcDNA: vcDNA=SeqID_65299; Strand=-; Position=1 -177,609-859,1407-1456
  Homolog annotation: Hit_ID=CAE57201.1; Match level="QueryCoverage =98%, HitCoverage=18%, E-value=2e-40, Identity=55%"; Hit description =Hypothetical protein CBG00051 [Caenorhabditis briggsae]
VETLGVGYNRTLGGRQLTLRLRDHLVRAFKQQHPSTSNTVEQNLRAMAKLMKEAERVKQILSANTDHYAHVESVFEDRDFRVKVTRDELEAMFQDFEQFHMEPITDALRMAQLTLDKLDRVVLMGAGTRMPRLQTVLGTFLQGKEISRQLNTDEAIVWA

SEQ ID NO: 138877 - protein, 177 aa, Heterodera glycines
  Coding regions on vcDNA: vcDNA=SeqID_65300; Strand=+; Position=1 -83,369-557,605-700,944-1052
  Homolog annotation: Hit_ID=NP_496985.1; Match level="QueryCoverage =100%, HitCoverage=18%, E-value=2e-60, Identity=62%"; Hit description= trp-asp repeats containing protein (90.1 kD) (2O647) [Caenorhabditis elegans] emb|CAB76722.1| Hypothetic
GPGRRLRNVANVRKHIDYIANALNHMEARLWQSPHRRQLRWERPVIQPDILYQSYVLMPKLTPEVPVDCVLSKFVRAAMNKVKCPIYSLCWTPEGKRLITGASSGEFTLWTPEGKRLITGASSGEFTLWNGTAFNFETILQAHDVAIRAMKWSHNDQWLASADQGGFVKYWQPNFNN

SEQ ID NO: 138878 - protein, 285 aa, Heterodera glycines
  misc_feature (11)..(11): Xaa can be any naturally occurring amino acid
  Coding regions on vcDNA: vcDNA=SeqID_65301; Strand=+; Position=1 -43,704-850,940-1021,1070-1221,1279-1400,1453-1581,2300-2390
  Homolog annotation: Hit_ID=NP_496985.1; Match level="QueryCoverage =94%, HitCoverage=29%, E-value=2e-97, Identity=63%"; Hit description =trp-asp repeats containing protein (90.1 kD) (2O647) [Caenorhabditis elegans] emb|CAB76722.1| Hypothetica
AHIITGKFGKXIRRLSWCPTDVKLATASDDATARVWDFARCAEERVMRGHGADVRSVDWHPTKGLLATGSRDSQQPVKLWDVKTGQCLATLHDHKNSVMAVQWNRNGHDHKNSVMAVQWNRNGNWLLTGSRDHVIKMYDVRMMREIRSFRAHKKEVTSLAWHPVLAWHPVHEGLFVSGGGDGSIGYWLVNSEKELTLLEQAHDMAIWALEWHAIWALEWHPLGHILATGSNDNNTKFWARNRPGDTQEDVFGMTSSNGNGKTASQSVPRAVSTGDEEGTAATAIP

SEQ ID NO: 138879 - protein, 109 aa, Heterodera glycines
  Coding regions on vcDNA: vcDNA=SeqID_65302; Strand=-; Position=1-332
NGKDIFRVNGCARDNEKKCPTVFYTFCRESGGNLFNCRHCDELVDGKVCNSFDQLINLDQSEEQMNSIYKSHSHHSNSSSSKAEKLGPVSAFTWISSNLLLLFGNGEKN

SEQ ID NO: 138880 - protein, 366 aa, Heterodera glycines
  Coding regions on vcDNA: vcDNA=SeqID_65303; Strand=-; Position=1-1099
  Homolog annotation: Hit_ID=NP_920205.1; Match level="QueryCoverage =99%, HitCoverage=24%, E-value=3e-40, Identity=32%"; Hit description =putative DNA helicase homolog [Oryza sativa (japonica cultivar -group)] gb|AAP52492.1| putative DNA helica
MLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFS

SEQ ID NO: 138881 - protein, 40 aa, Heterodera glycines
  Coding regions on vcDNA: vcDNA=SeqID_65304; Strand=+; Position=1 -79,334-377
MFSVRFFAFLLLLAVLCFSLVECGLIGFFWTTDKSLMRVK

SEQ ID NO: 138882 - protein, 27 aa, Heterodera glycines
  Coding regions on vcDNA: vcDNA=SeqID_65305; Strand=-; Position=1 -65,391-409
MPLANLAKRRSSMRTNSTLCLRKSVPR

SEQ ID NO: 138883 - protein, 82 aa, Heterodera glycines
  Coding regions on vcDNA: vcDNA=SeqID_65306; Strand=-; Position=1 -149,421-520
MALAKLKTSVFAISVVLFVSIDKCRCTNILFTFFHDTGSHFQSVFPLMQNLNVTLPMTFGHAVFPPLIWAFILGHVTRNSEF

SEQ ID NO: 138884 - protein, 18 aa, Heterodera glycines
  Coding regions on vcDNA: vcDNA=SeqID_65307; Strand=+; Position=1 -16,147-187
MRMNEKKKSNYFVKKENE

SEQ ID NO: 138885 - protein, 61 aa, Heterodera glycines
  Coding regions on vcDNA: vcDNA=SeqID_65308; Strand=-; Position=1 -23,62-224
MALTEKGIKTNRGENDLLDSWQMMAKFAFNFLPMLMTSSIHLFLIHFTAPSLGIFSFYCQS

SEQ ID NO: 138886 - protein, 80 aa, Heterodera glycines
  Coding regions on vcDNA: vcDNA=SeqID_65309; Strand=+; Position=1-243
MVRNVYNWGEAKAVGEREQQIADTPPEDGAEHRPQIHGQRMGAVHPTDGEQFKCQNGQHSDVIEEAAGQFVAEGTGLKNT

SEQ ID NO: 138887 - protein, 781 aa, Heterodera glycines
  Coding regions on vcDNA: vcDNA=SeqID_65310; Strand=-; Position=1 -40,243-371,419-553,597-637,684-762,834-993,1076-1214,1273-1404,1472 -1575,1635-1759,1850-1963,2035-2093,2152-2226,2274-2483,2530 -2733,2836-2958
  Homolog annotation: Hit_ID=NP_491491.2; Match level="QueryCoverage =99%, HitCoverage=98%, E-value=1e-133, Identity=37%"; Hit description= sodium:neurotransmitter symporter family member (70.2 kD) (snf-1) [Caenorhabditis elegans] gb|AAB96735.3
MWFEDRSLSNMKVTLIVEEWRDIWSAKSEFMFAAFAYLFATTNFLNLPRLILDNGGPAFLVAYGAALVLVVLPIVALEICLPAFLVAYGAALVLVVLPIVALEICLGQLTGRGPVQAFYNICPVFKGVGISQILFSLFVLGVGISQILFSLFVLATMTHFLARLIIFIYAATMTHFLARLIIFIYALFWTLTDDRPGLPWLHLPWLHCKNFPEIQFGPCRESMSVTAIVGTVQRLATFHEESAMSKFQNLLDHKLLDHKSDSVVDVGNFNWHFLVAQCLIWILVFCAICFGVRWLGKVIVFSFMVPLALLLALCGRAMFAFSFMVPLALLLALCGRAMFASGAVEMLEFFVDSLDWHKLKDYLVWKTAVEQAILASVWKTAVEQAILASGVGFGALITVGSYNKRSNNLVKDSFILVFTHALISVLQVATDSFILVFTHALISVLQVATVVALVGHVSAKSGLSPDQLIDQGENQFYQLENQFYQLLVFLGFLPHAKILSGLFLFLCAFVLLNVFVLLALSILALSILATLEDAFGEKWSRCCPRFSLCCPRFSLALFVCLFCASSSLFFATQAGAFGYAGAFGYELASGFLNYVTVLAILAFELFAVGWVYCAHSLAMDLRTMLSSVFWWCVGYLLLSLSYCLCFAPIAISVLNVLGYSFAKYSPQLRSFAPIAISVLNVLGYSFAKYSPQLRSWEWSEWCGVAVALFPLLPIPFCALLAIFRACARGGRSLCRVFPIFNHRVTSHHGLPRSSPFPPLLRRPPGYVLLPQAPLVSQNYLQ

SEQ ID NO: 138888 - protein, 67 aa, Heterodera glycines
  Coding regions on vcDNA: vcDNA=SeqID_65311; Strand=+; Position=1-204
MGWKKEEDERTDGWKRGRESEEKHGLMGRRESTKKREEKGKGEKEEGGKEKREEGKEREEGEEEEKH

SEQ ID NO: 138889 - protein, 111 aa, Heterodera glycines
  Coding regions on vcDNA: vcDNA=SeqID_65312; Strand=+; Position=1 -70,126-203,325-512
MFEIILSLFIYWSLLFFQQIPDENIDYPDQLDLRFTKTGQLRIPTTKDQDNCGCCWAISSTTVFSTAVFDARIGQKDRLLNFSEQYLVDCISEKKKHLSGCQGVPIADSFE

SEQ ID NO: 138890 - protein, 85 aa, Heterodera glycines
  Coding regions on vcDNA: vcDNA=SeqID_65313; Strand=-; Position=1-644
FLSKKIFFWVFGAVPPNRCAQIYGETESFRNSFPIACTLILRWIFAPHNCLSTPNGHLKKSIFLFSGRPPEPMRPDLWGDRILRE

SEQ ID NO: 138891 - protein, 71 aa, Heterodera glycines
  misc_feature (48)..(48): Xaa can be any naturally occurring amino acid
  misc_feature (58)..(58): Xaa can be any naturally occurring amino acid
  Coding regions on vcDNA: vcDNA=SeqID_65314; Strand=-; Position=1-215
PGLKCPAQAKNFFYFREKIEIFPKKIPVDRARKTMFWKWSPFLWEIRXKFLNSKTRKXFLGLARKILKIFE

SEQ ID NO: 138892 - protein, 44 aa, Heterodera glycines
  Coding regions on vcDNA: vcDNA=SeqID_65315; Strand=+; Position=1-135
NIEAQDGRFAPVFKFVGLGRALRARYSNFVGLTEIRRDTTVIKR

SEQ ID NO: 138893 - protein, 75 aa, Heterodera glycines
  Coding regions on vcDNA: vcDNA=SeqID_65316; Strand=-; Position=1-228
MIGRAVRNRPFIFEGIFKFILYPRKMAISFFEKFYTSQKRLRMRRRAVHNRHFISQRIFIFRGYPRKMAISFFDK

SEQ ID NO: 138894 - protein, 35 aa, Heterodera glycines
  Coding regions on vcDNA: vcDNA=SeqID_65317; Strand=-; Position=1-107
MIGRAGAIDLLFLREFLNLYSIPEKCLSLFLRNFI

SEQ ID NO: 138895 - protein, 91 aa, Heterodera glycines
  Coding regions on vcDNA: vcDNA=SeqID_65318; Strand=+; Position=1 -200,245-318
  Homolog annotation: Hit_ID=CAE68136.1; Match level="QueryCoverage =93%, HitCoverage=12%, E-value=3e-21, Identity=61%"; Hit description =Hypothetical protein CBG13784 [Caenorhabditis briggsae]
SNAFMVVVPTADKIKRLRLIRANATGPPPLSVYMLSFDSLSQMSFRRNLPKTMAFLENEMKSVVFNGYNIVGDGTPQAFIPILTAQTEEEL

SEQ ID NO: 138896 - protein, 69 aa, Heterodera glycines
  misc_feature (46)..(46): Xaa can be any naturally occurring amino acid
  misc_feature (50)..(50): Xaa can be any naturally occurring amino acid
  Coding regions on vcDNA: vcDNA=SeqID_65319; Strand=-; Position=1-301
  Homolog annotation: Hit_ID=CAE68136.1; Match level="QueryCoverage =78%, HitCoverage=7%, E-value=1e-17, Identity=77%"; Hit description =Hypothetical protein CBG13784 [Caenorhabditis briggsae]
SNQATVFLPGYNIVGDGTPQAFIPILTAQTEEELPLTRKRYRSASXVDEXYPFAWRIFPAPLCHMYGET

SEQ ID NO: 138897 - protein, 179 aa, Heterodera glycines
  Coding regions on vcDNA: vcDNA=SeqID_65320; Strand=-; Position=1-541
  Homolog annotation: Hit_ID=NP_702063.1; Match level="QueryCoverage =98%, HitCoverage=4%, E-value=7e-17, Identity=18%"; Hit description =hypothetical protein PF14_0175 [Plasmodium falciparum 3D7] gb|AAN36787.1| hypothetical protein [Plasmodium
ISITGTQSTNIPITGTAFQSPGLNPPAFQSLGLNSPAFQSLALKPPAFQSLGLNPPAFQLLGLNSPAFQSLALNPPTFQSLGLNPPAFQSLGLNSPAFQSLALNPPAFQSLGLNPPAFQSLGLNPPAFQSLGLNSPAFQSLALNPPAFQSLGLNSPAFQSLALNPPTFQSLGLNPPAFQ

SEQ ID NO: 138898 - protein, 41 aa, Heterodera glycines
  Coding regions on vcDNA: vcDNA=SeqID_65321; Strand=-; Position=1 -45,112-192
MQCDTGEANTQVLKIIRELKFAVHKSVMYGLKTWDFTGYGH

SEQ ID NO: 138899 - protein, 31 aa, Heterodera glycines
  Coding regions on vcDNA: vcDNA=SeqID_65322; Strand=-; Position=1 -41,103-157
MFGQSLSNSTQEARPEEMPLELSNNIKKIQM

SEQ ID NO: 138900 - protein, 155 aa, Heterodera glycines
  Coding regions on vcDNA: vcDNA=SeqID_65323; Strand=+; Position=1 -51,262-401,446-722
MGVSGSSLSAYVQVAVHRFKTDAAFARSAKMVTSLAFMPLADLTPAWAALEDHLPNELESVLDWFIINYVGRLLNNDTRTRPLFRPEEWSVYERTMNSTDRTNNFAEAYHRTLQLAIGQGHPPIWKFINILREHQKIIDVDFEHFLAGNAPADEI

SEQ ID NO: 138901 - protein, 48 aa, Heterodera glycines
  Coding regions on vcDNA: vcDNA=SeqID_65324; Strand=+; Position=1 -38,82-118,207-277
RDGVGPLYTKTELARRSWPDGVGSDGVGPKTELARRSWPQDGVGETEF

SEQ ID NO: 138902 - protein, 119 aa, Heterodera glycines
  Coding regions on vcDNA: vcDNA=SeqID_65325; Strand=-; Position=1 -97,123-562
NTFYNIYKWVGKKYSNKIVKILHKNGVFLFISRYFPLFASRPPLLLLPAVRLSCYCQPSASLVIASRPPLLLLPAVRLSCYCQPSASSCYCQPSASLVIASRPPLLLLPAAHFSCYCRP

SEQ ID NO: 138903 - protein, 134 aa, Heterodera glycines
  Coding regions on vcDNA: vcDNA=SeqID_65326; Strand=+; Position=1 -232,286-458
MKTLFLFSLLFFSSYENPIRKQRAVRNERAIAGLAQLAASLVAVKAFIAANAALTASTAVALAALGTDIYLAIELVRSSDHYEELLKDFFPLTFVLDDYEFTVSAKDYTPDYIFRKISQHFGHKTEEICINSMF

SEQ ID NO: 138904 - protein, 85 aa, Heterodera glycines
  Coding regions on vcDNA: vcDNA=SeqID_65327; Strand=-; Position=1-429
NTFYNIYKWVGKKYSNKIVKILHKNGVFLFISRYFPLFASRPPLLLLPAVRLSCYCQPSASLVIASRPPLLLLPAAHFSCYCRPP

SEQ ID NO: 138905 - protein, 46 aa, Heterodera glycines
  Coding regions on vcDNA: vcDNA=SeqID_65328; Strand=-; Position=1 -81,225-284
MCRGITNAHRPFFVAFVCPFIWAFGPFCRGFTSVRLNAYHLWANYF

SEQ ID NO: 138906 - protein, 16 aa, Heterodera glycines
  Coding regions on vcDNA: vcDNA=SeqID_65329; Strand=-; Position=1-49
EATPEGFGLPINLGAS

SEQ ID NO: 138907 - protein, 645 aa, Heterodera glycines
  Coding regions on vcDNA: vcDNA=SeqID_65330; Strand=+; Position=1 -38,230-350,494-639,960-1153,1199-1330,1370-1409,1456-1576,1742 -1867,1917-2030,2085-2203,2257-2361,2473-2595,2915-2996,3478 -3597,3647-3724
  Homolog annotation: Hit_ID=XP_422222.1; Match level="QueryCoverage =99%, HitCoverage=70%, E-value=1e-106, Identity=30%"; Hit description= PREDICTED: similar to Neurogenic locus notch homolog protein 2 precursor (Notch 2) (hN2) [Gallus gallus]
GKSSHECAILCRSWFGAQCKLRRCSQHNPCINGAECEKTKESFKCHCAVGSGFTGTYCENAVPTICERDDPCMHGTCRVGTTVDDFVCDCQYGYTGKICADINFCQSSTEVCLNGCMNDQNGSHCQCQTGWTGQRCQEDIDECQLSKLCQNGGKCVNTIGGFYCECPSDFVGYLCIGGFYCECPSDFVGYLCEVPHRPTDPCLANHFPCLNGAQCHENIDWHWECECLPGFDGDWHWECECLPGFDGKHCERAIDECDKHCERAIDECDMGMMTCLNGGKCAHAGPKTRVMGMALWWTGDFCEQDINECELGATLCKNGGTCVNRHGSYMCICVGGFAGKFCETNIDDCVDNLCYAKFCETNIDDCVDNLCYAGSTCVDGIARYDCRCAPDRIGALCEFQNICNIHENLCEHGHGALCEFQNICNIHENLCEHGHCFTNPFNGSYTCLCDEGWKSQNCSQNCTEDVDECSDEMTRCFNGKCVNLVGSYKCECEFGYTGDICASWISYCDDEQPCQNGGICHDQLSHYECRCKFGLVLIYCSEKPDPCEFKPCPERTICTPTTIHFECICPKNFSGTLCENMLIERHCENGCRNGGKCGKTKGSWGCKCLMGFEGEQCEIFSWGCKCLMGFEGEQCEIFRNPCSKS

SEQ ID NO: 138908 - protein, 189 aa, Heterodera glycines
  Coding regions on vcDNA: vcDNA=SeqID_65331; Strand=+; Position=1 -108,216-338,1016-1166,1289-1343,1408-1519,2753-2773
  Homolog annotation: Hit_ID=AAM09703.1; Match level="QueryCoverage =39%, HitCoverage=37%, E-value=5e-13, Identity=50%"; Hit description =glp-1 [Caenorhabditis briggsae]
TAVPVDKFNRTDLMDKENCKKAGCEAKYGNHRCDSECNLFACQFDGGDCSTKQAQPFGKCPQASYCAHVFADGKCDEPKLFEWRSDKGIGKRIELSPEVNATALFNVRYDEKEEEAGKRSKRKAEEKDVVEGIALFLQVDVTMCNMITPGSLAQSTQLVGVHKLCFSDLENVAAYLGAANAKQTISSAN

SEQ ID NO: 138909 - protein, 150 aa, Heterodera glycines; identical to SEQ ID NO: 134527
  Coding regions on vcDNA: vcDNA=SeqID_65332; Strand=+; Position=1-669

SEQ ID NO: 138910 - protein, 57 aa, Heterodera glycines
  Coding regions on vcDNA: vcDNA=SeqID_65333; Strand=-; Position=1 -21,124-276
MFESEFGGYHFTLETGAGRDPARDFGERQKEGLTFVKDSILCTVLSQNFGRASRSHV

SEQ ID NO: 138911 - protein, 92 aa, Heterodera glycines
  Coding regions on vcDNA: vcDNA=SeqID_65334; Strand=-; Position=1 -18,521-781
MRKFLEALQLHTKLMKEALDRDVKQKRGEGGGDLAKSNEVMEKRNGKKGILNGTLFKVKHAKAEADRRAKLDTEKEGTARDAIKELEKVGVE

SEQ ID NO: 138912 - protein, 116 aa, Heterodera glycines
  Coding regions on vcDNA: vcDNA=SeqID_65335; Strand=-; Position=1 -99,374-622
MQNALRVKLAELQNSRRTKEEEKEQQKEEPPQKLDFSLFDDSEFANRSWVELIEEEEAAARKTHKAKAATAETTAASAAPPIASVAAVASSSASPSNKRCNSERAEKGENVPKAQK

SEQ ID NO: 138913 - protein, 66 aa, Heterodera glycines
  Coding regions on vcDNA: vcDNA=SeqID_65336; Strand=-; Position=1-198
MLERVNDGEEPLNGQRNDGEIAHVNCRVPSETDGEAKGETDGVKIDKHSHEHAEKDQRIGGQQHQN

SEQ ID NO: 138914 - protein, 130 aa, Heterodera glycines
  Coding regions on vcDNA: vcDNA=SeqID_65337; Strand=-; Position=1 -40,292-644
MCASLFCMNYCWQTSLNYCLCRCFRFDWFHLETLFGIFRLHIFCRHCGGPWPYCCPFSKPFATKFFPKHRASIVMLEKNILTFVRLEEFEKVFEVVHEIEKDVNERDDGQQNIGGTHFAGARLALKFCCN

SEQ ID NO: 138915 - protein, 21 aa, Heterodera glycines
  Coding regions on vcDNA: vcDNA=SeqID_65338; Strand=+; Position=1-63
MSATIIRVPKIACDLSLAKNG

SEQ ID NO: 138916 - protein, 104 aa, Heterodera glycines
  Coding regions on vcDNA: vcDNA=SeqID_65339; Strand=-; Position=1 -111,289-390,517-618
  Homolog annotation: Hit_ID=NP_492045.1; Match level="QueryCoverage =90%, HitCoverage=11%, E-value=2e-09, Identity=32%"; Hit description =PAZ Piwi domain protein family member (105.4 kD) (1H813) [Caenorhabditis elegans] emb|CAA95839.1| Hypothe
MIVGTKRHFKKFFLEEEGREGRPFNQNLTPGSVIQEKGTGKPVEYAMLEDEIGISMDELQGVIMALSYSHQIVNVAVSMPEPVYQAHELAKRGKNNFVTLKYGH

SEQ ID NO: 138917 - protein, 48 aa, Heterodera glycines; identical to SEQ ID NO: 136255
  Coding regions on vcDNA: vcDNA=SeqID_65340; Strand=-; Position=1 -94,185-237

SEQ ID NO: 138918 - protein, 32 aa, Heterodera glycines
  Coding regions on vcDNA: vcDNA=SeqID_65341; Strand=-; Position=1 -66,427-459
MVYVGIFSQLMRLAHQQQRPAENLSNLVAKAV

SEQ ID NO: 138919 - protein, 62 aa, Heterodera glycines
  Coding regions on vcDNA: vcDNA=SeqID_65342; Strand=-; Position=1 -21,137-304
MCCCVRIPISKAIEAFLGTMRECAQMARDSARACAIFSQWSREFGDQLQLQPNWEVKRENLN

SEQ ID NO: 138920 - protein, 69 aa, Heterodera glycines
  Coding regions on vcDNA: vcDNA=SeqID_65343; Strand=+; Position=1 -71,325-463
MTRRRFWPRVKMETKKFWPSFWKRKSPGFDPWPAGRALTMTASLICGVCSLLRKATLPVATNKAKTHSQ

SEQ ID NO: 138921 - protein, 21 aa, Heterodera glycines
  misc_feature (9)..(9): Xaa can be any naturally occurring amino acid
  Coding regions on vcDNA: vcDNA=SeqID_65344; Strand=+; Position=1-63
EFRKYYHAXVVQLLLENGADP

SEQ ID NO: 138922 - protein, 182 aa, Heterodera glycines
  Coding regions on vcDNA: vcDNA=SeqID_65345; Strand=-; Position=1 -238,280-590
MPTVREILESLQKRVKKPRIATNEDSVLNVERTDAEQQIEGTSTRNNLDVASSDDEENCEPVQFKRGETIRGALCLWYQGFRFIKNRKDGSWFRCEQRNCPATAKLDDNDLMTGILGAKGHHHGCAPSRYDAETKRNQMKRLIKEEPKTKPCQIRAQIRTDIDDEVFELLGTNEALDQMANR

SEQ ID NO: 138923 - protein, 61 aa, Heterodera glycines
  Coding regions on vcDNA: vcDNA=SeqID_65346; Strand=+; Position=1 -108,355-432
MKILRSFKISKEPKICLEGIFFERKLIDVEGAPHLLIGGKDKQFPCHEMPNKIRFCFLQIE

SEQ ID NO: 138924 - protein, 92 aa, Heterodera glycines
  Coding regions on vcDNA: vcDNA=SeqID_65347; Strand=-; Position=1 -55,129-348
GMRDSATSSSSACSASSTLRRPFDHPTNLFLCQQALNSSNNLTLNGMPTTNNELLFPSATTPLLHQYGTTAQLGTAQFGISAQLGTAQFGIS

SEQ ID NO: 138925 - protein, 56 aa, Heterodera glycines
  Coding regions on vcDNA: vcDNA=SeqID_65348; Strand=+; Position=1-168
FAGGRNGHDGGSNGWGKRNFGAQPHRRTERREERDHQTLTAYVVADVVKALGPVKW

SEQ ID NO: 138926 - protein, 67 aa, Heterodera glycines
  Coding regions on vcDNA: vcDNA=SeqID_65349; Strand=+; Position=1 -81,202-324
MFEAANDKEAYYHMLAEKIYKIQKELQTEKNSFKKPSNFILDPTFKMTVRVAFMGCSYFCRKRKTGG

SEQ ID NO: 138927 - protein, 113 aa, Heterodera glycines
  Coding regions on vcDNA: vcDNA=SeqID_65350; Strand=+; Position=1 -80,127-232,275-430
MHGSSPLTEANLCMKFESSFSWKDWVRLRDTWNAVVTSQSQIHRHSEQLDKIVSEESSYRNYASDIQNRQIMIQIVERNVNKARELVRTARYQLNAFNSALSQSEKPIYVQRN

SEQ ID NO: 138928 - protein, 164 aa, Heterodera glycines
  Coding regions on vcDNA: vcDNA=SeqID_65351; Strand=-; Position=1-495
MNDQNGPTNIENFVQRLFVEESNQIFDENLEMKDEKSEEMSTNCDQLEQMTENSGQIYDQIPILNDKQKREIVEKFHKIKEKIKQMGKKYSTKEWNKIERKIATKLGANQMKIYKWKREFGMMKNKNYSVEEKRIMLKQFDQIYGKLKTKLNEKLEGKGTKCQK

SEQ ID NO: 138929 - protein, 195 aa, Heterodera glycines
  Coding regions on vcDNA: vcDNA=SeqID_65352; Strand=-; Position=1 -227,783-943,1023-1222
MAKTMDELQRRTVKVNTLMTPTKEQQQKQSEQKHQKGGEAAENWAKQNDAGQNAKGNAKDGEGTIGGELSMRDKEIQAQFKFYERLIYELNMDERRMADQCTRLGKTHAEYAQFGLKPHFLDIYQQSLIALISKMEFADDNERAETINAFGRLIRFIVEAMIEGYGQRVTELRTERRGSGETTEEKGQIGRRIEK

SEQ ID NO: 138930 - protein, 108 aa, Heterodera glycines
  Coding regions on vcDNA: vcDNA=SeqID_65353; Strand=+; Position=1 -128,524-722
MTAIVGGEPKPNVKWLLNEQEMDAVDKNVQVFFMKIQMMALKRYLKGECLVSGDNLRVKYDAVSGKTSIRLFHPNTDDSGEVKVIAQNVHGQAEASAKLKAIEKTKLE

SEQ ID NO: 138931 - protein, 128 aa, Heterodera glycines
  Coding regions on vcDNA: vcDNA=SeqID_65354; Strand=+; Position=1 -111,164-438
MTKWLFTPCPNGVPKWLQCFVNSPVGQWSSMMEQIKAAFSNASSVTFRIHFLLSSPIDSVVPFVDRINEVTGEELALQQSNGFWLTRCPIGWDNRNWDNVWEELSARQNPIDIVINRDRISGFVLSIL

SEQ ID NO: 138932 - protein, 98 aa, Heterodera glycines
  Coding regions on vcDNA: vcDNA=SeqID_65355; Strand=-; Position=1 -59,447-684
MEEWKQKKKAFKDIKRKIKNDIFDKTEKGAEFSFGNHIFNAVERKNGIVGKLLYDWEKKKLYEWDRNQMSIWVAKQYKNPDPPEHSELQTAYYCICMV

SEQ ID NO: 138933 - protein, 78 aa, Heterodera glycines
  misc_feature (10)..(11): Xaa can be any naturally occurring amino acid
  misc_feature (16)..(16): Xaa can be any naturally occurring amino acid
  Coding regions on vcDNA: vcDNA=SeqID_65356; Strand=-; Position=1-237
  Homolog annotation: Hit_ID=AAP30763.1; Match level="QueryCoverage =100%, HitCoverage=19%, E-value=8e-32, Identity=85%"; Hit description= putative gland protein G8H07 [Heterodera glycines]
KAFGVKDPYXXGHPNXCTSEKENEWEESDEERVARHAKEREEEEERERKEEQKRKEEEAERLRQEQLQQQQNQEQQPQ

SEQ ID NO: 138934 - protein, 218 aa, Heterodera glycines
  Coding regions on vcDNA: vcDNA=SeqID_65357; Strand=+; Position=1 -140,186-285,331-438,515-661,708-869
  Homolog annotation: Hit_ID=CAE74278.1; Match level="QueryCoverage =80%, HitCoverage=16%, E-value=3e-61, Identity=64%"; Hit description =Hypothetical protein CBG21973 [Caenorhabditis briggsae]
MGRTLAPFAGHDHGISVFGFGDSTTGDWTVFSLNEEKDCENLEEVLSVYNRMTPNIDLSGPTNFAPLIYRAMEICQQRRDYHILVIIADGQVTNEKATVKAIVSACQFPLSIIVVGIFDESLPKRPWDNFHFVELHELINQRADQPIESRELAFAVHSLLEIPDQYATIRKMGLLSSTAFFTRPPSHSPRRSKSPKAAQKINGTTADDEGAQEKETNC

SEQ ID NO: 138935 - protein, 102 aa, Heterodera glycines
  Coding regions on vcDNA: vcDNA=SeqID_65358; Strand=+; Position=1 -46,158-328,489-577
  Homolog annotation: Hit_ID=AAH70663.1; Match level="QueryCoverage =100%, HitCoverage=25%, E-value=3e-10, Identity=32%"; Hit description= MGC82267 protein [Xenopus laevis]
MVFNRKERLQISKKIVNLEKRKQRERQTIEEYEERKSNTNKEEEEHVEEEEQQHEKQQSDSNGVAMECQSEKEGWYSLTVALPGTILDNVQTSELKTYLSGE

SEQ ID NO: 138936 - protein, 104 aa, Heterodera glycines
  Coding regions on vcDNA: vcDNA=SeqID_65359; Strand=+; Position=1-315
MEGASTVDACHILRIILYQICLLVLDGDDHFAGASVGQSENGESHLNSKKVNGGNRFQIQEWDMVKGLMARVLLYRIRWQVDIECQRAKMPKKTNKSGIILHST

SEQ ID NO: 138937 - protein, 114 aa, Heterodera glycines
  Coding regions on vcDNA: vcDNA=SeqID_65360; Strand=-; Position=1 -168,259-393,478-519
MQKNVRFVGDSPLQSKAIIQLDGNIPMISKFVKMDPGTKSMAKFSSCKIWIKELIPQRNRPSSRPLILSNLFADFSILALITSKMISHSPRRCGPSSNRSKVLLCKLCICQKVR

SEQ ID NO: 138938 - protein, 15 aa, Heterodera glycines
  Coding regions on vcDNA: vcDNA=SeqID_65361; Strand=+; Position=1-61
TFDHLYSDQIVNMVK

SEQ ID NO: 138939 - protein, 132 aa, Heterodera glycines
  Coding regions on vcDNA: vcDNA=SeqID_65362; Strand=+; Position=1 -229,701-870
MPSRAFQRQVLVEWRNKSNTIRGKVTKAQLDERRRFHAQCVENRQRDGQDWIVYAGSVILREEIHIFRRQMIDTDSHDLNFSKKDLVWKEGKPFSLSNFGEIFCDFFNRFSYVNATHGPSRRNSWLDSFTSK

SEQ ID NO: 138940 - protein, 228 aa, Heterodera glycines
  Coding regions on vcDNA: vcDNA=SeqID_65363; Strand=+; Position=1-687
MIEPRTSLIKFAAELFNTKAEFVQCIVLTRADKREKLIMELRKADFNGVKIWSKMDTKPKVNLNENWWEFVLDMPFEAEFGGTNSVVELNKQINDDFRPNLSKFGPGLVLNRKFYPISGIMLEGVLDIYDKYREFWWKIEKENTQIQNSKSCQKGATKIMNANEEKEKTIEFFMETDEDSVDFEAESEFFQEEKEQNSAKRADGRLKLTVKANSNQNRVLTIKGVNAK

SEQ ID NO: 138941 - protein, 32 aa, Heterodera glycines
  Coding regions on vcDNA: vcDNA=SeqID_65364; Strand=+; Position=1-98
LHFQLLSLTNCCTFPNFISSLVSSIGAQCALF

SEQ ID NO: 138942 - protein, 106 aa, Heterodera glycines
  Coding regions on vcDNA: vcDNA=SeqID_65365; Strand=-; Position=1 -223,388-485
MVKNPILSNSFVTAVTLGGLKFFFIICANGFGRFRSERLRSRRAWRPSRGSVVGCDLPIRALLLPRFSPSPALVVLCRAVVRQQWPIGRPIGGWLGPNRRFRNLFR

SEQ ID NO: 138943 - protein, 125 aa, Heterodera glycines
  Coding regions on vcDNA: vcDNA=SeqID_65366; Strand=-; Position=1 -193,391-575
MKCHWLSLAPLLYWHFQRKDCTACKCEAISHGRRSNKNQIAHANEESGQRNKISVQIWDTSEKETHTIHAMELCAQFWHGHKSLFACKHFACPLLAECQFIADSLIRGNSHKNEIYANTNVCIKM

SEQ ID NO: 138944 - protein, 92 aa, Heterodera glycines
  Coding regions on vcDNA: vcDNA=SeqID_65367; Strand=+; Position=1-278
MSKPIRMRINPSWRNLRERLTQIRPVVEAQEITPEEIELLRKSLVKLKRSVNFIDERIEEWRNYMANVQAAQRAEEEGLFDNLTNNGRHITE

SEQ ID NO: 138945 - protein, 85 aa, Heterodera glycines
  misc_feature (44)..(45): Xaa can be any naturally occurring amino acid
  Coding regions on vcDNA: vcDNA=SeqID_65368; Strand=+; Position=1 -62,212-241,429-477,526-720
  Homolog annotation: Hit_ID=AAL78212.1; Match level="QueryCoverage =49%, HitCoverage=28%, E-value=4e-14, Identity=90%"; Hit description =putative esophageal gland cell secretory protein Hgg-25 [Heterodera glycines]
PDSPKYDSPILAGSSGSPKKGKSPHADPKKAASHLVPVTPGKVXXASLKMVKKLCGTMMPTMNKPKAVVVDVEKKLWYHHAIIVV

SEQ ID NO: 138946 - protein, 130 aa, Heterodera glycines
  Coding regions on vcDNA: vcDNA=SeqID_65369; Strand=-; Position=1 -121,163-257,571-747
NNLLKKDSEAALSGEIVGDERETENIVRTLITIIDSFEENEFFAQGLYRLSGSLTTQQNALNIIENAKGRELKLYFIYELNATDKASCIKTLLRKMPDTLFPHCQRVALLDLSGFVFVAFGLGAMLFLLN

SEQ ID NO: 138947 - protein, 128 aa, Heterodera glycines
  Coding regions on vcDNA: vcDNA=SeqID_65370; Strand=-; Position=1-385
IWYIIMSNLQNSPAYCVLVNDQRDGVLREIIDHLGLLESGGLGAQQKKIGSETLPCHTLHLDTKYYTCDVPLLSCHSFVRFKSICAAERRSNLSVFAVLFCVTRQQLTDDFLATVSKYSASLEKAEMK

SEQ ID NO: 138948 - protein, 99 aa, Heterodera glycines
  Coding regions on vcDNA: vcDNA=SeqID_65371; Strand=+; Position=1 -227,288-360
MPIESFELVNERTKEKLTLKQNIDEFDVNVCNWLLQRCPIGETATAPAIKWGDSLNPSANLNHIRFVLWSFDKSIGPLSPLAEEDKEEDKADQSNKNVV

SEQ ID NO: 138949 - protein, 91 aa, Heterodera glycines
  Coding regions on vcDNA: vcDNA=SeqID_65372; Strand=-; Position=1 -128,228-375
MSTENKSSDKTESNGPKVLRILEIVKNAQQKHGLRHENYQRYRAIGYTKLVRFVQLMKRVIASGRHPVGRRSFVPHRPCFMMAALRTKKET

SEQ ID NO: 138950 - protein, 52 aa, Heterodera glycines
  Coding regions on vcDNA: vcDNA=SeqID_65373; Strand=+; Position=1 -59,460-559
MKFWLSPASVILGSLAIWSGAFFFPIRPKWSKSPPISLDLVPITGFWSVLAI

SEQ ID NO: 138951 - protein, 253 aa, Heterodera glycines
  Coding regions on vcDNA: vcDNA=SeqID_65374; Strand=+; Position=1 -69,118-232,282-407,463-572,631-969
MPTMEMEVKAAAIKSTKKGKLLQLFSSTESDKRALLLSAESETELQFWLFSIERALAWNNREMMLAPEEDNLSLNSSGRDNSFPPCLSSLNDSESLASEDSGGSREFSTAFWRSRNAAAKALQPPIVERRNIFSLFWDMEPLPEGEGEKSTLGEQLSETEQCNVERISPIPSSSATTTSLVLRPNFGGKRTTSHEPSSFDEETKGQLAVREDSQCLEPSKSEFAGEKPAILFTAQLRQLDIRIRMAGKEHAEQ

SEQ ID NO: 138952 - protein, 933 aa, Heterodera glycines
  misc_feature (255)..(255): Xaa can be any naturally occurring amino acid
  misc_feature (262)..(262): Xaa can be any naturally occurring amino acid
  misc_feature (311)..(311): Xaa can be any naturally occurring amino acid
  Coding regions on vcDNA: vcDNA=SeqID_65375; Strand=+; Position=1 -195,284-505,625-820,869-930,998-1426,1501-1548,1576-1655,1711 -1890,2141-2256,2304-2463,2538-2799,2865-2948,2994-3116,3371 -3538,3600-3672
  Homolog annotation: Hit_ID=XP_224538.2; Match level="QueryCoverage =100%, HitCoverage=36%, E-value=1e-105, Identity=29%"; Hit description=similar to KIAA1058 protein [Rattus norvegicus]
IEPFFARLFLFDSSLGVRVSEEFHVAFRHFTTICFNKMDMPTLLNANSAPSSSFALNGVLATEKQLICSIHNPRADLFLVVLVERILSGVSRHLHEGNATDNKYSSKIQKSLSASIPKLGHLRTLFAWTARQFIINCDGSKKSSLATCSLYKCDSGRLTDGDLQKLLIEMQKADKLAKLVVFPSASLVLETDVTSVLCEFPMRISPSFLPLRPWKCIPTSPDFPMRISPSFLPLRPWKCIPTSPDTVAVLTFSMXLLSFSEXLFMWNNHLKVYPLSLNYSTQKTFSRARNISCTVHYVPSSRSRKGPLPCXHSHPNGPFVDSFVCGVQYHEQSPQFNAEVKMDLPVALGEDDHILFTFHHVSISNAITNKNKPFTEVETPVGYAWLPTPVGYAWLPMVKTDSHKSQEFELPVTANLSSKYYEFKPLSMVKTDSHKSQEFELPVTANLSSKYYEFKPLSSSVSPNFDLKFVEYGRPLFRVRVSPNFDLKFVEYGRPLFRVRLRLVSSVFTTDERLQNFFQLCHLIYPNITQSNRNPLTQLPKLSSIDLDQLIPFLAVIFDRLFNLLTFSKAEDVMLSSLNAIIYLADQLFMHRKSKRELLRNLNAIIYLADQLFMHRKSKRELLRNYVLLFFKAKVRNANAMPTVKNRPMAQFANALSSKDSSKDGTISITKLLRQLWFLLDCAAKSMAHWLIIHNLLKVPRRNRFPTDLYFSLEELFHTITERIIFMQRECPRESRMANNALGNFLKHCLSLMDRYQIMKELHCLSLMDRYQIMKELYTVVKKMDTIETRSFRVYKFELLQISFRVYKFELLQILAGHEHWLPLCLPLLTDKFGIILRGDSFRHFYLSKTYCSVHFPIGLLLQELSTSLRDSRDYRRKVIQLLRNLLAKHSQDERYGDTSARNRIAILTSARNRIAILTMPLLRIAIENIKEI

SEQ ID NO: 138953 - protein, 413 aa, Heterodera glycines
  Coding regions on vcDNA: vcDNA=SeqID_65376; Strand=+; Position=1 -165,357-613,659-771,1438-1712,1892-1997,2056-2243,2299-2434
  Homolog annotation: Hit_ID=CAE60697.1; Match level="QueryCoverage =52%, HitCoverage=9%, E-value=2e-39, Identity=41%"; Hit description =Hypothetical protein CBG04359 [Caenorhabditis briggsae]
MVEALNKAKANPFSNGYVWTNGTINANNTGKSNNEQQQRSSDKFNRAKREHSLRVNEVRDLMLCVLYTLNILPKKILAAFWNVQEAIQPTKTMPSCDDSVTELPKQPQQNVLVDFVRILELSLLLFRYRGRTHHLMLQAKRNKATNPNKTPELLLKFDGSNSYVMSSKFSTLTDINFGAKFPSDFSSMSAPDGSKNSSLTERLGRPGAQIAPVLARLLSEKAVFLNSFRFERGLSALESLIGCGSATKSGAKGAASSALVLTSLFDKAVLIQLADLHIQLANSFRGSAALRAEFFDALAAQHIAGAWYSEAAVCQAHSLVIIGKELQSRGLFRPDWTLLSVLSERITATEGVNESGLMSSTQQGGFTLEEFTRKVEALVRVLLLSERYEAVGPICRLAIPIFEQNNDFKVQRH

SEQ ID NO: 138954 - protein, 87 aa, Heterodera glycines
  Coding regions on vcDNA: vcDNA=SeqID_65377; Strand=+; Position=1 -159,579-683
MPTKGGREKEQRVASMNNGRASERPMDELKEDNDPMGYNLHTNISTFIQEERLVNAGLLAYAETFTASAQRHRYGKDGICRLATALK

SEQ ID NO: 138955 - protein, 133 aa, Heterodera glycines
  misc_feature (8)..(8): Xaa can be any naturally occurring amino acid
  Coding regions on vcDNA: vcDNA=SeqID_65378; Strand=-; Position=1 -215,272-452
  Homolog annotation: Hit_ID=CAE66647.1; Match level="QueryCoverage =89%, HitCoverage=68%, E-value=6e-29, Identity=39%"; Hit description =Hypothetical protein CBG11984 [Caenorhabditis briggsae]
LLKSVFVXHDQKCHSGPSGQPVQPGQPGQGGGAPPPGPPGPGGPPGPPGPPGGDGQPGGDGQAGTSGGDGKYCPCPCPNRGSSGGGVPSESGGGGGGGGTSGGYGPGGGPSGGSAAAEVPPSGGGATESGGAS

SEQ ID NO: 138956 - protein, 259 aa, Heterodera glycines
  Coding regions on vcDNA: vcDNA=SeqID_65379; Strand=-; Position=1 -619,673-831
  Homolog annotation: Hit_ID=NP_499982.1; Match level="QueryCoverage =97%, HitCoverage=84%, E-value=1e-57, Identity=42%"; Hit description =COLlagen structural gene (33.8 kD) (col-103) [Caenorhabditis elegans] gb|AAK29827.1| Collagen protein 103
MNILLFEDINNMYDEIIEDLGEFKVLANDAWSQMQAVQVQMVGGKAQAAAFGRDFAEMIRERRSYAAGGSGGGGGGGSGYASGGSSGGGGGSGYASGGGGAKKGGGGGGGGGYARAGTSGGGATACPAGPPGPPGQPGAAGPPGSPGQPGGPGENGGPGTPCPAGGSCPACPGGPPGPAGPPGGSGPPGSDGEPGQNGNGGGGGQPGPPGPPGDSGPPGPPGGSGPPGPPGNPGTCTGGGGGAVSGGSGGQVGYGGGRL

SEQ ID NO: 138957 - protein, 183 aa, Heterodera glycines
  Coding regions on vcDNA: vcDNA=SeqID_65380; Strand=-; Position=1 -291,386-646
MSSKLSSKWVVFGSCLLFFASGCVLYVLVMTRHFVDDEIEMADEGQKVDEGTAKWELPNESKQNGNLVGGDEQQKDQQKEKQQSKVLLLEQSMPNGNSRLCLIGGRFFLQNAFVLGSFKPGPARSLRKESGRTDESDDGHHFALPTPKGGVGGARSMKGEKEEFGRMKKRRVWKDEEEKSLEG

SEQ ID NO: 138958 - protein, 151 aa, Heterodera glycines
  Coding regions on vcDNA: vcDNA=SeqID_65381; Strand=-; Position=1 -37,364-548,803-1036
MESAFCKKKCASADKQKPSQYGKAYPKLQMLKVPNIWRHEKCARKRAKLSEEDGLSLSEDKLCTVEEKSRDTCLLQQGLEKPLMQAKEAKMANGGHLIVKEFTNVTFHKNAIEKFVNGNLNEENPTTEETKKEKVKEDEEDEAEEMWGDCQ

SEQ ID NO: 138959 - protein, 132 aa, Heterodera glycines
  Coding regions on vcDNA: vcDNA=SeqID_65382; Strand=-; Position=1 -166,324-384,426-597
MVGWMTFITTKNPSDPFALFAFYCQEISKIGRNLGLILSIVMAHKKQIFVWPKSETFPFFCLSFALAWPLNSPKLIGVATHMPIPTADGTAKGKPGSAHPQVLALLAVTETEMPTEEGHRRQQIDKGKVIKE

SEQ ID NO: 138960 - protein, 176 aa, Heterodera glycines
  Coding regions on vcDNA: vcDNA=SeqID_65383; Strand=-; Position=1 -234,350-643
  Homolog annotation: Hit_ID=CAE67008.1; Match level="QueryCoverage =98%, HitCoverage=6%, E-value=2e-70, Identity=72%"; Hit description =Hypothetical protein CBG12408 [Caenorhabditis briggsae]
MAILEPRPVWFVYSGMGSQWVGMGRQLMRIPLFDQSLRESSQTLAEFGEDVYGMLTNAEPKQYENNTLNCMLAITSIQIALTDLLFALGVTPDGIVGHSTGEMGCGYADGALTRAQTMMLAYYRGKTIMAHKERMRGAMAAVGLSWEEAVKRCPDGVVAACHNGADSVTVSGDTEK

SEQ ID NO: 138961 - protein, 87 aa, Heterodera glycines
  Coding regions on vcDNA: vcDNA=SeqID_65384; Strand=+; Position=1-410
APRRRNRPPEELRHRNRQRHLLEERRRWAPCRRNRPPEEPRRRSQPLGEPCRRNRQLEEPRPRRPEQPPDGIRTRRSTTRFNDIYRQ

SEQ ID NO: 138962 - protein, 160 aa, Heterodera glycines
  Coding regions on vcDNA: vcDNA=SeqID_65385; Strand=+; Position=1-482
  Homolog annotation: Hit_ID=NP_509552.1; Match level="QueryCoverage =100%, HitCoverage=8%, E-value=1e-30, Identity=42%"; Hit description =reverse transcriptase RNase H-like protein family member (XJ813) [Caenorhabditis elegans] gb|AAA85753.1|
MDADIIELTGRDNDEHFLPHHAVINPKKLRIVIDASAHAKGTPSLNDCLHRGPVLLPDLCGILIRFRSATMPVLADVQGAFHAIEVEPDDRRFCKMLWLKDPSRPVSGDNLLIYRYKRLVFGATCSPFILAAVLLHHFDRHAHPFAKELAANMYVDNLLI

SEQ ID NO: 138963 - protein, 102 aa, Heterodera glycines
  Coding regions on vcDNA: vcDNA=SeqID_65386; Strand=+; Position=1 -147,302-463
MTAADHPQLFSTELVALKRMTALPAKRQTASSRTTTSDGTQRKRGRRERGPKHYTSIAFFGLIVYGILIISYCLIYFLINFPFYITFLPFRRCIICECVTVN

SEQ ID NO: 138964 - protein, 111 aa, Heterodera glycines
  Coding regions on vcDNA: vcDNA=SeqID_65387; Strand=-; Position=1 -16,63-289,352-444
  Homolog annotation: Hit_ID=CAB40412.1; Match level="QueryCoverage =96%, HitCoverage=22%, E-value=6e-29, Identity=61%"; Hit description =hexokinase [Haemonchus contortus]
MLRAIGISNSSAADCANVAYISSLIGTRAAHLCACGLAAILNRMQRPRVTIGVDGSVFRFHPTFKFNLDQKIKALLAVKCEFFMVLSEDGSGRGAAVAAAVALRMNRLVGA

SEQ ID NO: 138965 - protein, 72 aa, Heterodera glycines
  Coding regions on vcDNA: vcDNA=SeqID_65388; Strand=+; Position=1-219
TDDSLRAPMRRSSSLYDFFVSQQPPVHSLAKKNNEAKYYARNWELFPRSFVSSSSHMICRPKGKEKYHILPN

SEQ ID NO: 138966 - protein, 36 aa, Heterodera glycines
  Coding regions on vcDNA: vcDNA=SeqID_65389; Strand=+; Position=1-263
VVPVLRWHWFEFIPCFLDLAHQELSNDTKFVRIWAF

SEQ ID NO: 138967 - protein, 52 aa, Heterodera glycines
  Coding regions on vcDNA: vcDNA=SeqID_65390; Strand=+; Position=1-265
YPLYRAILTTHPKCVFPSTFNCRYIWQIRRNRQTKKMKEILQGIFPNRAKTV

SEQ ID NO: 138968 - protein, 83 aa, Heterodera glycines
  Coding regions on vcDNA: vcDNA=SeqID_65391; Strand=+; Position=1-303
TFYFEGIFKFILYPRKMAISFFEKFYTSQKRLRMRRRAVHNRHFISQRIFIFRGYPRKMAISFFDKFYTHTNALEHDREGGAQ

SEQ ID NO: 138969 - protein, 161 aa, Heterodera glycines
  misc_feature (6)..(6): Xaa can be any naturally occurring amino acid
  Coding regions on vcDNA: vcDNA=SeqID_65392; Strand=-; Position=1 -78,351-483,572-611,919-1100,1486-1517
  Homolog annotation: Hit_ID=XP_216864.2; Match level="QueryCoverage =97%, HitCoverage=64%, E-value=7e-45, Identity=57%"; Hit description =similar to ubiquitin-conjugating enzyme E2-32k [Rattus norvegicus]
CIQFFXNGDICITFLHPPVDDPHSGEMPSERWNPTQSVRTVLLSVISLLNEPNTSSPANVDASVMYRKYKVSDHGDQESDHGDQEYATIIRKQVEKSKEEAKKDGIKVPETIDEYVVKAKPRVQGNESNDVILDEDYYDYEDDDTGEGDSHEDAEYGGEEE

SEQ ID NO: 138970 - protein, 29 aa, Heterodera glycines
  Coding regions on vcDNA: vcDNA=SeqID_65393; Strand=+; Position=1 -15,925-999
MAFFKQKGDDDNPPAGVHADERLFQTVRP

SEQ ID NO: 138971 - protein, 197 aa, Heterodera glycines
  Coding regions on vcDNA: vcDNA=SeqID_65394; Strand=-; Position=1 -267,568-854,906-944
MNLDNKLFRRLRQFVPSILNDCPLLRVVSFSESNLFTEFPADDSATASDGQAMAKWLFTPLPTNVPKVLRCPLNKDYVNLASTIEAFKSAFASASSPVNFIVVLWFPKSFAASVMLFDLANELTHEQLALKRTVFNTRFLLIRCPIVRDANKWAKWEEEAANWLIYYQWNRIDIEINDEKNIGDGLLGATPGPSDQQ

SEQ ID NO: 138972 - protein, 140 aa, Heterodera glycines
  Coding regions on vcDNA: vcDNA=SeqID_65395; Strand=-; Position=1 -243,1141-1320
MAIVRQKDKRRNSGDQLASLVSAASCETVPCRKPIPISRSANSVRPKNAGGAASSRLLLLSFALSLFLTLADARKNNHHYKGQRTAQRQQQQQQQHQQQHNKQQQQIDSEFSIEDVDEEQIDEILRDTAKNLVVFFCKRE

SEQ ID NO: 138973 - protein, 181 aa, Heterodera glycines
  Coding regions on vcDNA: vcDNA=SeqID_65396; Strand=+; Position=1-546
  Homolog annotation: Hit_ID=NP_916735.1; Match level="QueryCoverage =93%, HitCoverage=26%, E-value=5e-10, Identity=31%"; Hit description =VsaA -like protein [Oryza sativa (japonica cultivar-group)] dbj|BAB90075.1| VsaA -like protein [Oryza sat
MGGGGATPFFVPPRENSPQNNAGQPWATPLPGEGPSHPNSPYNQPGQNGYFPPAPNAMPAEPGYPNYYGPSPSNAGSSSGYGAPNSPPPFQQQGDAKNPYNYEPPPPTSPAPTSAYMAATSEVSYTQMSDVTQSSSGYKPPIDTKASPFSKGAVNPNATPVHRADGPSGGAQAPPQYDAPF

SEQ ID NO: 138974 - protein, 50 aa, Heterodera glycines
  Coding regions on vcDNA: vcDNA=SeqID_65397; Strand=+; Position=1-152
VELDDEVRTLDDRLLCMRVEMGQKRRKVHLNACINGEWGREALIKHKWRN

SEQ ID NO: 138975 - protein, 75 aa, Heterodera glycines
  Coding regions on vcDNA: vcDNA=SeqID_65398; Strand=+; Position=1 -42,108-233,744-803
MPNCVKFDTQRVLELLNFCVRKNSNGIEQFDVFYLHLLLNSEINCIMNTEIGLIKKATANQSLSKWSFIQVVYVF

SEQ ID NO: 138976 - protein, 61 aa, Heterodera glycines
  Coding regions on vcDNA: vcDNA=SeqID_65399; Strand=-; Position=1 -95,595-685
MDEINRKNRDKVISKQTISRSGKAKHSFAIQLTRLTLLKNLDPDPAFVGPETPGPVQIAVF

SEQ ID NO: 138977 - protein, 57 aa, Heterodera glycines
  Coding regions on vcDNA: vcDNA=SeqID_65400; Strand=+; Position=1 -34,83-222
FKNRIFKKKQNKKGPKDSNNRWLVFEPPITFCPFCLNRIMRRLSDSLCLLRLTLWLI

SEQ ID NO: 138978 - protein, 111 aa, Heterodera glycines
  Coding regions on vcDNA: vcDNA=SeqID_65401; Strand=-; Position=1-335
MAINGILSEEKTKQIMQEIGTIKQQNDAKLEAIKNVELRKKIQQKNHSEFEAHLINLLFSFAVRLEALINGKNEEGNIVEENGQNSKDKIRAFLAVLKCLTVVKEWRNNEL

SEQ ID NO: 138979 - protein, 18 aa, Heterodera glycines
  Coding regions on vcDNA: vcDNA=SeqID_65402; Strand=+; Position=1 -45,627-638
MKELIGSYFYGHPKNAFQ

SEQ ID NO: 138980 - protein, 240 aa, Heterodera glycines
  Coding regions on vcDNA: vcDNA=SeqID_65403; Strand=-; Position=1 -105,281-475,939-1049,1426-1503,2700-2933
MSPGSPAQHSPVRYRKLTTAGELARPMFTEAAPNTGAARRFIVAAALKKVSGRAFASNAAASSAESAAISTGGITSAPISKMAQSKSMQSLAALHQRPIQLSAHELLPDLAESANEEWGSGRATIASSQASNVGRQQGCIFRTFVKMPIEIWTKVSNTENIEKQQVAMVSSGAETASTAANGTGDEDRVNLEPTEEKVDDIMGWWEDEGSEDNERGGGEEEKNNGMMKMSDGGGRSLDEM

SEQ ID NO: 138981 - protein, 307 aa, Heterodera glycines
  Coding regions on vcDNA: vcDNA=SeqID_65404; Strand=-; Position=1 -58,108-221,280-373,699-920,1284-1471,2486-2593,2643-2691
  Homolog annotation: Hit_ID=NP_741414.1; Match level="QueryCoverage =99%, HitCoverage=14%, E-value=1e-125, Identity=75%"; Hit description= novel Channel type/putative Nematode CAlcium channel (nca-1) [Caenorhabditis elegans] gb|AAM81121.1| Nov
SFISGRNSTLKMLMLTVVMSMLRSFFIIMASMLRSFFIIMAMVLLVLFYAYTGVILFGMVKYGQAVSKHVNFRSGFEALVVHVNFRSGFEALVVLFRSVTGEDWNDIMHDTSRSAPFCYWLPGANYWQTDCGNYYGALIYFCSFYLIITYIVRNLLVAIIIENFSLFYSSEEDALLSYADIRNFQQVWNIVDVEQKGQIPIGRVKFLLRLLRGRLEVDPNKDRLLFKHMCYEMEKLHGGDDVSFHDVLYMLSYRSVDIRKSLQLEELLQREELEYIIEEEVAKQTIKTWLEIKTWLEFCLRRLRSPG

SEQ ID NO: 138982 - protein, 105 aa, Heterodera glycines
  Coding regions on vcDNA: vcDNA=SeqID_65405; Strand=+; Position=1 -171,353-499
MPYSNALADNHLLEVADVRITEQCVLFRRVKQREVFDDNCHQQVAHNVRDDQVEGAESGPETELLKQFKKISAKIFMGGNKSLAGGTLFSTTSALLPLCFLTHSN

SEQ ID NO: 138983 - protein, 132 aa, Heterodera glycines
  Coding regions on vcDNA: vcDNA=SeqID_65406; Strand=+; Position=1 -34,172-536
MANQPFYCFLRDIIENDDHPIWPILARQIWPIFATNIHILDCADDNHLDILAYQISPTILTDVDQLNVIAFDIMFLDGIDDEISTGQLLSEWLHIPRKNGKPKKLYCGKGFNVERHLDWINSFKEVRLVTFS

SEQ ID NO: 138984 - protein, 176 aa, Heterodera glycines
  Coding regions on vcDNA: vcDNA=SeqID_65407; Strand=-; Position=1-528
GAVPPNRCAQIYGETESFRNSFPIACTLILRWIFAPHNCLSTPNGHLKKSIYFCFRAVPLNRCAQIYGETESFGNSFPIACTLILRWIFAPHNCLSTPNGHLKKSIFFVFGAVPPNRCAQIYGETESFGSSFPIACTLILRWIFAPHNCLSTPNGHLKKSIFLFSGQSPRTDAPRF

SEQ ID NO: 138985 - protein, 341 aa, Heterodera glycines
  Coding regions on vcDNA: vcDNA=SeqID_65408; Strand=-; Position=1-1026
MYNQGGRTFRAICEWRRACRQCGAITYANYPHKCPAQIGQTEWVRCARCSGPHQSGDPCFIQPLKDEPMRRRRRRRGQQQQQQQNNNNDDEDDDDDNDGNEEGDDDHGHDADNEEEEEVGTNRSVRLCFFDAETSQDLPLQLRTKVVQKHVPMLIIAEIICEACINEGISVHSGVGQYANGCVCGPPAGPRGRRWCSPPFLNAPGDDNALSANVHYNPRRLFFHSFDDATNNDPVDDFINFLTGSGPHGVKTICLSHNGGKYDIHLILEALHRRNLPPKRICTTGLKIFSMTLKGNHQRHVIFRDSLNYFFCELDALPRTFGLNAESATAKPFLSLSVHPA

SEQ ID NO: 138986 - protein, 101 aa, Heterodera glycines
  Coding regions on vcDNA: vcDNA=SeqID_65409; Strand=+; Position=1 -97,162-266,313-416
MARLLLLVFGLAFVFAVLAFGTAQPPPPFQGSGQFGAPPFGGNSADVSVSASDSSECSGEGGNGVQGGGEYGNGNGGFGGGGAEGGQGMDIDVDVEQSSEK

SEQ ID NO: 138987 - protein, 571 aa, Heterodera glycines
  Coding regions on vcDNA: vcDNA=SeqID_65410; Strand=-; Position=1-1716
  Homolog annotation: Hit_ID=DAA04499.1; Match level="QueryCoverage =97%, HitCoverage=40%, E-value=2e-62, Identity=29%"; Hit description =TPA: pol polyprotein [Schistosoma mansoni]
MESGVKENPILTAKDRPVNEISRVPLTKRWPSPEEMELNKTVAPKGPSKKNVIQTRRLKEERCAVRTTARQDVGQMQNETVLALIETENWVPNFKKKGRVNHHDAVFLVDTGAHITLCSVQTARKLGIKLLHNSEIPGVVGIDGKIVPIMGQTEILIELMGHEVKSIISVVDRNIGKGSYDIILGRNTFQKLSFLLDLQSGKLMEKTKKVMVAEEKETKTQILEEMLKEVGTKNEDEIDRLRECLKENCKAFSENDYDLGTCKIIAPTLLTSTEMPERVRPYPIPEKYESELKAHIGKMLEVGVIKESTTPWVHNIVLVKKANGQLRPCADFRPLNKVTIADPYPLPRMDKVIFRAAGKRWYSTLDLASGFWQIPLDAESSYKCGLITPWGLYQMLKLPFGLRNAPSIFQRTMDQILKGVPNVMVYIDDILIYSEELDEHIESLRNVFRCLCENGLKLKGQKCRFLQKECVYLGHILSASGYQPSLSNREVIENFPPPTNVKEIKRFLGMVSFFRKFIPNFAQIAYPLNKLTRGGAFEFEWGENEEKAMNLLKNHLLKSPSLRAPNYALPF

SEQ ID NO: 138988 - protein, 151 aa, Heterodera glycines
  Coding regions on vcDNA: vcDNA=SeqID_65411; Strand=-; Position=1-455
MVSRSQSPIDQQRNNGSDFDSSLFTLEENEFFQNLLPRLRSFEAAVCSQFRQMENEMRIESERKGEQIRELERMVNEQITVEERSNFDFAERIVKLEDQAEENANTLKGYKQAAKIGLKRIVERIESELKNVKTTIGKLQEKIETVENDFQ

SEQ ID NO: 138989 - protein, 85 aa, Heterodera glycines
  Coding regions on vcDNA: vcDNA=SeqID_65412; Strand=+; Position=1 -67,270-373,857-939
HNFKSMATSANHRPIFEFIVELGIRLQADSLTVAFASVYCHRVLRQKAFPGDQICPFTMASACVLVAGKVTNDARINTRDVMNMA

SEQ ID NO: 138990 - protein, 71 aa, Heterodera glycines
  Coding regions on vcDNA: vcDNA=SeqID_65413; Strand=-; Position=1 -27,292-367,417-526
  Homolog annotation: Hit_ID=CAE66642.1; Match level="QueryCoverage =90%, HitCoverage=7%, E-value=4e-22, Identity=71%"; Hit description =Hypothetical protein CBG11979 [Caenorhabditis briggsae]
MSGCWSAKLGGKKLERARDLFEQCLDKCPPKYAKNIYLLYAKLEEEHGLARHSMDIYNRATGAVEKEEMHL

SEQ ID NO: 138991 - protein, 54 aa, Heterodera glycines
  Coding regions on vcDNA: vcDNA=SeqID_65414; Strand=-; Position=1-163
MFDAGGLSPSDWNAVGLSPSDWNAGGLSPSDWNAGGLNHSDWNAGGLSPSDWNA

SEQ ID NO: 138992 - protein, 33 aa, Heterodera glycines
  Coding regions on vcDNA: vcDNA=SeqID_65415; Strand=-; Position=1 -30,100-171
MPCRSARIQLIILIDEVLSLRTKIHEIEKQNGQ

SEQ ID NO: 138993 - protein, 92 aa, Heterodera glycines
  Coding regions on vcDNA: vcDNA=SeqID_65416; Strand=-; Position=1 -93,142-175,228-284,550-606,655-692
SSSKNVELEKKEQQRLAKKLNHTQAMGHHDKPTNISVANNSSKNNVTSRTNVLVTSKNTTDAAAIGNEIEQYATNEPSLSTNKYSRRQKIKQ

SEQ ID NO: 138994 - protein, 132 aa, Heterodera glycines
  Coding regions on vcDNA: vcDNA=SeqID_65417; Strand=-; Position=1-399
MERHKQQPVKIGELIKENRGWLCALVRTKSGKKCRKLIRNANTEQLLSLVEICLNLVASRFQLTTRQKKRLMPYVDTVRRISRARSERGAKRVLVQKDAGFGGLYAALLTPVLMEVAKILCEQKRINTSHHC

SEQ ID NO: 138995 - protein, 44 aa, Heterodera glycines; identical to SEQ ID NO: 126591
  Coding regions on vcDNA: vcDNA=SeqID_65418; Strand=+; Position=1 -45,128-217

SEQ ID NO: 138996 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_65419; Strand=-; Position=1-838
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 138997 - protein, 255 aa, Heterodera glycines
  Coding regions on vcDNA: vcDNA=SeqID_65420; Strand=+; Position=1 -58,112-197,239-365,413-608,691-785
  Homolog annotation: Hit_ID=CAE75302.1; Match level="QueryCoverage =97%, HitCoverage=41%, E-value=2e-33, Identity=39%"; Hit description =Hypothetical protein CBG23272 [Caenorhabditis briggsae]
EMPFRDRTAEFRTVAKSCQLRQQPNGYRKSEREKIVNSSIQLRQQPNGYRKSEREKIVNSSIQFNQLAKRIGRDLSMTCAKMEKLAQLRIGRDLSMTCAKMEKLAQLAKKKSLFDDRAGEVEELSQIIKQDITGLNKQIANLQQSHRTSIKQDITGLNKQIANLQQSHRTSGGSSVSLRQEQQSQNHSKLVVVGLQSKLANISKNFQNVLEIRTENLKFKRERRNLKFKRERREKFSQSGAIPSNLPPSTRSGPS

SEQ ID NO: 138998 - protein, 106 aa, Heterodera glycines
  Coding regions on vcDNA: vcDNA=SeqID_65421; Strand=-; Position=1 -59,241-373,708-836
MIPRILAWKSKVSMGLLSLSRTEHALTECQTRLHQRVPNAFLGTFDLGHSQLAEEKASKQRKDQKRKSRKAITWTKEEWKSLNRRRNGRMEPSQSDFQKDLMMTNN

SEQ ID NO: 138999 - protein, 350 aa, Heterodera glycines
  Coding regions on vcDNA: vcDNA=SeqID_65422; Strand=+; Position=1 -138,189-333,379-482,1201-1350,1875-2063,2110-2166,2212-2480
  Homolog annotation: Hit_ID=BAB47439.1; Match level="QueryCoverage =94%, HitCoverage=86%, E-value=5e-45, Identity=39%"; Hit description =KIAA1810 protein [Homo sapiens]
MVRISVSFVVLASFVSTVLTILNAFFLKKQFYPSVVYLSKSSTSMAVLYFQAAVLSYLVFSLLRCLFFGQLRVAEVERAQERVWHTLMETCLAFTVFRDDFSPVFVVQFVVLFFIKAFHWLAEDRVDYMMHTFPLFAIRPFYLTVRAFRKAVNDVILSRRAINAMNNLFPLATAQDWQKAQQNPQQQQQAAASLANGSVGEQPQTLDQERVQPQQSATDGTQQPSQQQAQHFPWSPQQPFFMPFGGLPPPPPFLPFPQPPLFAGLSDAEIAAMEGTERRAVEARIQSLRNISTLLDAALLQFQQYLSVSPGIAPQQTQRDENFAQNLSTSADSATDAETNGRESQRNETE

SEQ ID NO: 139000 - protein, 45 aa, Heterodera glycines
  Coding regions on vcDNA: vcDNA=SeqID_65423; Strand=+; Position=1 -49,238-326
MFKYNTRQFNFYPIIKSNFLCWIFVTFSLFKLVWRFVGVFPLLFC

SEQ ID NO: 139001 - protein, 103 aa, Heterodera glycines
  Coding regions on vcDNA: vcDNA=SeqID_65424; Strand=+; Position=1 -204,505-612
MASATTNCTPTYATSTPTSATTVGTTPSVTTTGTPVLTTTTRPPTNGVLCRCTRKEYRMLTADERTRYKIDYFFCPWLICRVGFCLWLFCHNANWTMSIFLGN

SEQ ID NO: 139002 - protein, 79 aa, Heterodera glycines; identical to SEQ ID NO: 127784
  Coding regions on vcDNA: vcDNA=SeqID_65425; Strand=+; Position=1 -127,178-287

SEQ ID NO: 139003 - protein, 184 aa, Heterodera glycines
  Coding regions on vcDNA: vcDNA=SeqID_65426; Strand=-; Position=1-555
FDKEVVLMDHYLIALLIGETEISRMTNKLAADLSVFVHWSDSEPKGAKMDKFWQKKRTIEMHRMYDGLFDVELEVEMTKIALAFEETIKGMKEFLAANRNAGIEKKLAEEWDKMAKKADKETKRRADEMPKRTNWNNLMDATPKWVKELHAAKFKKYADKRLGRETENAFFVHPGESLINELKK

SEQ ID NO: 139004 - protein, 103 aa, Heterodera glycines
  Coding regions on vcDNA: vcDNA=SeqID_65427; Strand=-; Position=1-310
EFEKGICDDHQQIGNWDIPKFDKMEAMQIYESIMAQGERGKTINLYCIGMLIERFINMRIFFCKMDSDRLVQSKEKLITLIGEMGLIQLEQMYPEVMNFCGFN

SEQ ID NO: 139005 - protein, 120 aa, Heterodera glycines
  Coding regions on vcDNA: vcDNA=SeqID_65428; Strand=+; Position=1-365
EILRNFFVRVALCTSCLLYELPIVRVALCTSCLLYELPIVRVANCTSCLLYELPIVRVALCTSCLCTSCQLYELPIVRVALCTSCPVYELPIVRVALCTSCLLYELPIVRVACVRVAMTP

SEQ ID NO: 139006 - protein, 78 aa, Heterodera glycines
  Coding regions on vcDNA: vcDNA=SeqID_65429; Strand=-; Position=1 -120,570-684
MAKSKSLGKQNDVKTKNDLKHSDANDGDSDDEHVQLLSTSRLGKITDNIINKKHDVQLRPVVDTSRKSRNLQRNNTAG

SEQ ID NO: 139007 - protein, 69 aa, Heterodera glycines
  Coding regions on vcDNA: vcDNA=SeqID_65430; Strand=-; Position=1 -4,111-178,235-372
MEKSDQKRDPTTWMDTAREWSGWMANKLGNIYSWSKAETPAAEQSSPNQKTKSLKMVKQNSSPKREEIV

SEQ ID NO: 139008 - protein, 302 aa, Heterodera glycines
  Coding regions on vcDNA: vcDNA=SeqID_65431; Strand=-; Position=1 -283,802-1068,1530-1889
NLLKELDDLINLIKNARDNFTHAEVELGVASAFKHKTNDIDCWINDAKFKQFLDGQPIAIDLLPRGDANNMQYILDSLLQRREHFINENLGKGKLENKNDHNLIKRMDSVIRHVNKARKFLKKAEGGSSEKTRAHSYITEKKMNQIFKKILNGENVMPILLPKGGSSCLEGYLDNLIKRRELMRYGGEGLLEGQQQQQNEENSDDNAQKHLQNGDNYYSKPYDKYSNSHGKYGKSKSLPTNGDGKKQAIENENEYSKSRSMPTTGAEYEEKGTKKHTVTSKSSIYPIHPTVTHFIMPISSLS

SEQ ID NO: 139009 - protein, 347 aa, Heterodera glycines
  Coding regions on vcDNA: vcDNA=SeqID_65432; Strand=-; Position=1 -69,870-920,1207-1464,1961-2623
IEEQPHNEDETENDEQSEDGQEESPPESSRKRYQLLLDEKGPQILERLNNLMEAIKRRKTELIRDQENGLMPEDHGKALLQNCEVDDELFNKFLYGTDIEHELLSKGGPNCLHTIYNSLEKRRNKMIEKRPSLVKMKPNVSIKINGSEQDSDLMHIAKNLRPIKTSKNLPNEKTKKVDKPHKKDNSPNRGINSPTKMPKIDHYISPKLVSSPSKKLINSPSKVKIKQTDKLPKWDTWPNNGIISSPKTTVINNVKLPKWNTWPETDSNGPRNAVPNVDNVPKLDNSPKQGINNPLMTRAINSDNVPKLDNSIKQGINSPPKEGTVKNDNAQKLNSSPDKGKNVQIRV

SEQ ID NO: 139010 - protein, 92 aa, Heterodera glycines
  Coding regions on vcDNA: vcDNA=SeqID_65433; Strand=+; Position=1-277
SFAVSLYGRDDGFEHKRLRKQAAKTLKQFESDPARTADDQEKMKHMVMANLPSDQEMSMYKDSIGLYADYYAAKSGNFVGIAECQALSIHLN

SEQ ID NO: 139011 - protein, 99 aa, Heterodera glycines
  Coding regions on vcDNA: vcDNA=SeqID_65434; Strand=-; Position=1-300
MSDNSQIAIQLQRMAFLLDEKEAGLETIQKLLVAKNEFLEKIAADLLERQKIQHAIESQQNARAQLLNEMANNLLTAASDFQFHLDLHIIGENPPSESP

SEQ ID NO: 139012 - protein, 174 aa, Heterodera glycines
  Coding regions on vcDNA: vcDNA=SeqID_65435; Strand=+; Position=1 -62,115-141,197-293,406-600,3627-3738
  Homolog annotation: Hit_ID=NP_495408.1; Match level="QueryCoverage =94%, HitCoverage=23%, E-value=2e-38, Identity=53%"; Hit description =ATP-binding cassette sub-family D member 3 like (74.9 kD) (2H174) [Caenorhabditis elegans] gb|AAA68340.1|
LLFMVAIALSLMLRTYADVWMIQTSTKIEAIQTSTKIEAAIAIISRHKPRFWRSLTEYLLCMPLVSVINSFLKLSLCELKLCFRERLTHHFYAQYLDGFTFYKMTNLDNRIANADQLLTQDVDRFCEGIVELYSNLSKGNANFCLNSFRSEIAIGSRTFGSYLVYTKNWVTPKH

SEQ ID NO: 139013 - protein, 38 aa, Heterodera glycines
  Coding regions on vcDNA: vcDNA=SeqID_65436; Strand=-; Position=1 -55,425-486
MQANGEHNITGPLDVEFKAQTIFPYAPLQELNSSLISR

SEQ ID NO: 139014 - protein, 288 aa, Heterodera glycines
  misc_feature (252)..(252): Xaa can be any naturally occurring amino acid
  Coding regions on vcDNA: vcDNA=SeqID_65437; Strand=-; Position=1 -75,1174-1971
  Homolog annotation: Hit_ID=NP_500013.1; Match level="QueryCoverage =94%, HitCoverage=19%, E-value=1e-42, Identity=37%"; Hit description =predicted CDS, polyprotein family member (4B673) [Caenorhabditis elegans] gb|AAC02594.1| Hypothetical pro
NASAFTSEFFREFCSMLYIDKKYACPHWSQGNASTERTFRTFHNILAKISKTQPDFDEFLDAANFCYNTSVHASTGETPFFLMFGRDPIFCVDQIIDPKVRDPIAISDRNEFKQKLVAIRHAWHAAADEYAKAQRKMKEQYDRKARPQQITIGDRVLIRNYDGRVGTSKKFHLPWRGIFRVIKIDGIYVTVISCTSPNSNPKRLHLNQIKKCFEILGPPCTMPTQPVEEKKCLEKTQNVEEVSSERSVNPKXNAESREGENLEEIHAREPETRPEIEADEEKNVNEKT

SEQ ID NO: 139015 - protein, 33 aa, Heterodera glycines; identical to SEQ ID NO: 136332
  Coding regions on vcDNA: vcDNA=SeqID_65438; Strand=-; Position=1-101

SEQ ID NO: 139016 - protein, 83 aa, Heterodera glycines
  Coding regions on vcDNA: vcDNA=SeqID_65439; Strand=+; Position=1 -55,145-341
MSSSIGSPDTFFRSETDQEAAAGAEEVGKYEVFSWHGNLSDQLSAELFVTDQQLLKVRPFEWTNDQTAGGEGRPKTEKDLWKI

SEQ ID NO: 139017 - protein, 56 aa, Heterodera glycines
  Coding regions on vcDNA: vcDNA=SeqID_65440; Strand=-; Position=1-243
AYFGHFYGILCLFHFLRRIFFQKITIKKILFTYFPTYFEDFCTYFIHIFSIFYYIF

SEQ ID NO: 139018 - protein, 405 aa, Heterodera glycines
  misc_feature (4)..(4): Xaa can be any naturally occurring amino acid
  misc_feature (211)..(211): Xaa can be any naturally occurring amino acid
  misc_feature (388)..(388): Xaa can be any naturally occurring amino acid
  Coding regions on vcDNA: vcDNA=SeqID_65441; Strand=+; Position=1 -124,189-282,329-407,470-682,765-930,978-1034,1099-1212,1268 -1342,2266-2355
  Homolog annotation: Hit_ID=CAE61649.1; Match level="QueryCoverage =86%, HitCoverage=74%, E-value=3e-70, Identity=49%"; Hit description =Hypothetical protein CBG05583 [Caenorhabditis briggsae]
MRNXKNDSGCRVQMSKNLEVYHGTSERICLVKGKLAATMIVMGAILEKIQEKIDANHMGAILEKIQEKIDANHASDHFDLKGLDRTKEMKFVVPNTSAMKFVVPNTSAGMVIGKNGTSIKEIRDRFSFSANIQIYPKAGSEEAKISAERVITVGHESNEVLLSAVQRVLEKVVADPMHAQPVPAESQASNKGTKTISGHKKGHKKGVSLYXMFSPHFVSASGFEFGGSRLSAGSNQFGGISNMGNNSGEQKPNVTFSFGGPSFKYPLSFGGPSFKYPLQGTGNNELLAFLDNLQSTLLLAFLDNLQSTLRSSGFNDQSVSEVMQAMQVLAKYNIMGLGLGLGVAAMAQMRGLGLGLGVAAMAQMRNTESAMAQQNHSEWTHHDRESYXPGTATSFYDGHRSLSVP

SEQ ID NO: 139019 - protein, 157 aa, Heterodera glycines
  Coding regions on vcDNA: vcDNA=SeqID_65442; Strand=-; Position=1 -78,311-433,581-752,820-920
MRRKSIVGEQKDEESAGSSKGSGRKKGRFSNLARKLNIRRKPSIGLHSKRLSPALAPQPTPRALQSKQLEMEMSDRQAQDRQLRSLLIPTPINITCKRHENGEKGNDALDIMWENAIPLMNSVDSYELFLNGKQCDSVKAKARRLRITDLNPAEDIK

SEQ ID NO: 139020 - protein, 49 aa, Heterodera glycines
  Coding regions on vcDNA: vcDNA=SeqID_65443; Strand=-; Position=1 -40,87-194
EKPKERSHSAMDGCDTNRTVSTLVLPPVSPTRTVILSGSSFDTVRLNFS

SEQ ID NO: 139021 - protein, 87 aa, Heterodera glycines
  Coding regions on vcDNA: vcDNA=SeqID_65444; Strand=-; Position=1-260
CLSTPNGHLKKSIFLFSGQSPRTDAPRFMGRPNPFGNSFPIACTLILRGIFAPHKCLSTPNGHLKKLFFLFWRSPPRPDAPRFMGET

SEQ ID NO: 139022 - protein, 36 aa, Heterodera glycines
  Coding regions on vcDNA: vcDNA=SeqID_65445; Strand=-; Position=1-156
KPKLFGLFKKELKIFKNFIHIPFDRKSIREPYLTFN

SEQ ID NO: 139023 - protein, 30 aa, Heterodera glycines
  Coding regions on vcDNA: vcDNA=SeqID_65446; Strand=-; Position=1-200
FFINYLFFAKLIHKYFFRTCSETHKTLIKS

SEQ ID NO: 139024 - protein, 83 aa, Heterodera glycines
  Coding regions on vcDNA: vcDNA=SeqID_65447; Strand=-; Position=1 -77,128-170,240-372
  Homolog annotation: Hit_ID=CAE68486.1; Match level="QueryCoverage =96%, HitCoverage=21%, E-value=3e-10, Identity=42%"; Hit description =Hypothetical protein CBG14288 [Caenorhabditis briggsae]
VRALDTRKDKSVRQNTLDGLGEAMKEAASKAVGAESTFGAILLKVSQTESKMAAGERQLIQSVTTQTLASLRHLLENELRTVQ

SEQ ID NO: 139025 - protein, 65 aa, Heterodera glycines
  Coding regions on vcDNA: vcDNA=SeqID_65448; Strand=-; Position=1-195
MPWHEFVRYFTDICVCQLLTMGTLTECKQPQQKQAQRGVSLRRKQLSMQLSNVTIGLTEKRWREW

SEQ ID NO: 139026 - protein, 130 aa, Heterodera glycines
  misc_feature (9)..(9): Xaa can be any naturally occurring amino acid
  Coding regions on vcDNA: vcDNA=SeqID_65449; Strand=-; Position=1 -264,437-562
  Homolog annotation: Hit_ID=EAL29911.1; Match level="QueryCoverage =73%, HitCoverage=3%, E-value=8e-32, Identity=68%"; Hit description =GA15168-PA [Drosophila pseudoobscura]
HHQCFVIDXYFIIRNESNNFYRLVKKYFFKLIFCQQIIKERELELQKEHRRQEDNDKLRREFARQANEFHQWLADTRGEMMEASGSLEQQLDTIRRNAQDIKAQRAKLKKVEDLGALLEEHLILDNRYTE

SEQ ID NO: 139027 - protein, 31 aa, Heterodera glycines
  Coding regions on vcDNA: vcDNA=SeqID_65450; Strand=+; Position=1-93
MGSKIPTQIKVQAIGKLFPKGFGLPINLGAS

SEQ ID NO: 139028 - protein, 41 aa, Heterodera glycines
  Coding regions on vcDNA: vcDNA=SeqID_65451; Strand=+; Position=1-125
MQVPPLLYALALLCNATKFANQNTPNIIRNTLSHLTRRQTE

SEQ ID NO: 139029 - protein, 309 aa, Heterodera glycines
  Coding regions on vcDNA: vcDNA=SeqID_65452; Strand=+; Position=1 -245,695-812,1217-1257,1554-1774,2016-2320
MMMIARDAAYCSKRAGPGTVVPKWATLHKGAVMGNDRSGRDEEGTGAGDAIGGQQFECNSKSRMQFGTTALKSAPICQHLAKRLNYKLGLINSLPNKLESHCAAKCSAIGRQNDRDATADHVTVPSLAKRLWAEFFWLRSLAFRILEIDEEAAQVAKEKKAEQQLHKLQLNINTKNTGEEAAQQQKQRHNAWGAARDTAQTQKTEAAADFYYATDSENMLISSNDQEEDNGIDADRSSSSSATAFDGTFAAGQSAADGLPLFVSVPLVLLYLCFIAFVVSCFDWPDQRTGDDGPPLSFGEAFYFAYGAT

SEQ ID NO: 139030 - protein, 247 aa, Heterodera glycines
  Coding regions on vcDNA: vcDNA=SeqID_65453; Strand=+; Position=1 -313,772-1202
MTIGCDFDYAKNAHDAGGGDNNANVDTRQKLSRHKSTSNVWWRTAKSLEAISNNFGMKMSRNLAENEAKNDDIEMQRDENEIGTMAKREYEAKAPTERRIYFKKEIAESAASSSTAAATTNYKQIRRTHSERVSQRRRHAHGGAQLYVINEGESHQQTVAGGERLLRLRRLRRQRSRQNVSPLVQQQQQQHGDSSGTASVAQMESGDERTQRCCDESVASSPSSSRRLQMHAGPQPPMGADNSTNGE

SEQ ID NO: 139031 - protein, 129 aa, Heterodera glycines
  Coding regions on vcDNA: vcDNA=SeqID_65454; Strand=-; Position=1-389
  Homolog annotation: Hit_ID=AAC04494.1; Match level="QueryCoverage =69%, HitCoverage=70%, E-value=1e-27, Identity=57%"; Hit description =unknown protein [Arabidopsis thaliana] pir||T00799 hypothetical protein At2g32690 [imported] - Arabidopsis
MGSFPLLTICSMIGVVLFVVSPIQTQSYGFDQNQQQQGGPPMGMGGNGGMSGGGGMPGGGGMPGGGGMPGGGGMSGGGGMPGGGGMPGGGGMPGGGGMPGGGGMPGGMGGGGGGPGGMPGGMGGDAMPF

SEQ ID NO: 139032 - protein, 106 aa, Heterodera glycines
  Coding regions on vcDNA: vcDNA=SeqID_65455; Strand=+; Position=1-323
RFLKTPAIYPNQLNALKHYGTTLLDYLLTNGESNLSQKLVQIDGMPNLVKHFCQFLGYGLMKDADPSENDIKIELPAEWKIFCKKYMEKISRKISGYSEQLKSNCN

SEQ ID NO: 139033 - protein, 34 aa, Heterodera glycines
  Coding regions on vcDNA: vcDNA=SeqID_65456; Strand=+; Position=1-158
KIFMKMFNYIAFKFKIQIFLIIFIYESPKHLTLK

SEQ ID NO: 139034 - protein, 16 aa, Heterodera glycines
  Coding regions on vcDNA: vcDNA=SeqID_65457; Strand=+; Position=1-48
MAIVHSPPSLRKRFCE

SEQ ID NO: 139035 - protein, 174 aa, Heterodera glycines
  Coding regions on vcDNA: vcDNA=SeqID_65458; Strand=-; Position=1 -112,168-307,407-676
  Homolog annotation: Hit_ID=CAE56115.1; Match level="QueryCoverage =82%, HitCoverage=8%, E-value=8e-11, Identity=35%"; Hit description =Hypothetical protein CBG23721 [Caenorhabditis briggsae]
MSSTRSRRSGIVDSGGLNPSTIHLLPMARVKKELEARGLDTKGSAADLAFRLQEYVRLAGGFVSKFDPSPASEPTTPLKKRKRKQLDVEVDENVAGFDRQEASSPVAAKTFRHFSWAIAPPTAPHPAKEAKKEEIIESGNEEERDEEEEAEKEQNDQIQIGRKIEETERQQKTK

SEQ ID NO: 139036 - protein, 155 aa, Heterodera glycines
  Coding regions on vcDNA: vcDNA=SeqID_65459; Strand=-; Position=1 -122,170-278,322-400,535-690
  Homolog annotation: Hit_ID=AAL87139.2; Match level="QueryCoverage =88%, HitCoverage=20%, E-value=2e-16, Identity=36%"; Hit description =DEAD box RNA helicase Vasa [Cyprinus carpio]
GKITPNRRIRQTFVLAESAEKRHTLVRLLQLEKEQNEQLDRSKKLLSTMVFVNTRNDAEIVCNFLNSRGFSATTINGRRDQPTREKAVWDFRTGEFQIIVTTDVINLDLPCADSAEDAYYKYVQRIGRTGRIQQGMSTTFFDPATDMDLAALLVE

SEQ ID NO: 139037 - protein, 131 aa, Heterodera glycines
  Coding regions on vcDNA: vcDNA=SeqID_65460; Strand=+; Position=1 -87,227-535
MSKTAKRTISKNGTDEEKLKWTWLFSRIKLDDELFLTFIKEQTKFEEICREEGEELWTKIGLLSKRKGKGTYDIGDTVEYLTKQYEGYLGILYLLKEKWQCDGITEKQKREKCEKFQKYVEIIFIINKIIS

SEQ ID NO: 139038 - protein, 25 aa, Heterodera glycines
  Coding regions on vcDNA: vcDNA=SeqID_65461; Strand=+; Position=1 -38,144-183
MVSVGFPNLKLGGFLVRIFDKNSHN

SEQ ID NO: 139039 - protein, 45 aa, Heterodera glycines
  Coding regions on vcDNA: vcDNA=SeqID_65462; Strand=-; Position=1 -94,275-318
MRRFGAGGPRNRFEADAVPMTDAIELNQKNYDRLLRIKLLNKIVY

SEQ ID NO: 139040 - protein, 242 aa, Heterodera glycines
  Coding regions on vcDNA: vcDNA=SeqID_65463; Strand=+; Position=1 -69,184-421,485-558,615-797,1026-1190
MIKDSSQQQNVKLYIHSGCNCSMFIKSLNPHGPFTMVIVEKQCPSLPIDQAFSVGPTDRPSLPIDQTFSIGHTDRVPISVSFTALTDANINSMAVELLIASDDGNNRQIIRFDIGTDSDLTVHLASGMKNEFISKHTRLAKGSYELKVEIELHPYYYVIIMNGTKMGIKYWPKQWWNEFQWLGVNQIKVGVPFVEKFWASESRKFLGPQNAIPNMRGTKGIFQSVQISTELWAKSLEQFFTF

SEQ ID NO: 139041 - protein, 97 aa, Heterodera glycines
  Coding regions on vcDNA: vcDNA=SeqID_65464; Strand=-; Position=1 -64,514-743
  Homolog annotation: Hit_ID=NP_494372.2; Match level="QueryCoverage =70%, HitCoverage=18%, E-value=2e-13, Identity=49%"; Hit description =FUcosyl Transferase (44.3 kD) (fut-4) [Caenorhabditis elegans] gb|AAF39933.2| Fucosyl transferase protein
MPIRSGPAELEISVSNKKIKIESHFFYLAFENAVCTEYVTEKFWKALRNLMVPIVLSRKVMEEVGIPNGTFIAVDDFNSVKALADYLKINQREENAL

SEQ ID NO: 139042 - protein, 78 aa, Heterodera glycines
  Coding regions on vcDNA: vcDNA=SeqID_65465; Strand=+; Position=1 -146,1396-1486
MVPIVLSRKVMEEVGIPNGTFIAVDDFNSVKALADYLKELQRDTDKYMRTKGPTLLNLTDRTGWHAFNVICRKRKCSI

SEQ ID NO: 139043 - protein, 144 aa, Heterodera glycines
  Coding regions on vcDNA: vcDNA=SeqID_65466; Strand=-; Position=1-434
MEKPFNRRFGAKPRFFSVGEKVYARHRLSQQWRAGHVTTCKGVMYDVEFVNGSTSRFHANQLIKRETDQMDTDPLDVFNEEFGLPNVAQQPNQRPNVAVLQLNIVDNAEPANDPPPVEQQPFSPIRPRRQYPQRNRRPPDRYSP

SEQ ID NO: 139044 - protein, 286 aa, Heterodera glycines
  Coding regions on vcDNA: vcDNA=SeqID_65467; Strand=-; Position=1 -438,807-1229
  Homolog annotation: Hit_ID=XP_320889.1; Match level="QueryCoverage =48%, HitCoverage=17%, E-value=4e-35, Identity=49%"; Hit description =ENSANGP00000012033 [Anopheles gambiae] ref|XP_313651.1| ENSANGP00000013044 [Anopheles gambiae] ref|XP_314
MCEKHQAWVKKYLAKNANQRKQVNYVRLGGLKINLVNQPKRLIEAPVNVDGNAIEFVMDPGAEITVLNKESHRLVGTRLSSCSEQAFYHDGSQCRLFGKGTATFSIGGRMTKGTFYVSDEGSLNLLGIDMLDALGLMDSFRTNLTDIELDDNSIELCTIATHRGNFEYQRLPFGVKSAPGIFQSIMDSMLAGCNCAIAYLDDVIVVSRSADEHQQHLANVFQRMENFGFRIKPEKCSFFQSQIKYLGFIVDKDGRRPDPAKIQAIAEMPVPTNVSELRSFLGMINH

SEQ ID NO: 139045 - protein, 98 aa, Heterodera glycines
  Coding regions on vcDNA: vcDNA=SeqID_65468; Strand=+; Position=1 -11,73-358
MNRRWICNDVWMDIFPSFDHAQLGLKLALLSPRFNALVDKHFNGKSELTIWRPIEISKDKGPEPKLIVQMDDKYNKFMEFPLPDRPLPSKIRFKRLRI

SEQ ID NO: 139046 - protein, 192 aa, Heterodera glycines
  Coding regions on vcDNA: vcDNA=SeqID_65469; Strand=-; Position=1 -84,527-1021
  Homolog annotation: Hit_ID=AAP32203.1; Match level="QueryCoverage =88%, HitCoverage=37%, E-value=2e-11, Identity=25%"; Hit description =latency associated nuclear antigen [Saimiriine herpesvirus 2]
MIDFMRHKKESTTTATTKMEDGGGSRGRAKSKHSTGSTAGGGLSVSAPNNRKKTPNQQQQKGNSEGGGEGRENGGKREEKGGEKGAAAEAEEKEKKVAVEHHQKQQQQKQEVQAVQQQQQKQILVGMEMKMDNSKNGETREEVEKEGNSTGEGGETEEKERKGKRKNSAEGREERGENEAEKREEQQQIDTF

SEQ ID NO: 139047 - protein, 169 aa, Heterodera glycines
  Coding regions on vcDNA: vcDNA=SeqID_65470; Strand=+; Position=1 -216,422-461,610-863
VTIDDEMANQRGMGDFYDSDDETPPENKSELNDRQHNFGDELGGGQWDGNSEGNGERETRAHEAANGYAWTVNKVKWHKNLKNSLEIAHLSPKLNLTMKRFNSWASQLENELEGWKDGCPCDFLPNMSPISVFRRAFMLMSNVLRMQMTPLPSPLLPPGLRHSFTNIAC

SEQ ID NO: 139048 - protein, 95 aa, Heterodera glycines
  Coding regions on vcDNA: vcDNA=SeqID_65471; Strand=-; Position=1 -144,245-388
  Homolog annotation: Hit_ID=NP_499976.1; Match level="QueryCoverage =96%, HitCoverage=6%, E-value=6e-10, Identity=40%"; Hit description =putative protein family member, with at least 15 transmembrane domains (4B476) [Caenorhabditis elegans]
YVNDFESVHDVLVVTVLPGIYLLFALILFMKSRIIKDGPPPMVHRKRRIFVQVVLISSVNAIASGIYVVMQFVPLSEFLLVAGQFYWILAHGKRN

SEQ ID NO: 139049 - protein, 79 aa, Heterodera glycines
  Coding regions on vcDNA: vcDNA=SeqID_65472; Strand=-; Position=1-240
TIAEVIQRRPKDNFLRKKRTPRGRSDSKSIASTFGSFPFPTDGTRAGKRSEVVFQRVPSLKIEIGAGKAMASDEDATAL

SEQ ID NO: 139050 - protein, 95 aa, Heterodera glycines; identical to SEQ ID NO: 133575
  Coding regions on vcDNA: vcDNA=SeqID_65473; Strand=+; Position=1-660

SEQ ID NO: 139051 - protein, 19 aa, Heterodera glycines
  Coding regions on vcDNA: vcDNA=SeqID_65474; Strand=+; Position=1-59
TAPNLLASQQSLLNLPDRT

SEQ ID NO: 139052 - protein, 46 aa, Heterodera glycines
  Coding regions on vcDNA: vcDNA=SeqID_65475; Strand=-; Position=1 -141,310-386
LVRPLCSLSRALRRFFNFCWPWTGASRPFFKFVELIRALRARFLAC

SEQ ID NO: 139053 - protein, 34 aa, Heterodera glycines
  Coding regions on vcDNA: vcDNA=SeqID_65476; Strand=+; Position=1-209
KRARSARLRPRSSLNSPTNLETGAKRPSEASKLP

SEQ ID NO: 139054 - protein, 125 aa, Heterodera glycines
  Coding regions on vcDNA: vcDNA=SeqID_65477; Strand=+; Position=1-378
  Homolog annotation: Hit_ID=AAQ89162.1; Match level="QueryCoverage =61%, HitCoverage=61%, E-value=7e-11, Identity=44%"; Hit description =VLGN1945 [Homo sapiens]
MIVLFLTIVVPFQQFLYLSNNYCTFSTVVVPLLITFVALLITFVPLLITVVPLLITFVALLITFVPLLITVVPLLITFVALLITFVPLLITVVPLLITFVALLITFVIFFYLKIFIMYFLNLQKN

SEQ ID NO: 139055 - protein, 41 aa, Heterodera glycines
  Coding regions on vcDNA: vcDNA=SeqID_65478; Strand=+; Position=1 -10,287-392,798-807
MKRTRELNGVIGLVEQTFKHFVIIIIIITEIAGSGTTNESP

SEQ ID NO: 139056 - protein, 159 aa, Heterodera glycines
  Coding regions on vcDNA: vcDNA=SeqID_65479; Strand=-; Position=1 -165,509-823
  Homolog annotation: Hit_ID=XP_320889.1; Match level="QueryCoverage =34%, HitCoverage=6%, E-value=3e-13, Identity=57%"; Hit description =ENSANGP00000012033 [Anopheles gambiae] ref|XP_313651.1| ENSANGP00000013044 [Anopheles gambiae] ref|XP_3141
MPVPTNVSELRFLGMINHYQRFVKNIRFIQQPLDELLKQDKVWQWSADCQNAFEKRWAITLLGYDFEIEYQNTADFGQADILSRLIAKTPVLDNEVIIANIRESNETGVLNFVSKTLPLGTMIWPRPRQTIGDQKFHRIPPLRWTICAHFVPVTAFPKF

SEQ ID NO: 139057 - protein, 113 aa, Heterodera glycines
  Coding regions on vcDNA: vcDNA=SeqID_65480; Strand=+; Position=1 -95,248-338,382-535
MTKIKEDIGEAFVWISVDETTDKMGRMIANLLQFSANIKKERVLFLVTDGAAYMKKAGRQLKVFYTNLLHVTCLCHALHRVAEKVRDEFAQVDKLISKTKQIFLKAPHRLSVY

SEQ ID NO: 139058 - protein, 183 aa, Heterodera glycines
  misc_feature (38)..(38): Xaa can be any naturally occurring amino acid
  misc_feature (54)..(54): Xaa can be any naturally occurring amino acid
  misc_feature (120)..(120): Xaa can be any naturally occurring amino acid
  misc_feature (177)..(177): Xaa can be any naturally occurring amino acid
  Coding regions on vcDNA: vcDNA=SeqID_65481; Strand=-; Position=1-562
  Homolog annotation: Hit_ID=BAB33421.1; Match level="QueryCoverage =100%, HitCoverage=65%, E-value=9e-52, Identity=64%"; Hit description= putative senescence-associated protein [Pisum sativum]
EGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 139059 - protein, 69 aa, Heterodera glycines
  Coding regions on vcDNA: vcDNA=SeqID_65482; Strand=-; Position=1 -124,380-466
CATSFISESFARKANLLGNIDRSNCETIYVPIFGGAKVLGWANDVQIRIDELDYQFVYRLGVMEDKHLP

SEQ ID NO: 139060 - protein, 229 aa, Heterodera glycines
  Coding regions on vcDNA: vcDNA=SeqID_65483; Strand=+; Position=1-692
QLKSPTAFQLKPQQPSKPQAPPSGSPPRFEETEHQQPPPPPPPTSAAQIDPSRLIHTLDPPKIFFRTPPANQNPLTYVPNSVFILYETNMERFKVVFNEEIISHLSFSPQLGYVLGFENPQHVVSNEVAKYGFDLRGGISSFAVYSKGLTENMIIGNSLSSLLRVVSISGAIPGEYNEKIYDSPIFARVLPREINEIEIELRTMDKGRLVPFAYGTTMAVLIFKKVINF

SEQ ID NO: 139061 - protein, 153 aa, Heterodera glycines
  Coding regions on vcDNA: vcDNA=SeqID_65484; Strand=+; Position=1 -81,208-296,340-454,944-1041
  Homolog annotation: Hit_ID=NP_494897.3; Match level="QueryCoverage =98%, HitCoverage=13%, E-value=7e-36, Identity=50%"; Hit description =p-type trefoil domain and Glycoside hydrolase, family 31 precursor (106.8 kD) (2F206) [Caenorhabditis ele
DQFIQIATFLSSDRLYGLGENTHHELKHDFSIYKTWSAFSRDQGNEYYVPGSYNGYGVHPFYVGLEPSGKAHGVLILNSNGYGVHPFYVGLEPSGKAHGVLILNSNAQEYVTGPGPHFVYRTIGGQLELFFFPGPTAEEVIRQYQQIIGTPLF

SEQ ID NO: 139062 - protein, 73 aa, Heterodera glycines
  Coding regions on vcDNA: vcDNA=SeqID_65485; Strand=-; Position=1-220
LRIHQQQNYFHSALSDPTTVETLGTVVGTTVRRAKEGTVETVVLQMVMIREGISAGASEIWRGIIGAKFGKRA

SEQ ID NO: 139063 - protein, 168 aa, Heterodera glycines
  Coding regions on vcDNA: vcDNA=SeqID_65486; Strand=+; Position=1 -23,397-752,997-1124
MFTPQYPMYTESPSRLPQQLEATKETVAELAPADHQLPPNGTAIVSDDGGGIVVPTVSELTETTVTTTTVHHTQQRHAVETTEQQQQLVPNGAKPYQHQQQHQQEENEQNHDERQQQQQQPTVLTDEMPQHNAITQNGHAEPALNGELNGDMHHPNEQAQIFLKTHTY

SEQ ID NO: 139064 - protein, 52 aa, Heterodera glycines
  Coding regions on vcDNA: vcDNA=SeqID_65487; Strand=+; Position=1 -66,210-302
MTEKMMVVPPEADRFLADFVDEINLDSNQGFFFDREIIVKPFPGFEYSFSNS

SEQ ID NO: 139065 - protein, 216 aa, Heterodera glycines
  Coding regions on vcDNA: vcDNA=SeqID_65488; Strand=+; Position=1 -150,204-419,495-564,619-833
MAPLFHRFSSLFVFLMPFLSVVLLPSTVCTGSDSAAAPFDRKNYPKIDLRLFEWPIASHSGSSAEVSFIAVDCYTQLDRSFISTDAVLRLNNSLALRHRACLLRIPTGTRLTVTEMQTTNRKSYATVLAGASHYELPLRTEYIRKGQNQNFGPWHVPCQQAYVLFNSRGRKMEWVEFRLDDETEADKEMASADECLADEEEDEEEEEKGYRKKRAH

SEQ ID NO: 139066 - protein, 39 aa, Heterodera glycines
  Coding regions on vcDNA: vcDNA=SeqID_65489; Strand=+; Position=1-117
MGNYGQSEPKECRRVLMMPNGSISMIFPSPTTIKTHSFR

SEQ ID NO: 139067 - protein, 254 aa, Heterodera glycines
  misc_feature (245)..(245): Xaa can be any naturally occurring amino acid
  Coding regions on vcDNA: vcDNA=SeqID_65490; Strand=+; Position=1 -152,270-459,735-976,1021-1135
  Homolog annotation: Hit_ID=CAE72889.1; Match level="QueryCoverage =79%, HitCoverage=23%, E-value=2e-42, Identity=45%"; Hit description =Hypothetical protein CBG20202 [Caenorhabditis briggsae]
MLTIYISNFFSVSAKIRTLSDFHSRIVCQQQPPSSAEIVTTLRYFQQTLVGFLKELPAKRSELFEEFSAENTTVRTGLYPNLNYSGLFYGITNLLDAFPMLSSAHNGPFVMVNTILPYIISLYYRISQSDPPPRPDQMPLLLAAQLGVFPAENRRLVHLLCDCILPYSFGEGANGRVSVPAVLMLILHHPTDPSIHTMAVESLMRTLPDIYNGEKPDPSIHTMAVESLMRTLPDIYNGEKPNIVXTNKFRQSDK

SEQ ID NO: 139068 - protein, 370 aa, Heterodera glycines
  Coding regions on vcDNA: vcDNA=SeqID_65491; Strand=+; Position=1 -29,473-599,644-699,844-973,1033-1084,1143-1305,1361-1590,1681-1866
  Homolog annotation: Hit_ID=CAE72889.1; Match level="QueryCoverage =97%, HitCoverage=36%, E-value=4e-76, Identity=41%"; Hit description =Hypothetical protein CBG20202 [Caenorhabditis briggsae]
IGTLQMLTNMDRRLVHLLCDCILPYSFGEGANGRVSVPAVLMLILHHPTDPSIHTMAVIHTMAVESLMRTLPDIYNDLVTVIASGTSESRIVAANLLFHYWPLMNPAILHRRSIQYKIHVWSPPPCQNIGCAEHGKWSPPPCQNIGCAEHGKSTRLTFEPALCALLGDTSPPLTRLTFEPALCALLGDTSPPLALCDRCADSCQAEMPPFLCQPLPVLISATCQLKGCQSSSGCQSSSRIAVSTCFDEDCIRAHGHVPLRLCHECSVHLHAPPVRAHRCHFGPGTIWGTPLEHTMAEAVVKLLRETSAKSSSDGEAAKRPKWLRQLESGRELGREVDPLSDERRMLSRFGIWLMAALMPPSGGSNAGNGQ

SEQ ID NO: 139069 - protein, 101 aa, Heterodera glycines
  Coding regions on vcDNA: vcDNA=SeqID_65492; Strand=-; Position=1 -26,309-588
MNRRLRKKIWICSDVWMDILPSFDHAQLGLKMALLSDRFDVLVDAHFDGKTELTIWKEISIKKDEGPTPKLSERIDGNFVEFPLPDRPLPTKIRFRDLWIE

SEQ ID NO: 139070 - protein, 50 aa, Heterodera glycines
  Coding regions on vcDNA: vcDNA=SeqID_65493; Strand=-; Position=1-150
MKGKAFELAQKWVSANYKLYQNNKNCGKKMWEKISADAARPGRGGEYNVQ

SEQ ID NO: 139071 - protein, 92 aa, Heterodera glycines; identical to SEQ ID NO: 125147
  Coding regions on vcDNA: vcDNA=SeqID_65494; Strand=-; Position=1-304

SEQ ID NO: 139072 - protein, 134 aa, Heterodera glycines
  Coding regions on vcDNA: vcDNA=SeqID_65495; Strand=+; Position=1-405
MQTNLRPARLNFHPSRPFAGTSSADGAAFLGPSEFDQSGTDQSGQNPPPLQRSDDSFIFDMLLNSFICPYFCQHFDPNLSDFEAITAESEKGKQLMATKGNCALSTDLLTKLCPEVKRSSDDLVANFKRMKETK

SEQ ID NO: 139073 - protein, 192 aa, Heterodera glycines
  Coding regions on vcDNA: vcDNA=SeqID_65496; Strand=+; Position=1 -448,856-986
MGKKYSNKEWYKIEKKIAQKLGTNQREIYKWKREFGLIKDSYSEEEKLKILERFDQIYDQIKIKLKGKLDGKGTKCQKIIAKQLGISLMSIYKWKKQLNNVNSVDIQKTDDEKREIIEKYFKIKNEFMQNGKHSQKEWKEFRANIKQMIGKEQIINQFNKMKNEFLKANLKANNRKAEFKNCQVNGPTIQNN

SEQ ID NO: 139074 - protein, 161 aa, Heterodera glycines
  Coding regions on vcDNA: vcDNA=SeqID_65497; Strand=-; Position=1 -145,409-622,1003-1129
MCAPHECIWDWASNQNYALNTLITGTTVATYIGIWIILLYRNQNAQNTNNSSDAWTRRILKALAFLVALQLAGHTLSSIGRLTIPQLQLSVTSKAVSTFLLSCLTNIVLAVNGPVLYKMNMEYRKAFQKVFKFLQPTNYATSIGTQQQQWAIRVATANVRN

SEQ ID NO: 139075 - protein, 130 aa, Heterodera glycines
  Coding regions on vcDNA: vcDNA=SeqID_65498; Strand=-; Position=1 -18,70-197,427-673
MNQNETLFELYAEDGLPWALIALTAVRTFISTIGIICNLALVYVTIKTNSLNGPCNILIAFDAAACAWFEIGSWIGMFQILVGQQFVPIRLCCVYLLLPFITGVYASMSANLLIAFDRLLSICFPIWCLI

SEQ ID NO: 139076 - protein, 64 aa, Heterodera glycines
  Coding regions on vcDNA: vcDNA=SeqID_65499; Strand=+; Position=1 -154,326-366
MSTRRTKRRFGLTRVAGHPYQTSSTASKKHLFCHGWQNMDGQRIDDGVLGKEIQYFCNCIKNAP

SEQ ID NO: 139077 - protein, 133 aa, Heterodera glycines
  Coding regions on vcDNA: vcDNA=SeqID_65500; Strand=-; Position=1-535
  Homolog annotation: Hit_ID=NP_493879.1; Match level="QueryCoverage =90%, HitCoverage=29%, E-value=7e-25, Identity=45%"; Hit description =transposase family member (2B289) [Caenorhabditis elegans]
FRAESSKRKRLEGGGRKVPNRNFEEAVFQWVSELRQKKVRVTRNMIAAQAIKMSAAYEDMECFAASNGWLEKFMHRHKFSLRRPTTVAQKEPDAYKNIIINFILYIQQLIHKKNYTHVYAADETAVWLDPGGG

SEQ ID NO: 139078 - protein, 331 aa, Heterodera glycines
  Coding regions on vcDNA: vcDNA=SeqID_65501; Strand=-; Position=1 -284,517-670,752-1308
  Homolog annotation: Hit_ID=XP_318187.1; Match level="QueryCoverage =58%, HitCoverage=27%, E-value=6e-48, Identity=43%"; Hit description =ENSANGP00000016242 [Anopheles gambiae]
MEFGAMVNARSERADMTLSKEEVKCLIFITGLSDAHKELRQECLRQMEKARKSTPPRSMTLEALMEECRSIQSLQNSAAALSGPGQIHSVQVSARTGLNDALELNRHPLPRTDDIFHALRGSKVFSQLDLRDAYLQLELDEKSKSLKIMDQMTSGIPGVFAYLDDIIIASANITDHIESLSKLFSKIQDFGFRIRLEKWHFLQTELKFLGHIVSAKGIQPDPARSAAIREMPPPNDLSTLRSFLGALNYYGRFIKEMRVIRAPLDILLRKDVPWAWGNDQQNAFEKAKQILQSDLLLTHYTTPQNQLSLLRMLVSQELAQPSVTSSLMALN

SEQ ID NO: 139079 - protein, 30 aa, Heterodera glycines
  Coding regions on vcDNA: vcDNA=SeqID_65502; Strand=-; Position=1-93
TKELEQNLRDLPTCKLIFPSTSALQRNGAD

SEQ ID NO: 139080 - protein, 102 aa, Heterodera glycines
  Coding regions on vcDNA: vcDNA=SeqID_65503; Strand=-; Position=1 -91,149-292,705-775
MATKTLPKCILDGNGMAKWDGIPSEGIKCQFENLCEQFDENPCGSNGICIPLNGTYTCNCTTPTYRFNRKAIFGQQCEAQRCQKPTSAEEQFVIQSSDPLHL

SEQ ID NO: 139081 - protein, 192 aa, Heterodera glycines
  Coding regions on vcDNA: vcDNA=SeqID_65504; Strand=+; Position=1 -146,190-351,396-668
  Homolog annotation: Hit_ID=NP_509255.1; Match level="QueryCoverage =96%, HitCoverage=29%, E-value=5e-11, Identity=30%"; Hit description =predicted CDS, ac-like transposable element family member (XI27) [Caenorhabditis elegans] gb|AAC46515.1|
CEYSEKLLIATLLDPAYKGAFFKDAVIFERAKDMLLNEAERIAIKCVEFDTSELLAMPEIEASEDPFLAFGNHTTENDNSFMLPITPTPSPSLASAKAMAAGQVADYLNSQTVDCESHNFWANQIQTAKYPLLIPLVKKYHSAPCTSAESERMFSAAKLIVTDLRKNLAGETLKELLFLQQNLPLYGFKFEI

SEQ ID NO: 139082 - protein, 337 aa, Heterodera glycines
  Coding regions on vcDNA: vcDNA=SeqID_65505; Strand=-; Position=1 -138,276-405,1792-2079,2566-2692,2746-2960,3228-3342
  Homolog annotation: Hit_ID=NP_499337.2; Match level="QueryCoverage =70%, HitCoverage=40%, E-value=5e-24, Identity=30%"; Hit description =zn-finger, A20-like and vacuolar sorting protein 9 (3L703) [Caenorhabditis elegans] emb|CAD56609.1| Hypot
NGLRSFFNGLAPTMAREIPGYFCFFGAYELSRTMLRPDGSAKEEIGIARTALSGAFGGIVRLFDIYFLKQLMISQFKGSLDCDFSRRRRNRCGFYGTPQCDGLCSRCWRDFQLESKRQNDYQNNIKVLRQHQQHATGPSGAGGGSAAALSSAAAVTRKGSDARFNSLKTLVKKSPSVLSASTCGGPPSPDTVTAQEHLHQFLEANFAHVYAKELDKQCQVFIDNLFKSEFLPSDELSLLVQAFYQSIKESAVKFAAQMPPPAAATAGDGAATPCSTSDFMTEIENFVCTRAYPVLFGSRTEEEAEDLSLQTRIRSLHWVTNGYLETALSESSAPGAQ

SEQ ID NO: 139083 - protein, 59 aa, Heterodera glycines
  Coding regions on vcDNA: vcDNA=SeqID_65506; Strand=-; Position=1 -109,291-361
MNDKSSATVPINSALTDTAHISHLKDGMIDFVAGTAGGVATVYTAQPLDTVKGLETDHT

SEQ ID NO: 139084 - protein, 68 aa, Heterodera glycines
  Coding regions on vcDNA: vcDNA=SeqID_65507; Strand=+; Position=1-206
  Homolog annotation: Hit_ID=AAP06277.1; Match level="QueryCoverage =86%, HitCoverage=20%, E-value=7e-12, Identity=49%"; Hit description =similar to NM_079059 GTP-binding-protein in Drosophila melanogaster [Schistosoma japonicum]
FDQSGAYLAVGGSNVQIFQAKSWNNIAQFNAHSQPVTGVCFADDVKSVVSASMDKSVRVHAVPPVANE

SEQ ID NO: 139085 - protein, 42 aa, Heterodera glycines
  Coding regions on vcDNA: vcDNA=SeqID_65508; Strand=-; Position=1-133
FENFFKRGDPFVLQNFFEIKKHDNLLSGVLKVANHESDMYFD

SEQ ID NO: 139086 - protein, 177 aa, Heterodera glycines
  Coding regions on vcDNA: vcDNA=SeqID_65509; Strand=-; Position=1 -243,526-813
  Homolog annotation: Hit_ID=CAE73779.1; Match level="QueryCoverage =80%, HitCoverage=28%, E-value=8e-47, Identity=61%"; Hit description =Hypothetical protein CBG21324 [Caenorhabditis briggsae]
MPISPPPPGVLLFLLLLPSHPFSLQIRIWNADDQSARNVIGIHDRPVTDVSLHPTGDYVLCSSEDSHWSLIDLNAGRPLIKVKSDDDDVPGICCGQFHPDGLIFGTGGKNSVVKIWDIKEQINVAQFPGHQEAVVAISFSENGYYLATGSTDGEVKIWDLRKLKNLKNLTLYDVKQA

SEQ ID NO: 139087 - protein, 52 aa, Heterodera glycines
  Coding regions on vcDNA: vcDNA=SeqID_65510; Strand=+; Position=1 -42,408-524
MLMKDPGLRFDITQPFGGGDGAGSDRVHSHDAAPRHADPRKSDGPQKTFGNP

SEQ ID NO: 139088 - protein, 212 aa, Heterodera glycines
  Coding regions on vcDNA: vcDNA=SeqID_65511; Strand=+; Position=1 -354,407-690
MVRADFVTKMVRHFEGAIVPTAIACFFVENSFGDKLQKSESVALTLYFIFALSNSTVAPSFNQSFWYKMAIPIQCRGRRLKQAYVSEQLREHFKLYNELMCQYQSQYPELLTGLKLTQQARHILLERSEQEQLVECLVCFERVALRRMVCCTAPIESPSTGGASHQHIAQESEGEVLLIELPSDSSRVQLLSNERESTTILLQFALTREPPE

SEQ ID NO: 139089 - protein, 86 aa, Heterodera glycines
  Coding regions on vcDNA: vcDNA=SeqID_65512; Strand=-; Position=1 -156,387-434,529-585
MPPSNAEVVVEPNATTTKVKFTARQKVCPSTTAAKVVATQNAGCSSSSTAANPPPPSIRIPKGKTPKKIIKGKRIGVYQRKAMPWS

SEQ ID NO: 139090 - protein, 75 aa, Heterodera glycines
  Coding regions on vcDNA: vcDNA=SeqID_65513; Strand=+; Position=1-441
SLGVDGQAFPRVGPPFNAYFGAVKSGRQAFPCVGPPIVFASHFSLSLSFTFPNIWVLMGRPSLVLVPPSMLISEL

SEQ ID NO: 139091 - protein, 95 aa, Heterodera glycines
  Coding regions on vcDNA: vcDNA=SeqID_65514; Strand=-; Position=1 -43,119-228,273-405
  Homolog annotation: Hit_ID=NP_508937.1; Match level="QueryCoverage =88%, HitCoverage=17%, E-value=5e-17, Identity=47%"; Hit description =membrane bound O-acyl transferase, MBOAT (55.3 kD) (XG140) [Caenorhabditis elegans] gb|AAA81391.1| Hypoth
YRWFILRDYHLDVTGPMMIMVQKVTVLAFSLHDGSKKSEELSRILSKESLSKVPPILNFLAYTFQFQTVLTGPMVFYSEFMEFVSGENFSKALKK

SEQ ID NO: 139092 - protein, 24 aa, Heterodera glycines
  Coding regions on vcDNA: vcDNA=SeqID_65515; Strand=+; Position=1-76
KIPIFMTLDDKLTFPPLEEQTARK

SEQ ID NO: 139093 - protein, 22 aa, Heterodera glycines
  Coding regions on vcDNA: vcDNA=SeqID_65516; Strand=+; Position=1 -33,476-511
MVNVIMVVVVVIKITKMLKNTK

SEQ ID NO: 139094 - protein, 146 aa, Heterodera glycines
  Coding regions on vcDNA: vcDNA=SeqID_65517; Strand=-; Position=1-439
NGVSKNRNYAQKAPQTILALPIPSTIAFIHPIMSAKIIRVPKIACDLSLAKNGVSKNRNYAQKASQTILAHPIPSTIAFIHPIMSAKIIRVPKIACDLSLAKNGVSKNRNYAQKASQTILALPIPSTIAFIHPIMSAKIIRVPKIA

SEQ ID NO: 139095 - protein, 326 aa, Heterodera glycines
  Coding regions on vcDNA: vcDNA=SeqID_65518; Strand=+; Position=1 -177,236-405,521-674,729-840,976-1116,1164-1284
  Homolog annotation: Hit_ID=AAK26377.1; Match level="QueryCoverage =100%, HitCoverage=97%, E-value=1e-163, Identity=89%"; Hit description=putative alpha/beta hydrolase [Heterodera glycines]
ELKTCEQKKTNGLTINNAHEETKMEPIEEANLKIIDTDIGYCRYGKGPVNFLFICGGVGCYKKDYPECVLRAFDPCYKKDYPECVLRAFDPNFATIICIDPPGYGTSRPPDRKQEVNRCKMDAKYCLKLMETTLKLTPFVVLGWSEGGRTSIHVAGQGKGLVSHMVLLSSGSQVDMRGDLAFKGMRNTDQWMPAAMRNTDQWMPAAKAPYLEHYSNEFLKEQWAGLCDVVAKVYKDLGGSFPCDRVLNTLKIPVLIVNGNMDRFVLDPSLMSKKLENARIEIHAQGIEIHAQGGHDLHIKYPRWFALKVTSFVKESAKSDVKANRK

SEQ ID NO: 139096 - protein, 28 aa, Heterodera glycines
  Coding regions on vcDNA: vcDNA=SeqID_65519; Strand=+; Position=1-86
IPTEAKYYFVRWVVGFRKNDTVHQVDKL

SEQ ID NO: 139097 - protein, 41 aa, Heterodera glycines
  Coding regions on vcDNA: vcDNA=SeqID_65520; Strand=+; Position=1 -61,1436-1500
MRAHLVSMHAKYGLHVCGEGEISFFNINLLTYCLLTNVREP

SEQ ID NO: 139098 - protein, 171 aa, Heterodera glycines
  Coding regions on vcDNA: vcDNA=SeqID_65521; Strand=+; Position=1 -229,290-540,772-807
MPINEMILQLEIESANECQSNENLDGIIQEKFGGNVQKSRRKGKKDRLWRANEINDDKHWIILESKFDYIYIYIYMDALFLEFVKGLVTNFDKFFELPREYSKGLMQKYKGNLDVLYLMRENWHCEKIGKEFKENEMTECQKYRNYVNIYMNIYSGFMLKLYFQMHKWSSG

SEQ ID NO: 139099 - protein, 95 aa, Heterodera glycines
  Coding regions on vcDNA: vcDNA=SeqID_65522; Strand=+; Position=1 -224,554-617
MIRLHEFVARNFLRQLPLLLSILLLFLRWLLVSLCRLLKLLRTDKGKMILSRIEKWRMKPVGSPRRMLIICCPIRTPKEQIQTVKGTHYILPLIL

SEQ ID NO: 139100 - protein, 92 aa, Heterodera glycines
  Coding regions on vcDNA: vcDNA=SeqID_65523; Strand=+; Position=1-304
MIGRAVRNRPFIFEGIFIFRVYPRKMAISFFEKFYTSQKRLRMRRRAVHNRHFISQRIFIFRGYPRKMAISFFDKFYTHTNALEHDREGGAQ

SEQ ID NO: 139101 - protein, 53 aa, Heterodera glycines
  Coding regions on vcDNA: vcDNA=SeqID_65524; Strand=-; Position=1-202
FEYPKRTLEKIDFFVFGAVPPSRCAQIYGETESFRNSFPIACTLILRWIFAPP

SEQ ID NO: 139102 - protein, 26 aa, Heterodera glycines
  Coding regions on vcDNA: vcDNA=SeqID_65525; Strand=-; Position=1-79
EVAIRKATNSINTKKVVDQREFSSLV

SEQ ID NO: 139103 - protein, 123 aa, Heterodera glycines
  Coding regions on vcDNA: vcDNA=SeqID_65526; Strand=-; Position=1 -128,949-1192
MVVYQRLFQVVRNAVPAWNPQTFISDFENSSIQAVNQVKKGGKSGHPKVSEIVRGIESEDLHWANVVRDWDDTPVNGIRGKGMKRKEIYVEQDENLLALYNTREQRHPYQYLRAVAYRMPDPI

SEQ ID NO: 139104 - protein, 85 aa, Heterodera glycines
  Coding regions on vcDNA: vcDNA=SeqID_65527; Strand=+; Position=1 -101,1057-1213
MFADLLDSSADEEPTEKILDLSNENDLDNTRISHMLHNIAIDCNAPLPRDLLVAADIEGEQQGNPDENVAQSAEAIRNDYINRNF

SEQ ID NO: 139105 - protein, 173 aa, Heterodera glycines
  Coding regions on vcDNA: vcDNA=SeqID_65528; Strand=-; Position=1 -77,142-586
MSFKRVNSAQPTAVPMAKKWDFRSIGPLNLLTTKLQNAKNITEFVINPDVERPDETLREAIDMMIKNSISKTEETMGRKVKMFGVALTAGLGHPIWLPYRPFPQNNADVVMEEINKLGQSGGEEGEEDKRTILLSESIKMKVTCVALPAGEGPRNVHKFDFGFKEKQRIKLHR

SEQ ID NO: 139106 - protein, 68 aa, Heterodera glycines
  Coding regions on vcDNA: vcDNA=SeqID_65529; Strand=-; Position=1 -94,185-297
MHAFCARDIYHWPCQSKAKQQRWCFERIKGIESVPRLLEKYICNLSTILRSKLEMINFPIQTNFRCFN

SEQ ID NO: 139107 - protein, 93 aa, Heterodera glycines
  Coding regions on vcDNA: vcDNA=SeqID_65530; Strand=+; Position=1-282
SKSSESGEPPANGAEVAQSRKKRQAEEVTTEEPPSETNDAEGAEDHQSAAAGNGKAPKNKGKKNKSDSSDSSSSSSSSSESDEKKKLKKKNKH

SEQ ID NO: 139108 - protein, 165 aa, Heterodera glycines
  Coding regions on vcDNA: vcDNA=SeqID_65531; Strand=-; Position=1 -147,204-552
  Homolog annotation: Hit_ID=P02256; Match level="QueryCoverage=81%, HitCoverage=53%, E-value=4e-11, Identity=32%"; Hit description =Histone H1, gonadal pir||HSUR1P histone H1, gonadal - sea urchin (Parechinus angulosus)
MSAESPTTSQRRARSRKTKKRAASAGETKPLRRSARIAAQKAAKEKAAKQKARDGSTASTKSAGRGRPSRSPKKSGPKSRRSPAGRGGGRSQTPHKKKQPLKKKAPGPRSRTPGRRVKKPSTKKSPAPRRAKTSTKKRGRPAKKAEQAEPSDSGTVADSDRDDSE

SEQ ID NO: 139109 - protein, 51 aa, Heterodera glycines
  Coding regions on vcDNA: vcDNA=SeqID_65532; Strand=+; Position=1 -64,242-333
MDTGKIPEIWKKFIVIPLFKKVLEDWYDSIYGKKISTVFMWTFGKLLIPFL

SEQ ID NO: 139110 - protein, 144 aa, Heterodera glycines
  Coding regions on vcDNA: vcDNA=SeqID_65533; Strand=-; Position=1 -181,582-835
MKHCPENFNEFCRGMEDILSEWDCTEIQAFNELWEGVKRRAEALDEFAERLYGIVERAYPEGEKKPNDFKLSNQPPAQRTNTEAGTKLKVSNRPHISSSSCYVKGGKNEENPTENSELFLNSIVATLVLFAGAVSKQKSKCGRI

SEQ ID NO: 139111 - protein, 127 aa, Heterodera glycines
  Coding regions on vcDNA: vcDNA=SeqID_65534; Strand=-; Position=1-382
MPWTRASVMPEGTEYGRKWIKDLREPLKLAPVAQLVRARHGLLGSWVRVPPGELPFMFYMALLGGSPPHCRDHWTKESPSPSVKCQGEPEGPVFRGRRNVMPEGTECGRKWDKGPERTSKSSARSSV

SEQ ID NO: 139112 - protein, 79 aa, Heterodera glycines
  Coding regions on vcDNA: vcDNA=SeqID_65535; Strand=+; Position=1 -26,131-219,285-358,811-861
  Homolog annotation: Hit_ID=T37317; Match level="QueryCoverage=94%, HitCoverage=26%, E-value=2e-24, Identity=62%"; Hit description =probable Ca2+/calmodulin-dependent protein kinase kinase (EC 2.7.1. -) - Caenorhabditis elegans
MVFEYVEKRSLMDLPTDNPLCEFTAWKYFRDALKGLEYLHFQKIVHRDLKPSNLLLSDTENVKGTAGTPAFMAPEVNAK

SEQ ID NO: 139113 - protein, 229 aa, Heterodera glycines
  Coding regions on vcDNA: vcDNA=SeqID_65536; Strand=-; Position=1-688
  Homolog annotation: Hit_ID=XP_521668.1; Match level="QueryCoverage =98%, HitCoverage=99%, E-value=9e-32, Identity=28%"; Hit description =PREDICTED: similar to uncharacterized glycine-rich low complexity protein [Pan troglodytes]
SIPITGTQPISISITGTQPTSISIAGTQPTNISITGTQPTSITITGTQPTSIPITGTQPTSIPITGTQPTSIPITGTQPNIISITGTQPTSISITGTQPTNISMTGTQPTSIPITGTQPTNISITGTQPTSIPITGTQPTSISITGTQPTSISITGTQPTSISITGTQPTSISITGTQPTSIPITGTQPNIISITGTQPTSISITGTQPTSIPITGTRPTNISITGTQP

SEQ ID NO: 139114 - protein, 44 aa, Heterodera glycines
  Coding regions on vcDNA: vcDNA=SeqID_65537; Strand=-; Position=1 -89,864-909
MDDDNRQNEKKMTADVVSIEKVMDDDDDELGIEPRERRRESQGD

SEQ ID NO: 139115 - protein, 164 aa, Heterodera glycines
  Coding regions on vcDNA: vcDNA=SeqID_65538; Strand=-; Position=1 -52,240-277,687-884,1248-1397,1698-1757
QIPLSLFSLKFSSSESAYRCYSCASDNMKENFLTRSRGPPGRVREPRLFDSMCDSDTWVIREKSAIECQGACFKWQQTLNNSGVLSYATIRGCYERVAPLPPPTVRRPSPSTLCKHTQRALVCLDDSSVEESTCWCFGDFCNAATKMLIFKKMFVYFIIINLFQ

SEQ ID NO: 139116 - protein, 312 aa, Heterodera glycines
  Coding regions on vcDNA: vcDNA=SeqID_65539; Strand=-; Position=1 -143,191-214,280-372,418-565,665-840,936-1136,1185-1223,1321-1436
  Homolog annotation: Hit_ID=XP_424456.1; Match level="QueryCoverage =100%, HitCoverage=78%, E-value=1e-112, Identity=61%"; Hit description=PREDICTED: similar to acetyl-Coenzyme A acyltransferase 2 (mitochondrial 3-oxoacyl-Coenzyme A thiolase)
NVIQSSKDAAYLARHIGLRVGVPVHVPAVTVNRLCGSGFEAIAQGGQQILAGDSKVVLAGGTESMSQAPFAVRGARFGTQLGAKIEFEDVLWQGLTDAHANMPMGITAENLGAKYNVTREEADAYAIRSQNRWRLANNAGYFKSEIVPVKLQGKRGEEKLFDVDEHPRESTAEQMAKLKPVFKKDGLVNAGNASGVCDGAAAVVVADEESVSKYHLDPLVRLLGWHAVGCDPTIMGIGPVEAIRGLCKKTGIALDKVDIVEVNEAFAPQVLAVQKELGLESDRLNVHGGAIALGHPLGASGARITAHLTHEL

SEQ ID NO: 139117 - protein, 54 aa, Heterodera glycines
  Coding regions on vcDNA: vcDNA=SeqID_65540; Strand=-; Position=1 -150,680-694
MYGNDLLARLKDETEGPGEKDFQYALETLLGSQREDSTTFKPKKIKAKKVGLPQ

SEQ ID NO: 139118 - protein, 75 aa, Heterodera glycines
  Coding regions on vcDNA: vcDNA=SeqID_65541; Strand=+; Position=1 -138,478-567
  Homolog annotation: Hit_ID=NP_741710.1; Match level="QueryCoverage =92%, HitCoverage=4%, E-value=1e-22, Identity=66%"; Hit description =aboc, EXpulsion defective AEX-3, Rab3 Guanine nucleotide Exchange Factor, regulator of presynaptic activit
MPIPMEFALPDHTRLSLVDFPLHLPLELLQIDAILQILTAIMLEYKVILQSRNCNAVSVCVMALVALLYPLEYVQ

SEQ ID NO: 139119 - protein, 19 aa, Heterodera glycines
  Coding regions on vcDNA: vcDNA=SeqID_65542; Strand=-; Position=1-73
NRTLTDDLMEKNPRRREFN

SEQ ID NO: 139120 - protein, 70 aa, Heterodera glycines
  Coding regions on vcDNA: vcDNA=SeqID_65543; Strand=+; Position=1 -56,106-262
MKAEKSKVKMTIRRNIVNRNILLSECKSRERFTFQPFLANDFKKRFFVDLCTNSRALPLKMSVYCFNLAK

SEQ ID NO: 139121 - protein, 194 aa, Heterodera glycines
  Coding regions on vcDNA: vcDNA=SeqID_65544; Strand=+; Position=1-583
  Homolog annotation: Hit_ID=A24264; Match level="QueryCoverage=58%, HitCoverage=99%, E-value=7e-21, Identity=45%"; Hit description =proline-rich protein MP2 - mouse (fragment)
MSLGRNKSFAPGLLLIILPLISFNGQIAIASPIPNAKERNNEIQAQAYDPSAGKLAEFGARERRQNAMLCCCQMGAGGGPQMPPPMGPQMPPQMPLGPQMPPPMGQQMPLGPQLAPPMGSQMPPQMPLGPQMAPPMGPSLGPQMPPPMGQQMPLGPQLAPPMGPQMPPQMPLGPQMAPPMGPQMPPPPPGQANM

SEQ ID NO: 139122 - protein, 332 aa, Heterodera glycines
  Coding regions on vcDNA: vcDNA=SeqID_65545; Strand=+; Position=1 -276,333-747,795-1063,1259-1298
  Homolog annotation: Hit_ID=AAL78214.1; Match level="QueryCoverage =43%, HitCoverage=75%, E-value=2e-18, Identity=34%"; Hit description =putative esophageal gland cell protein Hgg-20 [Heterodera glycines]
FICSDCWLLVFDFLAPSQLGLEIALISRRFDIYVDEHFKTRKWTLGEIRICYKIEENGTKQMHIHDADANPLPIPQNPLPNKIIGFRGIKIVYIDQNVVAFLRRFHRFFSICSTELGIITCNDHILEFVLLNIWPMLHDSIRAMYFNTITFRCLRQLAPALLSDSPSLRFVSFNDAILPVLPPDESANATDGQAVAKWLFTPHSDGMPKWFSCSVNSLDQWSSTLEQFKTAFSNASSSVTFRINFLLSSPIDSAVVPFDLINEVTVEKLTLQQEDEDVWLTRCPIGWDEMKWGNVQDELLNDDPLNAILFLIREDRFDDGLLDAASQGPSDH

SEQ ID NO: 139123 - protein, 285 aa, Heterodera glycines
  Coding regions on vcDNA: vcDNA=SeqID_65546; Strand=+; Position=1 -11,72-332,508-934,992-1150
MNRRWICGDVWMDILPSFDHAQLGLKMALLSDRFDVLVDAHFDRKSELTIWKAIEIRKDKGRNANENGPTPKFVVRIGDNDISLEELPIGPYIDYSVLAFLRSNKPIWDRMGTKLTLWPYRTEKDQSIWDVFVREIWPIFAPNIRHLGFHDGDYLDKLRSHTSPTILTDLDQLNAIDSGFLFPEGIADFDVLNPTAAQALTKWLHTPSKNGQPKNLYYFNSPRNLGWVNSFKEAFRRATTSISYKIRFNLYLEPMPIEPFELVNKRTKEKLTPDEGDRRIRRKCV

SEQ ID NO: 139124 - protein, 91 aa, Heterodera glycines
  Coding regions on vcDNA: vcDNA=SeqID_65547; Strand=+; Position=1 -215,276-336
MPTEQFELVNGRTNEKLTLKQSKECNLVIWLLQRYPIGETSTAPVKWEDSVNPSANLNSIRFDLWSFDKSIGPLSPPTEEEKADQINENVV

SEQ ID NO: 139125 - protein, 68 aa, Heterodera glycines
  Coding regions on vcDNA: vcDNA=SeqID_65548; Strand=+; Position=1 -162,266-310
MSSVDLDLYQPSRAKDVQTLYREYALLRETEPDCPSLDISDITLCVHCTVHPRGLFFGQTLEKVIESL

SEQ ID NO: 139126 - protein, 19 aa, Heterodera glycines
  Coding regions on vcDNA: vcDNA=SeqID_65549; Strand=+; Position=1-60
EPVNSCIGCKCRRCCTPNS

SEQ ID NO: 139127 - protein, 94 aa, Heterodera glycines
  Coding regions on vcDNA: vcDNA=SeqID_65550; Strand=-; Position=1-285
NTEEPSEWNKCIELLDRKKETDEKISQQVTLVANLGKAFDEGIQQNEGEEQREEKEKEEVEKEEEKEVRLEIEWNGLLVLEKKFFRFTIIGPKF

SEQ ID NO: 139128 - protein, 122 aa, Heterodera glycines
  Coding regions on vcDNA: vcDNA=SeqID_65551; Strand=-; Position=1 -75,296-464,666-786
EKIFRSVLCPKSFWSLSQASRDHLEHFLPLPSISSAIKSSSVSVARRNCGAPLDELLSCAFTSDPNFCFGNPLAKFFARIRNGYFSSPEQVQLRDHRRVLYDHYIRHYQMNLLKTLLINSHV

SEQ ID NO: 139129 - protein, 16 aa, Heterodera glycines
  Coding regions on vcDNA: vcDNA=SeqID_65552; Strand=-; Position=1-49
EAIPEGFGLPINLGAS

SEQ ID NO: 139130 - protein, 21 aa, Heterodera glycines
  Coding regions on vcDNA: vcDNA=SeqID_65553; Strand=+; Position=1-63
MPTETTESNEKKENPEDISST

SEQ ID NO: 139131 - protein, 200 aa, Heterodera glycines
  Coding regions on vcDNA: vcDNA=SeqID_65554; Strand=+; Position=1 -129,294-499,779-905,1243-1380
MTSRSAKRSLKKSDGLSGKESVSKAQQIEQFFGIDEAKCETAERTSKSPSAKRSRSSTNTAVQLLKKMAKHKKELNSSKETRREEDEREMENIPDTLDELNSRGTEDERGKGTESVQTVNELDELLDSETAKRIQSESEVTIRFCCPLLANVGSVSPIALHFSDVSSDVSFEQQLDKFAALFVSSKVRCAQRRRCLFYAN

SEQ ID NO: 139132 - protein, 120 aa, Heterodera glycines
  Coding regions on vcDNA: vcDNA=SeqID_65555; Strand=-; Position=1-361
MSVIFPFMFIVIPSSPCPPQGRKSRRRLDRHRHSQASIVSGMLGIFEATETGGGDDDGEDGGGDAGGGGEGEGGGAVANDQCPSVGTVAGQMPCLFGVHTKSTGRTRRIHRSWEGTGAAD

SEQ ID NO: 139133 - protein, 23 aa, Heterodera glycines
  Coding regions on vcDNA: vcDNA=SeqID_65556; Strand=+; Position=1-72
VIGIAINRIFGHNRNRRFNRNRI

SEQ ID NO: 139134 - protein, 32 aa, Heterodera glycines; identical to SEQ ID NO: 130522
  Coding regions on vcDNA: vcDNA=SeqID_65557; Strand=+; Position=1-140

SEQ ID NO: 139135 - protein, 110 aa, Heterodera glycines
  Coding regions on vcDNA: vcDNA=SeqID_65558; Strand=+; Position=1 -177,241-393
  Homolog annotation: Hit_ID=CAB79834.1; Match level="QueryCoverage =98%, HitCoverage=6%, E-value=1e-09, Identity=34%"; Hit description =putative protein [Arabidopsis thaliana] pir||T10670 hypothetical protein F6E21.80 - Arabidopsis thaliana re
VITTVDTKKPLLDFCAGYTDNFVGLIEIGRSDDDTNFFKLYEIGRRRDFDEEEEDQDEQNPEEEEDFSLGSSSPSSSSSSSNNSDTESHYPHENGSIRDIEEGAEDQDGQ

SEQ ID NO: 139136 - protein, 166 aa, Heterodera glycines
  Coding regions on vcDNA: vcDNA=SeqID_65559; Strand=-; Position=1 -37,106-262,303-390,715-820
  Homolog annotation: Hit_ID=XP_392449.1; Match level="QueryCoverage =92%, HitCoverage=12%, E-value=1e-28, Identity=46%"; Hit description =similar to CG4752-PA [Apis mellifera]
IFGNDECQRLNKEGSVKAFGEMTEEGSVKAFGEMTEQINAQLAQKGRPRISVSEAALGFIQVANEAMSRPIRRLTEAKGFDTSQHLLSCFGGAGGQHACAIAAKGFDTSQHLLSCFGGAGGQHACAIARTLGIGRVLVHRHHGVLSAYGLVLADVGNEQQEGFMNT

SEQ ID NO: 139137 - protein, 112 aa, Heterodera glycines
  Coding regions on vcDNA: vcDNA=SeqID_65560; Strand=-; Position=1 -58,102-245,434-484,540-623
NRDFDVDAELADVDLSDNREKSKSKSEKMQRWAEEERRWETEFDEANTKSRTDGRQNYRQMGAKMPWVNGTERRQNGGDTSAGAATFAITPSPPSASSSVFRGGSATRARGG

SEQ ID NO: 139138 - protein, 58 aa, Heterodera glycines
  Coding regions on vcDNA: vcDNA=SeqID_65561; Strand=-; Position=1-174
MSDPQNITLDHLLFFTTFANEIINFYYITILYIHDFSKLRFHVIFNELSLNLDSVNPL

SEQ ID NO: 139139 - protein, 72 aa, Heterodera glycines
  Coding regions on vcDNA: vcDNA=SeqID_65562; Strand=-; Position=1 -175,218-261
MSDPQNITLDHLLFFTTFANEIINFYYITILYIHDFSKLRFHVIFNELSLNLDSVNPIESVAGTWSQKKMHN

SEQ ID NO: 139140 - protein, 33 aa, Heterodera glycines
  Coding regions on vcDNA: vcDNA=SeqID_65563; Strand=-; Position=1 -33,382-449
MPTAHWHWVTDSWPNAPIFGHLCNANMSSNGGA

SEQ ID NO: 139141 - protein, 30 aa, Heterodera glycines
  Coding regions on vcDNA: vcDNA=SeqID_65564; Strand=-; Position=1-90
MARFVHKNLDKSSARRQQINRQIIINLIIQ

SEQ ID NO: 139142 - protein, 69 aa, Heterodera glycines
  Coding regions on vcDNA: vcDNA=SeqID_65565; Strand=-; Position=1 -6,270-473
MAWFNNTENICCNAIICVSIGIVTVIYTLIVGNDYINLSLLKAEEIFQIEQLLGGNLNDFVTYCERNVS

SEQ ID NO: 139143 - protein, 82 aa, Heterodera glycines
  Coding regions on vcDNA: vcDNA=SeqID_65566; Strand=+; Position=1-248
MCILGPKKRHVTGHVTEYFTMKCTARKMTPLSTKNADLPKKNAATLKMTPANPEGSGTHQKIVGPRAYVWSKCCNNFMKAAR

SEQ ID NO: 139144 - protein, 31 aa, Heterodera glycines
  Coding regions on vcDNA: vcDNA=SeqID_65567; Strand=-; Position=1 -32,83-146
MSHECFQDRHRTNSALPYPTTVLHHGVNDQS

SEQ ID NO: 139145 - protein, 64 aa, Heterodera glycines
  Coding regions on vcDNA: vcDNA=SeqID_65568; Strand=+; Position=1 -52,133-275
MTMQLFKRHFAIPFTIKNESVLLQKKIFVLLLQKYENKIFIFEVCIYFHYIFSTYLIIWNKNKI

SEQ ID NO: 139146 - protein, 149 aa, Heterodera glycines
  Coding regions on vcDNA: vcDNA=SeqID_65569; Strand=+; Position=1 -106,493-669,1213-1355,1542-1565
MESDLDKNNVCQFQTTFPLHDYLNKINRDLEVEQKFKSERQLKRFINFAKTRSSPPINSDVHPISKISISMKNFPIGPYELFDFQNKSESVMIEAVQQDANETDQSSGIANMIEIIDPLKCSELCGVADELFIEKDEHQSFRRGSTKKN

SEQ ID NO: 139147 - protein, 230 aa, Heterodera glycines
  Coding regions on vcDNA: vcDNA=SeqID_65570; Strand=-; Position=1 -576,621-737
  Homolog annotation: Hit_ID=NP_917837.1; Match level="QueryCoverage =79%, HitCoverage=8%, E-value=2e-26, Identity=40%"; Hit description =B1158C05.18 [Oryza sativa (japonica cultivar-group)]
MANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNISSWAHGFWRDANPIPICTMLGAKMVRSLDPGHGPVSPL

SEQ ID NO: 139148 - protein, 68 aa, Heterodera glycines
  Coding regions on vcDNA: vcDNA=SeqID_65571; Strand=+; Position=1-204
MISLTSSHVSMVRSENQTIEQLLVIAKELLEVRIDIVYQLFLALNEELRRKSEVLLRFSRARFRAHLQ

SEQ ID NO: 139149 - protein, 176 aa, Heterodera glycines
  Coding regions on vcDNA: vcDNA=SeqID_65572; Strand=-; Position=1 -262,315-582
  Homolog annotation: Hit_ID=CAE59888.1; Match level="QueryCoverage =99%, HitCoverage=12%, E-value=5e-52, Identity=58%"; Hit description =Hypothetical protein CBG03371 [Caenorhabditis briggsae]
MLGRNGQLSQFGSKDLDRLVKEVIEPMASDGLRTICLAYKDYIADGSAQVEENQLAFGGEIDWDDESAVISDLTVVAIVGIQDPVRSEVPEAIAKCKHSFETLKALFKANLMYHFFCCLGQRSGIVVRMVTGDNINTARSIATSCGILKPGEDFLALEGKEFNDRIRDEDGEVCQE

SEQ ID NO: 139150 - protein, 55 aa, Heterodera glycines
  Coding regions on vcDNA: vcDNA=SeqID_65573; Strand=+; Position=1 -41,234-360
MKFGGWIDDAQILLSYYLQHDHTEQVKLEQQASFDDICDRDVSMEHKKFSAALIT

SEQ ID NO: 139151 - protein, 111 aa, Heterodera glycines
  Coding regions on vcDNA: vcDNA=SeqID_65574; Strand=-; Position=1 -185,614-763
  Homolog annotation: Hit_ID=NP_499212.1; Match level="QueryCoverage =100%, HitCoverage=9%, E-value=3e-38, Identity=63%"; Hit description =sex determination DEAH box protein, similar to pre-mRNA splicing factor ATP-dependent RNA helicase., Masc
YENEGCYNDEFNPFANVSQNYVEKREKQLDQTRQKPRLTLRQQQIKKDNEMWENNRLARSGVVTFSEELGDFFDNETDENRVSLLVHNIIPPFLDGRIAYTCQTQPVIPVI

SEQ ID NO: 139152 - protein, 38 aa, Heterodera glycines
  Coding regions on vcDNA: vcDNA=SeqID_65575; Strand=-; Position=1 -3,474-587
MKRMIGQPSWICATPKKESDGFHTPAIKGKIFSNSMGI

SEQ ID NO: 139153 - protein, 31 aa, Heterodera glycines
  Coding regions on vcDNA: vcDNA=SeqID_65576; Strand=+; Position=1 -62,412-445
MRIMRKAKCEKRNLGTSLVHMVKASNSLSTI

SEQ ID NO: 139154 - protein, 97 aa, Heterodera glycines
  Coding regions on vcDNA: vcDNA=SeqID_65577; Strand=-; Position=1 -76,140-202,290-610
SLNIAGNVLSLAPIEGGSGEYVAIWNTADKEPTKKGTRQDIEFVLSAKDKTLSKNLQVKFYPHNDTHAGWGQKLDQITWHCSTNDIGHVFVLEEQTL

SEQ ID NO: 139155 - protein, 61 aa, Heterodera glycines
  Coding regions on vcDNA: vcDNA=SeqID_65578; Strand=+; Position=1 -66,646-688,739-815
MGSFLYQMKSFYQMANEIQKDFDFDAYPGEQFDRQDGYEGLFGPDHFVQIEKLRPKAVRFD

SEQ ID NO: 139156 - protein, 60 aa, Heterodera glycines
  Coding regions on vcDNA: vcDNA=SeqID_65579; Strand=+; Position=1-183
FLSNIPAAKVVHPFASQDTCSKEGCCKCTGESRSGEANARGKAIDANKLHDERKEKSNFE

SEQ ID NO: 139157 - protein, 49 aa, Heterodera glycines
  Coding regions on vcDNA: vcDNA=SeqID_65580; Strand=+; Position=1 -61,313-401
MYYQAWMEEQAQKLIDATTRAFTSQRMLAPGAPGFVPPPTGVPVMIVMF

SEQ ID NO: 139158 - protein, 101 aa, Heterodera glycines
  Coding regions on vcDNA: vcDNA=SeqID_65581; Strand=-; Position=1-308
HHHLHHSCGCCLIEVRSAADEANAPLAFTAMPDDCAAATAAIAAAVTAGVGMALKAAAVIDGIPCGNTGGVKKPAAEGITGGRTIDIGLTYGARGGLTEEV

SEQ ID NO: 139159 - protein, 120 aa, Heterodera glycines
  Coding regions on vcDNA: vcDNA=SeqID_65582; Strand=+; Position=1-363
MRRCAFSHPKPRFRRRHLRPSVNAAPIAAGTAHTNAAQVASEMLAGTAKYFRAACCRRCAPETVAVAAHATLCGTTGSHSNFAGPAQSARICAAIAARRTAAVFPSLLAVSGLRKSLPAH

SEQ ID NO: 139160 - protein, 64 aa, Heterodera glycines
  Coding regions on vcDNA: vcDNA=SeqID_65583; Strand=-; Position=1-197
GFSLPDALYQLTYIEYFENGTELGKWRTKMVIEFNLYNYWIKKLVDEQHEEIERIQSNFNYYTV

SEQ ID NO: 139161 - protein, 25 aa, Heterodera glycines
  Coding regions on vcDNA: vcDNA=SeqID_65584; Strand=+; Position=1-75
TCTCGVVVKLSTFHNFSPEFNSPLG

SEQ ID NO: 139162 - protein, 129 aa, Heterodera glycines
  Coding regions on vcDNA: vcDNA=SeqID_65585; Strand=-; Position=1 -285,669-773
MTTPNLPYGAREGSGQFSTGTNFSPPPPPYDAGASSPFEQPHQQHQSPSPYGMMYSGGNVPSPPPPSSPYHQYQQQAPPQMSPPFQPPIGDPQQQFMYDPLLNTARHLGGQFAEQQKQKVHSFITHSTK

SEQ ID NO: 139163 - protein, 33 aa, Heterodera glycines
  Coding regions on vcDNA: vcDNA=SeqID_65586; Strand=+; Position=1-102
QFVMRPMSDTVGSLSEALQNEDPGIELVTFYNS

SEQ ID NO: 139164 - protein, 98 aa, Heterodera glycines
  Coding regions on vcDNA: vcDNA=SeqID_65587; Strand=-; Position=1-297
  Homolog annotation: Hit_ID=Q05049; Match level="QueryCoverage=86%, HitCoverage=12%, E-value=9e-09, Identity=41%"; Hit description =Integumentary mucin C.1 (FIM-C.1) pir||A45155 mucin FIM-C.1 - African clawed frog (fragment) gb|AAA74725.1| FI
MAILSSTTTPSLCIGFDQSTTTTTTTAAATNTTGNSATPSYAAAATRSSCATPTTTTTTNHCLASKSTTTTTARLPSAAKRTKLSTQPPANGRRNFYL

SEQ ID NO: 139165 - protein, 57 aa, Heterodera glycines
  Coding regions on vcDNA: vcDNA=SeqID_65588; Strand=-; Position=1-280
RCAQIYGETESFGSSFPIACTLILRWIFAPHKCLSTPNGHLKKSIFLFHKYFFQKVL

SEQ ID NO: 139166 - protein, 131 aa, Heterodera glycines
  Coding regions on vcDNA: vcDNA=SeqID_65589; Strand=+; Position=1-396
MAQIQHVVDVVVVAAHSSCDHADELTDLLQQAKDGATVQAKYGAAVQAKDGAAVQAKDGAVVQAKDKAAVLPDTEKGIEAIASALAGLAKGLGDAKTAFGAAKNGSEGNRDEILGDPTNTKAFGRIYPKEK

SEQ ID NO: 139167 - protein, 90 aa, Heterodera glycines
  Coding regions on vcDNA: vcDNA=SeqID_65590; Strand=-; Position=1-582
IIFIQKIFFWVFGAVPLNRCAQIYGETESFGNSFPIACTLILRWIFAPHNCLSTPNGHLKKSIFLFSGQTPRTDAPRFMGRPNPSGVASL

SEQ ID NO: 139168 - protein, 80 aa, Heterodera glycines
  Coding regions on vcDNA: vcDNA=SeqID_65591; Strand=-; Position=1 -90,157-309
MNPDLEIAQKFFLCKENKKDVATIFLELLKSQNLSPNLVFYQKRLKSLAFRALLTTKWRPFTKYAALNCACPLTRLNCEH

SEQ ID NO: 139169 - protein, 57 aa, Heterodera glycines
  Coding regions on vcDNA: vcDNA=SeqID_65592; Strand=+; Position=1 -77,128-224
MTTSSTSSEKGDYEFHWKNPREIKQKWESFAKFGQSQAQATQVTEITGKNFDKWCTN

SEQ ID NO: 139170 - protein, 95 aa, Heterodera glycines; identical to SEQ ID NO: 124528
  Coding regions on vcDNA: vcDNA=SeqID_65593; Strand=+; Position=1-847

SEQ ID NO: 139171 - protein, 78 aa, Heterodera glycines
  Coding regions on vcDNA: vcDNA=SeqID_65594; Strand=+; Position=1-236
MSSEFHSMNRGTICKDEKPTEAERKRRENEGEEEEEKEKGTRTAKKKKPYKELTLEEKVELIRLAERCSNLSQASIAE

SEQ ID NO: 139172 - protein, 209 aa, Heterodera glycines
  Coding regions on vcDNA: vcDNA=SeqID_65595; Strand=+; Position=1-954
FQQKQLRSAQACAWAAKETEQVVMTQRWPGIRASRTWEEPSRRWTQLRGQCTGTHTSTPDFPVRTLPQAKGLRALMSRVFSNASTLVPRQGVPIHELIGLVNHGNTPLTRIPTPPPTLGSASPVLSSPQHLCLRPHLHKSINSPNFFNTQTSCMFIHFDSCQSLEKLRPRQRWHPSSSHHRSMPSTSASKHLNPDGRAPHSEIASFFQP

SEQ ID NO: 139173 - protein, 147 aa, Heterodera glycines
  Coding regions on vcDNA: vcDNA=SeqID_65596; Strand=+; Position=1 -109,475-809
MAALNPLLARNVPAKNGDPAFFEICQQIWAILGQFLGYITDPALRGIESSDFRLFDQAGGTRNGMGNSMPAQVGLHPLHHSLPMKRLVSSLAHEGLHILEFQQGRQWPRAGTSTKHDHGPFFRAKCAEFDEISGGLIQPEMQEFDPL

SEQ ID NO: 139174 - protein, 177 aa, Heterodera glycines
  Coding regions on vcDNA: vcDNA=SeqID_65597; Strand=+; Position=1 -193,464-679,794-918
  Homolog annotation: Hit_ID=EAA08835.2; Match level="QueryCoverage =100%, HitCoverage=82%, E-value=6e-26, Identity=35%"; Hit description= ENSANGP00000011823 [Anopheles gambiae str. PEST]
MCSKCFKDMIKRKQETGNTAPSTTAAATTAANKTTETMPVDAVVAALAASGGGTTEQQRSTSSPENAITGLSASSGTTASTSHPGMLSCSAATTTTDATNNTHAAPSPAPGQQQEDTQQKKKPNRCGVCSKRVGLTGFECRCGGLFCGEHRYDSAHNCTFDYKTAGREELRAKHPQV

SEQ ID NO: 139175 - protein, 17 aa, Heterodera glycines
  Coding regions on vcDNA: vcDNA=SeqID_65598; Strand=-; Position=1 -27,78-104
MDIDELKKMSPEQQNKV

SEQ ID NO: 139176 - protein, 188 aa, Heterodera glycines
  Coding regions on vcDNA: vcDNA=SeqID_65599; Strand=+; Position=1 -121,172-287,339-584,808-891
  Homolog annotation: Hit_ID=AAH27747.1; Match level="QueryCoverage =88%, HitCoverage=44%, E-value=5e-23, Identity=36%"; Hit description =RAD23b homolog [Mus musculus] ref|NP_033037.1| RAD23b homolog [Mus musculus] emb|CAA63146.1| MHR23B [Mus m
MGYPRQEVVRALQAAFFDADRAVEYLCNGIPEGLSLQESNSDADNDAVNEEGELMESLENPQGLSFLAQSPQFQQLRDIVRTDPSMLPQIIQQIAAANPQLMEAIRNNQGAFLQMLNEGQPLGGGTDAGAGGEAAAGVQQEAAQRRVSIPVNAQDRLAITRDLAVNYILARMDESQNERAGAGQQGGQ

SEQ ID NO: 139177 - protein, 175 aa, Heterodera glycines
  Coding regions on vcDNA: vcDNA=SeqID_65600; Strand=+; Position=1 -438,973-1062
  Homolog annotation: Hit_ID=CAG88655.1; Match level="QueryCoverage =87%, HitCoverage=10%, E-value=6e-09, Identity=29%"; Hit description =unnamed protein product [Debaryomyces hansenii CBS767] ref|XP _460364.1| unnamed protein product [Debaryomy
MTKKGGREEKGDGGTVAGKEDTGTVSVADEADGGTTTTAAGANDGRTTATIEDNNANATTVDNNSSETVAENNGGSAASVTNNSGSTIATVTTDHSGSTAGTDNSGSNATTCEQSTATPVQQQRTYDSNNSLRPVFIQGYDFQVSKTGRETLASLERRKQSLMSRKTICVRKLNM

SEQ ID NO: 139178 - protein, 116 aa, Heterodera glycines
  misc_feature (13)..(13): Xaa can be any naturally occurring amino acid
  Coding regions on vcDNA: vcDNA=SeqID_65601; Strand=-; Position=1-348
  Homolog annotation: Hit_ID=NP_500013.1; Match level="QueryCoverage =95%, HitCoverage=7%, E-value=2e-19, Identity=42%"; Hit description =predicted CDS, polyprotein family member (4B673) [Caenorhabditis elegans] gb|AAC02594.1| Hypothetical prot
QGNAVVERSFRTXFNILAKYISSEEPDFDEFLECANFCYNTSIHSSTKETPFFLVFGRDPIFCIEQILNPNTEPENTSEVDNVKQKLVKSLRKAWESAAAVIKEAQLRSKVQYDKL

SEQ ID NO: 139179 - protein, 256 aa, Heterodera glycines
  Coding regions on vcDNA: vcDNA=SeqID_65602; Strand=+; Position=1-773
  Homolog annotation: Hit_ID=NP_500013.1; Match level="QueryCoverage =96%, HitCoverage=17%, E-value=2e-35, Identity=36%"; Hit description =predicted CDS, polyprotein family member (4B673) [Caenorhabditis elegans] gb|AAC02594.1| Hypothetical pro
QGNAVVERSFRTFNILAKYISSEEPDFDEFLECANFCYNTSIHSSTKETPFFLVFGRDPIFCIEQILNPNTEPENTSEVDNVKQKLVKSLRKAWESAARSLKKLSYGQKYNNKLVRNQTVQIGDRVLLRNYAGKVKTSKKFQLPWKGLYLVIEINGVLITIVSCTSPQTNPRIVHINQIKKYFEYSGPPCTTKNLQKDEEQALKELESREQTNVPGYSHDSYQNISDNTVLIENAPALTPNPSPSSQSNNQVKEKE

SEQ ID NO: 139180 - protein, 317 aa, Heterodera glycines
  Coding regions on vcDNA: vcDNA=SeqID_65603; Strand=+; Position=1 -640,735-1048
MSYAAAFVNFDLGDMKKISLTDGHCLMAFQGSNDPFSNFFFSPFVYEGERYSCVEQAFVMKKVRTFELHGVAAELMRFIHKDDPTPNSPRWPDGHPRELKWFGREAEERATPATKRKWSENTQRSFIAFLVEQKFRQNRHLAALLLATNDMWIAEACKDRKWAVGYYKDDPFLCNYTPENGAFGRNWMGNILMSLRMRMLNEQQSVAGPSRQIEPPSAPVYLIAQELANGLIGAKIDFDNSFPHFVLLPNRLLSSGLGLGDFFTPGKLEADNRFTILASNVTEMTKERKLWINPNSSILAVQATVIDIKSKYLSLRF

SEQ ID NO: 139181 - protein, 117 aa, Heterodera glycines
  Coding regions on vcDNA: vcDNA=SeqID_65604; Strand=-; Position=1 -63,162-452
MTFVGQDADPEVVITYFGMTSNLRLRYLLLMSITVAWTAKIEEFGLIQSFLSFVISVTFEARMVNLLSASNLPGVKKSPRPRPLDNKRFGSRTKCGKLLSKSILAPISPLASSCAMR

SEQ ID NO: 139182 - protein, 49 aa, Heterodera glycines
  Coding regions on vcDNA: vcDNA=SeqID_65605; Strand=+; Position=1 -36,221-334
MNDCLCAKWGRGRRQRLFGPSDPIRAKGLRAAERLAKPKTAKTPWTSPI

SEQ ID NO: 139183 - protein, 92 aa, Heterodera glycines
  Coding regions on vcDNA: vcDNA=SeqID_65606; Strand=-; Position=1 -166,383-495
MDEGTKRERTKTTNGVSAEEIKAQPLGTKLKAGRKGRDTAEMLLLKKTALIGFRRKYYRSFFCFQMTSSEEKEKNEAMNGRKTANFEKAATH

SEQ ID NO: 139184 - protein, 49 aa, Heterodera glycines
  Coding regions on vcDNA: vcDNA=SeqID_65607; Strand=-; Position=1 -88,568-629
MLIKKGSNTKLIRSLLHGDLISPFWLGTRDFFNADPEKQYFKNEMGQHF

SEQ ID NO: 139185 - protein, 17 aa, Heterodera glycines
  Coding regions on vcDNA: vcDNA=SeqID_65608; Strand=+; Position=1-66
HKHLFDLFYHVHNLIKI

SEQ ID NO: 139186 - protein, 298 aa, Heterodera glycines
  misc_feature (9)..(9): Xaa can be any naturally occurring amino acid
  Coding regions on vcDNA: vcDNA=SeqID_65609; Strand=-; Position=1 -168,219-309,366-448,509-577,621-699,747-816,865-959,1005-1037
  Homolog annotation: Hit_ID=CAE58868.1; Match level="QueryCoverage =95%, HitCoverage=31%, E-value=7e-80, Identity=57%"; Hit description =Hypothetical protein CBG02098 [Caenorhabditis briggsae]
FLAVLSNYXFQSFSLYEFTRLLNSQLQTSYLPNSTKKVELHQELLVLLWKCCEYYQKFLYYVLKSSDVLELLVPILFHQKFLYYVLKSSDVLELLVPILFHLNDSRTDPTRIGLIHMGVFLIRIGLIHMGVFLILLLSGERNFGVRLNKPFTSRPFTSRGLIDVPIFTGSHADLLIIVFHKLITSVFHKLITSGNHKLQSLFDCLLTIVVNVSPYLKSPYLKSLSMVTANKLVHLVEAFSTPWFIFTPWFIFSTPTNHHLIFFLLELFNNIIQYQFDGNSNLVYTIIRNSNLVYTIIR

SEQ ID NO: 139187 - protein, 336 aa, Heterodera glycines
  Coding regions on vcDNA: vcDNA=SeqID_65610; Strand=+; Position=1-1011
  Homolog annotation: Hit_ID=BAB02793.1; Match level="QueryCoverage =98%, HitCoverage=25%, E-value=1e-63, Identity=41%"; Hit description =helicase-like protein [Arabidopsis thaliana]
MRTLDEKLKEIMNNGIAFGGKVMLWTGDFRQTLPIQKHATRAEMVNATIKRSEYWRLAKRYRLTKNMRALATEQEFAKDLLEIGSGKWNNENDEIILPEICISIGDLAEEIFGNCIVSENWNEMAKSAILAPKNVDVSEINNRVLEMLPGEEVVYTSIDLAQDENRQRADEYLDEYLNALNPSGFPRHKLRLKKNAIVLLMRNLNIEMGLCNGARMNVEQMQPNLIVCKILTGDKAGQTVYIPRITLCCSEEYPFDLHSHQFPLVLAFAMTINKAQGQTLEQVGIDLRKDVFSHGQLYVALSRARAWNKLRIRLDDGNLERKVKNVVYRELLDNSD

SEQ ID NO: 139188 - protein, 257 aa, Heterodera glycines
  Coding regions on vcDNA: vcDNA=SeqID_65611; Strand=+; Position=1 -47,95-236,284-388,441-485,534-598,645-793
  Homolog annotation: Hit_ID=EAA12849.3; Match level="QueryCoverage =99%, HitCoverage=48%, E-value=4e-40, Identity=39%"; Hit description =ENSANGP00000006599 [Anopheles gambiae str. PEST]
HNILTPQITFVAHSWFNILRFPIAIFAMIGSQAIQTAVSWFNILRFPIAIFAMIGSQAIQTAVSNRRLKHFLAAEEMEPLLRGRPTSAITIKNADFAWEKDRSLITIKNADFAWEKDRSLVLKDINLSVRKGTLFAIVGRTGSRTGSGKSSLLSAMLGELYRKSGENSLNGELYRKSGENSLNGSVAYVPQQAWIQNMTLENNVLFGHAWIQNMTLENNVLFGHEFDSDRYQSVLDVCALRQDLAVLPAGDQTEIGE

SEQ ID NO: 139189 - protein, 16 aa, Heterodera glycines
  Coding regions on vcDNA: vcDNA=SeqID_65612; Strand=-; Position=1-49
EAIPEGFDLPINLGAS

SEQ ID NO: 139190 - protein, 22 aa, Heterodera glycines
  Coding regions on vcDNA: vcDNA=SeqID_65613; Strand=-; Position=436-502
MHTCPSGAENIKVQTLTTSLKK

SEQ ID NO: 139191 - protein, 123 aa, Heterodera glycines
  Coding regions on vcDNA: vcDNA=SeqID_65614; Strand=+; Position=1-369
MPGKPELLLLEGRGPSTVVVHPRPSPATTPFPNDDFVDKSSSAEQRHKNLRVAPSTFTCHPIKTRLKPCRGLSSPSVFKATAAPSPSSQLFCFRVGQPMSDETILNATDSDWPFSKSETRNST

SEQ ID NO: 139192 - protein, 53 aa, Heterodera glycines
  Coding regions on vcDNA: vcDNA=SeqID_65615; Strand=-; Position=1-160
MLCSLRGVLPNFFKRHLSVAIQKNIPEEHDEGFVDVANTEILCKYVFINYQFG

SEQ ID NO: 139193 - protein, 20 aa, Heterodera glycines
  Coding regions on vcDNA: vcDNA=SeqID_65616; Strand=+; Position=1 -13,247-296
MVCAVRSRAQSLKEFYAVRS

SEQ ID NO: 139194 - protein, 64 aa, Heterodera glycines
  Coding regions on vcDNA: vcDNA=SeqID_65617; Strand=-; Position=1 -92,135-247
  Homolog annotation: Hit_ID=AAD30505.1; Match level="QueryCoverage =100%, HitCoverage=20%, E-value=1e-11, Identity=50%"; Hit description= ADP/ATP translocase [Ascaris suum]
ESLGMAFKELFKRWCVTESDRSVNYRRFVAGNLLAGGLAGSVTFFFIYPLDFSRTRLAVDMGKG

SEQ ID NO: 139195 - protein, 38 aa, Heterodera glycines
  Coding regions on vcDNA: vcDNA=SeqID_65618; Strand=+; Position=1-116
MTKEKPKEQWEKQWADEPEKKAMKELEKTDKQFKENNR

SEQ ID NO: 139196 - protein, 117 aa, Heterodera glycines
  Coding regions on vcDNA: vcDNA=SeqID_65619; Strand=-; Position=1-608
AKRCPILYSSCLFCFVYSFCLSKCSAFIQSSFFVAIFGFSQLFKVAFSPSIVFLELFVGLFKFFHGFFLRFVCPLFFPLLLWLFLSHCFVSGGFVWTPFHSLYECPPPPPPIKVRFL

SEQ ID NO: 139197 - protein, 74 aa, Heterodera glycines
  Coding regions on vcDNA: vcDNA=SeqID_65620; Strand=+; Position=1 -198,561-587
MKKQNRLKKWEGIVNKFMEEKGKYLRKKEPKGKKNIHHREIDEQIAETWGTNSRTIYRWKKNWDRLRILPMRTN

SEQ ID NO: 139198 - protein, 42 aa, Heterodera glycines
  Coding regions on vcDNA: vcDNA=SeqID_65621; Strand=-; Position=1 -18,292-378,894-917
MDTRFVQWDIAVITFYRTVVNWDGLMLHLYDVLTANIFYLLK

SEQ ID NO: 139199 - protein, 99 aa, Heterodera glycines
  misc_feature (6)..(6): Xaa can be any naturally occurring amino acid
  Coding regions on vcDNA: vcDNA=SeqID_65622; Strand=-; Position=1 -91,179-388
KSPANXQIATDKHADANANASQNTVVYGPIFPADYWQLPPALLAARLRRFSKADIVRSLRQNARRMGVDGGKLRAVMRHIEIMRREEAQLRNHRHYQLP

SEQ ID NO: 139200 - protein, 175 aa, Heterodera glycines
  misc_feature (1)..(1): Xaa can be any naturally occurring amino acid
  misc_feature (14)..(14): Xaa can be any naturally occurring amino acid
  misc_feature (164)..(164): Xaa can be any naturally occurring amino acid
  Coding regions on vcDNA: vcDNA=SeqID_65623; Strand=+; Position=1 -155,382-457,509-586,677-727,797-890
  Homolog annotation: Hit_ID=NP_495702.1; Match level="QueryCoverage =69%, HitCoverage=13%, E-value=9e-42, Identity=66%"; Hit description =UNCoordinated locomotion UNC-105, degenerin mec-4 family member (95.8 kD) (unc-105) [Caenorhabditis elega
XIQYMHPIRFLHEXQIKKLNNVLGLRVLVYANVSEYLPITEAVGFRITVHDKWTVPFVDAFGYNAPTGTLSAFGVRMKKFFRLEHPYKKFFRLEHPYGHCREGGERAEWYIYNNYNYSIEGCHRSCTQREVVRVCGCADPMVPVVVRVCGCADPMVPVSEKINXNFKFLWSYTKQ

SEQ ID NO: 139201 - protein, 156 aa, Heterodera glycines
  Coding regions on vcDNA: vcDNA=SeqID_65624; Strand=+; Position=1 -101,209-308,376-534,581-691
  Homolog annotation: Hit_ID=EAA50199.1; Match level="QueryCoverage =95%, HitCoverage=30%, E-value=1e-36, Identity=46%"; Hit description =hypothetical protein MG03958.4 [Magnaporthe grisea 70-15] ref|XP _361484.1| hypothetical protein MG03958.4
MLDLECFTFLHRALESEVNPVIVFATNRGRSKIRNSDEIGFYGIPSDLIDRLLIVPTRPYSIEEMSLIVRIRADAEGVLLDPGALSRLCELGQKTSLRYVMQLLTPAKLLAHIGGRESVEIVDIDECVQLFMDSKTSTNLLKSKQSEGGDDDVEMS

SEQ ID NO: 139202 - protein, 146 aa, Heterodera glycines
  Coding regions on vcDNA: vcDNA=SeqID_65625; Strand=+; Position=1-443
VDSALAEQIPVVEKPIINYHKRAFAQRVTICEAINNWANIRSSVQVEDYSFMLYYANTRLQNDRSLIKNYAINFNRLYEPEYLFDMQKLKLQISANSKFDNSYAPLRRIFDHQMGKMKTKAMAKFVSSAFSCHQHLSMFSRSHSMA

SEQ ID NO: 139203 - protein, 27 aa, Heterodera glycines
  Coding regions on vcDNA: vcDNA=SeqID_65626; Strand=+; Position=1 -55,138-166
MHSVFYLMFIFVFIHGSIYIWKNSLLI

SEQ ID NO: 139204 - protein, 15 aa, Heterodera glycines
  Coding regions on vcDNA: vcDNA=SeqID_65627; Strand=+; Position=1 -24,89-112
MTEYASVAVFIERFL

SEQ ID NO: 139205 - protein, 96 aa, Heterodera glycines
  Coding regions on vcDNA: vcDNA=SeqID_65628; Strand=-; Position=1 -144,238-384
MGSFWANLYKNGAKLVKSAGAVATKSLLCQLGQLDQVIVNTFANSLTQRFLFFGKSPIDYVEQNDPAMGHLLQNLYTIYQKLKLLKFLRNAIKWNF

SEQ ID NO: 139206 - protein, 55 aa, Heterodera glycines
  Coding regions on vcDNA: vcDNA=SeqID_65629; Strand=-; Position=1 -149,276-294
MPLLYPYEKDGSEREKQNFNVPYFCLSIRDTFKTDCQQMSGCNRQCKFCITCTYS

SEQ ID NO: 139207 - protein, 33 aa, Heterodera glycines
  Coding regions on vcDNA: vcDNA=SeqID_65630; Strand=+; Position=1-102
LNIQIFLSAVHFHLELGLELYPGLDFSWIQVQV

SEQ ID NO: 139208 - protein, 278 aa, Heterodera glycines
  Coding regions on vcDNA: vcDNA=SeqID_65631; Strand=+; Position=1 -85,191-285,370-463,937-1112,1172-1228,1302-1398,1440-1514
  Homolog annotation: Hit_ID=AAH02251.1; Match level="QueryCoverage =89%, HitCoverage=98%, E-value=1e-43, Identity=39%"; Hit description =Psph protein [Mus musculus] gb|AAH83937.1| Unknown (protein for MGC:97922) [Xenopus laevis] ref|NP_598661.
SLFQSDLAKFKTTASAVCFDMDSTLIKEEETLDAYSSFFGLDLGGSAITEKAMGGQIGFRKKALALRLEMLRPTKAQYERFLNEFTPTLSDGVEQLVTVLRGYGVDLYIVTGGFVEVAKRVAQRLNIPNKNVFANRILFSADGCYEGFDKSQSGASPIGKAGVCQQSGASPIGKAGVCQLLKERNSYKLLVMVGDNSYKLLVMVGDGGTDMEARPPADLFVGYGGNQVREKVRLGSDWFVRDFRTLTDAIEEQVREKVRLGSDWFVRDFRTLTDAIEE

SEQ ID NO: 139209 - protein, 118 aa, Heterodera glycines
  Coding regions on vcDNA: vcDNA=SeqID_65632; Strand=+; Position=1 -33,365-688
MRSLAALIQQLKNHLLYSSPNIGNPARCYVVIRARYFEKSLDLDLDSMFDLDLDFLDKNPGKYRSRKNPGLDPGPGRALVVIKKPSKRGQSLIIGVPTKKSVKNLSDIFSDCELKKMR

SEQ ID NO: 139210 - protein, 43 aa, Heterodera glycines
  Coding regions on vcDNA: vcDNA=SeqID_65633; Strand=-; Position=1 -87,445-489
MRQMEELGQFLRERYAAANFLPQHFDRKEVNFRLNLKNGLIRV

SEQ ID NO: 139211 - protein, 62 aa, Heterodera glycines
  Coding regions on vcDNA: vcDNA=SeqID_65634; Strand=-; Position=1 -52,150-257,295-323
MEKACKIWRDYIDFSALGKASGTLVYVLISILIGGDRFMKKYLVIDFSSEGRYILMELSSYQ

SEQ ID NO: 139212 - protein, 36 aa, Heterodera glycines; identical to SEQ ID NO: 130206
  Coding regions on vcDNA: vcDNA=SeqID_65635; Strand=-; Position=1-206

SEQ ID NO: 139213 - protein, 109 aa, Heterodera glycines
  Coding regions on vcDNA: vcDNA=SeqID_65636; Strand=+; Position=1-327
MTAAGARVDGAVQILSTLFLIANYAIVLPMFLLCWMMVVHWLRRSGLMPPPHQSPSTSQHPNRYGGLHTIFEDTVEQKAGHEKDVRQQQQRHTSAAAAAAADTVTTEAM

SEQ ID NO: 139214 - protein, 53 aa, Heterodera glycines
  Coding regions on vcDNA: vcDNA=SeqID_65637; Strand=+; Position=1-162
ISPALSIHFAMHQSTVAPSSAAAAQSLGCKIEPPKPRVDATRATDSDKHSTAK

SEQ ID NO: 139215 - protein, 42 aa, Heterodera glycines
  Coding regions on vcDNA: vcDNA=SeqID_65638; Strand=+; Position=1-126
NNVISNQLQTTPAIYPMRKIEIRSLFIPRGTSDLSHNVFTSI

SEQ ID NO: 139216 - protein, 255 aa, Heterodera glycines
  misc_feature (239)..(239): Xaa can be any naturally occurring amino acid
  Coding regions on vcDNA: vcDNA=SeqID_65639; Strand=-; Position=1 -193,246-322,369-476,525-809
  Homolog annotation: Hit_ID=NP_509517.1; Match level="QueryCoverage =86%, HitCoverage=37%, E-value=2e-31, Identity=36%"; Hit description =l-carnitine dehydratase/bile acid-inducible protein F (XJ613) [Caenorhabditis elegans] gb|AAA81458.2| Hyp
KGFGILEFDWSKLWNGGRGFVLDCAMTEGLAYLGSFLFLSRHEPWLWHEEFALFSGKCPIYRTYETADRKWMAVGAVEPKTYETADRKWMAVGAVEPKFQQKLFEILGISTEKIDGMAKLTRLGISTEKIDGMAKLTREMENAFRGKTQREWAIIFEGEDACEDACVTPVLNMDEVGHYEQHKRRNAFLRGEVEGEAVWVPRAVPKRMETEKSQTKAKSERTEREKSQMRAKVSTANEXMNGTMSSNAFLSQNAI

SEQ ID NO: 139217 - protein, 16 aa, Heterodera glycines
  Coding regions on vcDNA: vcDNA=SeqID_65640; Strand=-; Position=1-49
EAIPEGFGLPINLGAS

SEQ ID NO: 139218 - protein, 104 aa, Heterodera glycines
  misc_feature (93)..(93): Xaa can be any naturally occurring amino acid
  Coding regions on vcDNA: vcDNA=SeqID_65641; Strand=+; Position=1 -109,200-238,290-381
  Homolog annotation: Hit_ID=CAE70655.1; Match level="QueryCoverage =68%, HitCoverage=6%, E-value=3e-25, Identity=76%"; Hit description =Hypothetical protein CBG17362 [Caenorhabditis briggsae]
RVITMESCNRFSGVEHAAYLHYMRNSSVYFGPGCNNEILVIGRLILVIGRLVSRWNVPIIAHLSGDDALSDRTGPIIAHLSGDDALSDRTGRXFWPFHSLIKSS

SEQ ID NO: 139219 - protein, 116 aa, Heterodera glycines
  Coding regions on vcDNA: vcDNA=SeqID_65642; Strand=-; Position=1 -231,979-1098
MRWRGKNLGNIVEELDKEGNDDGDQKNDQPDKRETMRKGEKGKDGRQKQSGDEIVEEKEKNDSEKGEAVKKDQFATTVETNLCSTMFQNVKIEVEVLRQIVFDPIGRVLAQTQVDN

SEQ ID NO: 139220 - protein, 66 aa, Heterodera glycines
  Coding regions on vcDNA: vcDNA=SeqID_65643; Strand=-; Position=1-203
  Homolog annotation: Hit_ID=AAB37623.1; Match level="QueryCoverage =100%, HitCoverage=10%, E-value=2e-11, Identity=48%"; Hit description= Hypothetical protein C43E11.8 [Caenorhabditis elegans] ref|NP _491337.1| exocyst component (1E812) [Caenor
IRKLLSTVDATIQFHGKTTVLENTIRDGGNVLLNIDDYLEKMRNLKEAIAFFATHPVYRNHEHIVR

SEQ ID NO: 139221 - protein, 41 aa, Heterodera glycines
  Coding regions on vcDNA: vcDNA=SeqID_65644; Strand=+; Position=1 -55,447-517
MAKVQKIIKKWLAEKWAPGWCPVFPCPVSYLESRIRTKGEN

SEQ ID NO: 139222 - protein, 28 aa, Heterodera glycines
  Coding regions on vcDNA: vcDNA=SeqID_65645; Strand=+; Position=1 -12,93-164
MITPEQHQKRLEFIKRKKMNSVGCFGLE

SEQ ID NO: 139223 - protein, 49 aa, Heterodera glycines
  Coding regions on vcDNA: vcDNA=SeqID_65646; Strand=+; Position=1 -63,295-381
MFPTLKKTHRTHVRIDAPVRAGPKQNGLLPEKLEKELGGLFRPTSLCCA

SEQ ID NO: 139224 - protein, 66 aa, Heterodera glycines
  Coding regions on vcDNA: vcDNA=SeqID_65647; Strand=-; Position=1 -109,327-418
MALPRAGARQLPPLTIGRGGVGNSEMATIMTDDGGTESTNHCRDGDEEPPQRRRRGPKLALDELDG

SEQ ID NO: 139225 - protein, 80 aa, Heterodera glycines
  Coding regions on vcDNA: vcDNA=SeqID_65648; Strand=-; Position=1-631
LFEYPKRTLEKIDFFVFGAVPPNRCAQIYGETESFRNSFPIACTLILRWIFAPHNCLSTPNGHLKKSIFLFHKYFFQKVL

SEQ ID NO: 139226 - protein, 148 aa, Heterodera glycines
  Coding regions on vcDNA: vcDNA=SeqID_65649; Strand=+; Position=1 -242,572-695,812-892
MRTPPPLLCSAIRCLIWLHQQQQQRQNQFACTRTNFLGTIMPTSTICDGATTTTQGMAHRVPQPPTDRGRRKRTLPRRYCSESTSHGGAPPTAEPIKMPNNKRFIIDEAELELKYAWIRHYNPITALAGGPRMDWNNNDKNNEIVTKF

SEQ ID NO: 139227 - protein, 48 aa, Heterodera glycines
  Coding regions on vcDNA: vcDNA=SeqID_65650; Strand=+; Position=1-148
FVKKSNYHCILMILASSSKRLACQFLIRKVPHFAVTSSRKEYFVVLST

SEQ ID NO: 139228 - protein, 139 aa, Heterodera glycines
  Coding regions on vcDNA: vcDNA=SeqID_65651; Strand=+; Position=1 -40,637-756,952-1031,1095-1274
  Homolog annotation: Hit_ID=CAE58594.1; Match level="QueryCoverage =64%, HitCoverage=7%, E-value=3e-14, Identity=38%"; Hit description =Hypothetical protein CBG01761 [Caenorhabditis briggsae]
MCYNPKFLKFIKNLLSGGLSALFVSTIDSIFDTRPPPYRIIYQRELDEGQIAWVIAIAVDWRDVLDNWQCLETSLLPILESLGTDENELEKFVLTKIDGFLALRDEMERREHLVADGGEEDDGAESAAGEILQIKFKIP

SEQ ID NO: 139229 - protein, 66 aa, Heterodera glycines
  Coding regions on vcDNA: vcDNA=SeqID_65652; Strand=-; Position=1-199
MARTKQTARKTQSQKGFSSSSGSQHMQSQLHNLRKQLATKRPNPKRGIGYKELPPVKIAQKRHHKK

SEQ ID NO: 139230 - protein, 94 aa, Heterodera glycines
  Coding regions on vcDNA: vcDNA=SeqID_65653; Strand=+; Position=1 -178,659-765
MIGTYGVPKSVSIMSIAWRKPLRAVFNWLMISSLPSERTSLILSAAWMASYSECLSCMLVVGTPINATEKIIGNIRKYSAIFEYFMKMIVNVSR

SEQ ID NO: 139231 - protein, 39 aa, Heterodera glycines
  Coding regions on vcDNA: vcDNA=SeqID_65654; Strand=-; Position=1-117
HQKDPEVSWRNDATEGVLGKLTTTMGPCFCKGTAYLIHS

SEQ ID NO: 139232 - protein, 42 aa, Heterodera glycines
  Coding regions on vcDNA: vcDNA=SeqID_65655; Strand=-; Position=1-128
LDDSTGPTSSIDLPTERIWSHRMRDTGNLEAQIASMMVSMGH

SEQ ID NO: 139233 - protein, 55 aa, Heterodera glycines
  Coding regions on vcDNA: vcDNA=SeqID_65656; Strand=+; Position=1-168
  Homolog annotation: Hit_ID=NP_501127.2; Match level="QueryCoverage =94%, HitCoverage=3%, E-value=2e-10, Identity=53%"; Hit description =RNA Polymerase, Class III (C), rna polymerase (rpc-1) [Caenorhabditis elegans] gb|AAA83341.2| Rna polymera
QDLAVNYGNTVRTSTNEVVQFTFGDDGLDPAYMEAKDGRPLDFQHMLAQVRNTNN

SEQ ID NO: 139234 - protein, 179 aa, Heterodera glycines
  Coding regions on vcDNA: vcDNA=SeqID_65657; Strand=+; Position=1-540
MKLCLFLSVLIAFLIVLIEIGAEKKKLEQSFEEIFGEKWEEKEEENLEEENNQNENDQKKREIIEKFYKIKEKIKQNEKIYTRKEWNKIEQKIGKKLGTNRQYIYKWIKELNLQKYKCHKSKTDEQKIEIIQKFNSMKNEYKQKGRKYSKKEWKKNLQKFIRKLELTKEELTNGRNNLE

SEQ ID NO: 139235 - protein, 66 aa, Heterodera glycines
  Coding regions on vcDNA: vcDNA=SeqID_65658; Strand=-; Position=1 -166,514-548
MIVLQSQITASITVTSRLTVFIAKFSNTAKTDEKNELDEEEDEVVDEDGEREEEEVYFVGVPKEMP

SEQ ID NO: 139236 - protein, 81 aa, Heterodera glycines
  Coding regions on vcDNA: vcDNA=SeqID_65659; Strand=-; Position=1-243
MHAFCARAIYHRACQSKAKQQRCCFERIKGIGYFEEVSNEHEAISLQNLISGKYMSIEFIFRKCPQTLQKKICNLSTNFEN

SEQ ID NO: 139237 - protein, 63 aa, Heterodera glycines
  Coding regions on vcDNA: vcDNA=SeqID_65660; Strand=-; Position=1 -144,324-371
MRRQWANKFARLASISRKTLRSNKAGTASHEVGHSVIIWLLGVRQFLKANKVSQKLSNDNKNI

SEQ ID NO: 139238 - protein, 121 aa, Heterodera glycines
  Coding regions on vcDNA: vcDNA=SeqID_65661; Strand=+; Position=1 -126,288-527
MLIGMLFILSVQSLMLLTVLRCRYFLSQRELHAMALHVAQKSRQDYPTIQIVVTNGSVLSSAAAAAENGFVAPPQGNGVVGNSAGTEMANGHATTAQNGQQQQNGGQQDEPQDQPILKGIV

SEQ ID NO: 139239 - protein, 82 aa, Heterodera glycines
  Coding regions on vcDNA: vcDNA=SeqID_65662; Strand=-; Position=1 -89,180-337
MPFGFEERLFLFPVNFAITSLMLWSKWALKFKNNSSVDKVNVYGIVRSFRANPAESILLAVPMRSSKIEAVAVALAFADYAK

SEQ ID NO: 139240 - protein, 146 aa, Heterodera glycines
  Coding regions on vcDNA: vcDNA=SeqID_65663; Strand=+; Position=1 -183,235-365,714-840
  Homolog annotation: Hit_ID=AAL78213.1; Match level="QueryCoverage =71%, HitCoverage=41%, E-value=5e-32, Identity=69%"; Hit description =probable protein kinase Hgg-20 [Heterodera glycines]
MPEELVALSPGTRVSGRWTIIKKLGAGAFGAVYLCQDRDGRTMAALKTEPIDAQRPLLYMEAHVLLSLNELRSNSGRHFCRCLDLGRDEQPDADSGQTMEFNYVVAHTGAKGTPPASEGRQSTHQSLRTSNATTAAGMTLSRGSTC

SEQ ID NO: 139241 - protein, 249 aa, Heterodera glycines
  misc_feature (224)..(224): Xaa can be any naturally occurring amino acid
  misc_feature (230)..(230): Xaa can be any naturally occurring amino acid
  Coding regions on vcDNA: vcDNA=SeqID_65664; Strand=-; Position=1 -58,114-356,468-661,1137-1383
  Homolog annotation: Hit_ID=AAH61875.1; Match level="QueryCoverage =100%, HitCoverage=99%, E-value=1e-28, Identity=33%"; Hit description= Unknown (protein for MGC:72396) [Rattus norvegicus]
MTKPQQVLVLDPNNELSFKGPFTEYPFTEYVNANLTLSNPSRKDVYFKVKTTAPKFYCVRPNSGVIKVNKHTQSFVAIKWTEIKANDKTQINVMLQPVESPETLETVDQFWKTVDPTLVMDSKLRVVFQRPFGFGDENNRDETNATGLNFNKTGEPKNEQPTQTPKSTKTEKYLKTSKKLLIFVSKTWLKNFSSTKIGNFARSFFNAKCTKRFGPRSAQHFWLXNLHPFXAILFAVLALMVGLIVGKLM

SEQ ID NO: 139242 - protein, 489 aa, Heterodera glycines
  Coding regions on vcDNA: vcDNA=SeqID_65665; Strand=-; Position=1 -230,273-875,2145-2568,2614-2826
MRKKRSGVHTPNSICEKEQKKPKIGNESAEVCHFQAEKFVGEYCTVHTRPSLTVKALSFNSSIGRLCVIRQNESTVSQQFPAQLSLVEFYNADNLPLIFLEKSIPVNDRFETLVWVDNWAVFGGLGGRLTALSPFTSKFGVSGFFKSWVDFFGSVKRVQLCVSDILVMTRAGENHQFVAGNTSGELLVVNNRDFDEEGKCTNKVPTFSTVQTIKLSTDEHITAIGCSNNKTLTPQMMAVGKVNGLSLFLYESEWKKHKEIDIPRTKESANVVWSLIFVWLHPIPFQVNGGHVTKICVDSADTRLVALTVAGTFCFDLTKLTHENGQMGEDGLISLELPQKAHPYDCVFYDKCKIVIIMADLNKHVIIYDLNSNSILFTIGNAELGLVSNEWVAYLHVNMRGTVVATTNKARLRLLSIEESKIRLFVDESAESNEHEIAKSSDSRIEPFWLEDRSDLSTNCLNSRFVLVKHVEENVSTRIPCHLRFFGKN

SEQ ID NO: 139243 - protein, 108 aa, Heterodera glycines
  Coding regions on vcDNA: vcDNA=SeqID_65666; Strand=+; Position=1 -110,825-1041
MPLHGNFKDIVAEVKFTNRIEMVWICSNTKKKMLAYSYEVPFQNASKLIMDKLMRWYHSENPDKQFSLVPLPFENVGRMREALNKELDANYDGCRDFVGINIIVVLFN

SEQ ID NO: 139244 - protein, 144 aa, Heterodera glycines
  Coding regions on vcDNA: vcDNA=SeqID_65667; Strand=+; Position=1-432
MELINQFWRDDSEKQFEDYQIPESPPYWSSGFLSIQYAIDKAFIELVRFNIYIFENGLIVSLSFFTVCPIKKIYRDFTFLRAFKAKGDDALANVSLRLHRLPIPSYMNKQMATITVPLFLTMLLFVFAFSMLKDIAVERESGIM

SEQ ID NO: 139245 - protein, 36 aa, Heterodera glycines
  Coding regions on vcDNA: vcDNA=SeqID_65668; Strand=-; Position=1 -59,553-604
MINRRGLNEYMECYKRNIFTKECACNDIYQILWDST

SEQ ID NO: 139246 - protein, 246 aa, Heterodera glycines
  Coding regions on vcDNA: vcDNA=SeqID_65669; Strand=-; Position=1-740
  Homolog annotation: Hit_ID=CAG83749.1; Match level="QueryCoverage =100%, HitCoverage=33%, E-value=2e-29, Identity=38%"; Hit description= unnamed protein product [Yarrowia lipolytica CLIB99] ref|XP_499823.1| hypothetical protein [Yarrowia lipo
VPLLITVVPLLIAVVPLLITVEPLLIAVEPLLIAVVPLLITVEPLLITLLITVVPLLITVVPLLIAVVPLLITVEPLLITLLITVVPLLITVVPLLIAVVPLLITVVPLLIAVEPLLITVVPLLIAVEPLLIAVVPLLITVEPLLITLLITVVPLLITVVPLLIAVVPLLITVVPLLIAVVPLLITVVPLLIAVEPLLIAVVPLLITVVPLLITVVPLLITVVSLLITVVSLLITVVPLLITVVSL

SEQ ID NO: 139247 - protein, 105 aa, Heterodera glycines
  Coding regions on vcDNA: vcDNA=SeqID_65670; Strand=+; Position=1 -66,873-1124
MDQNMDKKCQNICCKPPKIPKKKKNFRMGVKSPNGQVSFFKNEIKYLGVIIDQSGRRPDPTKSQPLLKCAFLQMSANCAHIWAWSIITRNLYEISDSFDSPWMNC

SEQ ID NO: 139248 - protein, 22 aa, Heterodera glycines
  Coding regions on vcDNA: vcDNA=SeqID_65671; Strand=-; Position=1 -57,130-141
MLSNGPMCRYASDLPLALAKNN

SEQ ID NO: 139249 - protein, 55 aa, Heterodera glycines
  Coding regions on vcDNA: vcDNA=SeqID_65672; Strand=-; Position=1 -126,189-230
MNTQILCTPLSEDSTQSATSTATSSRATRPSDVRNQTNIRDDGQQHRPRTSFFQN

SEQ ID NO: 139250 - protein, 189 aa, Heterodera glycines
  Coding regions on vcDNA: vcDNA=SeqID_65673; Strand=+; Position=1 -125,187-631
MDTREVEGRLFEIKLIREGKMGEVIRETQADVAIVFDKGLEKMGKEAGGHNAKQQIFRKMNPLQIKFTDTKVGHRTKFLLFFLRLYRKMIGQIGAPYQGSAELYAVTVGTAGPKMDIKLGRSKTKLAYLKQIKEKVKRTDREALLILMSMAKDEIMAYFGGYLNINAFKQHKLVNKILMLGNSEKYFPN

SEQ ID NO: 139251 - protein, 30 aa, Heterodera glycines; identical to SEQ ID NO: 126994
  Coding regions on vcDNA: vcDNA=SeqID_65674; Strand=+; Position=1-197

SEQ ID NO: 139252 - protein, 103 aa, Heterodera glycines
  Coding regions on vcDNA: vcDNA=SeqID_65675; Strand=+; Position=1 -120,800-991
MACDVASKNAKLLSGRVLQKSNGPPKTLCDNVLSSVPIPTKLVDPLAYVGMLAKRALGSALKISETPTKCGGRPSDGLFCSSFWEDFFSSVKTVSAFVGFTKQ

SEQ ID NO: 139253 - protein, 17 aa, Heterodera glycines
  Coding regions on vcDNA: vcDNA=SeqID_65676; Strand=+; Position=1-53
MLKNQLAAIPPKKEHFQ

SEQ ID NO: 139254 - protein, 248 aa, Heterodera glycines
  Coding regions on vcDNA: vcDNA=SeqID_65677; Strand=+; Position=1-747
  Homolog annotation: Hit_ID=CAB55954.1; Match level="QueryCoverage =97%, HitCoverage=91%, E-value=3e-44, Identity=48%"; Hit description =hypothetical protein [Homo sapiens]
RSYSNRLMATPNRHRLTATPNRHRLTATPNRHRLTATPNRHRLTATPNRHRLTATPNRHRLMVTPGRHRLTATPGRHRLTATPSRHRLTATPSRHRLTATPSRHRLTATPSRHRLTATPSRHRLTAKPGRHRLMATPSRHRLTVTPSRHRLTAKPSRHRLTATPSRHQLTVTPSRHRLTAKPSRHRLTATPSRHRLTATPSRHRLTATPSRHRLAATPSRHQLTVTPSRHRLTAKPSASANGTPSRHR

SEQ ID NO: 139255 - protein, 113 aa, Heterodera glycines
  Coding regions on vcDNA: vcDNA=SeqID_65678; Strand=+; Position=1 -42,83-382
MCQKRDGGEHSKMKKKPEDAHFLLLPPSDFGVGKHDNESAKKNKMDKERMDNRAKTFAKEQKPKNTKKRANEWDAEKANKATNKLMRKMAEEKTKMANAMLYPTKGKKDAMYR

SEQ ID NO: 139256 - protein, 57 aa, Heterodera glycines
  Coding regions on vcDNA: vcDNA=SeqID_65679; Strand=-; Position=1-172
QHTMELERIISKSGKVYEQLDAAFSRNNMPRKSIKQHQESCKHGLSPVFEKFETGTS

SEQ ID NO: 139257 - protein, 172 aa, Heterodera glycines
  Coding regions on vcDNA: vcDNA=SeqID_65680; Strand=-; Position=1 -50,99-246,292-388,442-665
MFFIGIDRMIGIIFGEMHSKCKIRLYLATITIICCTFSLGSCLTFYQNIELNGDQMITGTYADFFMGSSQYSLICLFLIVITIFIYLFVGLIIRIKSAGLPSADQINYRTFRSLCCIIAVNIGGYFICLFFLTLIKPLIPSPITAWFAHFLTSIPMNIGAASNAPILYVTRY

SEQ ID NO: 139258 - protein, 70 aa, Heterodera glycines
  Coding regions on vcDNA: vcDNA=SeqID_65681; Strand=-; Position=1 -30,83-265
MNDNSTNNNTFYLAFKDVHPSWSLIGCALIFGIIAVIGIIFNSSVIGVTFLTKCVKLISIKSWKSIINYF

SEQ ID NO: 139259 - protein, 125 aa, Heterodera glycines
  Coding regions on vcDNA: vcDNA=SeqID_65682; Strand=-; Position=1 -56,116-211,470-697
  Homolog annotation: Hit_ID=NP_509285.2; Match level="QueryCoverage =92%, HitCoverage=32%, E-value=1e-28, Identity=52%"; Hit description =cytidylyltransferase (XI199) [Caenorhabditis elegans] gb|AAA68722.2| Hypothetical protein F08C6.2 [Caenor
NGDEDTKKYKGKTVTNETERYEGVRHCRYVDEILPNSPWYVSVDFLKRYKIDFIAHDALPYSAKDEEDLYEKFRRADMFVVSLKRGDYDWVGKEDIIRYDNGLPQNFAIEILKKELNNSSFFEIF

SEQ ID NO: 139260 - protein, 73 aa, Heterodera glycines
  Coding regions on vcDNA: vcDNA=SeqID_65683; Strand=-; Position=1-228
GGRCAIDLLFLREFLNLYSIPEKWLSLFLMKFITSQKRLRMRRRAVHNRHFISQRIFIFRGYPRKMAISFFDK

SEQ ID NO: 139261 - protein, 90 aa, Heterodera glycines
  Coding regions on vcDNA: vcDNA=SeqID_65684; Strand=+; Position=1 -169,387-488
WQKVLNEEEEAEGTQPGTEPTNQYIQTTFIHRDANSWRENRTHKNEQPMPPQMMTASVPVPLCIALNACGIGTPAEAERAQWHGLKLPFW

SEQ ID NO: 139262 - protein, 30 aa, Heterodera glycines; identical to SEQ ID NO: 126994
  Coding regions on vcDNA: vcDNA=SeqID_65685; Strand=-; Position=1-198

SEQ ID NO: 139263 - protein, 49 aa, Heterodera glycines
  Coding regions on vcDNA: vcDNA=SeqID_65686; Strand=+; Position=1-358
KSLKFFQRRLSAPPDPSPYYPNFLIFFGNARRKKGCNCPKKKIKNCIIT

SEQ ID NO: 139264 - protein, 55 aa, Heterodera glycines
  Coding regions on vcDNA: vcDNA=SeqID_65687; Strand=-; Position=1 -156,460-471
MGAQKKKYRDADARILRLVQRYNDINNNIALKMITIMPMPMSIPKTLTIFSLNLY

SEQ ID NO: 139265 - protein, 65 aa, Heterodera glycines
  Coding regions on vcDNA: vcDNA=SeqID_65688; Strand=-; Position=1 -132,252-317
MTTTDEKQLQVVVAGNEKKQNKKSEVVAANEKKQIKKSEVDFPVGCFEALSTNPDTISANSVSLT

SEQ ID NO: 139266 - protein, 48 aa, Heterodera glycines
  Coding regions on vcDNA: vcDNA=SeqID_65689; Strand=-; Position=1 -45,294-395
MAQFPKSLFRCSFSQSVNYIIVKMTFKAMSRTRRVFLPSYCDKYMAIA

SEQ ID NO: 139267 - protein, 25 aa, Heterodera glycines
  Coding regions on vcDNA: vcDNA=SeqID_65690; Strand=+; Position=1-76
REKKIMFFSGTLYLLVHISFFRTVC

SEQ ID NO: 139268 - protein, 40 aa, Heterodera glycines
  Coding regions on vcDNA: vcDNA=SeqID_65691; Strand=-; Position=1 -30,93-185
MLQAPTAPIDASKFVAYVHERRKKRILFKGEFLVNFYLFF

SEQ ID NO: 139269 - protein, 177 aa, Heterodera glycines
  Coding regions on vcDNA: vcDNA=SeqID_65692; Strand=-; Position=1 -50,96-198,240-402,445-536,578-703
  Homolog annotation: Hit_ID=NP_502882.1; Match level="QueryCoverage =68%, HitCoverage=22%, E-value=6e-18, Identity=40%"; Hit description =DNA polymerase like family member (4Q408) [Caenorhabditis elegans] emb|CAB60306.1| Hypothetical protein Y
MSTSKRGTITRTVFRDSYKLIPIKLASFVKTFGLSIEGVENKKYFPHGFNKAENYGNVLDNLPPIESYHPGSMLPDDRKALESWYAENRETRFDLREVIADYCKTDVQILAHGLIKMRELFTQKTGADITDSITIPSACMRFFVTLAIWEMNALLSFPTWDTRSEGSKAPLRGNISR

SEQ ID NO: 139270 - protein, 95 aa, Heterodera glycines
  Coding regions on vcDNA: vcDNA=SeqID_65693; Strand=+; Position=1 -154,250-383
MDDRSDAFIRPTAEAQRRKIAAPMPSAVMGCRHVNGQLNLANYCDDFWPLNVFRSIAFEVSNRKEKKGKGQLSSEEFFTDLLIFTHFPCFCPFTA

SEQ ID NO: 139271 - protein, 29 aa, Heterodera glycines
  Coding regions on vcDNA: vcDNA=SeqID_65694; Strand=-; Position=1-88
MTSSPSAIAPAFHPLIHPPPSEAGRKITQ

SEQ ID NO: 139272 - protein, 26 aa, Heterodera glycines
  Coding regions on vcDNA: vcDNA=SeqID_65695; Strand=-; Position=1-80
SSSYGPLIQTRYRMLVTNLSSRCSWQ

SEQ ID NO: 139273 - protein, 767 aa, Heterodera glycines
  Coding regions on vcDNA: vcDNA=SeqID_65696; Strand=-; Position=1 -63,123-212,267-347,404-752,1702-1943,1987-3043,3085-3278,3686-3913
  Homolog annotation: Hit_ID=NP_507780.1; Match level="QueryCoverage =49%, HitCoverage=30%, E-value=5e-45, Identity=28%"; Hit description =predicted CDS, DNA polymerase type B, organellar and viral family member (5T899) [Caenorhabditis elegans]
MQQPVPMRAVPQFLHPPPNAPEIGVGPIHDGQQPLPLRALPQFAQPPPNVPAVRVQPIQQPIPLRDVPLFVNPPPNVPIIHVQPMPQPLPLRDMPQIHHSPRNVTSIWIKLWLLFLSLWVFLQGIHVRQIQREYAVPQFAHPPPNVPYHPPENVPVMLGLVSHISGCFSASATTATTAPAERRATIRPPAAKRTGLFYALEIARTYQLIGKSITENKFRYLMKTEKKQREMAMELMEKAGISTDDKTFGTQHLEAVQKYWDREFPDMFRIVAFEMKTGLRPIFKGEGVRKNEVGVIREGDHWDGIKSASWFFGVRYFCVSCEVTYDRPERHRMECKERCKKCCRMGFGFPCTDVCDEIHCGECNLKFYNPECFEAHKKAACNEYKKCDKCGEVYQTRSKHVCGEKFCKLCKVCHPGRQCFIKKIQVRPQKAYRIVAYDLETTVDGGEHRPNLVSAARTCNICAGEERECEICEGPSKITWSVADGFDPMSEFVVWIMGFQRFETIAFAHYAGRFDSHFVLSELTKKEIATELMMADLKIYQIKAGRVYFRDFWMLSQNKLADLPKTLGLKTAAKLYFPHKYNKNENFGKRLSNLPPLEDYCPDNMKEEEAVKLEAWHNENFQKEFELGEQLKTYCENDVEILMESILKFRRLFLGITGDLDVMKDSVTIAGVVMKIYRAKFLKDRHIPIMPEECDVKEELKKNKEMKKFFESVPDKGPINPRDAYAGGRTMPFCLYAKTTEEIEISMFDIISLYPLLIMVKICLLFC

SEQ ID NO: 139274 - protein, 83 aa, Heterodera glycines
  Coding regions on vcDNA: vcDNA=SeqID_65697; Strand=+; Position=1-303
TFIFEGIFKFILYPRKMSISFFEKFYTSQKRLRMRRRAVHNRHFISQRIFIFRGYPRKMAISFFDKFYTHTNALEHDREGGAQ

SEQ ID NO: 139275 - protein, 88 aa, Heterodera glycines; identical to SEQ ID NO: 124691
  Coding regions on vcDNA: vcDNA=SeqID_65698; Strand=+; Position=1 -96,135-305

SEQ ID NO: 139276 - protein, 287 aa, Heterodera glycines
  Coding regions on vcDNA: vcDNA=SeqID_65699; Strand=-; Position=1 -490,549-919
MQIGYGRAPAAAAAAGNSQRNNNNNKDDSGGGGGGGSGNDRRSEAENNASNPEADDDDEKGGATADQLYEEKQHYVHRLERFALQRHVTEFVLNGQHERPDEALRDAFERIIKRAIRNAEQQQQQNEQQSRNQEEEQPQDGGGAAQQNPRRRVTKIGIFLDGNGLTDPIVLPIRPPEQNTADTLMGELEKLGQSDGDEDVHGGGMSKRSLLLSEPVQIVITCIAPPVGAAPRFHHYQHWGYNERQLIRIRNVGDHFCLFHALIAARSYTDHDLTKMIATQQQCQQGD

SEQ ID NO: 139277 - protein, 47 aa, Heterodera glycines
  Coding regions on vcDNA: vcDNA=SeqID_65700; Strand=+; Position=1-141
MADTSALYNTSDIGERKWLLDLLMEESDPDSGGEEHITEQDLKEIVK

SEQ ID NO: 139278 - protein, 103 aa, Heterodera glycines
  Coding regions on vcDNA: vcDNA=SeqID_65701; Strand=+; Position=1 -177,431-565
  Homolog annotation: Hit_ID=CAA27814.1; Match level="QueryCoverage =92%, HitCoverage=59%, E-value=2e-47, Identity=95%"; Hit description =cal-1 [Caenorhabditis elegans] pir||A24921 calmodulin-like protein - Caenorhabditis elegans sp|P04630|CALL
MASKKPQELGVAMRSLGQNPTEQEILEMINEVDIDGNGQIEFPEFCVMMKRMMKETDSEMIREAFRVFDKDGNGVITAQEFRYFMVHMGMQFSEQEVDEMVGI

SEQ ID NO: 139279 - protein, 436 aa, Heterodera glycines
  misc_feature (20)..(20): Xaa can be any naturally occurring amino acid
  misc_feature (32)..(32): Xaa can be any naturally occurring amino acid
  Coding regions on vcDNA: vcDNA=SeqID_65702; Strand=-; Position=1 -103,373-401,453-485,562-630,686-746,804-909,1021-1279,1554-1663,2057- 2227,2272-2343,2586-2736
  Homolog annotation: Hit_ID=CAE75508.1; Match level="QueryCoverage =96%, HitCoverage=96%, E-value=1e-114, Identity=51%"; Hit description= Hypothetical protein CBG23519 [Caenorhabditis briggsae]
MVTIRRDVSIFAPYTAHERXFIVIGEREYLNXLGVKNELKLTEEDVQIVNEKGNKDVQIVNEKGNKVYFIRAPGNYSISFKRINVLNNLAHLSGELGITLQVPILAHLSGELGITLQVPILEGPAGIRFDVPYTMVPETGLLIRFDVPYTMVPETGLLNQQCDEFSGIVERDKRQYCRYCDLCGLTDQIENRLTRTDSDGHRFLPASGEEAPFSPRCEKIDARTYEFRRTINLPGRRELEQKARQKISGVDAEIRKRLNKGRGRFQVFLNLISADQPPITQKAWFDGSEQCRCCGRDKDPNCRSVLSFLYCNVEDCKSAYAQQCLHNSARIVACYTVEFNYRMTTRRDEVQMFLRENNYPDQENNYPDQDAPGTAPPSPATISANEPYPMSLLSFHPHTVPLFQVSQMETRLTHLRRYCTIFWNEKLCCSHCPGIC

SEQ ID NO: 139280 - protein, 75 aa, Heterodera glycines
  Coding regions on vcDNA: vcDNA=SeqID_65703; Strand=+; Position=1-228
MAAPKWPRQNGRAKMDAPKWTRQNGRAKMAAPKKLAPKKLAPKKLAPKWADCEISTKKSRDDCEINRDITKKRTN

SEQ ID NO: 139281 - protein, 84 aa, Heterodera glycines
  Coding regions on vcDNA: vcDNA=SeqID_65704; Strand=+; Position=1 -31,131-354
MSSNANEQSDEIFATITIHDHHQKQRNEQRQIDIRLMRAEEVQACAEIIRDAYLGSTAQTRDGMEFRLPVSGIFGVRIPISEKF

SEQ ID NO: 139282 - protein, 437 aa, Heterodera glycines
  Coding regions on vcDNA: vcDNA=SeqID_65705; Strand=+; Position=1-1312
MTEHNFEQIRRTNSSIIHEGNVQFANEMDENEIRRRLLKVMMRQDGSADLARHGNQNIGHGENERPLFDEAQRPAIPRRTPPNPHSLMQSGNQIHQRHNSQNIATINHRPNGFEDNERPVPNPGLIFDGMMAQAIRSMDGFSYTMTLNTIPNLDGSRGSDSVNAFFKQFDIANEEWPEQKRVRALRSKCFGKAERAFNSAVAENRHDYQLIRTSIIRQLDDTDAKQLTAFDQLIKGVWLRPNEGIDQLGERVSRLVRCAYPGLSEQLYDEYSAMHFIRALPNSELAMTLEMTRKPGATFDEFIAQAARAEAVQNAARNSWRNSQNNGCFQNQRRHIVCYNSGRVGHTSRNCYSQPTHQTHQFSKNCNLRSTPPPLLNQQNDEPPKKGNLLVGAINLEHRPEIEKFFGKATNESDKGRFLEESPAAGKILATKVSGVG

SEQ ID NO: 139283 - protein, 124 aa, Heterodera glycines
  Coding regions on vcDNA: vcDNA=SeqID_65706; Strand=+; Position=1 -134,190-337,386-478
DHLAHKQNEQKELWVKVDELEQRQTADSEQWNTAKEGILVKIDERSSQTGSGTGFSGIRSGDFLEIGIDWIMRDRIRNPVVFENTSPVWSDRFAVASSGVKASETADRTQRTDGESGRDGKGKK

SEQ ID NO: 139284 - protein, 19 aa, Heterodera glycines
  Coding regions on vcDNA: vcDNA=SeqID_65707; Strand=+; Position=1-60
EPVNSCIGCKCRRCCTPNS

SEQ ID NO: 139285 - protein, 195 aa, Heterodera glycines
  Coding regions on vcDNA: vcDNA=SeqID_65708; Strand=+; Position=1 -131,177-424,471-576,619-721
  Homolog annotation: Hit_ID=NP_001004509.1; Match level="QueryCoverage= 84%, HitCoverage=11%, E-value=4e-10, Identity=28%"; Hit description =si:busm1-180o5.3 [Danio rerio] emb|CAD60788.1| novel protein similar to DNA polymerases [Danio rerio]
MRDNGWTLRHVESPGGEYKHGNFLLDGMLERIGEDKNLAIEVNGCYWHACPHCFPEDDAIVGGGETAGAIRARDEKRIRQIARDFEVEIVWECQLGRMLEVDPPMKAFFDNTPDSGPIDFHDAFFGGRTGPEWLGASIIPDKEGQAGRTIKVKDFNSLYPSRNMFTNYPVGHPKVIQMDKGRHWTAKDTLWTTTA

SEQ ID NO: 139286 - protein, 146 aa, Heterodera glycines
  Coding regions on vcDNA: vcDNA=SeqID_65709; Strand=+; Position=1 -148,211-285,435-546,1381-1486
MPPQSKERHHEVNIDDANVHRKYMLMRGTGHYNLFYYNCKHWAEEFVINILAKTRNKDEKCGCLQFHFRAKSIEAHRNSRDYVNLVRFECTNCRRENMIISILYTEVGKGTRYGVLVMIQAELWGPISNSNWPVADEGHLIMLCFL

SEQ ID NO: 139287 - protein, 53 aa, Heterodera glycines
  Coding regions on vcDNA: vcDNA=SeqID_65710; Strand=+; Position=1-159
MHMVSLLLISTIPMLLLIVFTAVIGARVIDGTTAMDLLAGDSELKQSQSKQFA

SEQ ID NO: 139288 - protein, 92 aa, Heterodera glycines; identical to SEQ ID NO: 129555
  Coding regions on vcDNA: vcDNA=SeqID_65711; Strand=-; Position=1-304

SEQ ID NO: 139289 - protein, 85 aa, Heterodera glycines
  Coding regions on vcDNA: vcDNA=SeqID_65712; Strand=-; Position=1-287
MIGRAVRNRPFIFEGIFKFILYPRKMAISFFEKFYTSQKRLRMRRRAVHNRHFISQRIFIFRGYPRKMAISFFDKILYTYKCSRA

SEQ ID NO: 139290 - protein, 358 aa, Heterodera glycines
  Coding regions on vcDNA: vcDNA=SeqID_65713; Strand=+; Position=1 -55,283-459,526-639,722-900,958-1139,1240-1493
  Homolog annotation: Hit_ID=CAE65983.1; Match level="QueryCoverage =98%, HitCoverage=63%, E-value=2e-50, Identity=37%"; Hit description =Hypothetical protein CBG11172 [Caenorhabditis briggsae]
QIGICSVFYVFCANHIKEIFKFVDFEFPSFTYPKYIWMFSIFVPMVLITFVRSLRAIAVLSSIGNVFCIAALTFIFQYLFRAKHQNLSDFPSNTYLFRAKHQNLSDFPSNTNFDGVMAACGAVLYSYEGQAMVLPLENRLKKPVLPLENRLKKPSQMVGFFGILSVGMTVVTAVYSASGVLGYITYGSQVKGSITQNLPQNEIFVIVRLLFTLVMFVIVRLLFTLVMFFGFAIQMYVVVEMLWPEFVKFLRNSNFGVNNENDHKNMVGIELLFLLIGLAVPELENIIPLVGATAGMLLALIFPALLDLLVFLPIHLQRHRIRQTFWLLLDNWTLVTIGVFGLIAGLRANLRNIFTPAE

SEQ ID NO: 139291 - protein, 55 aa, Heterodera glycines
  Coding regions on vcDNA: vcDNA=SeqID_65714; Strand=+; Position=1 -54,684-797
MGQEKGQNMFRPRDILADICKQNSAGHYNCQCGEGATFVDGKCQIVAACQVNEQN

SEQ ID NO: 139292 - protein, 94 aa, Heterodera glycines
  Coding regions on vcDNA: vcDNA=SeqID_65715; Strand=-; Position=1 -40,372-616
MMLYSSPKTEKYHCKNFYFDGFLNNLIQKTQKTAEKRQKQSKEWDDGEKMEIIKKYDEMIQEYKDKKGFGGESKIKIECAIAKQLGTSRAMVFE

SEQ ID NO: 139293 - protein, 57 aa, Heterodera glycines
  Coding regions on vcDNA: vcDNA=SeqID_65716; Strand=-; Position=1-176
VNPKKNGQCQRQTAPFDVRFDGVENGENELVQIRLRHRRRRTTALLHAFVVLFACLN

SEQ ID NO: 139294 - protein, 95 aa, Heterodera glycines
  Coding regions on vcDNA: vcDNA=SeqID_65717; Strand=-; Position=1-814
ENKKIDFFSVCWGLIHYGSKNPTQIKVQAIGSYPGGFGLPINLGASVRGDCPENKKIDFFKCPFGVLKQLWGAKIQRRIKVQAIGKLLPKDSVSP

SEQ ID NO: 139295 - protein, 101 aa, Heterodera glycines
  Coding regions on vcDNA: vcDNA=SeqID_65718; Strand=-; Position=1-306
MSEYEVVVEYLPDKKFGKKYIMVKRTDILATLKHKIREAYTKAYPTKMPFSIVQLVKKFKCAEKCGQEMRVEDVEQWYDDADAEKTMDKCGIGEGSIVFMF

SEQ ID NO: 139296 - protein, 109 aa, Heterodera glycines
  Coding regions on vcDNA: vcDNA=SeqID_65719; Strand=+; Position=1 -216,359-472
MPLPVPHFSELKSAKECVGGFGIWLFQFAGLEKNRENFPKPGGWVGYMVYQMYYGQKCVSEHFIGKHGAVRQGFSLPVDKVGTTRQFCHSLIGHGIGQTVRHFFAEFRL

SEQ ID NO: 139297 - protein, 229 aa, Heterodera glycines
  Coding regions on vcDNA: vcDNA=SeqID_65720; Strand=-; Position=1-690
  Homolog annotation: Hit_ID=CAH99049.1; Match level="QueryCoverage =95%, HitCoverage=60%, E-value=7e-27, Identity=27%"; Hit description =conserved hypothetical protein [Plasmodium berghei]
MSVRKCRSANVGPQKSVRKCRSAKVGPQMSVRKSRSANVGPQKVGPQMSVRKSRSAKVGPQMSVRKSRSAKVGPQMSVRKSRSAKVGPQMSVRKSRSAKVGPQMSVRKSRSAKVGPQMSVRKSRSAKVGPQKSVRKCRSAKVGPQKSVRKSRSAKVGPQKSVRKSRSAKVGPQKSVRKSRSAKVGPQKSVRKSRSAKVGPQMSVRKSRSAKVGPQMSANHFEFSFFKMF

SEQ ID NO: 139298 - protein, 121 aa, Heterodera glycines
  Coding regions on vcDNA: vcDNA=SeqID_65721; Strand=-; Position=1-363
MDLLFRLYAKDKDTQPIWNAFAAEIWPIFAPNIRHLKFNGDLENLRRHISPTILSDLNQLNSINSDTLGPTAIGDDGPNATDGQALSKWLHTPTKDGQPKQLSFWHFSECGTTKLLNDFKE

SEQ ID NO: 139299 - protein, 49 aa, Heterodera glycines; identical to SEQ ID NO: 130195
  Coding regions on vcDNA: vcDNA=SeqID_65722; Strand=+; Position=1 -110,199-238

SEQ ID NO: 139300 - protein, 38 aa, Heterodera glycines; identical to SEQ ID NO: 129423
  Coding regions on vcDNA: vcDNA=SeqID_65723; Strand=-; Position=1-273

SEQ ID NO: 139301 - protein, 126 aa, Heterodera glycines
  Coding regions on vcDNA: vcDNA=SeqID_65724; Strand=+; Position=1 -195,731-917
  Homolog annotation: Hit_ID=NP_492514.1; Match level="QueryCoverage =79%, HitCoverage=32%, E-value=1e-43, Identity=84%"; Hit description =DNA-dependent protein kinase catalytic -interacting (1K48) [Caenorhabditis elegans] emb|CAB03019.1| Hypot
NELNYNLNIGFLLKDCTFFTKKDILRLYKRFHALNPEKVPGNMQGNQASIVKLTFEEVGKIPELKENPFSRRICEVFSEDGCGNLTFDDFLDMFSVFSEMAPLQLKLKYAFRILRFCLWHVFCDFQ

SEQ ID NO: 139302 - protein, 142 aa, Heterodera glycines
  Coding regions on vcDNA: vcDNA=SeqID_65725; Strand=-; Position=1 -242,882-939,1119-1247
MPGAPSDVLWFFDAEEQKINPRWDSNPRPQLSVLCSNQLATQASSPLLSSLSYLRRRITLLISFTAVLAQGERVTAFITIGFIFLQFIAKPLTSLTLNMKKFPLLSMCQVDDGDFGMALLYPKLVSSARHFGANWRRSSGFW

SEQ ID NO: 139303 - protein, 97 aa, Heterodera glycines
  Coding regions on vcDNA: vcDNA=SeqID_65726; Strand=+; Position=1 -84,176-312,1164-1236
MEQYGWPQFAGEEEKIRQAVQFPNKKHVDLKTAKQITFGTKKWTENENNWSNMIEQNGELERARSVVQLVEQQWHTVFLPTKNRHRHMLYNSDAIHF

SEQ ID NO: 139304 - protein, 87 aa, Heterodera glycines
  Coding regions on vcDNA: vcDNA=SeqID_65727; Strand=+; Position=1 -3,599-734,1391-1448,1497-1563
MASLLSLAKVFPSVAPFGYFIDFYFDNLALLELARRTVDQSNDSYYRLAGSAIVEAPHVENGTITKWDVVYAPKRRFAVDMAGFAVK

SEQ ID NO: 139305 - protein, 93 aa, Heterodera glycines
  Coding regions on vcDNA: vcDNA=SeqID_65728; Strand=-; Position=1-282
MCQNMLLILFVLLLLHCVSVVRLDLRLRLPIALEQWEIGHWHESNWLISREQIGQWQKQGEITLSIFGSQSLQRIARVRQKGAQRKRTERAEK

SEQ ID NO: 139306 - protein, 74 aa, Heterodera glycines
  Coding regions on vcDNA: vcDNA=SeqID_65729; Strand=+; Position=1 -149,445-520
MPMPLVRLAFPRSVFLLALFCRFASAEFRPHFSQWLAQRFGEDVRNNLESNHGYTFSELYGTTYANGDQGNPLQ

SEQ ID NO: 139307 - protein, 120 aa, Heterodera glycines
  Coding regions on vcDNA: vcDNA=SeqID_65730; Strand=+; Position=1-363
MIHSFVGLFLCPFSSFSLCSLLPDACNSLEALASKYAESDFPLLLPLSDLFPTDQPIALVPMANFPLLEGYWKAQAQIQADDGNAMEEEEDEQNEQHILTHFGTENWHFVSLGNDLHEDL

SEQ ID NO: 139308 - protein, 58 aa, Heterodera glycines
  Coding regions on vcDNA: vcDNA=SeqID_65731; Strand=-; Position=1 -48,102-230
MTVIAFILPWVQAKANKMKYRKMSKKFMRHERELARLRFECRMCGGLEDSSGTIACFK

SEQ ID NO: 139309 - protein, 65 aa, Heterodera glycines
  Coding regions on vcDNA: vcDNA=SeqID_65732; Strand=-; Position=1 -147,321-371
MSLFKKSGQNLVGYLQIRTNLTNQDTFILSDLNPPNQDKSDKSGQIAPLSPIINFDNFGEENAKL

SEQ ID NO: 139310 - protein, 60 aa, Heterodera glycines
  Coding regions on vcDNA: vcDNA=SeqID_65733; Strand=-; Position=1 -70,205-317
MRNWWREWIPDENSSRIRGPTWRKSWYKSGSVYTKVSTKRATHVLRKCDQFQIIMINNMN

SEQ ID NO: 139311 - protein, 79 aa, Heterodera glycines
  Coding regions on vcDNA: vcDNA=SeqID_65734; Strand=+; Position=1-279
CFNNQIRSNKHQNNNNNQTTIFCCSVIHQQIHNFFNCVNPCIANCAKKKKNLRTDHNFAFYLAAFVSKMLSPDQLPDEV

SEQ ID NO: 139312 - protein, 118 aa, Heterodera glycines
  Coding regions on vcDNA: vcDNA=SeqID_65735; Strand=+; Position=1 -104,270-425,866-959
  Homolog annotation: Hit_ID=NP_500088.1; Match level="QueryCoverage =91%, HitCoverage=23%, E-value=5e-38, Identity=66%"; Hit description =hexokinase (50.1 kD) (4C273) [Caenorhabditis elegans] gb|AAF36071.1| Hypothetical protein Y77E11A.1 [Caen
MVINYCKMIKGELADVLTSFDHEIDQASVHRGKQIIDKLTGALYLGELIRRILAQLVMDRLLFSGTLVEALDRPDTFPTKYISEILGDNSGVFKNCRRICDELEVPSHGSNDYLIMRE

SEQ ID NO: 139313 - protein, 112 aa, Heterodera glycines
  Coding regions on vcDNA: vcDNA=SeqID_65736; Strand=+; Position=1 -320,361-554
SLVKLPKQFFSCLSPFFATETNGRQLTTKNCRKCAKEILWSFFLLRRRFWVISFSRGAPGTTERKGSRGKGGQCQRGKVGKWTCRAVTRREFNSRNIYCICFCYHPFCNYFF

SEQ ID NO: 139314 - protein, 53 aa, Heterodera glycines
  Coding regions on vcDNA: vcDNA=SeqID_65737; Strand=+; Position=1-243
SAASNCTRRKWSFVWSIFASGLLHVVLLTPPHSPPPPTIYLIIIITIVFLSHS

SEQ ID NO: 139315 - protein, 70 aa, Heterodera glycines
  Coding regions on vcDNA: vcDNA=SeqID_65738; Strand=-; Position=1-213
MRAFVSHCGFNSVNEAVQFGVPILAIPLLGDQLYNAIMARVKGIAVQLDIGQLNREGAEQLLVDGLDKAN

SEQ ID NO: 139316 - protein, 21 aa, Heterodera glycines
  Coding regions on vcDNA: vcDNA=SeqID_65739; Strand=+; Position=1-65
MAISFFSWGFDRKLGTNICLL

SEQ ID NO: 139317 - protein, 19 aa, Heterodera glycines
  Coding regions on vcDNA: vcDNA=SeqID_65740; Strand=+; Position=1-59
TFSFSSLALPNTHTIFEML

SEQ ID NO: 139318 - protein, 19 aa, Heterodera glycines
  Coding regions on vcDNA: vcDNA=SeqID_65741; Strand=+; Position=1-59
TFAFSSLALPNTHTIFEML

SEQ ID NO: 139319 - protein, 19 aa, Heterodera glycines
  Coding regions on vcDNA: vcDNA=SeqID_65742; Strand=+; Position=1-59
TFAFSSLALPNTHTIFEML

SEQ ID NO: 139320 - protein, 19 aa, Heterodera glycines
  Coding regions on vcDNA: vcDNA=SeqID_65743; Strand=+; Position=1-59
TFAFSSLALPNTHTIFEML

SEQ ID NO: 139321 - protein, 19 aa, Heterodera glycines
  Coding regions on vcDNA: vcDNA=SeqID_65744; Strand=+; Position=1-59
TFSFSSLALPNTHTIFEML

SEQ ID NO: 139322 - protein, 19 aa, Heterodera glycines
  Coding regions on vcDNA: vcDNA=SeqID_65745; Strand=+; Position=1-59
TFAFSSLALPNTHTIFEML

SEQ ID NO: 139323 - protein, 43 aa, Heterodera glycines
  Coding regions on vcDNA: vcDNA=SeqID_65746; Strand=+; Position=1-130
MQFLFTKITIFIFVSVAFCAKDSKKAGELAVALFKFIYNNEKL

SEQ ID NO: 139324 - protein, 45 aa, Heterodera glycines
  Coding regions on vcDNA: vcDNA=SeqID_65747; Strand=+; Position=1 -52,369-454
MTKFCAVPLLTANGGGNDFKLQVDTKNGGYGLGNRIFIVWTHKMN

SEQ ID NO: 139325 - protein, 59 aa, Heterodera glycines
  Coding regions on vcDNA: vcDNA=SeqID_65748; Strand=-; Position=1-179
RPAFASTPIGWALQMTKFCAVPLLTANGGGNGEAFECDDEQQNLAAAAGDNGVKNLVAV

SEQ ID NO: 139326 - protein, 121 aa, Heterodera glycines
  Coding regions on vcDNA: vcDNA=SeqID_65749; Strand=+; Position=1 -107,149-405
MADEIQQKIVQGIGPDFFSVTSDGWSQITKSPALLSVTVHHINQQFVRADFVLDVIPMTNHTGADIAEEIGNALRTNGLNPEKIICLVRDNAKNMIRATNICLSWQDSFPKFGLGVLFFVQ

SEQ ID NO: 139327 - protein, 77 aa, Heterodera glycines
  Coding regions on vcDNA: vcDNA=SeqID_65750; Strand=-; Position=1-231
MEILLEVILGSSVEEMTEVLKVYSKQYGGNLSEDIQKIGEKAQGKNSKGKNDTEEAKAVREILGDRLQNLKERAAIK

SEQ ID NO: 139328 - protein, 63 aa, Heterodera glycines
  Coding regions on vcDNA: vcDNA=SeqID_65751; Strand=-; Position=1 -102,216-267,650-687
MKIEKSLIYTESYVAGLSSVGVRNIGRATVKLGNPIQTNWSARLTKTHPKKGSMAFIFVSEYL

SEQ ID NO: 139329 - protein, 33 aa, Heterodera glycines
  Coding regions on vcDNA: vcDNA=SeqID_65752; Strand=-; Position=1-128
MARKDFRFPTFLGSEFRLPKFLMKSRKFFNFFF

SEQ ID NO: 139330 - protein, 20 aa, Heterodera glycines
  Coding regions on vcDNA: vcDNA=SeqID_65753; Strand=+; Position=1-61
MSQSFRRRREGETFDGPTEN

SEQ ID NO: 139331 - protein, 60 aa, Heterodera glycines
  Coding regions on vcDNA: vcDNA=SeqID_65754; Strand=-; Position=1 -112,238-308
MNVNKEEERLEKKVTKWAIMLTSEDKVSMGIPQYGILEKVLTWNRNSAILPGPFCNITGF

SEQ ID NO: 139332 - protein, 42 aa, Heterodera glycines; identical to SEQ ID NO: 128558
  Coding regions on vcDNA: vcDNA=SeqID_65755; Strand=+; Position=1-126

SEQ ID NO: 139333 - protein, 187 aa, Heterodera glycines
  Coding regions on vcDNA: vcDNA=SeqID_65756; Strand=-; Position=1-564
MLTKPTTAKPQQQASQHRHPPSSTWLSNGQQQQQQHHQPPQQGTPPPPTAGRAAPGGKAAAGAENGNSRKTSANPALLPKMSTTSSTAAAAVPPGPKSSSSSSTAAAVAGGRPRPPPTQRTTSRDSASAAPDRKVSKQSSGSRGTARSAVVSKRPELRRAVLLANAEEHSHPDGLFKVVNQSESLIK

SEQ ID NO: 139334 - protein, 94 aa, Heterodera glycines
  misc_feature (94)..(94): Xaa can be any naturally occurring amino acid
  Coding regions on vcDNA: vcDNA=SeqID_65757; Strand=+; Position=1-316
FCVGFLLPHKCLSTSNGHLKKSIFLFSGQSPRARCAQIYGETESFRNSFPIACTIILRWIFAPHNCLSTPNGHLKKSIYFCFRGSPPEPMPPDX

SEQ ID NO: 139335 - protein, 104 aa, Heterodera glycines
  Coding regions on vcDNA: vcDNA=SeqID_65758; Strand=-; Position=1 -118,210-389,578-594
MEICEERQNDHQKIDQKFTGTICKTPFSAVDEGTETISNEQHIRNCKEKEEIVNKFRQMKREFAAAKDKRPYEEINREIAKELGVSIRTISLWQRELGVDDVTT

SEQ ID NO: 139336 - protein, 43 aa, Heterodera glycines
  Coding regions on vcDNA: vcDNA=SeqID_65759; Strand=-; Position=1-387
CFAVPRTGRQWIALNLQEIRLAICGCKKLLGNELFFEVSQTPY

SEQ ID NO: 139337 - protein, 296 aa, Heterodera glycines
  Coding regions on vcDNA: vcDNA=SeqID_65760; Strand=+; Position=1-891
  Homolog annotation: Hit_ID=NP_507780.1; Match level="QueryCoverage =72%, HitCoverage=13%, E-value=2e-13, Identity=29%"; Hit description =predicted CDS, DNA polymerase type B, organellar and viral family member (5T899) [Caenorhabditis elegans]
MRRRRRRRRGQQQQQQNNNNDDEDDDDNDGNEEGDDDHGHDADNEEEEEVGTNRSVRLCFFDAETSQDLPLQLRTKVVQKHVPMLIIAEIICEACINEGISVHSGVGQYANGCVCSPPAGPRGRRWCSPPFLNAPGDDSALPANVHYNPRRLFFHSFDDATNNDPVDDFINFLIGSGPHGVKTICLSHNGGKYDIHLILEALHRRNLPPKRICTTGLKIFSMTLKGNHQRHVIFKDSLNYFFCELDALPRTFGLNAEVATAKPFFPYLFIRRENLHQRLRGLPAKEFYQPDHMKAS

SEQ ID NO: 139338 - protein, 74 aa, Heterodera glycines
  Coding regions on vcDNA: vcDNA=SeqID_65761; Strand=+; Position=1-223
MQKAPRHEQIEHEQRMVRKGQQEANRHLQPKKRQQKEIQEVPHSTTEEQQRETKRQQIERQQNDEQRAINQQTR

SEQ ID NO: 139339 - protein, 18 aa, Heterodera glycines
  Coding regions on vcDNA: vcDNA=SeqID_65762; Strand=+; Position=1-56
YREAIPEGFGLPINLGAS

SEQ ID NO: 139340 - protein, 93 aa, Heterodera glycines
  Coding regions on vcDNA: vcDNA=SeqID_65763; Strand=+; Position=1-282
MSLPVPWLMKVFSVVANHSAVRQMSVGHVFGSIILQLATYASPTQVVLPMSRSVGCPMAIWPNDRFACHPSSDVWPFRSLQFEMKEGIALIYL

SEQ ID NO: 139341 - protein, 57 aa, Heterodera glycines
  Coding regions on vcDNA: vcDNA=SeqID_65764; Strand=-; Position=1 -71,324-426
MYTKNVKYNSFFGFYTIKREVAISSKYHEIMKNEFPCVKFLLCSNNHKPPVVVVSVS

SEQ ID NO: 139342 - protein, 42 aa, Heterodera glycines
  Coding regions on vcDNA: vcDNA=SeqID_65765; Strand=-; Position=1-127
TVGVNSVWPTPSQQCSKSYNFFLCWPNFTIMVSFESPRCLED

SEQ ID NO: 139343 - protein, 152 aa, Heterodera glycines
  Coding regions on vcDNA: vcDNA=SeqID_65766; Strand=+; Position=1 -162,474-767
MALLNSVTSVRCRTAEVSLAAIITLIIRVISLYSLNNHHSFVYLICQCQSVSALLQIRECRIGRIDEGALGGLFTVGSVQLQSNQIVRLSPGWSSGMDNVGKLVFTYNTVREPMVSPECLRHDGAQRFEFADNTLHCSCALQWMINAPEEEQ

SEQ ID NO: 139344 - protein, 284 aa, Heterodera glycines
  Coding regions on vcDNA: vcDNA=SeqID_65767; Strand=-; Position=1 -28,339-1188
  Homolog annotation: Hit_ID=NP_510671.1; Match level="QueryCoverage =95%, HitCoverage=28%, E-value=6e-59, Identity=46%"; Hit description =predicted CDS, endonuclease/exonuclease/phosphatase family and RNA -directed DNA polymerase (XR69) [Caenor
LYKLCKIDPQFNIIETQKLLRKLPNKNGTSPDNISYKTLKNCHPSLATVITDLFRISLDSGSLPDIWKESIVFPLFKKGDKFNPENYRPISITCSLCRVMERILSQNIYNFLLKNNKISEYQFGFVRNRSTTSQLNSCGRLDAIINGKNADCIYIDFQKAFDSVPHNLLLYKLEKIGIRGKLLMWIKSFLSNRTFRVKIGDALSSNKVGSGVPQGSVLGPLLFLIYINDLPDALPSGVKIKLYADDVKLYISDTEIMHKALHNLSEWANKCRKKSFSSKNLYYI

SEQ ID NO: 139345 - protein, 77 aa, Heterodera glycines
  Coding regions on vcDNA: vcDNA=SeqID_65768; Strand=+; Position=1-231
MAEFTENLEQKNRRGAKGFYVDPALELRFLSAGDRNFELIRRYRFPDEEIDFISSLVKDDLQPKHGNKGNPIPVKLQ

SEQ ID NO: 139346 - protein, 135 aa, Heterodera glycines
  Coding regions on vcDNA: vcDNA=SeqID_65769; Strand=+; Position=1-410
EKKKLEEKTFDEIFGEKWEQKEEENGNNQNKNEQKKREIIEKFNKIKEKIKQKGGKYSKNEWDKINSKIAKTLGTNRQYIYEWIKELRLYKWHNKLKTDEQKIECVQKFITMKNEYKQKGRKYSKKQWNKNYAEM

SEQ ID NO: 139347 - protein, 181 aa, Heterodera glycines
  Coding regions on vcDNA: vcDNA=SeqID_65770; Strand=+; Position=1-546
  Homolog annotation: Hit_ID=CAE69428.1; Match level="QueryCoverage =98%, HitCoverage=97%, E-value=2e-18, Identity=36%"; Hit description =Hypothetical protein CBG15596 [Caenorhabditis briggsae]
MTGGFTIVLFDSSYRGGDSSIGEGFGGVFCLGGGGGGFGTVFAGFSLDAGVVFTGEGCFTAGGGELGLTSGGGVFVLVVVVVVVVVGGEAVLDGGGEGGEAVLAGGGGEAVLAGGGGEAVLAGGGEGGEGVLAGGGEGGEGVLAGGGGEGVLAGGGETVLAGVGVVTDLAVGVGGATGAIG

SEQ ID NO: 139348 - protein, 255 aa, Heterodera glycines
  misc_feature (248)..(248): Xaa can be any naturally occurring amino acid
  Coding regions on vcDNA: vcDNA=SeqID_65771; Strand=+; Position=1 -147,262-342,394-599,729-869,928-1042
  Homolog annotation: Hit_ID=NP_505954.2; Match level="QueryCoverage =96%, HitCoverage=36%, E-value=4e-60, Identity=46%"; Hit description =neurotransmitter-gated ion-channel subunit family member (72.0 kD) (5M150) [Caenorhabditis elegans] emb|C
PLPSSVLEPILDRGNYDPRSAPAFVEGRPVEVRVGIHVQSIANFQLATMDYDMDMWLRMSWRDPRLAQNLSTPVLINDELFLRRIWRPDAFFVRIWRPDAFFVNARDALFHRVTRLNFYAFVFPSGEVFMEARLYLKPSQLVLCKYPHDSQTLRLRISSIASTYGSVRFRWFSAPSNAIRVHGQLQLPDLYIDGLQSGECRSARKTGNFSCLEARFLMNFSCLEARFLMKRSIGYHLWQTYVPTAREXGGGGGGK

SEQ ID NO: 139349 - protein, 222 aa, Heterodera glycines
  misc_feature (51)..(51): Xaa can be any naturally occurring amino acid
  Coding regions on vcDNA: vcDNA=SeqID_65772; Strand=+; Position=1 -171,257-441,671-727,772-885,937-1023
  Homolog annotation: Hit_ID=CAE75317.1; Match level="QueryCoverage =88%, HitCoverage=30%, E-value=1e-45, Identity=51%"; Hit description =Hypothetical protein CBG23289 [Caenorhabditis briggsae]
GGGGTVREETKGIKFVFVQRLSKTRTGSVESLIATAFLSPLIASPHSLSVXLPLIACVLFSWISVWLPEEFVEGRVFVALTVFLTLSAESSSAKETLPKVSYVKAIDVWFGFTAVFVFTMLQALLVIGLEHMSGRARKTVVEQRKTVVEQAGELSAPKAIILMMDCRRYHRMARSLDDFFKVMYPVIFVVFLIVMYPVIFVVFLIIYIFVVIEGEEQKCLQQ

SEQ ID NO: 139350 - protein, 102 aa, Heterodera glycines
  Coding regions on vcDNA: vcDNA=SeqID_65773; Strand=+; Position=1 -96,222-278,332-484
MADEASEYTDEEYTYEYEAKWGGEIGGHGKGTDEEEPEANENAAPAPVEELPKDEPKKAGEDAAAKKKETSPPKSLKKEGSPPKSPKKEASPKKEASPDKSP

SEQ ID NO: 139351 - protein, 146 aa, Heterodera glycines
  Coding regions on vcDNA: vcDNA=SeqID_65774; Strand=+; Position=1 -164,222-274,343-564
  Homolog annotation: Hit_ID=CAE71947.1; Match level="QueryCoverage =100%, HitCoverage=61%, E-value=9e-57, Identity=55%"; Hit description= Hypothetical protein CBG19014 [Caenorhabditis briggsae]
MKSEGIIPIQAGTNKYASQRGMTGFGRPRDVVDKVKSENLAEITDEEKLASLKGSTWLQSGTNKFASQKGMTGIGTPRDVNYRTKGTGGAGEVPEDKARLTDGDMGKGGNGKERKPFKGIVPLQSGTNKLASQAGMTGMGMPRIID

SEQ ID NO: 139352 - protein, 64 aa, Heterodera glycines
  Coding regions on vcDNA: vcDNA=SeqID_65775; Strand=-; Position=1 -21,196-369
MAGFGNKACFDLFMPYGGHSLVARCKDCVKYSCEQKCVYSIEGCQRCIRGNCANIGMANSFGTF

SEQ ID NO: 139353 - protein, 16 aa, Heterodera glycines
  Coding regions on vcDNA: vcDNA=SeqID_65776; Strand=-; Position=1-49
EAIPEGFGLPINLGAS

SEQ ID NO: 139354 - protein, 95 aa, Heterodera glycines; identical to SEQ ID NO: 130684
  Coding regions on vcDNA: vcDNA=SeqID_65777; Strand=+; Position=1-656

SEQ ID NO: 139355 - protein, 130 aa, Heterodera glycines
  misc_feature (88)..(88): Xaa can be any naturally occurring amino acid
  misc_feature (105)..(105): Xaa can be any naturally occurring amino acid
  misc_feature (126)..(126): Xaa can be any naturally occurring amino acid
  Coding regions on vcDNA: vcDNA=SeqID_65778; Strand=-; Position=1 -249,300-401
  Homolog annotation: Hit_ID=AAC72366.2; Match level="QueryCoverage =73%, HitCoverage=8%, E-value=1e-28, Identity=72%"; Hit description =guanylyl cyclase [Heterodera glycines]
PSLPFQFGIPSHSGPAVGGVVGLTMPRYCLFGDSVNTASRMESNGKDKIVGDKTSIHISSSSNRFLTSVIEPSGEVIIKGKGVMETFXLLGRIGEVGKGVMETFXLLGRIGEVHLPKGTSVAEMRXLMGK

SEQ ID NO: 139356 - protein, 136 aa, Heterodera glycines
  Coding regions on vcDNA: vcDNA=SeqID_65779; Strand=+; Position=1-411
MVSSHLFCIGNFMVVFLVMFLVLSFLLSNHNNGGKPEINEQFLVRLISLSNQNNGGKPEIKLNSFWFGSFLLSNQNNCGKPEIKLNMVSSHLFSIGNFMVVFLVMFLVLSFLLSNHNNCGKPEIKLNSFWLGSFFV

SEQ ID NO: 139357 - protein, 421 aa, Heterodera glycines
  Coding regions on vcDNA: vcDNA=SeqID_65780; Strand=+; Position=1-1265
  Homolog annotation: Hit_ID=CAD22154.1; Match level="QueryCoverage =68%, HitCoverage=52%, E-value=3e-56, Identity=41%"; Hit description =pherophorin-dz1 protein [Volvox carteri f. nagariensis]
MSNSFFVFLPSNVTDYPDNQPNKFRVRLPKPLHFNGSWVCGLHSISYPYSWSTIGTLDEQWIDIHFTDIGVPEEDKHRIVRVPVPRSSHNRVEQLRDFLTTTLRNHANAKLKPLPREEEADRNRTKPLYSPPPAKRSIKDVNDLSLFPSPPRVDEPEKPPKSPPAHVPPTEPVTPPPASPPRVDEPEKPPKSPPAHVPPTEPVTPPPASPPRVDEPEELPLPLPAHVPPTKPITAPPDHKLESPPPTVKPSSSPPDTTLPSSTPVATQPPAPIPQPTPPKPSAPPPASTPPKPSAPPPTPTAPKPSAPPPAATPPKPASPPPPVPTPPKPASPPPPVSTPKTASPQKPPKTKLAPPPPPAQTQPSPVKTTPASKILTAKTIPRPPPPKQKTSPPEIPTRPSISPTLESPPRIDESNRTIVK

SEQ ID NO: 139358 - protein, 69 aa, Heterodera glycines
  Coding regions on vcDNA: vcDNA=SeqID_65781; Strand=-; Position=1-227
NDANFFGIHVYRYGKNENKCALNSDVSADRSILIQHHQRVALAHHHQHYSSSGHRLIKFDAHCCGPVPY

SEQ ID NO: 139359 - protein, 84 aa, Heterodera glycines
  Coding regions on vcDNA: vcDNA=SeqID_65782; Strand=-; Position=1 -12,46-124,371-534
  Homolog annotation: Hit_ID=NP_494578.1; Match level="QueryCoverage =83%, HitCoverage=15%, E-value=6e-26, Identity=81%"; Hit description =putative protein, with a coiled coil-4 domain (2D857) [Caenorhabditis elegans] gb|AAG24223.1| Hypothetica
MSERVGLHLPGICSEYVPSAIESFNASEFEGVEIEGPIGVNITALLAAGVNLTELAEKLRNDTEVDQILSRTQDINRSVVAQHN

SEQ ID NO: 139360 - protein, 126 aa, Heterodera glycines
  Coding regions on vcDNA: vcDNA=SeqID_65783; Strand=-; Position=1-381
MNKTVFLILFGFAIGQANSDCCCLSNEEKQQLNAARKTIEKAFRDTLRLNTEARDFAAASHRAITEAEKIKVRHPEAPSMKTWFGRLLEGVRKVQGISEKINEEKKKIGHIRKEMDKCLDRKDVLI

SEQ ID NO: 139361 - protein, 112 aa, Heterodera glycines
  misc_feature (32)..(32): Xaa can be any naturally occurring amino acid
  Coding regions on vcDNA: vcDNA=SeqID_65784; Strand=-; Position=1-338
KIRLKCQISTRKCRLRFAFHFCCSFSALSFGXRCFLPFKGLFRPLSVSSPFSPLRLPKGSPVSRSSSEVAKSVRFDPFLMAKKCRSFADAQSQIVANLFANYDPNQRPPVRG

SEQ ID NO: 139362 - protein, 33 aa, Heterodera glycines
  Coding regions on vcDNA: vcDNA=SeqID_65785; Strand=-; Position=1 -22,59-138
MPSTRQDAEIFENEMNRWRMEQKAWNLMIGQKR

SEQ ID NO: 139363 - protein, 63 aa, Heterodera glycines
  Coding regions on vcDNA: vcDNA=SeqID_65786; Strand=-; Position=1-190
MEVFKKRTIIGQNSARDSNADINGIDFTIIVVRPQPWANSHSRLYWPNYRFYSDQENVLKLRP

SEQ ID NO: 139364 - protein, 30 aa, Heterodera glycines
  Coding regions on vcDNA: vcDNA=SeqID_65787; Strand=+; Position=1-91
SYKFYEIFWHYKKIMAIFLSSSIFRAPGFL

SEQ ID NO: 139365 - protein, 137 aa, Heterodera glycines
  Coding regions on vcDNA: vcDNA=SeqID_65788; Strand=-; Position=1 -145,533-647,1203-1356
MWATTNAEEYYGVPLGSLRNGTLGISGNVWLANSSAIQITDFKLDKNQKHETLFAFASPDAKIEAVKSLYKVITDDNGEEALTPMSGKKKHLGAISETAEEPQQRLVVMAPAGKSINDFGQFGVVNGKTMVCLFGTN

SEQ ID NO: 139366 - protein, 80 aa, Heterodera glycines
  Coding regions on vcDNA: vcDNA=SeqID_65789; Strand=+; Position=1 -144,396-494
MDWICTDHFVCSVRVKRSLSALLIIHLSLCTFILSNTFCTSIIWAFFWCLPKAKYFVFQKGVLSSKYYITPLKPEKWANF

SEQ ID NO: 139367 - protein, 161 aa, Heterodera glycines
  Coding regions on vcDNA: vcDNA=SeqID_65790; Strand=-; Position=1 -210,493-768
  Homolog annotation: Hit_ID=NP_105679.1; Match level="QueryCoverage =97%, HitCoverage=31%, E-value=8e-47, Identity=56%"; Hit description =mannitol dehydrogenase [Mesorhizobium loti MAFF303099] dbj|BAB51465.1| mannitol dehydrogenase [Mesorhizob
TEEILPTVPPVPGIDLDDYCKQIQQRFGNPKNGDTIRRLCFDGTNRQPKFIVPTIEYCLKTGQSIDGLALVCALWCRYCYGTDQKGQAVEPNDPAWPQLQAIASRARDNDEPTVWLSMEHIYGSVGQSDAFRVVFAKTLRHLWQFGTESALKRYLGNKASQ

SEQ ID NO: 139368 - protein, 243 aa, Heterodera glycines
  Coding regions on vcDNA: vcDNA=SeqID_65791; Strand=-; Position=1-730
MSDKRGLLRQILGEAEITVTTSGLTISGPRLSTPRFLPFDESGRCRSCKATEVEVDTMVTKEGVTIWCTRIDKVQFVPFDVVYELPGHCFFRLKNKSRVFNLPYGDLPSESCEIPLIQHVDEERDLKRKAKAALELVEAGLIADSTVQDGARLKKAKTAMKVISDILLSEPVGDDQKKTVEVAVVDKQPQEQQPAPVQEKPVTAPAVEQNTVEVKTEEEKKDDLGDIDKTLDEFFASLKAATT

SEQ ID NO: 139369 - protein, 124 aa, Heterodera glycines
  Coding regions on vcDNA: vcDNA=SeqID_65792; Strand=+; Position=1 -174,219-419
MAQLKKARHEYLELVKVFMDELEEADLFEEQNVARVCIHEAGHTLILWFLRGSEKFLEICVVPDPNGDYDGYTASEPRAESTRSQIMAEIACYYGGKLAEELFCEKSIGHSDDMRQAKKLKKWR

SEQ ID NO: 139370 - protein, 918 aa, Heterodera glycines
  Coding regions on vcDNA: vcDNA=SeqID_65793; Strand=+; Position=1-2757
  Homolog annotation: Hit_ID=NP_494149.1; Match level="QueryCoverage =99%, HitCoverage=61%, E-value=1e-164, Identity=37%"; Hit description= predicted CDS, putative protein of ancient origin (2C297) [Caenorhabditis elegans] gb|AAF39854.1| Hypoth
MYPVENQGRGLPHIHLLLTLAEQDKLINGEDVEKKGISARIPDKELEPDMFDLVKRFMIHGPCGNLNPNCPCMEEFVDKNGMSGRKCSKGYPKAFQEETVVLENGLAGYARPNDGRIVEVFANGRRHVLDNRWVVPHNQYLLKMFKCHINLEKVNSVSSVKYLHKYVHKPPDRARRELEEKNDHDEVKEFIDARYVCPQEAVWRIFELPMYDRSHCIMSLPVHLQGEHICYFDENMEEEEIRERIANGSELMAYFELNKTNVLAKTLFYHQIPEKFCFKKGKWTERKTYFNTIGRMVKVSPAEPERYHLRLLLLNVKGACSYDDLKSVFDTNGNAKVCETFSAACLERGLIRNDEEWKRALEEAESFEMPWKLRAFFALILVHCNPAKPEALWNMFKDSLSEDFSRNFRKEVAYAKAYREIALSIMKAGKTLADFPTMEQINVDDDVEQVFDLAEELDLGQRNYALMYDEQRNVCDAILHRIWNPVNEPAFYFLSGPGGTGKTHVNKTIVHMLRGQKKKVCTMAFTGIAATLLPAGRTLHNRFGLTLDMSNSSISPRSKAWQELKETDLFVCDEAPMINKRAMSTLDEKLKEIMNNGIAFGGKVMLWTGDFRQTLPIQKHATRAEMVSSTIKRSAYWRLAKRYKLTKNMRALATEQEFARDLLEIGSGKWNNENDEIILPEDCISNGDLAEEIFGQCIVLENWNEMAKSAILAPKNIDVSEMNNKVLEMLPGEEVVYTSIDLAQDENRQRPDDYLDEYLNALNPSGFPRHKLRLKKNAIVLLMRNLNIEMGLCNGARMKVEQMQPNLIVCEILTGDKAGQTVYIPRITLCCSEDYPFDLHRHQFPLVLAFAMTINKAQGQTLEQVGIDLRKDVFSHGQLYVALSRARAWNKLRIRLDDGNLERKVKNVVYRELLDNSD

SEQ ID NO: 139371 - protein, 156 aa, Heterodera glycines
  Coding regions on vcDNA: vcDNA=SeqID_65794; Strand=+; Position=1 -205,373-638
MKIFVNDKEAWEDLIGFVSTDKQQIIDTKIIFEKIKNSPILSNENEQNLATMFVHLNAGTAIITKIIKSNSFTTATTTLMATNRRRKRMDNNNNNQNNNNGYNNVYEMLRQAQLIHGRRRVADNQPTRVDCVVVVIILVGCALLLDSLSQYVVFQF

SEQ ID NO: 139372 - protein, 107 aa, Heterodera glycines
  Coding regions on vcDNA: vcDNA=SeqID_65795; Strand=-; Position=1 -188,1031-1164
  Homolog annotation: Hit_ID=NP_491426.1; Match level="QueryCoverage =99%, HitCoverage=3%, E-value=5e-39, Identity=76%"; Hit description =chromodomain-helicase-DNA-binding protein   like (1F254) [Caenorhabditis elegans] gb|AAC17559.1| Hypotheti
SLLNFLEPEQFANSEAFLHQFGQCQTEEQVQKLQEILKPMMLRRLKEDVEKELQPKEETIIEVQLSNIQKKYYRAVLERNFTHLMKGSTPSLISLNNTMMQLRKCCK

SEQ ID NO: 139373 - protein, 62 aa, Heterodera glycines
  Coding regions on vcDNA: vcDNA=SeqID_65796; Strand=+; Position=1-191
GSIFSLDFHPSGCKLATAGQDPSGAGLLIVWDLGFLNCPPDSKEFNCSQLPLTRIPHTSCTL

SEQ ID NO: 139374 - protein, 92 aa, Heterodera glycines; identical to SEQ ID NO: 125147
  Coding regions on vcDNA: vcDNA=SeqID_65797; Strand=+; Position=1-304

SEQ ID NO: 139375 - protein, 250 aa, Heterodera glycines
  Coding regions on vcDNA: vcDNA=SeqID_65798; Strand=-; Position=1 -160,395-477,1595-1720,1767-1853,1931-2057,2142-2310
VFRVKRHYSNDSEESKNNDKKGHIVRRSLPTLFSNRVIPTRTVIGFSNLAYIEMLSDPREGFVFSVPDFLHVEVDFTVKRTDDIGIDPYRRALDLGFNSFNAFLHSEHMKKYIEIDSTGNVLSYHAILTPELLLTIDHIQRERQTFLSMKRIYPSRRTNGFNQSEEMGPLQFLKERMQKRELQAQMGGQTQEEETQSETVQEPSFVMNEGQYGIEEEFFEEIGENEQLGLDRIKWVQNDSDEEGEETLIF

SEQ ID NO: 139376 - protein, 176 aa, Heterodera glycines
  Coding regions on vcDNA: vcDNA=SeqID_65799; Strand=-; Position=1 -71,118-222,266-534,594-676
MGNEPQNQNISELIDKIKTLRQEIQKYSFMVLEVRRNEVLLKKKNENLVIQLQRSESARNDLLRSNELLEQKLATQSVETDELKRQINSLIESCATATSNCFRNSPFNSPIGRRQKPPLFSKQKVIVGLSPPTPLPKPIQKTTTLTQSALNASICFAIPGFVQLAAKNEFIVCSEP

SEQ ID NO: 139377 - protein, 133 aa, Heterodera glycines
  misc_feature (3)..(3): Xaa can be any naturally occurring amino acid
  Coding regions on vcDNA: vcDNA=SeqID_65800; Strand=+; Position=1 -122,193-336,398-490
  Homolog annotation: Hit_ID=NP_495793.1; Match level="QueryCoverage =81%, HitCoverage=24%, E-value=2e-22, Identity=48%"; Hit description =gamma Butyrobetaine Hydroxylase (gbh-2) [Caenorhabditis elegans] pir||T23737 hypothetical protein M05D6.7
LFXFSFLQIKIGINFQFLIRFNPYDRAPMRTLKIADDQSKDTVLFYTAYQRDTVLFYTAYQRFAQLANHSDNQVTLTLRPGTVLFIDNFRVMHGRKAFQGERGERVMCGCYLNRDVFLAKARPKLSPEFYRNV

SEQ ID NO: 139378 - protein, 237 aa, Heterodera glycines
  misc_feature (67)..(68): Xaa can be any naturally occurring amino acid
  misc_feature (71)..(71): Xaa can be any naturally occurring amino acid
  misc_feature (79)..(79): Xaa can be any naturally occurring amino acid
  misc_feature (91)..(91): Xaa can be any naturally occurring amino acid
  Coding regions on vcDNA: vcDNA=SeqID_65801; Strand=-; Position=1 -458,543-608,654-793
  Homolog annotation: Hit_ID=NP_506608.1; Match level="QueryCoverage =91%, HitCoverage=33%, E-value=5e-39, Identity=43%"; Hit description =g-protein-linked acetylcholine receptor, muscarinic (66.5 kD) (gar -3) [Caenorhabditis elegans] emb|CAC422
EREGGRERERERGGGEERGSRNTRRSDQFSRTANATERNDDVKTADEEERHPSVEGGTGEREGEGYXXTNXKNENVCIXSTTESRHRSVNXKIQFENGHCQRHFTSQMRRSEKERRRNERKQEGKAAKTLSAILFAFIITWTPYNVIVCLEAFYPNIVCLEAFYPNSVPSYLFTLSYFLSYVNSTINPLCYLSYVNSTINPLCYALCNARFRMTYLRIIKCKWRHSPIGRQMYAADG

SEQ ID NO: 139379 - protein, 20 aa, Heterodera glycines
  Coding regions on vcDNA: vcDNA=SeqID_65802; Strand=+; Position=1-65
TDQKRTKLCRDTERKRNNLF

SEQ ID NO: 139380 - protein, 53 aa, Heterodera glycines
  Coding regions on vcDNA: vcDNA=SeqID_65803; Strand=-; Position=1-167
FEYPKRTLEKIDFFVFGAVPPNRCAQIYGETESFGNSFPIASTLILRWIFAPP

SEQ ID NO: 139381 - protein, 59 aa, Heterodera glycines
  Coding regions on vcDNA: vcDNA=SeqID_65804; Strand=+; Position=1 -48,107-238
MLSEPNFLSPANLEALLMFRVNPQRYNERVKQCVKESNVALESDYRDIPNDGGGRRASI

SEQ ID NO: 139382 - protein, 108 aa, Heterodera glycines
  Coding regions on vcDNA: vcDNA=SeqID_65805; Strand=+; Position=1 -47,103-382
MSDRRREAEEKMAKAIFISADCWLSVFDLLSPRKLGLGVALISHRFDFYVDEHFKTRKWALKFIGIGSKIGKNGTKEMEITNYNRKALPIPQIQMPRKVTGFERIIIK

SEQ ID NO: 139383 - protein, 27 aa, Heterodera glycines
  Coding regions on vcDNA: vcDNA=SeqID_65806; Strand=+; Position=1 -24,87-146
MSRFSNNQAIENTYGYRMKYTLKIWLV

SEQ ID NO: 139384 - protein, 83 aa, Heterodera glycines
  Coding regions on vcDNA: vcDNA=SeqID_65807; Strand=-; Position=1 -12,756-995
MTEEQNEPLEILYTLTAVCVNSRRMWTGIKRCALLKLGYLKLQLGTEQGCDLSQKRREQEFGESCHTSGTEAIVFFELPIDKI

SEQ ID NO: 139385 - protein, 1181 aa, Heterodera glycines
  Coding regions on vcDNA: vcDNA=SeqID_65808; Strand=+; Position=1 -12,329-570,947-1044,1274-1657,1697-1854,1899-4098,4275-4379,4585-4931
  Homolog annotation: Hit_ID=NP_507780.1; Match level="QueryCoverage =75%, HitCoverage=56%, E-value=3e-86, Identity=27%"; Hit description =predicted CDS, DNA polymerase type B, organellar and viral family member (5T899) [Caenorhabditis elegans]
MNSMVLDNKIGEGEEVPNLNVIREDDPVNEFLGFLHYDQKLGHHIAKAYNETVFCAAKNQIPKRVVDQILQLTFSLAIRITLCVIIFPFQIIRIDAQTKKHFWDEIKANSAIEPQFIAMRKIIRIWIITYDFDVHRVKKVGNSFEHEVTFAAATVICTNCINNGEWKNSLEGKQCAICGPNRTITFSPFDYKETTVDQKIVTQQTLREFVQWLLFEQNKKYPTVAFAHFGGRYDMTMIIKEVIAQGVHDPQIIKQGNRLYELKIKDNEHAPLTIFHDSYNLMPIKLSGLIKSFGLKIQDKQHFPHMFNKSSNYENVLTNLPPREEYCPNQKKKTDLQKFNEWYNTNYDQHFDLKEKLPEYCCNDVKILTHALVELRREFKQLTQREGNHGGIDILWQAMTIASACVKNFALNHLRSNSLAIVPEKGYTPQQNQSALANKFLDWYSHINNVHVQTASSRYGEYMFKREGQVYQVDGYIKGTNGQRDKIIEVNGCLWHGCEECFDDMDEETRMPNGKTLGELRIREQRKHEILRRYVDLEVVWEHEINKQMKKDKEMREYFENWKDCSPIKIREAFHGGRTGPMKLIHTAKPGQKISYKDFTSLYPFTNFSTKYPLGHPKIISFTTNEQTVNWRSPTDNPYKGLLKVLLQPPDNNVKITVMPIKFDERLLFPLCEKCAKVISNKYPKGLKDDNYSCPHFNTNDRAFVSTCTHLELNASLEAGYTVRKLFHVLQYDQWSDNVFKSYVSEMMALKIHATGYPSWCNNEEEKRKYIDECWRKFGIKIEDNKMKADPGKRYIAKLCLNSLWGRFSMRNLLSKAIIDNDECLIRQYSDDKKIELIDVELMDEDNDVYMLTYKPKEEFVDENKYSNVVISLFTTSMARLYLYEALKKVADAPGCEILYYDTDSVIYVHPEDNDPLPTGKGHLGELTDEKPDHDILEFISAGCKNYGLKLRRKDNGEIEYDLKIRGFTLDEQTVQKIHYDSVKDQILRYGTEDPADPIIVTYPHFIRPNLIKGKVYTHSFTKQYQPIFTKGHPSEMKVDELLIIAMSSLVRECLDWGPKAKPDFLVSSKKALQSVVAKDPEIHSSEKTAHEKEAEKTVRKSKYEYNLLDHQRFFWKLARPKFAVMNFLCPTCRRINYKHKDQFKLMGEDEFHFTQVMCQGCVKYNMMQTDIYIKHTKNPH

SEQ ID NO: 139386 - protein, 544 aa, Heterodera glycines
  Coding regions on vcDNA: vcDNA=SeqID_65809; Strand=+; Position=1 -619,802-1817
  Homolog annotation: Hit_ID=NP_502797.1; Match level="QueryCoverage =64%, HitCoverage=95%, E-value=7e-48, Identity=32%"; Hit description =HASI (4P602) [Caenorhabditis elegans] emb|CAB16520.1| Hypothetical protein Y57G11C.19 [Caenorhabditis ele
MYKNLLKPDAGEINVDNAKNKLSSLLKQRKLDSGTKNLLYNQELRRFLKLRKEIEDKPVKVELTDGSLMVFNPRHREKDRKIPTQIVKEDDEEELDETGSIPTFEDPYATAEESDAEPTTTTTPKSRPLFRPLRIGTSKFRQKQKSFIDRKQQKIMSIINNDPEKFGVGSRGHILRADGTAYLKSNIKQALERILRRSPENAPSPIGQERLYEEAQKYDSSITRKDVEHFLEGDRTYTLHKPRRVRFKKSRTVPAGFMTDVQVDLADFQKLSRENNGFNYILLGIDVLSKRVFATPVKSKNFKHMREAFDKLISQMPMVPHRIFSDRGTEFENREIHKYFQEKNIQKHKAHTSTVKAALAERCIRTLKQRLYRYFSQSHTIKWVDVLPKIVNALNNSKSRITGMKPVDINPDNAQKIWKKVYGNEFSRKTYRRPRFKEGDHVRLAKYKSSFEKSYLPNYSDEIFQVYDIKKANPYRFGIKDDKEEPFDTRFYAEDLAKTRKDAETTYRIERVLKTRTRSGHKEHLVKFYGYKEPEWIKDNDIER

SEQ ID NO: 139387 - protein, 127 aa, Heterodera glycines
  Coding regions on vcDNA: vcDNA=SeqID_65810; Strand=+; Position=1-384
MTFQSLGLNPPAFQSLRLNSQAFQSLGLNSPAFQTMGLKSPAFQTLGLNPPAFQSLGLNSPAFQSRGLKSPAFQTLGLNPPTFNDIPISGTQSTSISISETQFSGIPNNGTQISRIPNTGTQPTNFQ

SEQ ID NO: 139388 - protein, 204 aa, Heterodera glycines
  Coding regions on vcDNA: vcDNA=SeqID_65811; Strand=+; Position=1-615
MQSPNLPPVKVFEDDLDENERKLREQINKLKEELEKTEEKKKVIEKRRMEQMKLARVDEVVLEDEEDEEEEEPTSKKSRLNPTATKEIVQKIINEELVANDLVMIDPRGINDRNGPEDVIESRRIEDGIRAKNRSVNEKAMREFVMTKTSLDHAKEIRTRAMNEVKYAEKPTDPSRLLRGEIRAAKWTFAKSKRRQFRLKGNDW

SEQ ID NO: 139389 - protein, 95 aa, Heterodera glycines; identical to SEQ ID NO: 128210
  Coding regions on vcDNA: vcDNA=SeqID_65812; Strand=+; Position=1-803

SEQ ID NO: 139390 - protein, 40 aa, Heterodera glycines
  Coding regions on vcDNA: vcDNA=SeqID_65813; Strand=-; Position=1-126
RPIWQVKQRLLTSQKVRCRDETNQHCLPRGTRHGPPKEWI

SEQ ID NO: 139391 - protein, 58 aa, Heterodera glycines
  Coding regions on vcDNA: vcDNA=SeqID_65814; Strand=-; Position=1 -57,404-523
MTAQRNIWAFTFCASLQRMELMDPSKGFYDKIEDKVTLAIDLTVGEEKGTKKRKLTDE

SEQ ID NO: 139392 - protein, 176 aa, Heterodera glycines
  Coding regions on vcDNA: vcDNA=SeqID_65815; Strand=-; Position=1 -338,379-571
MDALLSDLNQTLNRHKNNAEVAHFVQNLESILAENPTDPPVEYLDFDSENSSDSTSNSDNEELFVESPNRDPRQQKYPIETQRKIVQLLDEGTSYNQIKHLYRKIKSNNEIARIRKYVASGGSKPEKISVIDRHVFERFYEARSRNEAMHDIDLATLGLLKAREIGLQDFKVKKLT

SEQ ID NO: 139393 - protein, 23 aa, Heterodera glycines
  Coding regions on vcDNA: vcDNA=SeqID_65816; Strand=-; Position=1-70
FLKFYCLFASLGFFQKMFTNHLL

SEQ ID NO: 139394 - protein, 84 aa, Heterodera glycines
  Coding regions on vcDNA: vcDNA=SeqID_65817; Strand=+; Position=1 -28,648-855,969-987
MTNFCSVFQVWDCAWASDAHLFATCSRDKTLKVWRICAAVEHQQQQHDEELEEVKQIANFVGPAPQTAVDIAPRKIRDRLYENH

SEQ ID NO: 139395 - protein, 141 aa, Heterodera glycines
  Coding regions on vcDNA: vcDNA=SeqID_65818; Strand=-; Position=1 -143,192-261,488-576,702-825
MLPWDNNVLTFFKHAQALEEARAGGPMRRCGGNYKYAYYKCTNCEYRTRIQKIQGEEESGMFKKLECTNIESDQKTPRPTSLVCAKDWNAQPLRVWSRRLSAKKTLPEPGARCGGVGGIGSMHITNATSTTYTYYVCVING

SEQ ID NO: 139396 - protein, 62 aa, Heterodera glycines
  Coding regions on vcDNA: vcDNA=SeqID_65819; Strand=+; Position=1-187
MGFESDNQVHMYTFYEDSPSMGLIASTEIQPNNAKSQELADWVKGQIEGKFAAKIVHELELE

SEQ ID NO: 139397 - protein, 45 aa, Heterodera glycines
  Coding regions on vcDNA: vcDNA=SeqID_65820; Strand=-; Position=1-135
MHQSLAFKIIAILAGILALFGPIDCRATHGTCVHQGRQYREGEEW

SEQ ID NO: 139398 - protein, 106 aa, Heterodera glycines
  Coding regions on vcDNA: vcDNA=SeqID_65821; Strand=-; Position=1 -79,130-267,319-404,466-508
  Homolog annotation: Hit_ID=NP_000251.1; Match level="QueryCoverage =100%, HitCoverage=5%, E-value=4e-14, Identity=38%"; Hit description =myosin VIIA [Homo sapiens] gb|AAB03679.1| myosin VIIA sp|Q13402|MY7A_ HUMAN Myosin VIIa
MFVPIHLTDGRVISLPIDSQSTAFELCEMLCQQICLKDAFGFGLFLAVGRRFIRSLGVGSECVIDAIASLETKSEKNWRIFFKKELFRAHQSESDDPLAIELTFRQ

SEQ ID NO: 139399 - protein, 262 aa, Heterodera glycines
  Coding regions on vcDNA: vcDNA=SeqID_65822; Strand=+; Position=1-788
  Homolog annotation: Hit_ID=XP_471182.1; Match level="QueryCoverage =46%, HitCoverage=7%, E-value=2e-10, Identity=30%"; Hit description =OSJNBa0095H06.12 [Oryza sativa (japonica cultivar-group)] emb|CAE02205.2| OSJNBa0095H06.12 [Oryza sativa (
MEVDEHDDIMIIEPQTSGQAVDAILTQAQVAGENQADMLGLVSESCIPQEPIAQADDVIFVRPKTPPRRSLRVQKRLSASVSRSPSPAPKRPPPANSLGMATPITRRCSAFHKGWQCAAAAAKHFPEYCDSGKLGDKKCADCGAHLFSHEDSNICCRKGRVVLPMLNPHPDELKELIVGNKQSREGKEFVRHMSRYNNLFQFASVSAGNKPSPAGGPMAVILNGEFHRRISSMQAGNTQIPGFGQLYILDPSRGYGTTPKHP

SEQ ID NO: 139400 - protein, 102 aa, Heterodera glycines
  Coding regions on vcDNA: vcDNA=SeqID_65823; Strand=+; Position=1 -107,335-536
KERRVAKTSVGKRMVLKQRQMNGSENNNNAYQNREVEIMRSQKRNIAMPPIAEETSLVHRSEILQRLDHQMRKNPNFENRIKSMLRVWTDDMSSPAIGTSIL

SEQ ID NO: 139401 - protein, 46 aa, Heterodera glycines
  Coding regions on vcDNA: vcDNA=SeqID_65824; Strand=-; Position=1-141
FAQAVGGRAKSTADEAGRGGGVGEEVQGGQGEEPAADPAEAGPAKG

SEQ ID NO: 139402 - protein, 68 aa, Heterodera glycines
  Coding regions on vcDNA: vcDNA=SeqID_65825; Strand=-; Position=1-205
MVIRRGTMVMRRGTMVIRRGTMVIRRGTMVIRRGTMVMRRGTMVIRRGTMVIRRGTMVIRRGTMVIRR

SEQ ID NO: 139403 - protein, 207 aa, Heterodera glycines
  misc_feature (90)..(90): Xaa can be any naturally occurring amino acid
  misc_feature (200)..(200): Xaa can be any naturally occurring amino acid
  Coding regions on vcDNA: vcDNA=SeqID_65826; Strand=+; Position=1 -327,3435-3730
  Homolog annotation: Hit_ID=CAI02740.1; Match level="QueryCoverage =98%, HitCoverage=92%, E-value=4e-35, Identity=33%"; Hit description =hypothetical protein PB300893.00.0 [Plasmodium berghei]
HHCTSSNHHCTSSNHHCTSSNHHCTSSNHHCTSSHHHCTSSNHHCTSSNHHCTSSNHHCTSSHHHCTSSNHHCTSSNHRCTSSTRGKRLXRARTSLTKFKKRARSSRLTFNFCTSSNHCCTSSNHSCTSSNHSCTSSNHSCTSSNHSCTSSNHSCTSSNHCCTSSDHSCISSNQSCTSSIYFCTSFNHRCTSSDQCCTSXNHFCICS

SEQ ID NO: 139404 - protein, 101 aa, Heterodera glycines
  Coding regions on vcDNA: vcDNA=SeqID_65827; Strand=-; Position=1-307
  Homolog annotation: Hit_ID=XP_345184.1; Match level="QueryCoverage =91%, HitCoverage=38%, E-value=7e-09, Identity=39%"; Hit description =similar to CG14852-PA [Rattus norvegicus]
TDTKVILRGTTLVRRGTTVIKRGTKVNGRGTTLIRRDTTVIRRGTTVIRRGTTVIRRGTTVIRRGTTVIRRGTTVIRRGTTVIRRGTTVIRRGTKIECNLL

SEQ ID NO: 139405 - protein, 170 aa, Heterodera glycines
  Coding regions on vcDNA: vcDNA=SeqID_65828; Strand=-; Position=1 -133,195-319,402-653
  Homolog annotation: Hit_ID=NP_491087.1; Match level="QueryCoverage =99%, HitCoverage=43%, E-value=7e-63, Identity=70%"; Hit description =MAP kinase kinase or Erk Kinase, Dual specificity mitogen-activated protein kinase kinase, involved in ra
MDGLSLDIVLQSVGRVEEKWVGRIAVAVINGLTYLKEQFNILHRDVKPSNILVNSQGEIKLCDFGVSCMLIDSMANSFVGTRSYMAPERLTGARYSVQSDVWSFGLSLVELVIGRYPIPAPSRREYAKLFGVHPNDVKMEKNGTEEEQTADDLTPKTMAIFELLDYIVNR

SEQ ID NO: 139406 - protein, 133 aa, Heterodera glycines
  Coding regions on vcDNA: vcDNA=SeqID_65829; Strand=-; Position=1-399
  Homolog annotation: Hit_ID=E86336; Match level="QueryCoverage=100%, HitCoverage=33%, E-value=2e-24, Identity=52%"; Hit description =hypothetical protein F14O10.11 - Arabidopsis thaliana gb|AAF88160.1| Contains weak similarity to an unknown p
QKFEQNNNTEEEKEENGRGGEEGENGGRGEEANDGEENEEKEEEEDEQEESIVEEEEEEEEGEEDGREAFLEELEGTMDEEEEEEEEKEEEFVGEENEVEEKEEEEEEEFLDELEGERDEEEGALGGKKSRIL

SEQ ID NO: 139407 - protein, 127 aa, Heterodera glycines
  Coding regions on vcDNA: vcDNA=SeqID_65830; Strand=+; Position=1 -117,172-438
MPKIKSKSASFREWIRRIGGTDFYSTTGKIIYCQLCEQQIPCTQFAHLKQHNETVKHKAKLERNKGGQQQQFLTTPNNVPNQFNLDLCEAFVSANIPFQKLENEKFKFFLGNAPSLHTSKKLLAVDF

SEQ ID NO: 139408 - protein, 57 aa, Heterodera glycines
  Coding regions on vcDNA: vcDNA=SeqID_65831; Strand=-; Position=1-203
RKELKKRISALKFFHLDVTFRHWKSLFWGFVTKIVKNHYFGVLSLFFHYFDIFWKIL

SEQ ID NO: 139409 - protein, 36 aa, Heterodera glycines
  Coding regions on vcDNA: vcDNA=SeqID_65832; Strand=+; Position=1-108
MTKPDTLAERMNLLLSTGLGADVYFLVGEADAKEAN

SEQ ID NO: 139410 - protein, 68 aa, Heterodera glycines; identical to SEQ ID NO: 131735
  Coding regions on vcDNA: vcDNA=SeqID_65833; Strand=-; Position=1 -18,428-616

SEQ ID NO: 139411 - protein, 25 aa, Heterodera glycines
  Coding regions on vcDNA: vcDNA=SeqID_65834; Strand=+; Position=1-78
KRAPPSDIPIFPFHNWPKATVLIDT

SEQ ID NO: 139412 - protein, 347 aa, Heterodera glycines
  Coding regions on vcDNA: vcDNA=SeqID_65835; Strand=-; Position=1-1044
  Homolog annotation: Hit_ID=NP_912739.1; Match level="QueryCoverage =76%, HitCoverage=21%, E-value=9e-34, Identity=33%"; Hit description =unnamed protein product [Oryza sativa (japonica cultivar-group)]
MYNPQGIITLAQHKVEELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDT

SEQ ID NO: 139413 - protein, 85 aa, Heterodera glycines
  Coding regions on vcDNA: vcDNA=SeqID_65836; Strand=-; Position=1-257
SLRSVANIVLCHPTENVPAKAAPATRPRATHCQPGHSSENGTVQPTKTSSLISSKNGCAEAEEEQCLFVEHFGPIPQYSETDEKE

SEQ ID NO: 139414 - protein, 176 aa, Heterodera glycines
  Coding regions on vcDNA: vcDNA=SeqID_65837; Strand=-; Position=1 -237,299-409,466-532,865-946
  Homolog annotation: Hit_ID=CAE74217.1; Match level="QueryCoverage =91%, HitCoverage=41%, E-value=4e-48, Identity=62%"; Hit description =Hypothetical protein CBG21899 [Caenorhabditis briggsae]
PAANCAAAPTNRQTLAAALAHPPVGHSSRRRRRPVANMDNTLDGLVAKRAEQMPTPMKRRYQSETEAIELPDDEQETKRMETRMETDPDVCTRMCSVCGYQGKWVSEMIRHKRVHTAERPFKCKYCNPFKCKYCNRTSKWKADLIRHVAKTHGIRVVKYSRTKAFELGKTPTDADA

SEQ ID NO: 139415 - protein, 178 aa, Heterodera glycines
  Coding regions on vcDNA: vcDNA=SeqID_65838; Strand=+; Position=1 -137,183-582
MQKLVFPLVNLYKDNCLQLMHEKLKNQQLDTWAQLKNAILKEKEAREQKMKELMSQKTNKISTKRPKERVNKNIYKVLDVDQTLIVQGIDYHYFYRFDANAISCRHCPYRRPAQKNLKPTSTLKSHLKTHHLTVLEQYRRSNDILKEDSGKEQKEEGGGTIKTEAKQWESSIKTESLG

SEQ ID NO: 139416 - protein, 129 aa, Heterodera glycines
  Coding regions on vcDNA: vcDNA=SeqID_65839; Strand=-; Position=1-390
  Homolog annotation: Hit_ID=XP_479365.1; Match level="QueryCoverage =96%, HitCoverage=8%, E-value=9e-30, Identity=52%"; Hit description =helicase-like protein [Oryza sativa (japonica cultivar-group)] dbj|BAD32013.1| helicase-like protein [Oryz
MGLCNGARMKVEQMQPNLIVCKILTGDKAGQTVYIPRITLCCSEDYPFDLHRHQFPLVLAFAMTINKAQGQTLEQVGIDLRKDVFSHGQLYVALSRARAWNKLRIRLDDGNLERKVKNVVYRELLDNSD

SEQ ID NO: 139417 - protein, 18 aa, Heterodera glycines
  Coding regions on vcDNA: vcDNA=SeqID_65840; Strand=-; Position=1 -49,95-102
EAIPEGFGLPINLGASSV

SEQ ID NO: 139418 - protein, 139 aa, Heterodera glycines
  Coding regions on vcDNA: vcDNA=SeqID_65841; Strand=+; Position=1 -194,266-346,846-990
MALSLLVPMLAQCCGGTRMAAFTSGDNSPNEPPIRVYPCGAGPTGSRFRVVPAKFTGSHKISPTKVFLYEMIILRVRLGPLDPSLDRSMTFRAGPVPVMEEIAKVQPGSKNSKAVSPSIDEQLLLDQLVDSTDAKPLIR

SEQ ID NO: 139419 - protein, 104 aa, Heterodera glycines
  Coding regions on vcDNA: vcDNA=SeqID_65842; Strand=+; Position=1 -37,90-167,797-944,1201-1238
  Homolog annotation: Hit_ID=NP_508084.1; Match level="QueryCoverage =97%, HitCoverage=43%, E-value=3e-28, Identity=55%"; Hit description =putative protein family member (XA917) [Caenorhabditis elegans]
QYETDELIARNLLLQALLQAVKSKKCDLKHMGTILYCASQNQDNRKCCSHLNLSDAKLGVGERCLRFCDPGGEAGISSIARSDVTCLFNWNVLMYCHHSGIKMV

SEQ ID NO: 139420 - protein, 213 aa, Heterodera glycines
  Coding regions on vcDNA: vcDNA=SeqID_65843; Strand=-; Position=1-643
VDKSLHQSLSFQIQSQLRNPRKMRLFSICLLLLPLLLLLLLPPPFANAFEEEEEEDNEMRAQGQLSDEVIVANANDDGGPNSEQDEEQNQMRAQRPTPLPWQPTQWPTKPPQYPPGRPWPGSSNGKGWGNKPWYGNGNYGKGGGGGGRPNHRSGAIMLQPATPRWRTPPPFFPTRPTRWTKFPTYRPRPRPTRRPLMPNFVPQNVIPGMPSSY

SEQ ID NO: 139421 - protein, 205 aa, Heterodera glycines
  misc_feature (43)..(43): Xaa can be any naturally occurring amino acid
  misc_feature (203)..(203): Xaa can be any naturally occurring amino acid
  Coding regions on vcDNA: vcDNA=SeqID_65844; Strand=-; Position=1 -315,623-925
  Homolog annotation: Hit_ID=CAE62158.1; Match level="QueryCoverage =81%, HitCoverage=34%, E-value=4e-26, Identity=33%"; Hit description =Hypothetical protein CBG06205 [Caenorhabditis briggsae]
FLGLFFNSKNPNIKFLLFVKIRINFFQFLGARADERLLGKASXNVPVGPAPPNPLFSTVNQFMLQWTRRLRDRGTPISDYELEIRERGTKLMAGHTNQGGGKHEVIGVKRQHIYEFRVAAVNAAGQGEWSKNSVPIAATPSSCKPLITKGLFACDMTVLVGEQAKLLVPYAAKPWPKFVWSKNGEAMDVCADPRAEEKISGKXTR

SEQ ID NO: 139422 - protein, 109 aa, Heterodera glycines
  Coding regions on vcDNA: vcDNA=SeqID_65845; Strand=-; Position=1 -78,171-422
  Homolog annotation: Hit_ID=AAK73510.1; Match level="QueryCoverage =88%, HitCoverage=26%, E-value=1e-11, Identity=40%"; Hit description =AmphDII [Streptomyces nodosus]
MSKQISSAGTWPKQLAAKLCAIYDFPVAVPCCNGFTSLVLALRSANIGPGADVLMPSITFVAVSNAVLNVGANPVFVDSADEWDYNPSWSLLLRAATQKTRHEKILETF

SEQ ID NO: 139423 - protein, 145 aa, Heterodera glycines
  Coding regions on vcDNA: vcDNA=SeqID_65846; Strand=-; Position=1 -256,1402-1583
MSELCHLPNRYRKIYRNCAVSCTSVGTRSSVRQHATKPFDASCSCAPLSAVGFSLRLGTVEAVVVPNGSSTVCWKGLDTTAMSRQNSMPRELHVDELPVDELHVDELHVDELPVDELHVDELHVDELHVDELHVDELPVDELPME

SEQ ID NO: 139424 - protein, 147 aa, Heterodera glycines
  Coding regions on vcDNA: vcDNA=SeqID_65847; Strand=-; Position=1 -287,344-500
MAPSDRPTNNSVSDKQASAVIDWELFSANAILDGSESITKSSNLSNMYKPVPSENSKVTIASAFGLPGAPSVSKCHADFLYFFPNEIVQHHELAATTITSVVAPVVLLCTVGVVVAIGVVVIGVGICAVTVVSLVPTSAMPNWNCWC

SEQ ID NO: 139425 - protein, 47 aa, Heterodera glycines
  Coding regions on vcDNA: vcDNA=SeqID_65848; Strand=-; Position=1 -48,140-235
MKFGEFVNVKTVAFSQYSFFKILLSTVISETTICVIGTPSAALIRST

SEQ ID NO: 139426 - protein, 182 aa, Heterodera glycines
  Coding regions on vcDNA: vcDNA=SeqID_65849; Strand=+; Position=1 -73,165-319,384-517,646-742,804-891
MFFVRFGPRGAQEKNRLLPKNPIPSSNNVNPSNDHHQQQFINNTISPQNVEHIVHVERIKAADGVPITQIVVSEITERIYAVRDKLGIMRCHFYTCENATVLTLTNSPNFIYRLAEDAWNGFLYYATTAGDVFTTPMLPLDASQNYSLSITRRLAELPAVNSLEVDLAEQKLITVSRTGQLI

SEQ ID NO: 139427 - protein, 27 aa, Heterodera glycines
  Coding regions on vcDNA: vcDNA=SeqID_65850; Strand=+; Position=1-118
TQTQGGIELETPFLVTNSQTTKTKKPT

SEQ ID NO: 139428 - protein, 194 aa, Heterodera glycines
  Coding regions on vcDNA: vcDNA=SeqID_65851; Strand=+; Position=1 -89,138-198,261-413,466-615,688-787,836-869
  Homolog annotation: Hit_ID=XP_420618.1; Match level="QueryCoverage =95%, HitCoverage=31%, E-value=2e-19, Identity=32%"; Hit description =PREDICTED: similar to Hypothetical protein KIAA1223 [Gallus gallus]
TLLVESGANVNLGDSEGVTPIMITSRFGRVEPVHFLLSHGANVEQMDYSGMRFALLDAAADGHLEVCRLLVDDWAADVNQQAIDGTTPLMGACSFGHFEITVFLIEHGADIDHADMDGYNALMWAVKYEKAGVARHLLAIGANADQVGIDGKRAIDLAQEGRRAEMIDLFRTTANNEQREDGNAQQDEQPPQQQ

SEQ ID NO: 139429 - protein, 265 aa, Heterodera glycines
  Coding regions on vcDNA: vcDNA=SeqID_65852; Strand=-; Position=1 -194,247-445,495-602,648-746,791-872
  Homolog annotation: Hit_ID=NP_497647.1; Match level="QueryCoverage =88%, HitCoverage=57%, E-value=1e-43, Identity=43%"; Hit description =predicted CDS, n-acylsphingosine amidohydrolase precursor (3E58) [Caenorhabditis elegans] gb|AAK39622.1|
DLDGQILHGRNLDYGWTQLLKSHHIVVDYVRDGRVQFTGIQFILYSGLLTGQRPHAFTLSLNARYSGGPWDNLLMSGGPWDNLLMALITRFRHPIAFELRKVLETVDNYQEAVDKLSRITTVAPSYLIVGGKGDGAIISRDRFGVADRFGVADVFFLDYLHHRWFLVETNSDPWERMTDKRRTKAAQCLRRVGQRFITKAAQCLRRVGQRFISPIALSSRVLAIPPVRNEQTIFTTVMQTIFTTVMSAEQPNLIYNFTKVWPNAE

SEQ ID NO: 139430 - protein, 127 aa, Heterodera glycines
  Coding regions on vcDNA: vcDNA=SeqID_65853; Strand=+; Position=1 -264,619-739
NLKQNELCTFQAFTCDNNNSRCRRVTKRRKAKGRNGRGINGRGKRTERQRHQQQQQRRSTDQTDQKPHPTRCHVRQHWLVHLAHSTAVQKERVDDRGRAVCRTVHQLLLPVSAALVVARAQMPRLFG

SEQ ID NO: 139431 - protein, 94 aa, Heterodera glycines
  Coding regions on vcDNA: vcDNA=SeqID_65854; Strand=+; Position=1-600
FEYPKRTLEKIDFFVFGAVPPSRCAQIYGETESFRNSFPIACTLILRWIFAPHNCLSTPNGHLKKSIFLFSGQSPRTDAPRFMGRPNPSGVASL

SEQ ID NO: 139432 - protein, 84 aa, Heterodera glycines
  Coding regions on vcDNA: vcDNA=SeqID_65855; Strand=+; Position=1 -53,187-262,454-579
MMADFRRRTEAEEEAILRCVVKEQKDGQSGDQQQLDEQQLRQKGANVDYMEMGGEEEDGLSNGGGRKMLKMESSSPVNNSKACG

SEQ ID NO: 139433 - protein, 16 aa, Heterodera glycines
  Coding regions on vcDNA: vcDNA=SeqID_65856; Strand=-; Position=1-49
EAIPEGFGLPINLGAS
